United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 94

SEQ ID NO: 184136 - DNA, 1458 bp, Artificial Sequence
  Description of Artificial Sequence: Synthetic coding sequence
atggcccggctgaccgagagcgaggcccggcggcagcagcagcagctgttgcaaccccggccgagtcccgttggctcatctggtccagagcctcccggtggccaacctgacggaatgaaagatctcgacgccataaaactgtttgtgggacagatcccccgccatctcgatgagaaagatctaaaaccactgtttgaacagtttggcagaatttacgaactcacggttcttaaagatccatacacaggcatgcacaaggggtgcgctttcctgacatactgcgctcgggactcagctattaaggcccagaccgctctgcatgagcagaagaccctccccggcatggcccgtcctattcaggtgaagccagccgactctgagagtaggggcggcagggatcgcaagctgttcgtggggatgctcaataagcaacagtccgaagaagacgtgttgcgcctattccaaccctttggggttattgacgaatgcacggttctccggggaccagacgggagctccaagggctgcgcctttgttaagtttagcagccataccgaggcacaggccgccatccatgcactgcacggctctcaaacaatgccaggcgctagtagtagtctcgtggtaaagttcgctgacacagataaagaaagaaccctgagacgaatgcagcagatggttggacaactgggtattcttacgccatcactgacactgcccttctcaccttactctgcctatgcccaagccctcatgcagcagcagacaactgtgctcagcactagcgggtcctatctgtcccctggcgtggccttcagcccatgtcacatccagcagattggagcagtcagcctgaatgggctgcctgcaacgccaattgcccctgccagcggcctgcactcaccaccgctgttgggcacaaccgctgtgcctgggcttgttgctcccatcaccaacggattcgcaggcgttgtccctttcccaggcggtcaccctgctttagagactgtctatgcgaatggcctagttccttatcccgcacagtcccccacagtagcagagaccctacacccggcgtttagcggcgtgcagcaatacactgccatgtatccgacagcagcaattacacccatcgcacattccgtcccacagccaccccccctgctccagcagcaacagcgcgaggggcccgagggttgcaacttgtttatatatcatctgccccaggagttcggggacaccgaattgactcaaatgttcctgccatttggtaacatcatctcttctaaagttttcatggatcgggccaccaatcagagcaaatgtttcggcttcgtcagctttgataatcctgcttctgcacaggcagccatacaggcaatgaacggatttcagattgggatgaaaaggctcaaggtgcaactgaagaggcccaaggatccggggcatccctactag

SEQ ID NO: 184137 - DNA, 963 bp, Artificial Sequence
  Description of Artificial Sequence: Synthetic coding sequence
atggcccggcccatccaggtgaagcccgccgacagcgagagccggggaggcagagacaggaaactctttgtaggcatgcttaacaagcagcaatcggaagaggatgtactgcggttattccagccgttcggggtgattgacgagtgcacagtcctcagaggtcccgacgggtctagcaagggatgtgcatttgtaaaattttcaagccacacggaggctcaggccgccatccacgctctgcatggcagccaaacaatgccaggcgcctccagttctctcgtcgtgaaattcgcggacactgacaaggaaagaacattgcggagaatgcaacaaatggttggacagctgggcatcctgaccccctccctcactctgccctttagcccgtactccgcctacgcgcaggctcttatgcaacagcaaactaccgttctgtcaacatctggctcgtatctgtcaccgggcgtggcattcagcccctgccatattcagcagatcggtgcagtgagtctgaatggcctgccggctacacccatcgccccagcgtctgggttgcactcaccaccactcctcgggaccaccgctgtgcccgggctggtggcaccaataacgaacggcttcgcaggcgtggtgccctttcccggaggtcacccagctctggagacagtctacgcgaacggtctggtgccctatcctgcgcagtcccccactgtggccgagactctccatccggcgttctcgggggttcagcaatataccgctatgtatcccactgctgcaattacacccattgcccattctgtaccgcagcccccacctctcctgcagcagcagcagagggaaggagtttggaggcatggagccgacgccgatgtgcctaccttacggcaataccatttcctgcagggggtgtacgggtcatcgtatcaacctgaacaggtgtttcgtttgagggaactctag

SEQ ID NO: 184138 - DNA, 1230 bp, Artificial Sequence
  Description of Artificial Sequence: Synthetic coding sequence
atggcccggctgaccgagagcgaggcccggcggcagcagcagcagttgctgcagccacgcccatctcccgtgggttctagtggccccgagcccccaggcggtcaaccagacggcatgaaggacctagatgcaatcaagctgttcgtgggacagatccctcgacatcttgacgagaaggatctgaagccacttttcgaacagttcgggaggatatacgagctaactgtgttgaaggatccttatactggcatgcataagggctgtgcattcctgacatattgtgcccgcgattccgcaatcaaggctcaaaccgcactacacgagcaaaagacgctgcctggaatggcccgcccgattcaagtgaaacccgcagatagcgagagccgcggcggacgagacagaaaactcttcgtcggtatgctcaacaaacagcaaagcgaagaggacgtgcttaggttgttccagcctttcggggtgattgacgagtgcacagtcctccgtggacccgatggctcatccaaggggtgcgcctttgtcaagttttctagtcacacggaggcgcaggcagctatacatgccctccacggcagtcagacgatgcccggcgcttcctcttctctcgtagtgaagtttgctgatacagataaagagcggaccctacggagaatgcagcagatggttggacagctcggcatactaaccccaagcctgaccctgccatttagcccctatagcgcctatgcccaggccctgatgcagcagcaaaccaccgtgctgagcaccagcggatcctatctgtcaccaggggtagctttctccccttgccatatccaacagattggagccgtcagcttgaacggtcttccagctacccccattgcccctgcctccggtgtggtgccttttcccgggggacatccagctctcgagactgtgtacgctaacgggctggtgccttacccagctcaatctccgacggtggctgagacactgcatcccgccttctccggcgttcaacaatacaccgcgatgtatcctacagcagcgatcacgcctattgcccactccgtgccccagccacctccattactgcagcagcagcaacgcgaaggagtgtggagacacggagcagacgctgacgtcccaactcttcgacagtaccacttcctgcagggcgtgtatgggtctagttatcagcccgaacaagtttttcggctgagagagctttag

SEQ ID NO: 184139 - DNA, 1446 bp, Artificial Sequence
  Description of Artificial Sequence: Synthetic coding sequence
atggccgccgcccccggcggcagcgcccagcccgccggccccggcccccgcctcgggtttagtacggccgattccggggtgggaatgtccggtctcaatccaggtcccgcagttcctatgaaggaccatgatgccatcaaactttttgtcggtcaaatccctagaggcctcgacgagcaggaccttaaacccctctttgaagagttcgggcgtatctatgaactgaccgtcctgaaggaccggctcaccgggctacataaggggtgcgcattccttacatactgcgccagggatagcgctttgaaagctcagagtgccctccacgagcaaaaaacccttccaggcatgaatcggccaattcaagtgaaacctgctgcctctgaaggccggggcgaagaccgcaagctgttcgtaggcatgttgggaaagcagcagggtgaggaagacgtccgacggctcttccagccattcggacacatagaagagtgcacggtcctccgatctcccgatggtacctcgaagggctgtgcgtttgtcaagttcggaagccagggcgaagctcaagccgcgatcagggggctgcatggttccaggacaatggctggcgcaagtagctcgctagtggtaaagcttgctgatactgacagagaaagggcccttaggaggatgcaacagatggcagggcacttgggggcgtttcaccctgcccctcttcctctgggggcgtgcggcgcctacacaactgctattctgcagcaccaggcagcacttcttgcagccgcccagggccccggcctggggcccgtggccgctgtagcagcgcagatgcagcacgttgcagcattttcactcgtagccgcacccttactccccgccgcggccgccaatagtcctccagggagtggtccaggcacgttgccagggttgcccgccccaattggtgttaacggctttggccctctcacgccccagactaacggccaaccaggctctgacaccctctataacaacggtctctccccttacccggcacaaagtccaggtgtggccgaccccctacagcaggcctacgcaggaatgcatcattatgccgcggcgtatcctagtgcttacgcacctgtgtccaccgccttcccacagcagccctccgccctgcctcagcagcagcgcgagggaccagagggctgtaacctgttcatctaccatctgccgcaggagtttggtgacgcagagttgatccagacattcctcccattcggagcagtggtgagtgctaaggtctttgtggacagggcgaccaaccagtctaaatgctttgggtttgtgtccttcgacaatcctacgagtgcgcagaccgccattcaggcaatgaacggtttccaaatcgggatgaaaaggctgaaggtgcaactgaaacgtccaaaggatgctaatagaccttactag

SEQ ID NO: 184140 - DNA, 1107 bp, Artificial Sequence
  Description of Artificial Sequence: Synthetic coding sequence
atgatcagcgacccccccagcaacaacagctggaacagcgtgctgtacctcctggaagataggaagctcttcgtggggatgctggggaaacagcagggtgaggaggacgtacggagactattccagccctttggacatatagaggagtgcactgttcttagatcaccagacggtacttccaaaggctgcgcctttgtaaagtttggaagccagggcgaggcccaagctgccataagaggcctccatggcagcaggaccatggccggagccagctcatcattggtcgtgaaactcgccgacactgacagggaacgggccctaaggaggatgcagcagatggccggccatctgggagccttccacccagcacctttgccactgggggcctgtggagcttacaccacagccatcctccaacatcaggccgctcttctagcggctgcacagggacctggactcggaccagtagcagccgtggctgcccagatgcaacacgtcgcggcattttccctggtcgcagcccccttactcccggctgccgccgccaactctccgcccggtagtggccctgggacactacccgggctccctgctcctataggggtcaacggctttggacctctcactccgcaaacgaacgggcagccggggtccgataccttatacaacaatggactgagtccttaccctgcacaaagtccaggagtggcggatccgctgcagcaggcttacgcagggatgcaccactacgccgctgcatacccaagtgcctacgcccctgtgtctacagcctttccccagcaaccgtccgcacttcctcaacagcaacgggaaggcccagagggctgtaacttgttcatctaccacctaccacaggaattcggggacgcagagctgatccagacttttctcccattcggggcagtagtaagtgccaaggtattcgtggacagggcaactaaccagtctaaatgctttggcttcgtcagcttcgacaaccccacaagcgcacaaaccgcaatacaggccatgaatggttttcagattgggatgaaacgactgaaagttcagctgaaacgccccaaggacgccaacagaccatactag

SEQ ID NO: 184141 - DNA, 1365 bp, Artificial Sequence
  Description of Artificial Sequence: Synthetic coding sequence
atggccgccgcccccggcggcagcgcccagcccgccggccccggcccgcgcctgggtttctccaccgcggattccggggtggggatgtcaggcctgaatcccgggcctgcagtgccaatgaaagatcacgacgccatcaagttattcgtggggcagattccacgcgggctggatgaacaggatctgaagccacttttcgaggaattcggacggatctacgaactcaccgtgttgaaggaccggttaaccggactccataagggctgtgcttttctcacctattgcgcacgcgattcagcgctgaaagctcagtcagccctgcatgagcagaagacccttcctggcatgaataggcctatccaggtgaagccggccgcatctgaggggaggggtgaggataggaagctcttcgtcgggatgcttggcaagcagcagggcgaggaagatgtgcgcagactttttcagcctttcggacacatcgaagaatgtactgtgctgcggagccccgatggcacatcaaaaggctgcgcattcgtcaaatttggatcccagggagaggcccaagctgccataaggggactgcacggaagcagaaccatggccggagcctcctcatctctggtggtcaaacttgcagatactgaccgagagcgggccctccgtagaatgcagcagatggccggccatttgggcgcttttcacccagcccctctgccattaggtgcatgtggtgcctacacgaccgctatccttcagcaccaagcagcattgctagctgctgcccagggtcctggattgggccctgtcgcagcagtcgcggcccagatgcagcacgtggcagcattttccttggttgccgcgcccctgctgcctgcggcagctgcaaattcccctccagggtcgggcccgggaacactgcccgggctgcctgctcccattggcgtaaacgggtttggccccctgaccccacagaccaacggccaacccggctctgatacattgtataacaacggcttgagtccatatcccgcgcaaagccccggggtcgccgatcccctacaacaggcttacgccggcatgcaccattacgcaggccccgagggctgcaatctgttcatctaccatctgccgcaggaattcggggacgccgagttaatccagacatttctcccttttggggctgtcgtgtcagcaaaggtgtttgtggacagggcgacaaaccaatctaagtgcttcggttttgtttccttcgataacccaacaagcgcccagactgccattcaagcaatgaatgggtttcagatcggcatgaaaaggctgaaagttcagctcaagcgaccgaaagatgctaatcgtccctattag

SEQ ID NO: 184142 - DNA, 1029 bp, Artificial Sequence
  Description of Artificial Sequence: Synthetic coding sequence
atgctgggcaagcagcagggcgaggaggacgtgcggcggctgttccagccattcggtcacatcgaggagtgcacagtcttgaggagtcctgatgggacctctaaggggtgcgcattcgtgaagttcggaagccagggtgaggctcaggccgccattcgaggattacacggtagcagaaccatggccggtgcctctagcagtttggtggttaagctggccgataccgaccgcgagagagcccttcggcgaatgcagcagatggctggccacctgggcgctttccatccagctcctcttcccctcggggcttgtggcgcctacacgactgcgatcttgcagcaccaagctgccctattggctgcggctcaggggcccggactcggtccagtggccgccgtggccgcccaaatgcagcatgtggctgcattttcactagtggccgcgcccctgctccctgctgccgccgcgaattccccaccgggttccggcccggggactttaccagggcttccagccccaatcggtgtgaatggctttgggcccctgacaccgcagactaatgggcagccgggcagcgacactctgtacaataatggcctcagcccctaccccgctcaaagcccaggtgttgctgatcccctgcaacaggcctacgccggtatgcaccactacgccgccgcttatccatctgcatacgcccccgtgtcaactgccttccctcagcagccctccgctttaccccagcagcagagagaggggccagagggctgtaacctttttatctaccatttaccccaggagttcggcgacgcggaactgattcagacatttctaccttttggagcagtggtctccgctaaggttttcgtggaccgcgcgacaaaccagtctaaatgttttggcttcgtctcctttgataaccccacatctgcccaaacagcgatccaggcgatgaacggattccagattgggatgaagaggttgaaggtgcagcttaagcgtcctaaagacgccaatcggccatactag

SEQ ID NO: 184143 - DNA, 1035 bp, Artificial Sequence
  Description of Artificial Sequence: Synthetic coding sequence
atgaaccggcccatccaggtgaagcccgccgccagcgagggccggggagaagatcggaaactgtttgtagggatgcttggcaagcagcaaggcgaggaagacgtgagacggctgtttcagcctttcggacatattgaggaatgcacagttctacggagccctgacggaacatctaaagggtgcgcttttgtaaaatttggctcccagggcgaagcccaggcggctatcagaggccttcacggctctcgcaccatggccggagcttcatccagtctggtcgtgaagctggcagacactgatagagaacgggccctgcgacgcatgcagcagatggccgggcacctcggggccttccatcccgcacctcttccactgggggcatgtggtgcctatacaacagcgatactgcagcatcaggcggcgctcctggccgcagcccaaggccccgggcttgggcccgtagcagcggtggccgctcagatgcagcatgttgctgctttttccctcgtcgcggcgcctcttcttcctgctgcagctaattcgcctccaggcagcggtccaggtacacttcccggactgcctgcacctattggcgtgaacgggtttggccctctgacaccccaaaccaatggccaacccgggagtgacaccttatacaataatggattatcaccatatcccgctgcatatcctagcgcttatgcccctgtgtctaccgcattccctcaacagcctagcgctctcccacagcagcagcgtgaaggtcctgaagggtgcaacctgttcatataccacctcccccaggagttcggggacgccgagctgatccaaacatttttgcctttcggcgcagtggtgagtgctaaggtcttcgtcgacagggctaccaaccagagcaagtgctttggctttgtgtccttcgataatcccacctctgctcagaccgcaattcaggcgatgaatggcttccagatcgggatgaaaagattgaaggtacagctaaagagaccgaaagacgccaatagaccctattag

SEQ ID NO: 184144 - DNA, 1980 bp, Artificial Sequence
  Description of Artificial Sequence: Synthetic coding sequence
atgctgtacaagcagctgcggcaggcctgcgaggaccacgtgcaggcacagatcctgccttttcgggaggactcccttgactctgttctgtttcttaaaaagattaatacatgctggcaggatcactgccgacagatgatcatgatccgtagtatctttctatttctcgatagaacctatgtccttcagaatagcactctgccgagtatttgggacatggggcttgaattgtttcgtacccatattatcagtgataaaatggtgcagtccaaaaccatcgacggtatcctgctgctcatcgagcgggaaagatcgggcgaagccgtggacaggagtctccttcggtcacttctgggcatgttgagcgatctacaagtgtacaaggattcttttgaactgaagtttctcgaggagacaaactgcctttacgccgccgagggtcagcggctgatgcaggaacgtgaagttcccgaatatctgaatcacgtgtctaagagactggaagaagagggggacagagtgattacgtacctagaccattcaacgcaaaagccgctgattgcctgcgtggaaaaacagctgttaggggagcatctcaccgcaatactgcaaaaaggactggaccacctccttgatgagaatagggtgccagacctggcgcagatgtatcagctcttcagcagagttcggggtggacagcaggctttacttcagcactggtccgagtacataaagacttttggtaccgcgatcgtgatcaatccagaaaaggataaggacatggtgcaggacctgctcgatttcaaagataaggtcgatcatgtcatagaagtctgctttcaaaaaaacgaacgattcgtaaatttgatgaaagagagcttcgaaactttcattaacaaaaggcccaacaaacccgccgaactcatcgccaagcacgtggactccaagctgcgcgctggtaacaaagaggctaccgacgaggagctcgagcggactctggataagattatgatcctctttcgcttcatccacggtaaggatgtattcgaggccttttacaagaaggacttggccaaacgactgctcgtgggcaaaagtgctagcgttgatgccgagaaaagtatgctgtccaaactaaagcatgagtgtggcgcagccttcacgtcaaagttggaagggatgttcaaagacatggagctctccaaagacattatggtgcacttcaaacagcatatgcagaaccagagtgatagtgggcccatcgacctaaccgttaatatcctgaccatgggctattggccaacatacacccccatggaggtgcacctgacccctgaaatgattaaactgcaggaggtttttaaagcgttttatctgggcaagcactcgggcagaaaactgcagtggcagaccacccttggtcacgctgttctgaaagccgaatttaaggaaggtaagaaggaattccaggtttccctctttcagacacttgtcctgttgatgttcaacgagggggacggattctcttttgaggagatcaagatggctacagggatcgaggattccgaactgaggcgtaccctgcagtcccttgcttgtgggaaggcgagggtacttatcaagtccccaaaaggcaaggaggtagaggacggggacaaatttatttttaatggtgaatttaaacataaactctttcgcatcaagatcaatcaaatccaaatgaaagagactgtggaggagcaggtgtccacaaccgaacgcgtgttccaagaccggcagtaccagatcgatgccgcgattgtgaggataatgaagatgcgcaagaccctcggccacaatttgctggtatctgaactgtataatcaacttaagtttccagtgaagccaggcgatctcaagaaacgcattgagtctttaattgacagggactatatggaacgtgacaaagacaatcccaatcagtaccactacgtggcttag

SEQ ID NO: 184145 - DNA, 2280 bp, Artificial Sequence
  Description of Artificial Sequence: Synthetic coding sequence
atggccgacgaggccccccggaagggcagcttcagcgccctggtgggacgaacgaatggcctgaccaagcctgccgccttggctgccgcacctgctaagccaggcggcgcaggcggttccaaaaagctggtgatcaaaaattttcgggatcgcccgcgtctgcccgataactacacgcaggacacctggcgcaagttgcacgaggccgtgagagcagtacagtcctccacgtctatccgctacaatttagaggaattgtatcaagccgtcgagaacctgtgtagccacaaagtgtccccgatgctgtataagcagctgcgccaggcttgtgaggaccatgttcaagcccagatcctccctttccgagaagatagcctggactctgtgctcttcctcaaaaagatcaatacctgttggcaggaccattgccgccagatgatcatgattcgatctatcttcttatttctcgatcgtacatacgtgttacagaacagcacactgccatccatttgggacatgggcctggaactcttccgtacgcacatcatctcagataagatggtccagagcaaaactatcgatgggatcttgttgctgatcgagcgtgagcggtcaggcgaagcagtggatagatctctgctcaggtcactgctgggcatgctcagcgatctccaagtttacaaggacagttttgagctcaaattcctcgaggagaccaactgtctatacgccgcggagggacaacgcctgatgcaggagagggaggtcccagaatatttaaaccacgtcagcaagaggctcgaagaggaaggcgatagggtgatcacctacttggaccattccactcagaagcccctaatcgcgtgcgttgagaaacagcttttaggggagcacctgaccgctatcctccagaaaggactcgatcatctgctcgacgaaaatcgggtgcccgatctggctcagatgtaccagctcttctcgcgagtgcggggaggccaacaagccctgttgcagcactggagtgagtacatcaaaacattcggcaccgccatagtgattaaccccgagaaggataaggacatggttcaggacctcctggattttaaggacaaggttgaccacgtgatcgaggtgtgcttccaaaaaaatgagcgctttgtaaacttgatgaaggagagcttcgagacgttcattaataagcggcccaacaaacccgccgaacttattgccaagcatgtggattctaagctcagagcaggaaataaggaagccactgatgaagaactggaacgcactctggacaagatcatgatcctgtttaggtttattcacggtaaggatgtctttgaagcgttctacaagaaggatcttgccaagcgtctcctggtggggaagtctgcaagcgttgatgcagagaaatctatgctttccaagcttaagcacgagtgtggggccgccttcacatccaagttggaggggatgttcaaggatatggaattgtctaaggacataatggtgcattttaagcaacacatgcagaaccaatctgacagcggtcccatagatctgactgtgaacatattgaccatggggtattggccaacctataccccaatggaggtgcacctgactccggaaatgattaagttgcaggaggtgttcaaggcattctacctgggcaagcactctggccggaagctacagtggcaaaccaccctcggccacgcggttctcaaggccgaattcaaagaaggaaaaaaagaatttcaggtgtccctgtttcaaaccttggtcctgttgatgttcaatgagggagacgggtttagcttcgaagagataaaaatggcaacagggattgaagattctgaattgcgacgaacccttcagtccctggcgtgcgggaaggcaagagttctaatcaagagccctaaaggaaaggaagtcgaggatggggacaagttcatcttcaatggcgagttcaaacataagttatttaggattaagattaaccagatacagatgaaggagaccgtcgaggagcaggtgtccacgactgaaagggtgtttcaggatcgtcagtaccagattgatgcagcaattgtccggataatgaagatgcgcaagacactgggacataatctgctcgtgtccgagctctataatcaactgaaatttcctgttaaacctggagatctcaaaaaaaggatcgagagtctcattgatagggactatatggaaagagacaaagataatcccaatcagtaccactacgttgcttag

SEQ ID NO: 184146 - DNA, 1980 bp, Artificial Sequence
  Description of Artificial Sequence: Synthetic coding sequence
atgctgtacaagcagctgcggcaggcctgcgaggaccacgtgcaggctcagattctgccattccgcgaggattctctagattcagtactgttcctgaagaagatcaacacctgctggcaggatcattgtaggcaaatgattatgatccgatccatctttctattcttggatcgtacgtacgtgcttcaaaattctaccctgccctcaatttgggacatgggcctggagctgttccgcacacacatcatctccgataagatggtgcaaagcaagacaatcgacggtatactgctgctgattgagagggagcgctccggcgaagccgtggaccgctccctcctaaggagcttgttgggcatgctcagcgatctgcaggtttacaaggactcttttgaactgaaatttttggaagagacaaattgcctatatgccgccgagggccaacgactcatgcaggaaagagaggttcctgaataccttaaccacgtatctaaaagactcgaagaagagggagacagggtgattacatacctggaccattccacgcagaagccgctgattgcatgcgtggaaaaacagctgctcggcgaacacctgacggcaatactacagaagggattggaccatctgctcgacgaaaatcgtgtacctgacctggctcaaatgtatcaactattcagccgcgtaagaggcggccaacaggctctgttgcagcactggtccgaatatatcaaaacatttggaacagccatagttatcaatccggaaaaggataaagatatggtgcaggatctcctggatttcaaggacaaggttgatcacgttatagaagtctgctttcagaagaatgaaaggttcgtcaacctcatgaaggaatccttcgagacctttatcaacaaaagaccgaacaaacccgcggaactcattgcaaaacacgtcgatagtaagttacgtgcaggcaataaggaagcgactgatgaagaattggaacgaacgttggacaagatcatgatcttattccgcttcatccacggcaaagatgtttttgaggctttctataagaaggacttagccaaacggctcctggtaggaaagtccgcctccgtggatgcagaaaagtcgatgctatccaagctgaagcatgaatgtggcgccgcatttacttccaagctcgagggaatgttcaaagacatggagctgagcaaagacatcatggtgcatttcaaacaacatatgcagaaccaatctgactctggtcccatagatctgactgttaacatacttactatgggatattggccaacatacactcctatggaggtccacctgacccccgaaatgatcaaactccaggaggtctttaaggccttttatctgggcaagcatagcggccgcaagctgcagtggcaaacaacgttgggccacgccgttctcaaggcagaatttaaagagggaaaaaaagagttccaggtctctcttttccagaccctagtgctgctaatgtttaatgaaggcgacggcttttccttcgaggagataaagatggcgacggggatcgaagatagtgagctgcgccggaccctgcagtcactagcgtgcgggaaggcccgtgtactcatcaagagccctaaagggaaggaggtcgaagatggtgataaatttattttcaatggagagttcaagcacaagctgtttagaattaagatcaatcagatccaaatgaaggagacagttgaggagcaggtcagtactacagaacgcgtgtttcaggatcgacagtatcagatagacgccgctatcgtgaggatcatgaagatgaggaagacgctgggacataacctgctcgtctcagagctttacaaccaactaaaatttccagtgaaacccggcgatctcaagaagcgaatcgagtcgttaatcgatcgagactacatggaacgagacaaggataaccccaaccagtaccactacgtggcatag

SEQ ID NO: 184147 - DNA, 1980 bp, Artificial Sequence
  Description of Artificial Sequence: Synthetic coding sequence
atgctgtacaagcagctgcggcaggcctgcgaggaccacgtgcaggcgcaaatcctccccttcagagaagattccctggactctgttttgtttctcaaaaagatcaatacttgctggcaagaccattgccgacagatgatcatgatccggtccatctttttattcctggacagaacttatgtcttacagaactcaaccctcccatccatctgggacatggggctggagctttttagaacccatatcatttctgataagatggttcagtccaaaacaatcgatggaattttgttgttgatcgagagagaaaggagcggcgaggctgttgataggtctctattacgcagtctgctgggaatgctgagcgatttacaggtgtacaaggactcattcgagctgaaattcttagaggaaacgaactgtctgtacgccgctgaagggcaacgtcttatgcaggaaagggaagtgcctgagtaccttaatcacgtgagcaagaggctggaggaggaaggagaccgagttattacatacctggaccatagcacacaaaagccactaatcgcctgcgtggaaaaacagctcctgggagaacacctgactgcaatcctacagaaaggactcgatcacctgctggatgagaatcgggtccccgatctggcccaaatgtatcagctctttagtagagttcgcggagggcagcaggccttgctgcaacactggagcgaatacatcaaaactttcggcaccgctattgttattaatcctgagaaagacaaagacatggtgcaggaccttcttgacttcaaagataaagtcgaccatgtgatcgaggtgtgtttccagaagaacgagcgattcgtgaatctaatgaaagagtccttcgagacctttatcaacaagcgacccaataaacccgctgaactcatcgccaagcatgtcgactcaaagctcagggctggaaacaaagaggcaacagatgaggagctggaacgaacactggacaaaataatgatcttatttcgttttatccacgggaaggacgtgttcgaagccttctataaaaaagatctcgcaaaacgactcctggtgggtaaatccgcctcggtggatgctgagaaaagtatgctatccaagctcaagcatgaatgtggtgctgccttcacttccaagttggaaggcatgttcaaagacatggaactgagtaaggacataatggtacattttaagcagcatatgcagaaccagtctgactccggcccgatcgatcttacagtaaacatcctgacaatgggctattggccaacttacacccccatggaggttcacttaactcctgaaatgatcaagctgcaagaggtgtttaaggccttttaccttggaaaacacagcggaagaaagttgcagtggcaaacaacactcggccacgctgtccttaaggccgaatttaaagaagggaagaaggagtttcaagtctctcttttccaaactctggttctattaatgttcaatgagggtgacggcttttcattcgaagagattaaaatggcgactggaatcgaagacagcgaacttcgcaggacactgcagtccttagcctgcggaaaagcacgcgtgttaataaaaagcccgaaggggaaggaggtcgaggacggcgataagtttatcttcaatggtgagttcaaacataagttattccggataaagattaaccaaatccaaatgaaagagaccgtcgaggagcaagtctcgactacagaacgggtattccaagatcgacagtaccagatagatgccgcaatcgttaggataatgaagatgcgtaagactctcgggcataacttgctggtttccgagctttacaaccagctgaaattccccgttaaacccggagatctcaaaaaacggatcgagagcctgattgatcgcgactatatggagagagacaaggataatcccaaccaataccactacgtcgcctag

SEQ ID NO: 184148 - DNA, 2703 bp, Artificial Sequence
  Description of Artificial Sequence: Synthetic coding sequence
atgaagagcgtgtgccccgtgaccagcggcttcagcagccccagcccatcagcagccgccgctgcacaagaggttcgaagcgcaacagacggcaacactagcactacccctcctacctctgccaaaaaacggaagttgaactccagctcatccagcagctctaattcgtccaatgagagagaagactttgatagcacttccagttccagcagtacaccccctcttcagcctcgagacagcgcgagtcccagcaccagctctttttgccttggcgttagcgtggctgcctccagtcacgtgcctatacagaagaaactgaggttcgaggataccctggagttcgtgggctttgatgccaagatggctgaagagtcctcgtcttcaagctcttcctctagccctacagccgccacgagccagcagcaacagctgaagaataagtccattcttattagctctgttgccagtgttcatcacgctaatggcctggctaagtcttcaaccactgtgagctccttcgctaattcaaagcccggcagtgctaagaagttggtgataaaaaactttaaggataagcccaaactgccggaaaactatacagatgagacttggcagaaattaaaggaagcagtagaagccattcaaaattccacatccatcaaatacaatctcgaggagttgtatcaggccgtcgaaaatctgtgttcgtataagataagcgccaacctttataagcagctgaggcagatttgcgaagaccacatcaaagcccagatacaccaatttagggaagattccctggattccgtgctattcctgaagaagattgaccgctgctggcaaaaccactgtaggcagatgatcatgatccgatccatttttctttttctggatagaacgtatgttctacagaactcaatgctgccttccatctgggatatgggcctggagctgtttagggcacatattatttctgatcagaaagtgcagaataagactatcgacggtatcctgctgctcatagagcgagaaagaaatggggaggcgattgatcgtagcctgctacgctcccttctgagcatgctttccgatcttcaaatctatcaggattctttcgaacagcgattcctagaagaaacaaaccgtttatatgctgccgagggtcagaagttgatgcaggagcgcgaggtgccggaatatttgcatcatgtaaataaaaggctcgaggaagaggccgaccggctcatcacatatctggaccaaactacccaaaaatcgcttatcgctaccgtggaaaagcaactacttggggagcatttaactgcaatcctccaaaaaggattgaataacctgctggacgagaatcgcattcaagacctgagcctgctttatcagctattttcgagagtgcgcggcggtgtccaggtgcttctacagcagtggatcgagtatataaaggcttttggttctactatcgtcattaatcctgaaaaggacaaaactatggtacaggagttgctggatttcaaagacaaggtcgatcatattatcgacatctgttttttaaagaacgagaagttcattaatgcaatgaaggaggcctttgaaactttcatcaacaagagacctaataagcccgccgagctcatcgccaagtacgtggattcaaaactaagggcaggcaataaggaggccacagatgaagagctcgagaagatgctggacaagatcatgatcatctttcggtttatctacggtaaggacgtttttgaggccttctataaaaaggacctggctaagaggctattagtgggcaaaagtgcatcagtcgacgcagagaaatctatgctttccaaacttaaacatgaatgtggagccgcgttcacgagcaaactcgagggtatgtttaaggacatggaactctccaaagacattatgatacagttcaagcagtacatgcaaaaccagaatgtgccagggaacatagaactgaccgtcaatattttaaccatgggctattggcctacgtatgttcccatggaggttcacctgccacccgaaatggtaaagctccaggaaatattcaagactttctacctcggaaagcactcaggtcggaagctccagtggcagagtaccttaggtcactgcgttttgaaagccgagttcaaagagggcaaaaaggagttacaggtttctctcttccagacactcgtcctactcatgttcaacgaaggcgaggaattctcacttgaggagataaagcaagccaccgggatcgaagatggtgagctcaggcgcaccctacagtcactggcctgtggtaaagcccgagttctggctaagaacccgaaagggaaagacatcgaggacggagataagtttatatgcaatgatgacttcaagcacaaacttttcagaatcaagattaaccagatccagatgaaggagaccgtggaggaacaggccagcacgactgagagggtgtttcaggatcggcagtatcaaatcgatgccgcaatcgtgcgtattatgaagatgagaaagaccctaagccataacctgctggtttccgaagtttataatcagctcaaattcccagttaagcctgcggaccttaagaaacgcatcgagtcactcatcgacagagactacatggaaagagacaaagagaatcccaaccaatacaactacatcgcatag

SEQ ID NO: 184149 - DNA, 2688 bp, Artificial Sequence
  Description of Artificial Sequence: Synthetic coding sequence
atgttccccaccggcttcagcagccccagccccagcgccgccgccgccgcccaggaggtgagatctgctacggatgggaacacttcgacgacacctcctacgagtgcaaaaaagcgcaaattaaactcaagttccagctctagtagtaactcaagcaacgagagggaagatttcgatagcacttcatcttcgtcctctacccccccgctccagccgagagacagcgcttccccgagcacatccagcttttgtctcggcgtctctgtggcagcaagttctcacgtgccgatccaaaagaaactgaggttcgaagatacactggaattcgtcggttttgacgccaaaatggccgaggagtcctcctcgagctcatcatcttccagccccaccgctgccacatctcagcagcaacagctaaaaaacaagtctatcttaatatcctccgtggcctctgttcatcatgccaatggattggccaagtcatccactactgtgagttcctttgccaattcaaagcccggttcagccaagaagttggtgattaaaaattttaaagataagccaaagctgcccgagaattataccgatgaaacctggcaaaaactgaaggaagcggtcgaggcaatacagaactccacatctattaagtataatctcgaagaattgtatcaggccgtggaaaatttatgctcgtataaaatctctgcaaatctgtataaacagctgcggcagatatgcgaggatcatattaaagcccagatacatcagttcagggaggactcacttgactcagtgctattcctcaaaaagatagatcggtgttggcagaaccactgcaggcaaatgatcatgatccgctccattttcctcttcctagatcggacttacgttcttcagaattccatgcttcccagcatttgggatatgggccttgaactcttccgagcccatataattagtgaccagaaagttcagaataagactatcgacggcatactattactgattgagagagaaaggaatggtgaggccattgaccgctcccttttgaggagcttgctctcaatgctgtcagatctgcaaatttaccaagactcatttgaacagcggttcctggaggagaccaatcgcctgtacgccgctgaaggccagaagctgatgcaggaacgggaggtgccagaatatctccaccacgtaaacaaaagactggaagaagaggctgatcgcttgatcacctatttggaccaaaccacgcagaagtcactgattgccactgtagagaagcagctcctaggggagcatctcacggctattttgcagaaaggcctgaataatttgttggatgagaatcggatccaggatctgtctctattataccagctgttcagcagagtgaggggcggagtgcaggtcctcctgcagcaatggattgaatatatcaaggcctttggctcgaccatagtaatcaaccccgaaaaggacaaaacaatggtgcaggagctcctcgactttaaggataaggtggaccatattatcgacatctgttttctgaagaacgagaagttcatcaatgccatgaaagaggcctttgaaacctttatcaataaaaggcctaataagccagccgagttgattgccaagtatgtagatagcaagctgcgggccgggaataaggaggccacggatgaagaactggagaaaatgctggataaaattatgatcatttttcggttcatatacggcaaggacgtctttgaagccttctacaagaaagacttggccaaacgtctgctagtgggaaagagtgcatccgttgacgctgagaagtctatgctttcaaaactaaagcacgagtgcggtgccgccttcacgtccaaactggaggggatgttcaaagatatggaattatccaaagacattatgattcagttcaagcaatacatgcagaatcagaatgtcccgggtaatatcgaactgacagtgaacatactgacgatggggtattggccaacatacgtccccatggaggtccatctgccacctgagatggtgaagttgcaagagatttttaagacattttatttgggcaagcactctggacgaaaactgcaatggcagtccactttgggacactgtgtactaaaggctgaatttaaagagggcaagaaagaactccaggtgtctttgtttcagacacttgtcttgctgatgtttaatgagggtgaagagttctcactcgaggagataaagcaggcgacaggcatcgaggatggggaactgcgcagaaccttacaaagtctggcctgcggcaaagccagggtgttggctaaaaaccccaaaggcaaggatatagaggatggggataagttcatttgcaacgacgactttaaacataaactctttcggattaaaataaaccaaatacagatgaaagagacggtggaggagcaggcctccacaactgaaagggtgttccaggatcgccagtaccagattgatgccgccattgtgaggattatgaaaatgcgaaaaacgctgtctcacaatttgctcgtctccgaggtgtacaatcagctgaagttccctgttaaaccagccgaccttaagaaaaggatcgagtccctaatcgacagggactatatggaaagagacaaggaaaaccccaaccagtacaactacatcgcctag

SEQ ID NO: 184150 - DNA, 705 bp, Artificial Sequence
  Description of Artificial Sequence: Synthetic coding sequence
atgatcgaccccgacttcgccgacaagcccaagctgcccgagaactacaccgacgagacctggcaaaaactgaaagaagccgtcgaggcaatccagaattctacctccatcaagtacaatttagaagagctttaccaagccgtcgaaaacctttgctcttataaaatctcggcgaacctgtacaagcagttaagacagatatgcgaggaccacataaaagcccagatccaccaatttagagaggactcccttgattccgtgctcttcttaaagaagatagatcggtgctggcaaaatcactgtcggcagatgatcatgattaggtccattttcctgttcctagaccgcacctacgtattacagaattctatgctgccctctatatgggacatgggtctggaactgtttcgggcacacattatttccgatcagaaagtccaaaacaagacgatagatggcattctgttgctgatcgagagggaaagaaatggtgaggccatagatcgctccctactgcgttcattattgtctatgttgagtgacctgcaaatctaccaagattccttcgagcaacgattcttggaggaaacaaatcggctctatgctgcggaaggacagaagctgatgcaggagagagaggttcccgaatatcttcatcacgtgaacaaaagactggaagaagaggccgaccgtctgatcacatag

SEQ ID NO: 184151 - DNA, 2742 bp, Artificial Sequence
  Description of Artificial Sequence: Synthetic coding sequence
atgatgagccagagcagcggcagcggcgacggcaacgacgacgaggcaaccacctccaaagacgggggattttcaagtcccagtccttccgccgctgccgctgcccaagaagtgaggtcagctacggatgggaacacatccaccacaccccccacttccgccaagaaacgcaagctcaattcctcttcgtcctcatcttccaacagttccaatgagcgggaggacttcgattctaccagttcgtcctcatcaacgcctcccttgcagccaagggacagcgcttctcccagcaccagcagcttctgtttgggtgtgtcagtcgccgctagtagccacgttcctattcaaaaaaagctgagatttgaggacaccctcgaattcgtcggttttgatgctaaaatggccgaagagtccagttcctcaagtagcagtagcagtcctaccgccgctaccagccaacagcaacagttgaaaaataaaagtatcctgatttccagcgtggcttcagtgcaccacgccaatggcctggcaaaatcgtctacgacagtatctagtttcgcaaacagtaaaccaggctctgcgaaaaaactggtaataaaaaactttaaggacaaaccaaagctgcccgaaaactacactgacgagacgtggcaaaagcttaaagaggccgtggaggcaatccagaatagcacttcaataaagtacaatctcgaagagctatatcaggccgtcgaaaacctatgtagctacaaaatctccgctaacctctataagcagcttcgtcaaatttgtgaagaccacatcaaagctcagatccatcaatttcgcgaggatagcttggattccgtgctgttcctcaagaaaattgatcggtgctggcagaaccactgtcggcagatgattatgatacgttccatctttctctttcttgatcgaacgtatgtgctgcaaaatagtatgctaccttcaatatgggacatgggtctcgagctgtttagagcccatattatctctgaccaaaaagttcagaacaaaactatcgatggaatccttctactgatagagagggagagaaacggagaagccatagaccggagcctcttacggagcctgctgagtatgctgtccgacctacagatctatcaggactcttttgagcaacgattcctggaagagactaatcgcctgtacgctgccgaggggcagaagctaatgcaggagagagaagttccagagtatctccatcacgtgaacaagcggctcgaagaggaagctgatagactgatcacatacctggaccagaccactcaaaagtcattgattgcgacagtggagaagcagctacttggcgaacatctaacagcgatcttgcagaaggggctgaacaatctgctggacgaaaatagaatccaggacctcagtctactctaccaattattcagcagggtccgcggtggcgtccaggtattgctgcaacaatggatcgagtatattaaagctttcggctcaaccattgttatcaatcccgaaaaggacaagactatggtccaggaacttctagacttcaaggataaggttgaccatattatcgatatttgcttcctaaagaacgagaagttcataaacgccatgaaagaagcctttgagaccttcatcaacaagaggcctaacaagccggctgaattgatcgcaaaatatgtggatagcaagcttcgggcaggaaataaagaggcaacagatgaagagctagaaaaaatgctggacaaaattatgataatatttcggttcatctatggaaaggatgtcttcgaggcattctataagaaggaccttgcgaaacgtcttctggttgggaaatctgctagcgtggatgctgagaaatccatgctgtccaagctgaagcatgagtgcggggcggccttcacatccaaacttgaggggatgttcaaggatatggagctgtcaaaagatattatgatccaattcaagcagtacatgcagaaccagaacgtcccaggcaacatcgagttaaccgtgaacattctgaccatgggctattggccgacctatgtccccatggaagtccatctgccacctgaaatggtgaagctccaggaaatctttaagaccttctacctggggaagcattctggccgaaaactccaatggcagtcaactctcggccactgtgtgttaaaggccgaattcaaagaaggtaagaaggaactgcaagtgagcctgttccagaccctcgtgcttttaatgtttaacgagggagaggagttcagtctggaagagattaagcaggcaaccggtattgaggacggcgaactcaggcgcacactgcaatccttggcatgcggaaaggcgcgcgtgttggccaagaaccctaagggcaaggatatagaagatggagataaattcatatgtaacgatgacttcaaacataaattgtttcggattaagatcaatcagattcagatgaaggagactgtggaagaacaggcttctacaaccgaacgggtatttcaggataggcagtaccaaattgacgccgccatcgtgcgcattatgaaaatgcgcaagacactgtctcacaatctcttggtcagcgaagtgtataatcaactgaagttccccgtaaagcccgcagacctaaaaaagcgaatcgaaagcctaatcgacagggactatatggagagggataaagagaaccctaaccagtacaattacatagcctag

SEQ ID NO: 184152 - DNA, 2343 bp, Artificial Sequence
  Description of Artificial Sequence: Synthetic coding sequence
atggccaccagcaacctgctgaagaacaagggcagcctgcagttcgaagacaagtgggacttcatgaggcctatcgtcctgaagctcctgcgccaggaaagcgtgaccaaacaacagtggtttgacctgttctcagatgtgcacgctgtttgtctgtgggacgacaagggacccgctaaaatacatcaggctctgaaagaggatattttagaattcatcaagcaagcccaagccagagtgctgtctcaccaggacgacaccgccctgttaaaggcttacatcgtagaatggcgaaagttcttcactcagtgtgacatccttccaaagccattttgccagttggagatcacgctgatggggaagcagggaagtaacaaaaaaagcaacgttgaggactccatcgtacgaaaattgatgttagatacatggaatgagtcaattttttctaacatcaaaaataggcttcaggattctgccatgaaactggtgcatgctgagagactgggcgaagcctttgattcgcagctggttattggggttcgggagagctacgtgaacttgtgtagcaatccagaggacaagctgcagatctatcgcgacaattttgaaaaagcatacttagatagcaccgaacggttctaccgcacccaggcacccagttacctccaacagaatggcgtgcagaactacatgaaatatgccgatgctaaactgaaagaggaagagaaaagagccttgcggtatctggagacacgaagagagtgcaactcagttgaggccttaatggagtgctgtgttaacgcacttgtcaccagtttcaaggagactatcctcgccgagtgtcagggtatgattaaaagaaatgaaactgaaaaactccacctgatgttttcactgatggacaaagttcctaatgggatcgagccgatgctaaaagatttggaagagcacatcattagtgccggacttgccgacatggtggcagcagctgaaaccatcacaacagacagcgagaaatacgtagaacagctgcttactctctttaatcgctttagtaagctggtcaaggaggcgtttcaggatgatccccgctttctaactgcgagggacaaagcctacaaggccgtcgttaatgatgcaacgatttttaagctagagctgcccttaaaacagaagggggtcggcctgaagactcagcccgagagcaagtgcccagaattacttgccaactactgcgacatgctgctgcgcaaaacccccctatctaaaaagctgacaagtgaggaaatcgaagcgaagctgaaggaagtgttgttggtgttgaagtacgttcagaacaaagatgtattcatgagataccataaggctcacctcacccgacgactgatcctggatatcagcgcagacagcgagattgaggagaacatggttgagtggctcagggaagtaggaatgcctgcagactacgtgaacaagcttgcccgaatgttccaggatattaaggttagtgaagacttgaatcaggcctttaaagagatgcataaaaacaataagttagcacttccggccgactctgtgaacatcaaaatactaaacgccggcgcttggtcacggagtagtgaaaaggtcttcgtgtcccttcccaccgagcttgaggatctcatccctgaagtggaggagttctataaaaagaatcatagcggcaggaagctgcattggcaccatctgatgtccaacggcatcattactttcaagaatgaagtgggacagtacgacctggaggtgacgaccttccagctcgcagtcttatttgcctggaaccagagaccacgcgaaaagattagcttcgaaaatttgaaactggctacagagctcccagacgctgaattaagaagaaccctctggtcgttggttgcctttccaaagctgaagagacaggtgttactgtacgagcctcaggtaaactcccctaaggactttactgagggaacactcttcagcgtaaaccaggagtttagcctcatcaaaaatgctaaagttcagaaacgaggcaagattaacctcatcggccgactccagcttaccactgaacgcatgcgggaggaggagaatgaaggtattgtgcagctgagaattcttagaacccaggaagcgattatccaaatcatgaagatgaggaaaaagataagtaatgctcagctgcagaccgagctggtggagatactaaagaatatgtttcttccccaaaagaaaatgatcaaagagcagatcgagtggcttattgaacataaatatatcagacgtgatgaatcagatatcaacacctttatctatatggcttag

SEQ ID NO: 184153 - DNA, 2343 bp, Artificial Sequence
  Description of Artificial Sequence: Synthetic coding sequence
atggccaccagcaacctgctgaagaacaagggcagcctgcagttcgaagataagtgggattttatgaggcctatagtgctcaagctcttgcgtcaggaaagcgtgacgaagcagcaatggtttgacttattttcagatgtccacgccgtgtgcctttgggatgataaggggcctgcaaagatccaccaggcgctcaaagaagatatcctggagttcattaagcaggcacaggcccgcgttctatctcaccaggatgacaccgccctgttaaaggcctatattgttgagtggagaaaattcttcacccaatgcgacatcctgcccaaacccttttgtcaactcgaaatcaccctgatgggcaaacaggggtctaacaaaaagtctaacgtggaagattccatcgtcaggaagcttatgttggacacatggaacgaatctatattcagcaatatcaagaataggctgcaagatagcgctatgaagttggtccacgccgagcgccttggagaagccttcgacagccagctcgtgatcggggtgcgtgaatcatacgtcaacctctgtagtaatcctgaagacaagctgcagatatatcgggataacttcgaaaaggcctacctggatagcaccgaaagattctacaggactcaagcaccaagctaccttcagcagaacggcgttcagaactacatgaaatatgcagacgccaagcttaaggaagaggagaagcgtgctcttcggtacctcgaaactaggcgcgaatgcaactccgtcgaggcactgatggaatgctgcgtcaatgccctcgtgacttcatttaaggaaacaattctcgccgaatgtcaaggtatgattaaacgtaatgagactgaaaagctccacctcatgtttagtctcatggataaggtccccaacggaatagagcccatgctgaaggacttagaagaacacatcatctcggctggcctggctgacatggtggctgctgctgaaaccatcaccacagacagcgagaagtacgtagagcaactgctcacccttttcaatcggttcagcaaattggtcaaagaagcatttcaggatgatcccaggttcttgaccgcacgggacaaggcgtacaaggccgtcgtgaacgacgcgaccatcttcaagctggaactgccactgaagcagaaaggcgtggggctaaaaacccagcctgagtctaagtgtccagaattactggccaactattgtgatatgctcttgaggaagacacccctctccaaaaaacttacttctgaggagattgaggctaaattgaaggaagtactgttggttctgaaatatgttcaaaataaagacgtgtttatgcgttatcacaaagctcatttaacccgcagacttattcttgatatttctgcagattccgaaatcgaggagaatatggttgagtggctaagagaggtgggcatgcccgctgattacgtgaacaagcttgcgcggatgtttcaggatataaaggtaagtgaggacttgaatcaagcttttaaggagatgcacaaaaacaataagttagcacttcctgcagactccgttaatatcaaaatattgaatgccggagcctggtctaggagttcagagaaggtcttcgtgtcactccctaccgaactcgaggaccttatcccagaagtggaggagttctacaagaaaaaccacagtggacggaaactccactggcatcatctgatgtccaatggaatcattactttcaaaaacgaggtaggacagtatgacctggaagtgactacattccagctggctgttttattcgcgtggaaccaacggccacgcgaaaaaatctccttcgagaatctgaagctggctactgagctgcccgacgccgagctgcggcgcaccttatggagcctcgttgccttccccaagttaaaaagacaagttttactctatgagcctcaggtaaattcgcctaaagactttacggagggtacccttttctctgtgaaccaggagttttcactgattaaaaacgccaaagtgcagaagcgcgggaagataaatctgattgggcgcctgcagcttactacagaacgaatgagagaagaagaaaacgaaggtatcgtgcagctgaggatactgagaacgcaggaggctatcatccaaattatgaagatgcgcaagaagatcagtaatgcacaactccaaaccgagctggtggaaatcttaaaaaacatgtttttgccacaaaaaaagatgatcaaggaacagatagagtggttaatagaacacaagtacatccgacgagatgagtccgatatcaacacttttatctacatggcatag

SEQ ID NO: 184154 - DNA, 5097 bp, Artificial Sequence
  Description of Artificial Sequence: Synthetic coding sequence
atggtgggcgagctgcggtaccgggagttccgggtgcccctgggcccaggactgcacgcgtatccagacgagctgatacgccagcgagtgggtcacgacggtcacccggagtatcaaatccgttggctgattttacggagaggtgatgagggcgacggtggatccggacaagtggattgcaaggcggaacacatcctactttggatgtccaaggatgagatctatgccaattgccacaagatgctaggcgaagacggccaggtgataggtccctctcaggagtcagctggagaggtcggtgctctggataagagcgtactggaggagatggaaactgacgtcaaatcgctcattcaaagggctctaagacaactggaggaatgcgtcggcaccatacctccggctcccctgctgcataccgtgcacgtgttgagtgcctatgcgtcaatcgaacccttaacaggagtgtttaaggatccacgagtgcttgatctcctcatgcatatgctgtcgtcacccgactaccagatacgttggagcgcggggcggatgattcaagcgctaagcagccatgacgcagggaccaggacccagatcctcctgtccttaagccagcaggaagcaatcgagaagcatcttgatttcgactctaggtgcgcactgttggccctctttgctcaagcgaccctgagcgagcaccccatgtcattcgagggcatacagctgcctcaggtcccagggcgcgtccttttcagcttggtcaagcgttatttacacgtgacaagcctgttggaccaattgaatgatagcgctgccgagccaggcgctcagaatacctcagcccctgaagagctctcgggggagcgcggtcagctggagctcgagttttcaatggccatggggacgctgatttccgagctcgtgcaggccatgcggtgggatcaggcctcggatcggcctcgttcttctgcccggagtcccggctccatcttccagcctcagctcgctgacgtttccccaggcttgcccgccgctcaggcacagccaagctttcgccggtctcggcgctttcgaccaagaagcgagttcgcttcagggaacacatatgccctttacgtgcgagatacactccagccggggatgcgggtacgcatgctggacgattatgaagagattagtgctggcgacgagggggagtttcgccagtctaacaacggagtgccaccagttcaggtgttctgggagagcactggacgtacatattgggtccactggcatatgctggagattctggggttcgaggaggacatcgaggatatggtcgaggccgacgaatatcaaggggcagtcgcatcaagggtcctcggtcgagcactccctgcctggaggtggcggccaatgacagaactttatgctgtcccatacgtacttccggaggacgaggacacagaggagtgcgagcatcttacgttggccgaatggtgggagctgttgttctttattaaaaagctcgacggtcctgaccaccaagaggtgctccagatcctgcaggagaacctggatggtgagatactcgacgatgaaatcttggccgaactggccgtacctatcgagctcgcccaggacctcctcctgacacttccccagagattgaacgattccgcgctgcgggacttgattaactgtcacgtatacaagaaatatggacccgaggcccttgcaggtaatcaagcctaccctagcctgctcgaagcccaggaagatgttctgctgctagatgctcaggctcaggcgaaggactctgaagacgccgccaaggtagaagccaaagagccgcccagtcaatctcctaatacacctcttcagagactggtggaggggtacgggccggccgggaagatcctgctggacctggaacaagctctcagcagtgagggaacacaggaaaacaaagtgaagccgctcctcctccagctgcaacggcaaccccagcccttcctggcgctgatgcaatccctcgataccccggaaacaaataggacactgcatttaaccgtcctcaggatactcaagcaattggtggacttccccgaggccctgttgctcccctggcatgaggccgtcgatgcatgcatggcttgtctgagatcacccaatactgacagggaggtactgcaagagttgatcttttttctgcaccgactcacaagtgtgagccgagactacgccgtggtgctcaatcagctgggtgctcgcgatgctatttcaaaggccttggaaaaacacctagggaaacttgagttagcccaggaattacgggatatggtgtttaagtgcgaaaagcacgcgcacctgtatcgaaagctgatcacaaatattcttggaggctgcattcagatggtgcttggccagatcgaagaccaccggcgcacacatcagccaatcaacatcccgttcttcgacgtgtttctgagatatctgtgtcagggcagcagtgttgaagtaaaggaagataagtgctgggagaaggtcgaagtctcatctaacccccatcgcgcatccaaactcacagatcacaatcctaaaacatattgggagagtaacggtagtgcaggaagccattacatcactctgcacatgaggaggggtatcctgatccgtcagctgacattattggtggccagtgaggattcttcatatatgccagcccgcgttgtcgtgtgcggaggtgattcgaccagtagcctgcacaccgaactcaacagcgtgaacgtaatgccatctgcttcgcgggttattctgttggagaatctgaccagattctggcctattatccagatccggattaaacgctgtcagcaaggagggattgatactcgcatacgagggctggaaattttaggcccaaaacctaccttctggccggtgtttagagaacagctgtgtagacacacacggcttttttacatggtaagagcccaggcgtggagtcaagacatggctgaggatcgacgctctctcctacacctctcgtctaggctgaatggggccctgagacaggaacagaatttcgcagaccggtttctaccagacgatgaagccgcacaggctctgggcaagacctgttgggaagccctcgtcagccctgtggttcaaaacattacatcccccgacgaagacggcatatcccctctgggctggttgttagatcagtacctggagtgtcaggaagcagtgtttaacccacaatcccgcggtccagcttttttttcaagggtgagaagacttacccacttattggtgcatgtcgaaccctgtgaagcccctccccccgtcgtagcgacccccagaccaaagggaaggaaccggagtcacgattggtcatctttagctacacgagggctgccttcctccattatgcgtaatctgacgaggtgctggcgcgccgttgtggaaaagcaagttaacaactttctcacttcctcctggcgggatgacgattttgtacctcgatattgtgaacacttcaatatcttacagaacagctccagcgagttgtttggcccccgcgcggccttcctgctagctctgcagaatggctgtgccggagctctgttgaagttgccttttctgaaagctgcccatgtatccgagcagttcgcgaggcatattgaccagcagatccaaggaagccggatcggtggtgcccaagaaatggagagacttgcacagttacagcagtgcctgcaggcagtcctcatcttcagtggtctggaaatcgccactacatttgagcattactatcagcactatatggccgatcggctgctcggggtggtaagcagttggctggaaggggcagtcttggagcagattgggccctgctttcccaaccgcctgccccagcagatgctacagagtctgtctactagcaaagagctgcagagacaatttcatgtgtaccagttacagcagctagatcaggaactgctgaagttagaggatacagagaagaagattcaagtgggcctgggcgcgagcggcaaggagcataaatccgagaaagaagaagaagctggagctgccgctgtcgtggatgtggccgagggagaagaagaggaggaggagaatgaggatctttactatgagggggccatgcctgaagtgtccgtgctggtgctgagtcgccattcgtggccggtggccagtatttgtcatacactgaatccacggacgtgcctcccatcctatttacgtggcacgctgaaccgctactccaacttttataataagtcccagtcacatccagcacttgagcgaggcagtcagcggcgcttgcagtggacctggctcggatgggcggagttgcagtttggaaaccagacacttcacgtgagcaccgtacagatgtggcttcttctttaccttaatgacctgaaggcggtgagcgtggaatctctgctggctttttccggtctgtccgctgatatgttgaaccaggccattggcccactgacttccagccggggaccactcgacctgcatgagcagaaagatattcccggcggcgttctgaaaataagagacggttctaaggagcccaggtcacgatgggacatcgttaggctcatccctcctcagacatatctccaagcagagggagaagacgggcagaacctcgagaagagacggaatctattgaactgcctcatcgtccgcatcctgaaggcgcacggcgatgagggcctccacatcgatcagctcgtatgcttggtactggaggcctggcaaaagggcccgtgtccacctcgtggtctcgtcagcagtcttgggaaggggtctgcttgctcttctaccgatgtcctgagctgtattctgcacctgctcggaaagggaactctacggagacacgatgatcggccccaagtcctgtcttacgccgttcctgtgactgttatggaaccccatactgagagcctcaatcccgggtcctcgggtccaaacccccctctgacattccatactctgcagattagatctaggggggtgccatacgcctcatgtaccgctactcagagcttttccacatttaggtag

SEQ ID NO: 184155 - DNA, 5349 bp, Artificial Sequence
  Description of Artificial Sequence: Synthetic coding sequence
atgagccggggcttctggctggccgagcccctggccggcaccggcccccacccagccccagtggcggccgacagccgtggttgttcatcagtaccccgtcgacatgccccatctagactgtcagtttctacgccatctagagggcccggggcgaggatggtcggagagctgcgttacagggagttccgcgtgcccctgggacccggtctacatgcctacccagatgagctcatccgacaacgtgtgggacacgatgggcaccccgagtatcagattagatggctaatcttgcgtcggggggacgaaggggatgggggctctggtcaggttgattgtaaggctgaacacatcctgctctggatgtccaaagacgagatttatgcaaactgccataaaatgctgggcgaggacggacaggtcattggcccctctcaagagtctgctggagaggtgggggcgcttgacaagtctgtgctggaagaaatggagacagacgtgaaatctctgattcagcgagccctaaggcagctggaggagtgcgtgggaacaatccctccagccccattattgcacaccgtgcacgtgcttagcgcttatgcctccattgaaccactcactggagtcttcaaagacccacgtgtgctggacctgctgatgcatatgctgagcagtccggactatcagattaggtggagcgcaggtaggatgattcaggccctatcttcacatgacgctggagaagggcaatgtggtgaagaggggaaagctggcgaaggactcggcagactgagagacagccaggacaccgttgctggtgcatctgatttgatcagaaccaggacccagatcctgttgtcccttagccaacaggaggccatcgaaaaacacttagactttgactctcgctgcgccctgctggccctgttcgcgcaggcaaccttaagtgagcaccccatgtcattcgaagggatccagttgcctcaggtgcccggccgtgtactgttcagcttggtaaagcgttaccttcacgtaaccagcctgttggaccagctcaatgactctgccgccgagcccggagctcagaacacttctgcgccagaagagctgagcggagaacggggccagctggaactggaattctctatggccatgggtacactcatatccgagttggtgcaggccatgagatgggaccaggcctccgatagaccccgtagcagtgcccgatccccagggtccatttttcagccacagctcgccgacgtgtcaccgggcttgcctgccgcccaggcccagccttcttttagacgaagccgccgcttcagacctcggtcagagtttgctagcggtaacacttatgccctctacgttcgtgataccctccaacccggaatgagagtccgcatgctggacgattatgaggaaattagcgcaggtgacgaaggagagttcagacaatcaaacaatggggtgccacccgtgcaggtgttttgggaatcaacaggacgaacatactgggtacactggcacatgttggagatcttaggttttgaggaggatatcgaagacatggtcgaagccgacgaataccagggtgcggtagcctcgcgagttcttggaagagccttgcccgcatggaggtggcggccaatgacagagctgtacgccgtgccttatgtacttcctgaggacgaggatacagaggaatgcgaacatttaacactggccgagtggtgggaacttcttttttttataaagaaactggacggccccgaccaccaggaggtcctccagatcctccaggagaacttggacggcgagatcttagacgacgaaatcttagcggaattggcagtgcccatcgaactcgctcaggatctgctcctgacacttccacagcgcctgaacgactcagcactgagagacctcatcaactgtcacgtgtacaagaaatatggacctgaggcactcgctgggaaccaggcttatccaagcctcctggaggcccaagaagacgtgctcctgctagacgctcaagcgcaggccaaggattcagaagacgcggcaaaggtggaggctaaagagcccccatcccagtctccaaacacccctctgcagcgcttggtggagggatacgggccagccggaaagatcctgttagacctggaacaagccctctcttctgaggggacacaggagaacaaagtgaagccactgctgctccaactacagaggcagcctcagccattcctagctctcatgcagagcctggacaccccggaaacaaatcgcactctccacttgaccgttctgaggatcctcaaacagctggtggactttccggaagccctccttctgccttggcacgaggcagtcgacgcctgcatggcatgtttaagaagccccaacacagacagagaagtgctgcaagaacttattttcttcctgcatcgccttactagtgtatcccgggattacgctgtggtgctaaatcaattgggggcaagagacgcaatctccaaagctctcgagaaacacctgggcaaactagagctggcccaggaactgcgggatatggtgtttaagtgtgagaaacatgcgcatctttatcgcaaactcattaccaacatacttggggggtgcattcagatggttctcggtcagatcgaggaccataggcgcacacaccaacccattaatatccccttcttcgatgtgtttctgagatatctttgtcagggaagctcggtggaggtcaaggaggacaagtgctgggagaaggttgaggtgtcctccaatccccatcgggctagcaagctgactgaccacaaccctaagacatactgggagtcaaatggaagcgccgggtcccattatatcactttgcacatgagacggggcatactcatcaggcaacttacactcctggtagctagcgaggactcatcctatatgccggctagggtggtagtttgtggtggagactccacgtctagcctgcatactgaactcaactctgtcaacgttatgccctctgcctctagggtgatactcctcgagaatttgacacggttttggcccattatacagattcgtatcaaacggtgccagcaagggggtatagacactcgcattcgggggctggagatcctgggcccaaaacctacattttggcctgtttttagggaacagttatgtaggcatactcgcctcttctacatggtgagggctcaggcgtggtcacaggacatggctgaggatagacggtcactccttcatctctccagtaggcttaatggcgccttgagacaggagcaaaacttcgcggaccggttccttcccgacgacgaagccgcccaggcactggggaagacctgctgggaggctttggtctctcctgtcgtgcagaatatcaccagtccagacgaggacggaatttcacccttaggatggctgcttgatcaatatctggaatgtcaagaagccgtgtttaacccacagtccaggggccctgccttcttctcacgtgtgcgaaggttaacgcatttgctggtgcatgtggagccctgcgaagctccccccccagtcgtggcaactcctaggccgaagggtcgcaacaggtcccacgactggtcgtctctggcaacacgcggcttacccagctcgattatgcgcaatctcactcgttgctggagagccgtggtggagaagcaagttaataattttctcacgtctagttggcgggacgacgattttgttccgagatattgcgagcattttaatattctgcagaattcatctagcgagttgttcggtccaagagcggcttttttgctggctctccagaatggctgcgctggagcactgctgaagttaccatttcttaaagcggcccacgtgtctgaacaattcgcgcggcatatcgatcagcagatccaaggttcgagaatcggaggagcccaggaaatggaacgactggcacagctgcagcagtgcctccaggctgtcctcattttttccgggctggagattgccacaacatttgagcattactaccagcattacatggcagaccgcctgctcggtgttgtgagctcgtggttagagggcgccgtgctcgaacagattgggccgtgcttcccaaaccgcctccctcagcagatgttacagagcttatccacgtcgaaagagctgcagcggcagtttcatgtgtaccagctgcagcagctggaccaggaattactgaaactggaagataccgaaaagaaaattcaggtaggcctaggcgcatcaggcaaggagcacaagtccgaaaaggaagaggaggccggagccgcagcagtagtggatgtggccgagggggaggaggaagaagaggaaaacgaagatctgtattatgaaggcgccatgcccgaagtttccgtactggtactgtcgagacattcctggcccgtggctagcatttgccacacgctcaaccctcggacatgtttacccagttatttgaggggtacccttaaccgttactctaacttctacaacaagtctcaatcccacccggcactcgagaggggaagtcagcgccgtctgcaatggacctggttgggctgggctgagcttcagttcggaaaccaaactcttcacgtgtctacggtacagatgtggcttctcttatacctgaacgatcttaaggcagtctccgtcgaaagtttactcgcattctctggcctctctgccgatatgttaaatcaggcaattggtcctctgacttctagcaggggtccactggatctgcacgagcagaaagatattcctggaggcgtgctcaaaatcagggacggcagtaaagagccccgctcccgctgggacatagtaaggctgatcccgccgcagacatacttacaagcggaaggagaggacgggcagaacttggagaaaaggcgcaacctgctgaattgcttgatcgtcaggattctcaaggcccatggggatgaaggcctgcacatcgaccagctggtttgcctcgtcctggaagcctggcagaagggaccttgtcctcccaggggccttgtttccagcctggggaaagggagcgcctgctcatctaccgacgtgctgtcatgcatcctgcatttattgggaaaaggcaccctgagacgtcacgatgaccggccccaggttttgtcatatgcagttcccgtgaccgtgatggaaccgcatacagagtccctaaatcccggatcctccgggccgaatccccctctcacctttcacacattgcaaattcggagccgaggcgtgccctacgctagctgcactgcaacccagtcattttctacttttaggtag

SEQ ID NO: 184156 - DNA, 435 bp, Artificial Sequence
  Description of Artificial Sequence: Synthetic coding sequence
atgggcgtgctgcaggtggtgaagcagagcgtgcagatccccgtgttcgtaatgatcagacctcggggcggggatttcctgtatagtgatcgagagatcgaagtgatgaaagcggacataagactggcaaaactttacggggccgacggtctggttttcggcgcgctcacagaggatgggcacatagataaggagctctgcatgagtctgatggccatctgcagaccactccccgtcacgttccaccgcgcctttgacatggtgcacgaccccatggctgccttggaaaccctgctgacactgggcttcgagcgggtccttacgtccggctgtgacagctcagcactcgaaggtctgcctctgattaaacgactaatcgagcaggccaagggtcgtatcgtcgtaatgcctggcggagggataaccgatcgatag

SEQ ID NO: 184157 - DNA, 822 bp, Artificial Sequence
  Description of Artificial Sequence: Synthetic coding sequence
atgaagcggcagggcgccagcagcgagcggaagcgggcccggatcccaagcggcaaagctggagctgccaatggcttcctgatggaggtttgtgtggactctgtggagagcgcggtgaacgccgagagaggcggcgcagatcgcattgagttgtgctcgggcctctcagagggaggaaccactccatccatgggagtcctgcaggtcgtcaagcaatcagtccagattccagtctttgtgatgatccggccgaggggtggcgatttcttatattccgatcgggagatcgaggtcatgaaggccgacatccgcctggctaagctgtatggcgccgatgggcttgttttcggcgccctgactgaggatggccacattgacaaagagctttgtatgtccctgatggctatctgtcggcccctccctgtcacattccaccgagcctttgatatggtgcacgatcctatggctgcactcgaaacactgctgacactgggctttgaacgcgtactcacttctggctgtgattcctctgctctggaggggctaccattgattaagagattgatcgagcaagcaaaagggaggattgtagtgatgccgggaggaggcatcactgaccgcaacctgcagagaatcttggaaggaagcggagctactgagttccactgcagcgcccgctcaacacgagacagcggtatgaagttccggaattcttccgtcgctatgggcgcttccctgtcatgttctgagtacagcttgaaggtgaccgacgtgacaaaggtgcggactcttaatgcaatagcgaagaacatcctagtatag

SEQ ID NO: 184158 - DNA, 1122 bp, Artificial Sequence
  Description of Artificial Sequence: Synthetic coding sequence
atgagcctgctgctgctgctgctgctggtgagctactacgtgggcactcttggaacccataccgagataaaaagggtcgcagaggagaaagttacacttccttgtcaccaccaactcggactaccagaaaaggatacgctcgacatcgagtggcttctgacggacaacgaagggaatcagaaagtcgttattacatatagttctcggcacgtgtacaacaacctgacggaagagcagaaaggtcgcgtcgcattcgccagcaattttctggccggcgatgcgagcctgcaaattgaaccactcaaaccaagcgatgagggcaggtacacatgtaaagtgaagaactcagggagatatgtctggtcacatgtgatcctgaaagtcctcgtgcgtccttccaaaccaaagtgtgagctcgaaggcgagctgaccgaaggctccgacttaacactacagtgtgagtcctcttctggcactgagcctattgtgtactactggcagagaattcgtgagaaggagggtgaggatgaacggcttcctccgaagtccaggatcgattataaccatccagggagggtgctgctccagaatctgacaatgagttactccgggctgtaccaatgcactgctggcaacgaagcaggaaaagaatcttgcgtggtccgtgtcactgttcagtacgtgcagagcattggcatggtggcgggcgcagtaaccggcatcgtagccggagccctgctgattttcctgctcgtatggctgctgatcagacgaaaggataaagaacgttacgaggaggaagagagacctaatgagatccgggaagacgctgaagcgccaaaggcacgcctcgtgaagccgtctagcagtagcagcgggagtagatcatcccgcagtgggagctcctccactagatcaacagccaactccgcaagccggagtcagcgaaccctgtcgaccgacgcagctccacagcctgggctggcaacacaggcgtactccctcgtgggccctgaggtgaggggaagcgagcctaagaaggtgcatcatgccaatctaactaaagcggaaaccactccttctatgatccctagccagagtagggcctttcagacagtgtag

SEQ ID NO: 184159 - DNA, 597 bp, Artificial Sequence
  Description of Artificial Sequence: Synthetic coding sequence
atgcaccaccggaacgacagccagcggctgggcaaggccggctgccctccagagccatcactgcagatggccaatactaatttcctgtcaaccctgagtcccgagcattgccggcccctagcaggcgagtgtatgaacaaactcaaatgcggggcagcagaagcagagattatgaaccttcctgaaagagtgggcactttcagtgccatccccgctctcggtggtatttcacttccccctggagtcatcgtgatgacagctctccactctcctgccgctgcctctgccgctgtcacagatagcgcatttcagatcgcgaatctggcggattgccctcaaaatcacagcagtagttcatcctctagctcaggcggagctggaggagccaaccctgccaagaagaaacgtaaacgatgcggcgtctgcgtcccttgcaaaaggttgatcaattgtggggtttgttcttcgtgtcgcaatcggaagaccggacaccagatttgtaagttccgaaaatgcgaagagctgaaaaagaagcctggtaccagtctggagcggacgcccgtcccatcagccgaggcatttcggtggttcttctag

SEQ ID NO: 184160 - DNA, 597 bp, Artificial Sequence
  Description of Artificial Sequence: Synthetic coding sequence
atgcaccaccggaacgacagccagcggctgggcaaggccggctgccctccagaaccctccctccagatggcaaatactaattttctgtccacgctatcaccagagcactgcaggccgctggcgggggagtgtatgaacaagctgaaatgcggggctgccgaggccgaaatcatgaacctgccagaaagggtggggacctttagtgcaattcccgctctgggcggaatttctctcccaccaggagtcatcgtaatgaccgcccttcacagcccggcagcagctagcgccgctgtaacagactcagccttccagattgctaatctcgccgattgtcctcagaaccattctagtagcagttcttcatcctctgggggagctggtggcgcaaatcccgctaagaagaaacggaagagatgtggagtctgcgtcccctgcaagagacttatcaattgcggagtgtgctccagttgccggaataggaaaacagggcaccagatctgcaaatttagaaagtgtgaagagctcaagaaaaagcccggcacaagtctcgaacgcacacccgtgccgagcgccgaggctttcagatggtttttctag

SEQ ID NO: 184161 - DNA, 969 bp, Artificial Sequence
  Description of Artificial Sequence: Synthetic coding sequence
atgagcagcctgggcggcggcagccaggacgccggcggcagcagctccagcagcactaatggaagcggaggatctggaagcagcggacccaaggctggcgccgccgacaagtctgccgtggttgccgcggcggcaccggcctctgtggctgacgacacaccgcccccagaaaggagaaataagtctggcatcatcagcgagcccctgaacaagtcgctcagaaggtcccgcccgctcagccattattcatcattcggttctagcggcgggtctggaggcggtagcatgatgggcggtgagtctgcagataaagcgacagctgccgccgccgcagcctctctgctggccaatggacatgacctcgccgccgcgatggccgtggataaaagcaaccccaccagtaaacacaaaagtggcgccgtggctagtttactctctaaggccgagagagccaccgagttagccgccgaaggtcagctgacgcttcaacagtttgctcagagcactgagatgctgaaacgagtcgtgcaagaacacctgccactgatgagcgaggcaggtgcaggtcttccagacatggaagctgtcgctggcgcagaggctctgaatggacagtccgattttccatacttaggcgcctttcccatcaatcctggcctgtttataatgaccccggcgggagtcttcttagcagagagcgctttacacatggctggcctcgctgaatatccgatgcagggggagctggcatcggccatttctagtgggaagaagaaacgcaaaaggtgtggcatgtgcgcaccctgtagaaggcgtataaattgtgaacagtgttctagctgccgaaatcgtaagacggggcaccaaatctgtaagttcagaaaatgcgaggaactgaagaagaagcccagcgccgcactggaaaaggtgatgttgcctacgggcgccgcattcagatggtttcagtag

SEQ ID NO: 184162 - DNA, 210 bp, Artificial Sequence
  Description of Artificial Sequence: Synthetic coding sequence
atgagcagcctgggcggcggcagccaggacgccggcggcagcagcagctcctccaccaacggttcgggaggatccgggtccagtggtccaaaagccggggcagcagacaaaagtgcggtggttgcagctgccgcccctgccagtgttgctgatgacacacccccccccgagagacgcaacaaaagcggcataatttccgaacctctctag

SEQ ID NO: 184163 - DNA, 243 bp, Artificial Sequence
  Description of Artificial Sequence: Synthetic coding sequence
atgagcagcctgggcggcggcagccaggacgccggcggcagcagcagttcctcaaccaatggttcaggcggctctgggtcttctggtcccaaggctggcgctgcagacaaaagcgcagtggtggccgccgcagcccctgcttctgtggccgatgacacacccccacccgagcgccggaataaatcagggatcatctccgagcctctgaacaagagcttgcgtcgtagccgcccactgtcctag

SEQ ID NO: 184164 - DNA, 546 bp, Artificial Sequence
  Description of Artificial Sequence: Synthetic coding sequence
atgagcagcctgggcggcggcagccaggacgccggcggcagcagctcttcaagcacaaatggttccggaggtagcggatcctcgggacctaaggctggtgccgcagacaagtccgcagtggtggccgccgccgcccctgcctccgttgcagatgatacaccaccgcctgaacggcgaaacaagtcaggaatcatcagcgagcccctcaacaaatccttgcggcggagcaggccacttagccattatagctcttttggttctagcggggggtcaggtgggggatctatgatgggcggcgagtccgctgacaaagccacagcagccgccgcggctgcttccctgctggcaaatggtcatgatcttgccgccgcaatggcggtggacaaaagcaatccgacctccaaacacaagagtggagccgtggcatcgctgttgagtaaggccgaaagggccactgaactcgcggcagaaggacagttaaccttacaacagtttgctcagagcactgagatgcttaaacgggttgtccaggaacatctgccgtag

SEQ ID NO: 184165 - DNA, 252 bp, Artificial Sequence
  Description of Artificial Sequence: Synthetic coding sequence
atgagcagcctgggcggcggcagccaggacgccggcggcagcagctccagctccacaaacggatccggaggctccggcagctccgggccgaaggctggcgctgccgacaaatcagcagtcgtggcagcagcagcaccggcctccgtggctgacgacacacctcctcctgaaagacgcaataagtcagggataatctccgaaccattaaacaagtcactgcgtcgaagccgcccgctgtcccactatagttag

SEQ ID NO: 184166 - DNA, 486 bp, Artificial Sequence
  Description of Artificial Sequence: Synthetic coding sequence
atgagcagcctgggcggcggcagccaggacgccggcggcagcagcagctcttctacaaacgggtccggtgggagcggcagtagcggacccaaagctggtgctgccgataagtctgcagtggtggccgcggctgctcccgcaagcgtcgcagatgatactcctccaccagagaggcgcaacaaatcgggaatcatttctgaaccactcaacaagtcactgagacggagtaggcctctgagtcactacagcagttttggctcgagcgggggaagcggtggaggaagcatgatggggggcgagtctgccgataaagcaacagcagctgcggctgcggccagtctgctggctaacggacacgatcttgccgccgctatggctgtggataagtccaaccccaccagcaagcataagtccggcgccgtcgcttctttactttccaaggccgaaagggccaccgaactggccgccgagggtcagctaacatag

SEQ ID NO: 184167 - DNA, 309 bp, Artificial Sequence
  Description of Artificial Sequence: Synthetic coding sequence
atgagcagcctgggcggcggcagccaggacgccggcggcagcagctcaagcagcactaatggctccggcggaagcgggtctagtggacccaaagctggagcggcggacaagagtgcagtggttgctgcagccgcccctgcatcagtcgccgacgacactcctccaccagaacgacgcaacaaatcaggcatcatttccgagcctttaaataaaagcctgcgcaggagcaggcctctcagccactattcgagttttgggtcatcagggggtagtggaggtgggtctatgatgggtggggagtctgcatag

SEQ ID NO: 184168 - DNA, 36 bp, Artificial Sequence; identical to SEQ ID NO: 77974
  Description of Artificial Sequence: Synthetic coding sequence

SEQ ID NO: 184169 - DNA, 297 bp, Artificial Sequence
  Description of Artificial Sequence: Synthetic coding sequence
atgagcagcctgggcggcggcagccaggacgccggcggcagcagctcctccagtacaaacggtagtggcggttccgggagctccggcccaaaagccggcgccgcagataagagtgccgtcgttgcggccgcggcaccggcgtccgtcgccgacgatacgcccccaccggagcgtaggaataaatccgggattatttccgaaccactcaataagtctctccgtaggtccaggcccctgtcccactatagctcctttggttcaagtggaggttcaggcgggggctctatgatgggatag

SEQ ID NO: 184170 - DNA, 969 bp, Artificial Sequence
  Description of Artificial Sequence: Synthetic coding sequence
atgagcagcctgggcggcggcagccaggacgccggcggcagcagctcctcttcgacgaacgggtccggcggaagcggatctagcggacctaaggccggagctgctgacaagtccgcagtcgtcgccgccgcagctccagcctctgtggcagacgatacacccccccccgagaggcgcaataagagtggcattatatctgagccccttaataaatccctgcggagaagtcggcccttgtcccactactcctcttttggatcctccggcggtagtggtggcggcagcatgatggggggcgaaagtgccgataaggcaactgccgcggccgctgctgccagcctcttggcaaacgggcacgatttggcggcagccatggctgttgacaaatcaaatccaactagcaaacacaagtccggtgctgtagcttccctcttaagcaaggctgagagagcgacagaactggctgcagagggacaacttaccttgcagcagttcgcccagtccaccgagatgcttaagagggtggtacaggaacaccttcctcttatgagtgaagcgggtgcaggattacccgacatggaagccgtggccggagctgaggccctgaacggtcaaagcgacttcccgtacctgggagcatttcctatcaacccgggactgtttatcatgaccccagccggcgtttttctagccgaatccgcgcttcatatggctgggcttgcggaataccccatgcagggggaactcgcctccgcgatatcttccggcaaaaagaaacgtaaacgttgtggaatgtgcgccccttgtcgccgacgcatcaactgtgagcagtgttcgtcttgtaggaatcggaaaactggacaccaaatctgcaaattccgtaaatgtgaggaattaaagaaaaagccgtcagccgcactggagaaggtcatgctcccgaccggtgcagcattccgatggtttcagtag

SEQ ID NO: 184171 - DNA, 594 bp, Artificial Sequence
  Description of Artificial Sequence: Synthetic coding sequence
atgagcagcctgggcggcggcagccaggacgccggcggcagcagctcctcaagtaccaatgggtccggagggagcggctctagtggaccaaaggccggcgcagccgacaagtccgccgtggtggcagcagctgctcctgcatccgtcgcggacgatacgccgcccccagaacgtaggaacaaaagcggcataatttcagagccattaaacaagagcctccggcgatctcggccgcttagtcattatagctccttcggcagttcaggaggcagcggaggaggctccatgatggggggagaatctgctgacaaggcaaccgccgcggctgcagctgcttctctactcgccaacggacatgacctggcggctgccatggctgtggacaagtcaaatcctacaagtaaacacaagtccggagccgtcgcatccctcctgtctaaagcagaacgggcgactgagctcgccgcagaggggcaactcacacttcagcagttcgcacaatccacagaaatgctgaagcgcgtagtgcaggaacacttaccccttatgagcgaggcgggagcaggactgccagatatggaggcggttgcttag

SEQ ID NO: 184172 - DNA, 27 bp, Artificial Sequence
  Description of Artificial Sequence: Synthetic coding sequence
atgagcagcctgggcggcggcagctag

SEQ ID NO: 184173 - DNA, 222 bp, Artificial Sequence
  Description of Artificial Sequence: Synthetic coding sequence
atgagcagcctgggcggcggcagccaggacgccggcggcagcagcagctcatctaccaatgggagtgggggctccggatctagcgggccgaaagctggcgctgccgacaagtccgccgtggttgccgccgctgccccagccagtgtggccgacgacacccctccccccgagagaaggaataagtccgggatcattagcgagcctctaaataaaagcttatag

SEQ ID NO: 184174 - DNA, 414 bp, Artificial Sequence
  Description of Artificial Sequence: Synthetic coding sequence
atgagcagcctgggcggcggcagccaggacgccggcggcagcagctcatcatcaaccaacggttcggggggatctggctcaagcggccccaaggccggggcggctgataaatccgctgtggtagccgccgccgcaccagctagcgtggctgatgatacccctcccccagagcgccgaaacaagagcggtatcatcagcgagccactgaataaatctctgagaagaagccgccccctgagtcactactcatcattcggatcttccggtggaagcggcggcggaagtatgatgggcggagaaagcgcggacaaggccaccgccgccgcggcagccgctagtctcttagcaaacggccacgatttggcagcggcgatggccgtcgataaatccaacccaaccagtaaacataaatag

SEQ ID NO: 184175 - DNA, 2073 bp, Artificial Sequence
  Description of Artificial Sequence: Synthetic coding sequence
atgaagctgagcatgaagaacaacatcatcaacacccagcagagctttgttactatgccaaatgttatcgtgcccgacatcgagaaggagatccgacgcatggagaacggcgcctgttcctcgttttccgaagacgacgacagcgctagcacaagcgaagaaagtgagaacgaaaacccccacgccaggggctctttcagctacaagagcttgcggaagggggggccttcacaacgcgagcaatacctgccaggggccatcgcactgttcaacgtaaacaattcttccaacaaggaccaggaacctgaggagaaaaaaaaaaaaaaaaaagaaaaaaaaagcaagagcgacgacaagaatgaaaataagaacgaccccgaaaagaaaaagaagaaaaaggataaagagaagaaaaagaaggaagagaaaagcaaggacaagaaagaggaggagaaaaaggaagtcgtcgtaatcgacccatcgggcaatacctactacaattggctgttttgcatcaccctacctgttatgtataactggactatggtgattgccagggcctgttttgacgagttacagagcgattaccttgaatactggctaatcctggattatgtgtctgatatcgtatatctgattgacatgttcgttcgcaccagaacgggttatctggaacaaggactcctagtcaaggaggaactaaagctcatcaacaagtataaatctaacctgcagttcaagcttgatgtcctgtcactaatccccactgaccttctgtatttcaagctcgggtggaactacccggagatacggttgaaccgattgctacgtttctctagaatgttcgaattcttccagcggactgagacccgtactaactaccctaatatttttagaatcagcaaccttgtaatgtacattgtgattatcattcactggaacgcttgcgtgttttacagcattagcaaagccattgggttcggtaatgatacgtgggtgtatcccgatatcaacgatccagaatttgggcgcctggcccgtaagtatgtgtattccctgtactggtcaacgttgaccctgactacaataggggaaactccgcccccagtaagagactcagagtacgtgtttgtagtcgtcgacttcctgattggggtgttaatttttgcaacaatcgtgggcaacattggaagcatgatctcaaacatgaatgccgctcgcgcagaatttcaagcccgaattgacgccatcaagcaatatatgcattttcgcaatgtgagcaaggacatggaaaaacgcgtgatcaagtggtttgactatctctggactaataaaaaaactgttgatgaaaaggaagtgctgaagtatctaccagataagttgcgggcagagatcgccataaacgtgcatctggacacgctcaagaaagtgcgcatctttgcagattgcgaggccggcttgttggtagagctggtcctgaagctgcagcctcaagtgtatagccctggcgattacatctgtaagaaaggagacataggacgcgagatgtatatcatcaaggaaggtaagttggccgtggttgccgacgatggggtgacacagttcgtggtcctttctgatggcagctacttcggtgaaataagcatacttaatatcaaaggttcaaaagccgggaatcgcagaaccgctaacatcaagagcatcggctactccgatttgttttgtctgtccaaagatgaccttatggaggctttaacggagtacccagatgccaagaccatgctggaggagaaggggaaacaaatactcatgaaggatggtttactggacctcaacattgccaacgcaggcagtgatcctaaggatcttgaggaaaaagtgacccgcatggaaggatctgtcgatctgctccagactcgcttcgcacgcatcctggcggaatatgaatcaatgcagcagaaactgaaacagagactgactaaggtagagaaatttcttaagccactcatcgacacagagttcagctccatcgagggacctggagccgagtccggccccattgattccacctag

SEQ ID NO: 184176 - DNA, 2280 bp, Artificial Sequence
  Description of Artificial Sequence: Synthetic coding sequence
atggagagccggagcagcccccggctggagtgcagcggcgccatctctgcccactgctctcttcacttgcccgattcctctgacttccagctcatttttgtgtttctggttgagatggggttccatcacgtggggcaggctggattagagttgctgatcagttccgacctgcctacatctgcttcccaaagcgccggcatcaccgacatgaaactgtccatgaaaaataacattattaacacccagcaaagcttcgtgaccatgccaaatgtgatcgtgcccgacatagagaaagaaattcggaggatggagaatggagcctgttcttctttctcggaggacgatgatagcgcctccacctccgaggagtcagagaatgagaatccacacgcccgtggatcattcagttacaaatccctgcgaaagggtgggccttcccagcgggaacagtatcttcccggagcaatagccctttttaatgtgaacaactccagcaataaggatcaagagcctgaagagaagaaaaagaaaaagaaggagaaaaaaagcaagtctgatgataagaacgagaacaaaaacgatcctgagaagaaaaagaaaaagaaggataaagagaaaaagaaaaaagaagagaagagcaaagacaaaaaagaggaagaaaagaaagaagtcgttgtgattgacccaagcggtaacacatattacaattggcttttctgtataaccttgccagtgatgtacaattggacaatggtgattgccagggcttgtttcgatgagctccaaagcgattatctggaatactggttgatcttggactatgtctccgatatcgtgtacctgattgatatgtttgtcaggacgcggaccgggtacctggagcaggggctactcgtgaaggaagagttaaagctgataaataagtacaagtctaatctgcaatttaagctggatgtgctgtcactgattcctactgacctgctctatttcaagctcggatggaactaccctgaaattaggttaaatcgtttactgaggttttctaggatgtttgaattcttccagcggaccgaaacgcgaacaaactaccccaacatattccgcatcagcaacctggttatgtacatcgtgatcattattcactggaacgcctgcgtattctactccatttctaaggccattgggtttgggaacgatacatgggtgtaccccgacataaatgaccctgaatttggacgcctagctaggaagtatgtctactcactgtactggtctaccttgacacttacaacaataggagaaaccccaccacccgtccgtgacagcgagtacgtgttcgtggtcgtggatttcctgataggggtgcttattttcgccactatagtaggtaacatcggatctatgatttcaaatatgaatgccgcaagggcagagttccaggctcgaattgatgccatcaagcagtacatgcactttaggaacgtgtcaaaagatatggaaaagcgagtgataaaatggttcgattatctctggacaaataagaagaccgttgatgaaaaagaagtgttgaagtatcttcctgataagcttcgggctgagatcgccatcaatgttcacctggacactctgaagaaggtcagaatttttgccgactgcgaggcaggactcctcgtggagttagtactgaagctgcagccacaagtgtactcacctggtgactacatttgcaaaaagggggacattggaagagagatgtacattataaaggaaggtaaactcgctgtagtggccgatgacggtgtaactcagttcgttgtgcttagtgacggctcatattttggagaaatcagcatcctaaacatcaagggcagcaaagctggcaaccggcgcactgcaaatattaaatccattgggtattccgatttgttttgcctaagcaaggatgatctcatggaagccttaactgaatatcctgacgctaagacaatgctggaggaaaaaggcaagcagatcctcatgaaggacgggctattagatctgaatatcgcaaacgcgggtagtgatccaaaagacctcgaggaaaaagtaacccgtatggaaggcagcgtggatctcctacagaccaggtttgcgcgaattctcgccgaatacgaatccatgcagcagaagttaaaacaacgtctgacgaaggttgaaaagtttctcaaacccttaatcgataccgagttttccagtatagaagggccaggtgctgaatccggcccaatcgattcaacctag

SEQ ID NO: 184177 - DNA, 2073 bp, Artificial Sequence
  Description of Artificial Sequence: Synthetic coding sequence
atgaagctgagcatgaagaacaacatcatcaacacccagcagagcttcgtgacaatgccgaacgtgatagttcccgacatcgagaaggagattcgccgaatggaaaacggggcttgcagctcattctccgaagacgacgattccgcttcaacaagtgaagagagtgaaaatgaaaacccccatgccaggggatcatttagctataagtcactgagaaagggagggccaagccagagggagcagtacctgccaggggcgatcgcccttttcaacgtcaataatagtagcaataaggatcaagaaccggaagaaaaaaagaaaaagaagaaggagaagaagtctaaatcggacgataaaaatgaaaataagaacgaccccgagaaaaagaaaaagaaaaaggacaaggaaaagaaaaaaaaggaagaaaagtcaaaggacaagaaggaagaggaaaaaaaggaagtcgtggtgatagacccatcgggcaacacctactacaattggttattctgcataaccctgcccgtcatgtacaactggacaatggtcatcgcaagagcatgtttcgatgaactgcagtccgattatctggagtactggctcatcctagattacgtctccgatatcgtttatctgattgacatgttcgtgcggaccagaacaggctacctggaacaaggcttgctcgttaaagaggagcttaaattgatcaataaatataaatccaacctgcagtttaaactcgacgtcttaagccttatcccaacggacctgctgtacttcaaactgggctggaattacccagaaattcgtctgaatcggctcctacggttcagtagaatgttcgagtttttccaacggacggagacccgcactaattatcctaacatcttcagaatttccaatctggtgatgtatatcgtcattatcatacactggaacgcctgcgtgttctattctatttccaaggcgatcggcttcggcaatgacacctgggtttacccagacattaatgaccctgagtttggccggcttgctagaaagtacgtatactccttgtattggagcactcttaccctgacgaccattggagagaccccccctcccgtcagggattccgagtacgtttttgtcgttgtcgacttcctcatcggagttctgatcttcgctacaattgttggaaacatcggatccatgatctccaatatgaacgccgcgcgagccgaatttcaggcccgcatcgatgccatcaaacaatatatgcattttagaaatgttagtaaggatatggagaagcgggtcatcaagtggttcgactatctgtggactaataaaaagaccgtcgacgaaaaagaggtcctgaagtatctgcctgataaattacgggccgagatagcaatcaatgtacacctcgacacactgaaaaaagtccgcatctttgcagattgtgaagctggcctcctcgtggagctggttctgaaactgcagcctcaggtctactccccaggggactacatttgtaaaaagggggacattggacgcgagatgtatatcattaaagagggcaaactcgccgttgtcgcggacgacggcgtgactcagtttgtcgtcctgtcggacggcagctattttggagaaatttccattttaaatataaaagggtctaaggccggaaaccgcagaacggcgaatatcaaatctatcggatattctgatctgttctgcctgagtaaggatgacctcatggaagcactgaccgagtatcccgacgctaaaacgatgctcgaagagaagggtaaacagattctgatgaaggatggtctgttagacctgaacattgcgaatgccggttcagaccccaaggacttggaggaaaaagtgacacggatggaaggttctgtggatctcctgcagaccagattcgcccggatcttggccgagtacgaatccatgcagcagaagcttaagcaaagactgacgaaggtcgaaaagtttcttaaacctttaatcgatacagagttctccagtatcgaaggtccaggcgcagagtcaggccccatagactctacctag

SEQ ID NO: 184178 - DNA, 387 bp, Artificial Sequence
  Description of Artificial Sequence: Synthetic coding sequence
atgaagctgagcatgaagaacaacatcatcaacacccagcagagctttgtaaccatgccaaacgtcatcgtgcccgacattgaaaaagaaattcggcgtatggaaaacggcgcctgctctagtttcagcgaggatgacgacagtgcctccaccagcgaggagagtgaaaatgagaatccgcatgcacgcggatctttttcatacaagagtctcagaaagggaggccccagccaacgagaacagtacctgccaggggctatcgcccttttcaatgtcaacaattcctcgaataaggaccaggaacctgaagagaagaagaaaaagaaaaaggagaagaagtctaagtctgatgacaagaacgagaataaaaacgatccagagaagtag

SEQ ID NO: 184179 - DNA, 300 bp, Artificial Sequence
  Description of Artificial Sequence: Synthetic coding sequence
atgaagctgagcatgaagaacaacatcatcaacacccagcagagcttcgtcaccatgcccaacgtgatcgtgccggacattgaaaaagaaatccggaggatggaaaatggagcctgtagctctttctctgaggatgacgattcagcatctaccagcgaagaaagcgagaatgaaaaccctcacgcaagagggagtttttcttataagtcccttcgcaaggggggaccttcccagcgggaacagtatctacccggagctatcgccctttttaacgtgaataattcatcaaacaaggattag

SEQ ID NO: 184180 - DNA, 2073 bp, Artificial Sequence
  Description of Artificial Sequence: Synthetic coding sequence
atgaagctgagcatgaagaacaacatcatcaacacccagcagagctttgttacaatgcccaatgtgatagtacctgacattgaaaaggaaatacgccggatggaaaacggcgcatgctcttcattcagtgaggatgacgactccgcctcgacctctgaggaaagcgagaacgagaatccccacgcccgcgggagtttctcatataagagtctgagaaagggggggccaagccagagagaacagtatttgcctggggcgatcgccctcttcaatgttaataattcttcgaataaggatcaggagcccgaagaaaagaaaaagaagaaaaaggaaaagaagtccaaaagcgatgataaaaatgaaaacaagaacgatccagaaaagaagaaaaaaaaaaaagataaggagaagaagaagaaggaggagaaaagtaaagacaagaaggaagaagaaaaaaaagaggtggttgttatcgatccctcaggcaacacctattataattggctgttctgtattacactccctgtcatgtataactggaccatggtaattgccagggcttgcttcgacgagctgcaatctgactacttagagtactggctgatcctggactacgtgtccgacatcgtctatctaattgacatgtttgtgcgtacgcggaccggatatcttgaacaaggcctgctagtgaaggaggagctcaaattgattaacaaatacaagtctaatttacaattcaagctggacgtactttcactgatccctaccgatctactctactttaaactgggatggaattaccccgagatacggctgaatcggctcttgcgattttccagaatgttcgagttcttccagcgcactgagaccaggacaaactacccgaacatcttcaggatatccaatcttgtaatgtacattgtgatcatcatacactggaacgcctgtgtgttttactccatcagtaaagccattgggtttggaaatgacacttgggtgtaccccgacataaacgatccagagttcggcaggctggcccgaaagtacgtgtacagcctgtactggtccacactgacccttacaacgatcggcgagaccccccctccggttcgggacagcgagtacgttttcgtggtggtggactttctcatcggcgtcttgatttttgcaacgatcgttgggaatatcggatccatgatctccaatatgaacgccgctagagcagaatttcaggctcgcatcgatgccatcaagcagtatatgcatttcaggaatgtgagcaaagatatggaaaaaagggtgataaaatggtttgattatctttggacaaataaaaaaacagtggatgagaaggaggtactgaagtacctgcctgacaaattgagggcggaaatcgctatcaacgtacatctggacaccctcaaaaaagtgagaatcttcgccgattgcgaggctggactgctcgtcgagctggtgctcaagttacagccacaagtttacagcccaggggactatatctgcaaaaagggagatatcgggagagagatgtacatcataaaagagggaaaactcgccgttgtggctgatgacggggtgacgcagtttgtggtgctgtctgatggcagttactttggcgagatctctatcctgaatatcaaggggtccaaggccggcaacagacgtactgctaatatcaaaagcattggttatagtgacctcttttgtctttctaaggacgacctgatggaggccctgacggaatacccagatgccaagacgatgttggaggaaaagggcaagcagatactaatgaaggacggacttctcgatttaaacatcgccaatgcaggcagcgatccaaaggacctcgaagagaaggtgaccaggatggagggatcggttgatcttctacagacacggttcgcgcgaatcctggcggaatacgaatccatgcagcaaaaactgaagcagcgccttacaaaggtcgagaaatttttgaagcctcttatagatactgagttttccagcatcgaaggacctggcgccgaaagcggccccatcgattccacatag

SEQ ID NO: 184181 - DNA, 300 bp, Artificial Sequence
  Description of Artificial Sequence: Synthetic coding sequence
atgaagctgagcatgaagaacaacatcatcaacacccagcagagctttgtgacgatgcccaatgttattgtccccgacatcgaaaaggaaattagaaggatggagaatggggcttgcagctcgttctccgaggatgacgactctgcatctacatccgaggagtcagagaacgaaaatccacacgcacggggaagtttctcgtataagagtctacgaaagggaggtcccagccaacgcgagcaatatcttcccggggcaattgcactgttcaacgtcaataattctagcaataaggattag

SEQ ID NO: 184182 - DNA, 2073 bp, Artificial Sequence
  Description of Artificial Sequence: Synthetic coding sequence
atgaagctgagcatgaagaacaacatcatcaacacccagcagagctttgtgacaatgccaaatgtgatcgtaccagacattgaaaaggagataagacggatggagaatggcgcttgcagtagctttagcgaagacgacgatagtgcttctacttccgaagaatctgaaaacgagaatccacacgcccgtggctcatttagctataaaagcctgcgcaaaggagggccatcccagagggaacagtatctccctggcgcaatagcactcttcaacgtgaataattctagcaataaggaccaggaacccgaagagaagaagaagaagaagaaggaaaaaaagtcaaaatcagatgataaaaatgagaacaagaatgacccagaaaaaaagaagaaaaagaaggacaaggagaagaagaaaaaggaggagaaaagtaaagacaaaaaggaggaggagaagaaagaggtcgtggtgattgaccccagcggcaatacttactacaactggcttttctgcataaccttgcctgtgatgtataactggaccatggttatagccagagcgtgttttgatgagttacagtcagactaccttgaatattggctgatcctcgattacgtgtccgacatcgtgtacctaattgacatgttcgtcagaacccggactggttacctagagcagggcctgctggtgaaagaagagctaaaactgattaataaatacaagagcaacttacagtttaagctagacgtgctgagcctgattcccaccgatctactgtacttcaagctgggctggaattaccccgagatcaggctcaacaggctcctccgattcagccggatgtttgagttttttcagcgcaccgaaactcgcacaaattatcccaatatcttccgaattagcaatttggtgatgtatatcgtgattattatccactggaatgcttgtgtgttttacagcatctccaaggccatagggttcgggaacgacacttgggtgtaccccgatataaacgaccccgagtttggcagactggctcggaaatatgtgtatagcttgtattggagcacgctcacactgacgacgattggggaaactccaccacctgtccgagatagcgagtacgtcttcgtcgtggttgattttctaataggtgtcctcatttttgcaactattgtcgggaatatcggatccatgatcagcaatatgaacgcggcccgtgcggagttccaggcacgcatcgatgcgatcaaacagtatatgcattttaggaacgtttcaaaggacatggagaagagggtgattaagtggttcgactacctgtggaccaacaagaaaactgtcgatgagaaggaagttctcaagtacttgccagataagcttcgtgcggagatcgcaattaacgtccaccttgacactctgaagaaagtgcggattttcgccgattgcgaggccggcctgctggtggaactcgtactgaaacttcaacctcaggtgtattctcccggcgattatatttgcaaaaagggggacatcggccgagaaatgtacattattaaggaaggaaagctagcggttgtggccgatgacggagtcacacagtttgttgtcttgtcagatggttcctattttggcgagatatcaatcctcaacatcaaaggtagcaaggccggaaaccgacgaacagctaacatcaagtcaatcgggtattcagatctattctgtctcagtaaggatgacctaatggaggcactgacagaatatcccgatgctaagacgatgctggaagagaagggcaagcagatccttatgaaggacggactgctggacctaaatatcgcgaacgccggcagcgaccctaaggacctcgaagagaaggtgacgagaatggaaggatcagtggatctgctgcagacgcggttcgccaggatactggcagagtacgagagcatgcaacaaaagctgaaacagcggctgacgaaagtggagaagttccttaagcccctcattgacacagaattctcttctattgaagggcctggcgctgaatctggccccattgactctacttag

SEQ ID NO: 184183 - DNA, 1995 bp, Artificial Sequence
  Description of Artificial Sequence: Synthetic coding sequence
atgaccgagaagaccaacggcgtgaagagcagccccgccaacaaccataatcatcatgcaccccccgcgatcaaggcaaacgggaaagatgatcaccggacatcttcgagaccgcattccgctgctgatgatgacacatcttctgagttgcaaagacttgctgatgtagatgcgccccaacagggccgctcggggtttcgccggatagttcgcctagtgggcataattagagagtgggccaacaagaactttcgcgaggaggaaccccgccccgatagctttttagagaggtttagggggcccgaactacagactgtgacaacccaggagggggacggaaagggggacaaggacggggaggataagggaaccaaaaaaaaatttgaattatttgtactggatccggcgggggattggtactactgttggctgttcgtgatcgctatgcccgttctttacaattggtgcctgcttgttgcccgggcctgtttctccgacctgcagaaggggtactacctcgtgtggctggtcctagactacgtgagcgatgtggtgtacatcgccgacctcttcatccgcctccggaccggcttcttagagcagggattattagtgaaggatacaaaaaagttaagagataactatatacatactcttcagttcaaacttgatgttgcatctattattcctacggatctgatctatttcgccgttgacatccactcaccagaagttcggtttaatcgcctgctgcacttcgcgcggatgtttgaatttttcgaccgcactgagactaggaccaattaccccaatatattcagaatatcaaatttggtgctgtacattctggtgatcatacactggaacgcttgcatctattacgccatctctaagtcaatcggttttggtgtggacacctgggtgtatccaaacatcacagatcccgaatacggctacctagctagggagtatatatactgcctctattggagcactctgacactgacaaccattggggagactcccccccccgtgaaggatgaagagtacttatttgttatctttgattttctgataggcgtgctgattttcgccactatcgtgggcaacgtcggttcaatgattagcaacatgaatgcgaccagggcagaatttcaagccaagatcgacgccgtcaagcactacatgcagtttcggaaggtgtcgaaagggatggaggctaaggttatacgatggtttgattacttatggaccaataagaaaacagtcgatgaacgggaaatcttgaaaaacttgccggccaaactgcgcgccgaaattgctattaatgtacatctgtctacgcttaaaaaggtgaggatctttcatgactgcgaggcaggccttctcgtggaactggtactgaaactgagaccacaggtcttcagccctggcgactatatatgtcgcaagggggacatcggcaaggagatgtatattattaaagagggaaagctcgcagttgtggccgacgacggggtaactcagtacgcactcttatccgccgggtcttgttttggtgagatctccatcctgaacattaaaggatccaaaatggggaacagacgcactgccaatatcaggagcctgggctattctgatctgttttgtctttcaaaggacgacctgatggaggccgtaacagaatatccagatgctaagaaggtattagaggagcggggcagagagattctgatgaaagagggcctgctggacgagaatgaggtggccaccagcatggaggtggacgtgcaggagaaactagggcagttggaaactaacatggagacattgtatacaagatttggccgcttactcgctgaatataccggggcccagcagaaactgaaacagcggatcacagtgttggagacaaaaatgaaacagaacaatgaagacgattacttaagcgacggcatgaactctcctgaattggccgccgcagatgaaccatag

SEQ ID NO: 184184 - DNA, 2085 bp, Artificial Sequence
  Description of Artificial Sequence: Synthetic coding sequence
atggccaagatcaacacccagtacagccaccccagccggacccacctcaaggttaaaacgtccgatcgggatctcaacagagcggaaaatggtctctcgagagctcactcttcatcagaggagaccagttctgtgctgcagcccggcatcgccatggaaacccgaggtttggcagacagtggtcagggtagctttactggccagggcatagccaggctgtcacgcctgatctttctgctgagaagatgggccgcacgccacgtacaccatcaagatcaggggcctgactccttccctgaccgcttccgcggcgcagaactcaaagaagtgagctcacaggaatccaacgcccaggcaaatgtggggtcacaggagcctgccgatagagggcggagtgcttggcctttggccaaatgcaacacgaacacatcaaacaacacagaagaagaaaaaaaaactaagaaaaaagatgcaatagtggtggatccatcaagtaacttgtactaccggtggttgacagccatcgctctgcctgtgttctacaactggtacttgctcatctgccgggcttgtttcgacgagttacagagtgaatacctcatgctatggctggtcctggattactctgcagatgtactgtacgtacttgatgtgttagtccgtgccagaactgggttcctggagcaggggcttatggtctctgacactaataggttgtggcagcattataaaacgactacccaatttaagctcgacgtactgtcccttgtgccaacagatctggcttatttaaaggtgggtacaaactatccggaagttcgcttcaataggctcttgaagttttcccgactatttgagttctttgaccggaccgaaacccgcactaactatcccaacatgttcagaatcggtaacctcgtactatacatcctgattattatccactggaacgcctgcatttactttgccatttctaaatttatagggttcggaacagacagttgggtttacccgaacattagcatccctgaacacggacggctgagcagaaagtacatctactccttgtattggtccactctgacattgactactattggcgagacccccccacctgtcaaggacgaagagtatctgtttgtggtggtagacttcctggtgggggtgctgatcttcgccaccattgtgggcaatgtagggagcatgatttctaacatgaacgccagccgcgccgaatttcaggcaaagattgattctatcaagcagtatatgcaatttcgaaaagtgaccaaggatctagaaaccagggtcatccgctggtttgactacctctgggcaaataaaaaaaccgtcgacgagaaggaggtgctgaaatccttgcccgataagctgaaagccgaaatcgccattaacgtgcacctggatacactgaagaaagtgcgtattttccaagactgtgaggcaggactattggttgagctcgtcttgaagctaaggcctaccgtgtttagtccaggagactatatctgtaagaaaggcgatatcggcaaggagatgtatatcattaacgagggcaagttggcagtagtggccgatgacggtgtgactcaattcgtggtgctatctgacggttcatattttggagaaatcagcatcctgaatatcaaaggctcaaagtctgggaaccgccgtactgcaaatatccgaagtatcggctattcagacctgttttgcttgtccaaagatgacctgatggaggctctgacagagtaccctgaggccaagaaggctcttgaggaaaagggtcgccagatccttatgaaggataacctgatcgacgaagaactggcaagggccggcgctgacccgaaggacttagaagagaaagtcgagcagttggggagtagcctggacactcttcagacccggtttgcaaggctccttgccgagtacaatgctacccagatgaagatgaagcaacgcctcagccagctggagagtcaggtgaagggtggtggcgacaaacccctggcggatggagaagtcccaggcgatgctacaaagacagaagataaacaacagtag

SEQ ID NO: 184185 - DNA, 2085 bp, Artificial Sequence
  Description of Artificial Sequence: Synthetic coding sequence
atggccaagatcaacacccagtacagccaccccagccggacccacctgaaggtaaaaacttctgacagagacctgaacagggcggaaaatggactgagcagagcccactctagcagcgaggaaacctcctccgtgcttcaacccggaattgctatggagacccgcggcctcgcggactcaggacagggatcattcacagggcagggaattgcgaggctgtctcgtctgatattcctgttgcggcggtgggccgctcgccacgtccaccaccaggatcagggacccgatagttttcccgatcggttcaggggcgccgaattaaaggaggtctcctctcaagagtccaatgcccaggcaaacgttgggtcccaagaacccgctgaccgtgggcgatccgcttggcctctcgctaagtgcaataccaacacttctaacaacacagaggaggagaaaaagaccaaaaagaaggacgctatcgtggtcgacccgagctccaatttatactatagatggctcactgcaatagccttacctgttttttataattggtatcttctaatatgtcgcgcatgcttcgatgaactgcaatctgaatacctcatgttatggctggtcctggattattcagctgatgtgctttatgtcctcgacgtgctggtcagggctcggactgggttcctggaacaaggactgatggtgtcagacaccaatagactatggcaacattacaagacaacaacccagtttaagctggacgttttgagccttgttcccaccgatctagcatacttaaaagtggggacaaattaccctgaggtgcggtttaaccgcctgctgaaattctcaagattatttgaattctttgacaggaccgaaactagaaccaactatccaaacatgttccgaatcggaaatctggtgctgtacatcctgatcattatacattggaatgcttgtatatattttgccatctcgaagttcataggctttggcacagactcttgggtgtatccaaacatttcaattccagagcacggcaggttgtcgaggaaatacatttattcactgtactggtcaaccctcaccctgacaactatcggagagaccccacctcctgttaaggacgaggagtacttatttgtcgtcgtcgacttcctggttggcgtcttgattttcgcaactatcgtgggcaatgtggggtcgatgattagcaatatgaacgctagccgagcagagtttcaagcaaagatcgatagtataaaacagtatatgcagtttcggaaggtgacaaaggacctggaaaccagggttatccgatggtttgactacctatgggctaataaaaagaccgtcgacgagaaagaggtactaaaatctctaccagataaattaaaggccgagatagcgataaacgttcatctggacacccttaaaaaggtccggatctttcaagactgcgaagcaggcctgttagttgaactggtgctcaaacttaggcccacagtttttagccccggagactatatttgcaaaaagggagacatcggcaaggaaatgtatatcataaatgagggcaaactggctgtggtggcagacgatggagtgacgcaattcgtggtcctgagtgacggttcctattttggtgaaatatccattctaaacattaaagggtccaagtctggcaatcgtcgtacagccaacatacgcagtattgggtactccgatcttttttgcctaagcaaggatgacctgatggaagccctgactgaataccccgaggccaaaaaagctttagaggaaaaaggccgccaaatcctcatgaaggataatctgatagacgaggaactggcaagggcaggtgcagacccgaaggatctggaagaaaaagtggagcagctcggttcctcccttgacactctgcagacaagattcgcccgtttgcttgctgaatacaatgccacacagatgaagatgaaacagcgcctcagtcagctggaatcccaggtgaaagggggaggcgacaaacccctggccgatggtgaggtgccaggagacgcaacaaaaactgaggacaaacaacagtag

SEQ ID NO: 184186 - DNA, 2031 bp, Artificial Sequence
  Description of Artificial Sequence: Synthetic coding sequence
atggccaagatcaacacccagtacagccaccccagccggacccacctgaaagtcaaaacaagcgacagggatctgaaccgggcagaaaatggcctgtcccgcgctcactcttcttccgaagaaacctcgtctgttttgcagcccggcatagccatggaaaccagaggccttgctgattcagggcagggatcctttaccggccagggcattgcaagactgtcccgactgattttcctgctgcgaaggtgggccgctagacacgtccaccaccaggatcagggccctgactccttccctgaccggtttcgcggagccgagctgaaagaggtctcatcccaggaatccaatgcacaagctaatgtcggatcgcaggagcctgccgatcgtggcagaagaaagaaaacgaaaaagaaagacgctattgtcgtggatccgagtagtaacctttactaccgctggttaactgcaattgctctgcccgtgttttacaattggtacctgctcatctgtagggcatgcttcgacgagcttcagagtgaatatctgatgctgtggctagtgcttgattactcggcggatgttctctatgtgctggacgtgctggtgcgggctaggacgggctttctcgaacagggcctgatggttagtgatacaaatagactctggcaacattacaagaccacaactcaattcaagctggatgttttgagcctggtgccaaccgacctcgcgtatttgaaagtaggaaccaattatcccgaggtccgctttaataggctgctaaaattttcccgcttgttcgaatttttcgatcgtacagagacgcggactaactaccccaatatgttcagaatagggaacttggtcctgtacatcttaatcattatccactggaatgcttgcatttacttcgccataagtaaatttatcgggtttggtaccgactcttgggtttacccaaacataagcatcccagaacacgggaggttgtccagaaagtacatctacagcttatattggtctacactcacactaaccaccattggggagaccccccctccggttaaagacgaagaatacctgtttgtcgtcgtggattttttggtcggagtgttgatctttgcaacgatcgtcggcaacgtaggttcgatgatttcgaatatgaacgcatctcgagcagagttccaagccaaaatcgatagcataaaacaatacatgcagtttagaaaagtaaccaaggacctggagacgcgagtcatccgttggtttgactacttgtgggccaacaagaagactgtagatgagaaagaggtcctgaagtctctccctgataaactgaaagcagaaatcgcaatcaacgtccacttagacacgttgaaaaaagtgcgtatattccaggattgcgaggctggactactggttgagctcgtgctgaagctgcggcctactgtctttagccctggagactacatctgtaagaagggcgatatcggcaaggaaatgtacattattaatgagggtaagctggccgtcgtggctgatgacggcgtgacgcaattcgtggtactgtcagacggaagttattttggcgaaatatctatcttgaatataaagggctctaaatctggcaaccgcagaactgccaacatcaggagcataggctacagcgacctattctgcctgtcgaaagacgaccttatggaggctcttactgagtacccggaggccaagaaggcccttgaagagaaaggaaggcagatcctgatgaaagacaatctcatcgacgaggagctggcccgggctggggccgatcctaaggatttagaagaaaaagttgagcagctggggtcttccttggacacactgcagacgcggttcgcccggttgctggcggaatacaatgccacccagatgaaaatgaaacagcggctctcgcagctagaaagccaggtgaagggcggtggagacaagcccctggccgatggtgaggttcccggcgatgccaccaagacagaggacaagcaacagtag

SEQ ID NO: 184187 - DNA, 3756 bp, Artificial Sequence
  Description of Artificial Sequence: Synthetic coding sequence
atgctgggctgggtgcagcgggtgctgccccagccccccggcaccccaagaaaaacgaagatgcaagaagaggaagaagtcgaaccggagcccgagatggaagctgaagtggagcccgaacccaaccctgaagaggccgaaaccgagtcagaatcaatgcccccagaggaatccttcaaggaggaagaagtagccgtggccgaccctagcccccaggaaaccaaggaggctgccctgacatctactatatctctacgggcccaaggggccgagatttccgagatgaacagcccctcgcggagagtgctgacttggctgatgaagggcgtggagaaagtgattcctcaacctgtccactctatcactgaagacccggcccagattttgggacatggaagcaccggcgacaccggctgtacagatgagccaaatgaggctttagaggcccaggacactaggccgggcctcaggctgctgttgtggctagaacaaaatctggagcgggtattgccccagcccccgaaaagctctgaggtttggagggacgaaccggccgtggccacaggggctgcttctgatccagccccaccagggaggcctcaggagatgggccctaagctccaagcaagagagacccccagcctgcctacgcctatcccgctgcagcccaaggaagaaccaaaggaagccccagctccagagccgcaaccaggctcgcaagctcagacctcctcgctaccaccaactcgagaccccgccaggctggttgcttgggtcttgcatcggctcgagatggcgttgcctcaacccgtactgcatggcaagatcggcgaacaggaacctgactcaccaggaatctgtgacgttcagactattagcatactgcctggcgggcaggtcgagccggaccttgtgctcgaggaggtggagccaccttgggaagatgcacatcaggacgtctccaccagtcctcagggtacagaggtggttccggcttatgaagaggagaataaagctgtagagaagatgccgcgtgagctttcgaggattgaggaggagaaggaagacgaagaagaggaggaagaagaagaagaggaagaggaggaagaagaggtgactgaagtactgctcgattcttgtgtagttagtcaggtcggtgtcgggcagtctgaagaggatggcacacgcccccagtcaaccagtgaccagaaattgtgggaggaagtgggggaggaggccaagaaggaagcagaggagaaggccaaagaggaagccgaagaggtggcagaagaggaagccgagaaggaaccacaggactgggccgagacgaaagaagagcccgaggccgaggccgaggccgcctctagtggtgtgcccgcaaccaagcagcaccctgaggtgcaggtggaggacactgacgccgacagctgtcctctgatggcagaagagaaccccccttccaccgtgcttccccccccttctcccgcaaaaagtgatacactcatcgtcccttcgtccgcgtccggaacacatcggaagaagctgccgagtgaagacgacgaagcagaagagcttaaagccctgtccccagccgagagccctgtggtggcttggtccgacccaacgacccctaaggatactgatggccaagaccgtgccgccagcactgcaagcactaacagtgcaatcataaatgaccgtctgcaggagcttgtgaaactctttaaggaacgaactgaaaaggtaaaggaaaagctgattgacccggacgtaacaagtgatgaagagagtcccaagccttctcccgccaaaaaagcccctgagccggccccagatacaaaacctgcagaggccgagccagtggaagaagagcactactgcgacatgctgtgctgtaaattcaaacaccgcccctggaagaaatatcaattccctcaatcaattgatcctcttacgaacttgatgtacgtgctttggctgtttttcgtagttatggcttggaactggaattgttggctgatcccagttcgttgggctttcccgtaccagacacccgataatatccatcattggctccttatggactacctgtgcgacctgatctacttcttggacatcaccgtttttcagactaggttgcagttcgtaaggggcggagacattatcacggataagaaggacatgcggaacaattatctgaaaagcaggcgctttaaaatggaccttctttccctgcttccactggacttcctctacctaaaggtgggggtgaacccccttctccggctgcctcgctgcttaaagtacatggctttcttcgagttcaatagccgtctagaatctatcctgtccaaggcctatgtctatcgagtcattagaactactgcctaccttctgtattcgctgcaccttaactcttgcttatattattgggcttcagcttatcagggacttggctctacacactgggtctatgatggagtgggcaatagctacattcgctgttattacttcgcagtcaaaactctgatcacaattggaggactgcccgaccccaaaacactctttgaaatagtctttcagctgctcaattatttcaccggggtattcgctttctctgtgatgataggtcaaatgagagacgttgttggggccgccacagctgggcaaacctattacaggagctgtatggactctacagtgaaatatatgaacttctataagatccccaagtctgtccaaaatcgcgtgaagacatggtacgaatacacctggcactcacagggcatgttggatgaaagtgagctgatggtccaactccccgataaaatgcgcttggacttggccattgacgtcaattataatattgtgtcaaaggtggctctgtttcagggctgcgaccggcagatgatcttcgacatgcttaagaggttgcgtagcgtggtttacttgcccaatgactacgtgtgtaaaaagggtgaaataggaagagaaatgtacatcatccaggctggccaggtgcaagttctgggcggtcctgatggaaagagcgtcctagttacactcaaggccggcagcgtgttcggagagatctctttgcttgcagtcggcggcggaaaccgacgcactgctaatgtggtggcccacgggttcacaaacctttttatactcgacaagaaagatctgaacgaaatacttgtgcactatccagaaagccagaaacttctccgaaagaaggcgcggcgcatgctccggtctaataataagcctaaggaggagaagtctgtcctcatccttccgcctagggctggaacgcccaagctctttaacgcagccctggccatgacaggcaagatgggtggtaaaggcgccaaaggcggaaaattggctcatctgagagcccgactgaaggaactagccgctctggaggcagccgccaaacagcaggagctggtggagcaagccaaatcatctcaggatgtgaaaggggaggagggttccgccgcacccgatcagcacacacatcctaaggaagctgcaaccgacccgccagcaccccggaccccccctgagcctcccggttccccaccttcttcccctcctcctgcgtctttggggaggcccgagggagaagaggaggggcccgccgagcctgaggagcattccgtgcggatctgtatgagtccgggcccagagcctggagagcagattcttagcgtcaaaatgcctgaggagcgggaagagaaggcagagtag

SEQ ID NO: 184188 - DNA, 900 bp, Artificial Sequence
  Description of Artificial Sequence: Synthetic coding sequence
atgctgggctgggtgcagcgggtgctgccccagccccccggcacccccagaaaaactaagatgcaagaggaggaggaagttgaacctgagcccgagatggaggctgaggtggaacctgaaccaaacccggaggaagccgaaactgaaagtgagagcatgccacccgaagaaagctttaaagaggaggaggtcgcggtggccgatccctctccgcaagaaactaaagaagccgcactcacttctaccatttctctccgggctcagggagccgaaataagtgagatgaactccccctcccgccgcgtgcttacgtggctaatgaaaggagtagaaaaggttatcccccagcccgtgcactcaatcaccgaagaccccgcccagattctgggtcacggaagcacaggagatacaggctgcacagatgaacctaatgaggcattagaagcccaggatactaggccaggtttacgcctcctcttatggctggagcaaaacttggagagagtgctgccccagccgccaaagtccagtgaggtttggcgcgacgagcctgcagtggccacgggcgcagccagcgacccggctcctcctggcaggcctcaggagatgggacctaaactccaggctcgggagacacctagtctgccaacccctatccctttacaaccaaaggaagagcctaaggaggcaccggccccagagccccaacctgggagtcaggctcagaccagctccctcccacctacaagagatccggccagattggtggcctgggtactccaccgtctcgagatggcactgccccagccggtcctccacggaaagattggcgagcaagaacccgacagccccggtatatgtgatgtgcaaaccagagtgatgggggcaggaggcctgtag

SEQ ID NO: 184189 - DNA, 2430 bp, Artificial Sequence
  Description of Artificial Sequence: Synthetic coding sequence
atgttcaagagcctgaccaaggtgaacaaggtgaagcccatcggcgagaacaacgaaaatgagcagtcatccagaaggaatgaagagggctcccatccttctaaccaatcccaacagactaccgcgcaggaggagaataaaggagaggaaaaaagtctgaaaacgaaaagcactccggtcactagcgaggagccgcacactaacatccaggataagctcagtaagaaaaactcaagcggagatctcaccactaatcccgatccacagaacgccgcagagcctaccgggactgtgccagaacagaaggagatggaccctggaaaggaaggcccgaacagcccacaaaacaaaccccccgccgcccccgttatcaatgagtatgccgacgcccagctccacaatctagtaaaacggatgaggcagagaaccgccctatacaaaaagaaactggtggaaggcgatctgtccagtcctgaggcttcgccgcagactgctaagccgacggccgttccccccgttaaagagtcggatgacaaacctactgaacactattacaggctcttgtggtttaaagtaaagaagatgccactcaccgagtaccttaagaggataaagctgcctaattctatcgacagctacaccgataggctgtatctgctgtggcttctcctggtgactctggcctacaactggaactgttgctttattccattgcgtcttgtgtttccttaccagacagctgataatatacactactggttgatcgctgatatcatctgtgatattatttatttatacgacatgctgtttattcagccacgcctgcagttcgttcggggaggggatatcatagtggacagtaacgagctaagaaagcattatcgcaccagcactaagtttcaactggacgtggcgagtattattccctttgatatctgttatctcttctttgggttcaaccctatgttcagagctaatcgcatgctgaagtacacttctttttttgaatttaatcatcatctggagtccataatggacaaggcctacatctaccgtgtcataaggaccaccgggtatcttctgtttatcctacacattaatgcatgcgtctactactgggcctcgaattatgaagggatcgggacaactagatgggtgtatgatggagaaggcaacgaatacttacggtgttactattgggcagtcagaaccctcatcactatcggcggcctaccggaacctcaaaccctgtttgaaatcgttttccaactcctcaatttcttcagtggggtcttcgtgttttccagcttaatcggccagatgcgagatgtgattggggcggccactgcgaatcagaattattttagggcgtgtatggatgacacgattgcctatatgaacaactatagtataccgaagctggttcagaagagggtccgcacatggtatgagtatacctgggactcacaacgtatgttggatgagagcgacctactgaaaacactgcccaccaccgtccagctggcattggcaatcgatgtgaatttttctatcatcagtaaagtggatctgtttaaaggatgcgatactcagatgatatatgacatgttgctgcggctgaaaagcgtcctttatctgccaggggattttgtgtgtaagaagggagaaatcgggaaggaaatgtatatcatcaaacatggcgaggttcaagtacttggcggtcccgacggcactaaagtgttggtcacactgaaagcaggtagcgtcttcggcgaaatctcgttgctggctgcggggggcggaaatcgacggactgccaatgtagttgctcacggatttgccaacctcctaaccctagacaagaaaacgctacaagaaatactcgtgcattatcccgatagcgagaggatcctgatgaagaaagcacgggttcttttaaagcagaaggccaaaaccgccgaggcaacccccccgcgtaaggacctagcactcctgtttccacccaaggaggaaacacctaagctctttaaaacgctgctcgggggcaccggcaaggccagtctggcaagactcttgaagttgaagagagaacaagcggcccaaaagaaagagaactccgagggcggagaagaagagggaaaagagaatgaggataagcagaaagaaaacgaagataagcagaaagagaatgaggacaagggcaaggaaaatgaggacaaggataaaggtcgggaaccagaagagaagccactagacagaccagagtgtactgctagcccgatcgcagtggaggaagagccacacagcgtgcggcggacagtcctgccccggggtaccagtaggcagtcactgatcatctccatggctccttccgccgaggggggggaagaagtgctgaccatagaggtgaaggagaaagcaaagcagtag

SEQ ID NO: 184190 - DNA, 4188 bp, Artificial Sequence
  Description of Artificial Sequence: Synthetic coding sequence
atgctgctgcccctgcccccccagagcagcaagcccgtgcccaagaagtcacagagtagcaaaatcgtgccctcccatcatgatcctagcgagaagaccggtgaaaattgccagaccaaaatatctccatcatctctccaagaatcaccttctagcctgcagggagctctgaaaaaaagaagcgcctttgaggatctcactaatgcgagtcagtgtcagcctgtacaacctaaaaaagaggccaacaaggagtttgtgaaggtcgttagtaagaaaatcaaccgtaacacacacgcgctcggattagctaaaaaaaacaaaaggaatctgaagtggcataagctggaggtgacaccagtcgtggcctccacaactgttgtgccaaatattatggagaagcctcttattctggacattagtaccacctctaaaacacccaatacagaagaggcaagcctttttaggaagccactggtcttgaaagaagagcccacaatcgaagatgaaacactaattaataaatcactgtcccttaaaaaatgtagcaaccatgaggaagtgtccttattggaaaaattacaacctctgcaggaagaaagcgactccgatgacgccttcgtaatcgaacctatgaccttcaaaaaaactcataaaacggaggaggcggcgatcactaaaaaaaccttgtctttgaagaaaaagatgtgcgcgagccaacgcaagcaatcatgccaggaagaaagcctagccgtccaggacgtgaacatggaagaggactctttctttatggagagcatgtcgtttaagaaaaagcctaagaccgaggaatccattccaacccataaattgagctccctcaaaaaaaaatgtaccatctacgggaagatttgccattttcgaaagcctcccgtgttacaaaccaccatttgtggtgctatgtcctccattaaaaagccaaccacagagaaagagacgttattccaggagctgagcgtgttgcaggagaagcataccactgagcatgaaatgtctattcttaaaaaatccctagcccttcaaaagacaaactttaaggaggactcactcgtgaaggagagtctggcctttaaaaaaaagccgagcaccgaggaagcaatcatgatgccggtgatactgaaggaacagtgtatgacagaagggaaacgatctagactcaaacccctggtactgcaggaaatcacctcaggggagaaatcactgataatgaaaccactcagtattaaggaaaaacccagtacagaaaaggaatcattctcacaggagccctctgctctgcagaagaaacacacaacccaagaggaggtgagtattctgaaggagccatcatccctgcttaaatcccctaccgaggaatcacccttcgacgaagctctggcattcacaaagaagtgtacaatagaggaggcccctccaactaaaaaaccattgatccttaaacggaagcacgcgactcaaggaactatgtcccacctgaagaaaccccttattctgcaaactacatctggggaaaaaagcctcatcaaggaacccctgccttttaaggaggaaaaggtcagtctcaagaagaaatgcactacacaggagatgatgtccatctgccctgaattgctggactttcaagatatgattggcgaggataaaaactccttttttatggagcccatgtcttttagaaagaaccctaccactgaagaaaccgtactgactaagaccagtctatcccttcaagaaaaaaagatcacgcagggtaaaatgtcgcacctgaaaaagcctctcgtgctacagaaaatcactagcgaggaagaatctttctacaagaaattgttgccatttaaaatgaaatccactaccgaagaaaagtttttgtcacaggagcctagtgccctgaaagagaaacacaccactctgcaggaggtgtccctgtccaaagaatccctggccattcaggagaaagcgacaacagaggaagagttctcccaggagctgttcagcctccatgtgaagcataccaataaatctggaagcctcttccaagaagcgctagtcctgcaagagaagactgatgcagaggaggacagcttaaaaaaccttcttgctctgcaggagaagtcaacgatggaggaagagtctctaatcaacaagctcctcgccttaaaggaggagctcagcgcagaagcagcgactaatattcagacacaactctcccttaagaagaaaagcacctcacacggaaaagtattcttcctgaaaaaacaactagcactgaatgaaacaatcaacgaggaggagttcctgaacaagcagccccttgccctggaggggtacccttcaatagccgaaggtgaaacactgttcaaaaagttgttagccatgcaagaggaaccttcaattgagaaagaagctgtgctgaaggaaccgactattgatactgaagcacactttaaagagcctctggcgctgcaggaggagccatctaccgaaaaggaagccgttctgaaggagcccagcgtggatactgaagctcactttaaggagactctagcgctgcaggagaagccctcgattgagcaggaagcgctattcaagcgccattctgctctctgggaaaagccttccaccgaaaaggaaactatctttaaggagtcattggatttgcaggaaaagcccagtattaaaaaagagaccctgctgaaaaagccactggccttaaaaatgtcaactattaatgaggcagtacttttcgaggacatgatcgcactgaacgagaaacctacaacagggaaagagctgagctttaaagagccactcgccctgcaagagagcccaacgtataaagaggatacatttctgaaaactctgctagtcccccaagtgggtactagcccaaatgttagctctacagcccccgagagcataacctcaaagagcagcatcgccaccatgacaagcgtgggcaaatctggtaccatcaacgaagcattcctcttcgaggacatgattaccctcaatgaaaagccgaccactggaaaggagttgtcatttaaagaaccacttgctctgcaggagagtcccacatgtaaagaagataccttcctggagacattcttgattccccaaattgggacttctccttacgtgtttagcacgaccccagaaagcataacagagaagtcctccattgccacaatgacctctgttggtaagtcgcgaaccaccaccgaatcctcagcctgcgaaagcgcatctgacaagcccgtgagccctcaagccaaaggaactcctaaagaaataacaccaagggaggatatagatgaagattctagtgacccatctttcaaccctatgtacgctaaggaaattttctcttacatgaaggagcgcgaagagcaatttatattgaccgattatatgaaccgccagattgagatcaccagcgacatgcgcgcaatcctggtggattggctagtggaggtacaggtgagtttcgaaatgactcatgaaaccctctatctagccgtcaaattagttgacctttacctcatgaaggccgtgtgcaagaaagacaaactacaactgctgggcgccaccgcgttcatgatcgctgcaaagttcgaggagcataactctccccgggtggatgatttcgtgtatatctgtgatgataattatcaaagatctgaagttctgtccatggagatcaatattctgaatgtgctaaaatgcgacattaatattcccatcgcctatcacttcctgcgcaggtatgcccggtgcatccacacgaacatgaagaccctcactctgagtagatacatctgcgagatgacactccaggagtatcactacgtccaagagaaagcatccaaactggcagccgctagcttgcttctcgccttatatatgaaaaaactgggttactgggttcccttcctagagcactattctgggtacagcatatcggagctccatcccctggtgcggcagctgaataaattattgaccttctcaagttatgattcccttaaggctgtgtactataaatattcgcatccagtgtttttcgaggtggccaaaattcctgcacttgacatgctcaaattagaagagatcctcaattgcgactgcgaagcccagggcctagtgttatag

SEQ ID NO: 184191 - DNA, 876 bp, Artificial Sequence
  Description of Artificial Sequence: Synthetic coding sequence
atgctgctgcccctgcccccccagagcagcaagcccgtgcccaagaagtcccaaagcagcaaaatagtcccttctcaccatgatcccagcgagaagaccggggagaactgtcagaccaagattagcccctcttcactccaggaatctccaagttctctgcaaggagcactcaagaagagaagcgcattcgaagacctcaccaatgtttccttcgaaatgactcatgagaccctttacttagccgttaaacttgttgacctttacctgatgaaagccgtgtgtaagaaagacaagctccagctgctgggggcaactgcgttcatgatcgccgctaagtttgaagagcacaactcccctagagtggacgacttcgtctacatctgcgacgataactatcagagaagcgaagtgctgtctatggagatcaacatcctgaacgtgctaaaatgcgacatcaatattcccatagcctaccacttcctccggcggtacgcgcgttgcattcacaccaatatgaagacgctgaccctctcgaggtacatctgcgaaatgaccctgcaagagtatcattacgtgcaggaaaaggcatccaagttggcggcagcgtctctgttgctggcactttacatgaagaagctcggctattgggtcccttttcttgagcattacagcggctactctatctctgagctgcaccccttggtgcggcagttaaacaaactgctgaccttctcaagctacgatagcctgaaggccgtgtattataagtatagtcaccccgttttcttcgaggtggcaaagatcccagctctggacatgctcaagttagaggagattctcaactgcgactgcgaggctcaaggactggtgctgtag

SEQ ID NO: 184192 - DNA, 876 bp, Artificial Sequence
  Description of Artificial Sequence: Synthetic coding sequence
atgctgctgcccctgcccccccagagcagcaagcccgtgcccaagaagtcccagtcctcaaagattgtgccctcccaccacgacccttcggagaaaactggtgagaactgccagaccaagatctctccaagcagtttacaggagtctccgtccagccttcaaggcgctttgaaaaagcgatccgccttcgaagatctgactaatgtaagttttgaaatgacacacgagactctatatctggccgtgaaacttgttgatctctacctcatgaaagccgtatgtaaaaaggataagttgcagctgctgggtgcaaccgcattcatgatcgctgccaagttcgaggagcataacagtccccgagtggatgacttcgtgtatatctgtgacgataactatcagcggtctgaggtgctgagcatggagataaatattctcaatgtgcttaagtgtgacattaacatcccgatcgcataccattttctgcgccgctatgccaggtgtattcacactaacatgaagaccttaactttgagcaggtacatctgcgagatgactctccaggaataccattacgtccaggaaaaagcgagcaaactagcggcagcctcccttttactggcattgtacatgaaaaaactcgggtattgggtcccattcctagagcattacagtggctattcaatttccgagttgcatcccctggtccgacagttgaataagctgttgaccttttcctcttacgattcactcaaggccgtttattacaaatacagccaccctgtgtttttcgaagttgctaagatacctgctctcgatatgctcaagctcgaagaaatcctcaattgcgattgtgaggcccagggactggttttgtag

SEQ ID NO: 184193 - DNA, 4188 bp, Artificial Sequence
  Description of Artificial Sequence: Synthetic coding sequence
atgctgctgcccctgcccccccagagcagcaagcccgtgcccaagaagagccagtcatctaagatagttccttcacatcacgatccgtctgagaaaacaggagagaactgccagacaaagatttcaccttctagcttgcaagaaagcccaagcagcctgcagggagcccttaagaaacggtcagccttcgaagatctcaccaacgctagtcagtgccagcctgtgcagccaaaaaaggaggcaaacaaggaattcgtgaaggttgtctctaaaaagattaacaggaacacacatgctcttggcctagccaaaaagaacaagagaaatctgaaatggcacaaactagaggtaacccctgtggtggcttccacaaccgtcgtgcctaacattatggagaaacccctcatactggatatttccactacttctaaaaccccaaacacagaagaggcgtccctgtttcggaaacctctggttcttaaggaagagcccaccatcgaggatgagactcttattaacaagtctctgtccctgaagaaatgctctaaccacgaagaggtttctctgctggagaaactgcagccattacaggaagagagcgactcagatgatgcgttcgtgatcgagcctatgacattcaaaaaaacccataaaaccgaggaagccgcaattactaaaaaaactctgtcactgaagaaaaagatgtgcgcaagccagcgaaaacagtcatgccaggaagagagcctggctgtgcaggatgtgaacatggaggaggatagtttctttatggagtctatgagcttcaagaaaaagccaaagaccgaagaaagtatcccaacacataagctgagttccctgaagaaaaagtgcactatatatggcaagatttgccatttccggaagccccctgttctgcaaacaacaatctgtggagccatgtcctctatcaaaaaaccaactacagaaaaagaaactttgttccaggagctgtctgtactccaagaaaaacacactactgaacacgagatgtctatactgaagaagtctctggcactccaaaagacaaatttcaaggaggatagtttggtgaaagagtccttggcttttaaaaagaagccttcgaccgaggaagcgattatgatgccagtgattctgaaggagcaatgtatgaccgagggtaagcggtcacgcttgaagcctctcgtgcttcaggaaataacatccggagaaaaatctttaataatgaaacccctatccattaaagagaagccctcaaccgagaaggagagcttttctcaggaaccatccgcgttgcagaagaagcatacgacgcaggaggaagtctctatcctgaaagagccaagctcacttcttaagagtcctactgaggaatcccccttcgatgaagccttggccttcactaagaaatgtactatcgaggaagccccccccaccaagaaaccgcttattctgaagcggaaacacgccactcaaggaaccatgtcgcacctcaagaaaccattaatcttgcagaccacttccggggagaaaagccttattaaggagcctctcccttttaaggaggaaaaagtgagcttgaaaaaaaagtgcacaacgcaagagatgatgtcaatttgcccagaactactcgacttccaggatatgataggagaggacaagaacagtttctttatggagccaatgagtttcaggaagaacccaacaacagaagagacagtactcacgaagaccagtttgagcctgcaggagaagaaaattactcagggaaagatgagccaccttaagaaacccctcgttctgcagaaaatcacaagcgaggaggaaagcttttataagaagctgttaccgtttaagatgaagtctactacggaggaaaagttccttagccaggagccatcagcattgaaggagaaacataccactctccaggaggtgtcactctccaaggaatctttggcgattcaggagaaagcgaccaccgaggaggagttttcacaggagctcttttctcttcatgtgaaacacacaaacaagtcgggatctctttttcaggaagccctggttctgcaggaaaaaacggatgctgaggaggatagcttgaaaaacctgcttgcgctccaggaaaaatcaacaatggaagaggaatccttgatcaacaagctcttggctctgaaggaggaactcagtgctgaagctgcgactaacattcagacccagctcagccttaagaagaagagcacctcacatgggaaggtgtttttcctaaaaaagcaactagccttaaacgagaccatcaatgaggaagaattcctcaataaacagcctttggcactcgaagggtatccttccatcgctgagggggaaactctgtttaaaaaactgttggcaatgcaggaggaaccatccatcgaaaaagaagcggttcttaaggaacctacaatcgatacagaggcacatttcaaggaacccctggccctacaggaagagccatctacggagaaggaagccgtgctgaaggagcccagcgtggataccgaggcccactttaaggagacgctggcccttcaagagaagccctccatcgaacaggaagccctgttcaagcgacattcagccctctgggagaagccctccacagagaaagagactatattcaaggagtcactggatctccaagaaaagcccagcataaaaaaagagactctccttaagaaacccctggccctgaagatgagcacaattaacgaggcagtcctgttcgaagatatgatcgcccttaacgaaaaacctacgacggggaaggaactgagcttcaaagagccattagcccttcaggagtccccaacatacaaggaagataccttcctgaagacactgttagttccccaagtgggtacctccccaaacgtgtcctctacagcacccgagagcattacttctaaaagcagtatcgctactatgacatccgtgggcaagtcaggcacaataaacgaagcattcctgtttgaagatatgatcaccctgaacgagaaacccacaacaggcaaggagctttcttttaaagaacccttggcactccaggagtcccccacgtgcaaagaggacacgttcctcgagacttttctgataccacaaataggcacctctccgtacgtgttttctacaactcctgaatccattaccgaaaaatcatccatcgcgacaatgacgtcagtcgggaagtctcgcactacaaccgaatcttctgcatgcgagtctgcctcagacaaaccagtgagcccacaggccaagggcacacccaaggagatcactccccgcgaggacatcgacgaggatagcagcgacccatcatttaacccaatgtatgccaaagagattttttcttatatgaaggaacgggaggagcagttcatcctcaccgactatatgaacagacagattgaaatcacaagcgatatgcgggccattctggtagactggctagtggaagtccaggttagctttgagatgactcacgagaccctgtatctggccgttaaactggtagacctctacctcatgaaagcagtctgcaagaaagataagcttcaattattaggagccacagcatttatgatagcagcaaaattcgaggagcataattcgcctcgtgtcgatgatttcgtatacatctgcgacgacaactaccagaggtccgaggtgctttctatggagatcaacattctaaatgtcctgaagtgcgacattaacatcccaatcgcctaccactttctgcggcggtatgcgcggtgtatccacacaaacatgaagactttgactctgagccgctacatatgcgaaatgacactccaggagtaccactatgtccaggagaaggcgagtaagctagcagcggcttctttgctattagccctttatatgaaaaagcttggctactgggtgccttttctagagcattatagtgggtacagcattagtgagctgcaccctcttgttcggcaacttaataagctgctcacattctcctcttatgacagcttaaaggccgtctactataaatattcacaccctgtattcttcgaagtcgccaaaatcccagctctggacatgcttaaactggaggagatccttaactgcgattgcgaagctcaggggcttgtcctctag

SEQ ID NO: 184194 - DNA, 336 bp, Artificial Sequence
  Description of Artificial Sequence: Synthetic coding sequence
atgctgctgcccctgcccccccagagcagcaagcccgtgcccaagaagagccaaagctccaagatcgtgccatcccaccatgacccgagcgagaagaccggtgaaaattgtcagactaaaattagccctagctccttgcaggagagtcctagcagtctccaaggcgcacttaagaagcggtcagcctttgaagatcttaccaatgccagtcaatgtcagccagtgcaaccgaagaaggaagcaaacaaagaattcgtcaaggtagtttcgaagaagatcaataggaacacccatgctcttgggctggcaaagaaaaacaagaggaatcttaaatag

SEQ ID NO: 184195 - DNA, 1083 bp, Artificial Sequence
  Description of Artificial Sequence: Synthetic coding sequence
atggccagcgccaccgcccccgccgccgccgtgcccaccctggccagtccattggagcagctccggcacctggctgaagagcttagactgctgctgccccgggttagggttggtgaagcccaagaaactacggaggagttcaacagagagatgttttggcgacgcctgaacgaggccgcggtgacggtgtctcgtgaagcaaccacgcttacaatcgtattcagccaactgccgctccctagtccccaggagactcagaagttttgtgaacaagtccatgctgctatcaaagcctttatcgccgtgtactatctccttcccaaagatcaaggcatcaccctgcgtaaattggtccgcggtgccacactggacatagtggatggtatggcccagctgatggaagtgttgagcgttactcctacccagagccccgaaaacaatgacctgatcagctacaactccgtttgggtggcctgccaacaaatgccccagattccaagagacaataaagcggccgccctcctgatgctgacaaaaaatgtggatttcgttaaagacgcgcatgaggagatggagcaggcagtcgaagagtgtgatccctatagcggtcttctcaacgataccgaagagaataattctgataaccacaaccatgaagacgacgtgttaggattcccttccaaccaggacttgtattggagcgaggatgaccaggaactgattatcccttgcttggcactcgtacgcgcctccaaagcctgcctgaaaaaaattcgtatgctcgtcgccgagaacggaaaaaaagatcaggtggctcagcttgatgatattgtcgacatttcggatgaaatctcaccaagcgtcgatgacctggctctgagcatctatccaccaatgtgccatttgactgtcagaatcaactccgctaaactcgtgtctgtcctcaagaaagccttagagatcaccaaggcaagtcacgtcacacctcagccggaagactcgtggatcccccttctgatcaatgctatcgaccactgtatgaaccgcatcaaggaactgacgcagtcggagttggaactttag

SEQ ID NO: 184196 - DNA, 600 bp, Artificial Sequence
  Description of Artificial Sequence: Synthetic coding sequence
atgccccagatcccccgggacaacaaggccgccgccctgctgatgctgacgaagaatgtggacttcgtcaaggatgcacacgaagagatggagcaggcggtagaggaatgcgatccgtattctggcttactgaatgacaccgaggaaaacaactccgataatcataaccacgaagacgatgtcctggggttcccatctaatcaggatttatactggtcagaggacgaccaggaactgattattccctgcctcgccttggtgcgcgcaagtaaggcttgtctcaagaagattcgcatgcttgtcgccgagaacggcaagaaggaccaagttgcccagctggacgatatcgtggacatcagcgacgagatctccccaagtgtcgatgacctagcgctgtctatctatccccccatgtgtcacctcacggtgcgtataaacagcgctaagctggtgagcgtcctgaagaaagccctggagatcacgaaagcatcccacgttaccccccaaccagaggactcctggatccctttgttaatcaacgccattgaccactgtatgaataggattaaagaattgacacagagtgaactcgaactatag

SEQ ID NO: 184197 - DNA, 699 bp, Artificial Sequence
  Description of Artificial Sequence: Synthetic coding sequence
atggcccagctgatggaggtgctgagcgtgacccccacccagagccctgagaacaatgacctgatttcatataacagcgtttgggtggcttgtcaacaaatgccacagatcccccgagacaacaaggctgctgccctcctcatgctgaccaaaaatgttgattttgttaaagatgcccacgaagagatggagcaggctgtcgaggaatgtgatccgtattcaggtctgctgaacgacactgaggagaacaactccgataatcacaaccacgaagatgatgtcttaggctttccctctaatcaagacctttactggtccgaagacgatcaggagctgatcatcccgtgcctagcactcgtgagggcgtccaaagcgtgtttgaaaaagattcgtatgctggtggcggaaaatggaaaaaaagaccaggtcgcccagctggatgacatcgtggatatctctgacgagatctcaccttctgttgatgacctggctctctctatttacccccccatgtgccacctcacagtccgaatcaacagcgccaaactcgtttccgtcctgaagaaggcgctggaaataaccaaggccagccacgtgacgccccagccggaggacagttggatcccgctgcttataaatgctattgatcactgtatgaataggatcaaggagctgacccagtctgaactggaactttag

SEQ ID NO: 184198 - DNA, 3936 bp, Artificial Sequence
  Description of Artificial Sequence: Synthetic coding sequence
atgagcctgctgcagagcgccctggacttcctggccggccccggctcattgggaggagcttccggccgggaccagtctgactttgtgggccagaccgtggaacttggtgagctgaggctgcgtgtgcggagagtcttggccgaaggcggttttgcttttgtgtacgaagcccaagatgtgggttcagggcgagaatacgctctgaaacggctgctgtctaatgaggaagagaaaaacagggccatcatccaggaagtgtgttttatgaaaaaactgtcagggcatcctaacatagtgcaattctgcagcgccgcgtctatcgggaaagaagaatccgacacaggtcaggcagaattcctgctacttaccgagctctgcaaaggccagctagtagaattcctcaagaagatggaatctagggggccgctttcctgtgatacagtactgaagatattttatcagacttgccgagcggtccagcatatgcacaggcagaagccgccaataatccacagagacctgaaggtcgagaacctgttgttaagtaatcaaggaacaatcaagctgtgcgactttggcagcgccaccaccatcagtcactatccagattactcttggtccgcccaacgacgggccttagtggaggaagagataacaaggaacaccactcccatgtacaggaccccagagataatcgacctatacagtaatttccccatcggcgagaaacaggatatctgggccctcggttgcatattgtacttgctttgcttccgtcaacacccgtttgaggacggtgcaaaattacgtatcgtcaacggtaaatatagcattccgcctcacgacacacaatacaccgtgtttcactcgttgataagagcgatgctgcaggtgaaccctgaagaacgactgagtatcgccgaagttgttcaccaattacaggaaatcgccgctgcccggaacgtgaatcccaagtctccaattacagagctgctggagcaaaatggaggttatggttctgcaaccctgagtaggggcccacctccaccggttggcccggccggcagtggctattctggcggactcgcgttggctgaatacgatcagccatacggaggatttttggacatactgcgcggcgggactgagcgcctgtttactaacctcaaggataccagctccaaagtaattcagtccgttgctaactacgctaaaggtgatctggatatcagttacatcacttctagaatcgcggtgatgtccttccccgccgagggtgtagaaagcgctctgaaaaataacatcgaagatgtgagattatttctggatagcaagcatcccggacactacgccgtttataatctgagtccaagaacataccggcccagtcggttccacaacagagtttccgaatgtggctgggcagctcggcgcgccccccatctgcacaccctttacaatatctgtcgaaacatgcatgcatggctgcgccaggaccacaaaaacgtgtgcgtggtgcattgcatggacggcagggcggcaagcgccgtggccgtgtgttcctttctgtgtttctgtaggttgttttcaaccgctgaagctgccgtgtacatgttttccatgaaaaggtgtccaccaggcatctggccatctcataagcgttacatagagtatatgtgcgacatggtggcagaagaacccatcacccctcattcaaagcccatcctggtcagagcagtggttatgacccccgtgccactgttttctaagcagcgtagcgggtgtcggccattttgcgaggtgtacgtaggtgatgagcgggtagcctctacctcacaggaatacgataagatgagagactttaagatagaggatggaaaggccgtgatccccctgggagtgaccgtgcagggcgatgtgctgatcgttatctaccatgcccgttccacactgggcgggcgactgcaggccaaaatggcttcaatgaaaatgttccagatccagtttcataccggattcgtgccaagaaacgccaccaccgttaaattcgcgaaatacgacctagacgcctgcgacatccaggaaaaatatcctgacctgtttcaggtaaatctcgaagtggaagttgaaccccgggataggccatctcgggaggctcctccgtgggagaactcctctatgcgtggccttaaccctaaaattcttttctcttcccgagaggaacagcaggatattctaagcaaatttgggaagccggaattgccccgccagcccgggtctacggctcagtacgatgcaggcgccggttccccggaagccgagcccaccgattctgacagtccaccttcttcttctgcagatgccagccgatttttgcatactctggattggcaggaagagaaggaggccgaaactggcgccgagaacgctagcagtaaagagtcggaatcagcccttatggaagacagggacgaatctgaagtgtctgatgagggtggttcgcccatcagttcagaaggacaggagccaagggctgaccccgaaccccctggtctcgcagccggcttggtccagcaggatctggtgttcgaagtcgaaacaccagctgtgctcccggaacccgtcccacaagaggacggggttgacctgctgggtttacactctgaggtgggggctggacctgccgtgccacctcaggcttgcaaggcgcctagcagtaatacagatctgctgtcttgcctcctgggccctcccgaagccgcctcacagggaccccctgaagatctgcttagcgaggacccgctgcttttggccagtcccgccccccccttatccgtccagagtaccccccgggggggaccacctgccgcggccgaccccttcggacccctactgcccagtagcggaaataacagtcagccttgcagcaatcccgacctcttcggggaatttttgaactctgattccgtgacagtgcctccctcctttccgtctgcgcatagcgctccccctccctcctgtagtgcagacttcttgcacctcggcgacctgcccggggaacccagcaaaatgacggcatctagcagcaacccagacctgctaggcggttgggcagcttggaccgaaactgccgcatccgccgtcgccccaacccctgcaacggagggccctctattttctcctgggggacaaccagccccttgcggctcacaggcctcatggaccaagtctcagaacccagatccttttgcagatcttggggatctctcctctggcctccagggctctccggccggattcccacctggaggcttcatcccaaaaaccgccactacacctaagggatcctcgagttggcagacttcccggcctccggcccaaggagctagttggcccccccaggccaaaccgcctcccaaggcgtgcactcaacctcgaccaaactatgcatccaacttttctgtgatcggcgcgcgggaggaacggggcgtgagagctccctccttcgcccagaagccaaaagtctccgagaacgactttgaggacctcctctctaaccagggattctcttccagatctgacaagaagggccccaagacaatcgcggagatgagaaagcaggatttagccaaggacaccgaccctcttaagctcaaactgctggactggattgagggaaaagagcggaacatcagagctctcctgagtacccttcacacagtgttgtgggatggagagtctagatggactccggtgggaatggctgatttggtggctccagagcaggtgaagaagcactaccggagagccgtcctggctgtgcatcccgacaaagccgccggacagccatacgaacagcatgctaagatgatctttatggagctcaacgacgcctggtcagagtttgagaatcaaggcagccgtcctctcttttag

SEQ ID NO: 184199 - DNA, 1764 bp, Artificial Sequence
  Description of Artificial Sequence: Synthetic coding sequence
atgagcctgctgcagagcgccctggacttcctggccggccccggctcactgggcggagcctccgggcgggatcagtcagactttgtggggcaaacagtagagcttggcgaacttaggctgagggtccggagggtgctcgccgagggaggtttcgcctttgtctacgaggcccaggacgtgggaagtggaagggaatatgccctgaaacgcttgcttagcaatgaggaagaaaagaatcgagccatcatccaagaagtgtgtttcatgaagaaattatctggacaccctaacatcgtacagttctgttctgccgcaagtatagggaaggaggaatctgacaccggccaggccgagtttctccttctgaccgagcctcctgggctggcggcaggcctggtacagcaggacctcgtctttgaagtggaaacccctgcggtactgcccgaaccagtcccccaggaagacggagtggatctcttgggtctgcactccgaagtcggagctggccctgccgtccctccccaggcgtgcaaggctccaagctctaacactgatctccttagttgcctgctcggcccccctgaggctgctagccaggggccccccgaggacctcctgtcagaggaccccctcctgctcgcctcacctgcccctccgttgtcagtgcaaagtacacctagaggcggtcctcccgccgcggcggatccttttgggcctctcctgccttcttccggaaacaatagtcagccatgttcaaatccagatctgtttggggaattcctgaactctgattcggtgacggtcccaccatcttttccatctgcccactccgcccccccccccagctgtagtgctgacttcctgcacttgggagatctgcctggtgagcccagtaagatgacagcctccagcagcaacccagatttactgggtggatgggcagcctggaccgaaacagccgccagcgctgtcgccccaacaccggcgactgaaggacctttgtttagtccaggcggccagccagccccttgcggatctcaagcctcttggacaaaatcccagaacccggacccgttcgcagatctgggcgacctgtctagtgggctgcagggatcccccgccggctttcccccaggcggcttcatccccaaaacagcaacaacccccaaaggaagttcttcttggcagacgtctagacctccagcacagggcgcgtcctggccaccacaggcgaagcccccaccaaaggcgtgcacacagcctaggcccaattacgcctccaacttttctgttatcggcgcacgtgaagagaggggggttagggcccccagtttcgcacagaaacctaaagtaagcgaaaacgactttgaggatctgttgtccaaccaagggtttagctcacggagtgacaaaaaaggacccaagaccatcgcagagatgcgcaaacaagatctggctaaggatacagatcctttgaaacttaagctgttagattggatagagggcaaggaacggaatatccgagcactgctttctactctgcataccgtgctgtgggatggtgaatctagatggacacccgtgggaatggctgatttagtggcacctgagcaggtgaaaaagcattaccggcgagccgtgcttgccgtgcatccggataaagccgcaggccaaccatacgagcagcatgctaaaatgattttcatggagttgaacgacgcatggagcgaatttgaaaaccaggggtctaggcccttgttttag

SEQ ID NO: 184200 - DNA, 2238 bp, Artificial Sequence
  Description of Artificial Sequence: Synthetic coding sequence
atgcccttccccgtgaccacccagggcagccagcagacccagcccccacagaaacactatggaatcactagcccgattagcctcgcggcccctaaggaaaccgactgcgtgttgacacaaaaactcattgaaaccctcaagccatttggtgtgtttgaggaggaggaggaattacaacggcgcatattaattctgggcaaactgaacaacttggtgaaagaatggatccgggagattagcgagtccaaaaatctgccccagtcagttatagagaacgtgggcggcaaaatcttcacattcggaagttaccgcctgggagtgcacacgaaaggagctgatatcgacgcactgtgcgtggcccctcgacacgttgaccgatccgacttctttacatctttttatgataaacttaagcttcaggaggaggtgaaagacctgcgagcagtggaggaggcatttgtaccagtgatcaagttgtgctttgacggtattgagatcgacattcttttcgcgagactagcgctgcagaccatacctgaggacttggatctgagggacgactcacttctgaaaaacctcgacattcgatgtatccgatccctaaatggctgtcgtgttactgatgaaatattacatctggtgcccaatatagacaactttcggctgactctgcgcgcgattaagctgtgggccaaaaggcacaacatctatagcaacatactggggtttttaggtggcgttagttgggccatgctggtggccagaacatgtcaactctaccccaacgcaatcgccagtacgctagtacacaagttttttctggtattcagcaagtgggagtggcctaatcccgtgttgctcaagcagccagaggagtgtaacttgaatctgcccgtgtgggatcccagggtgaacccctccgatcgctaccatctgatgccaattattactccagcttacccccaacagaatagcacctacaacgtatccgtctcaacacgaatggtcatggtagaggagttcaagcaggggctggcaattactgacgagatcctgctgagcaaggcagagtggagtaaattgtttgaggccccaaactttttccaaaagtataagcactatatcgtccttctagcttctgcacctactgagaagcagcggctggaatgggtggggctagtcgaatccaagatcaggatactggtgggttctctcgaaaaaaatgaattcattaccctcgcccacgtgaatccacagtcctttccagctcccaaggaaaacccagataaagaggagttcaggaccatgtgggtgattggtctcgtgtttaagaaaactgagaactccgagaatctctccgtagacttaacttacgacattcaatcatttaccgacaccgtgtaccgccaagcgatcaatagtaaaatgttcgaggtggacatgaaaattgctgcaatgcatgtcaagaggaagcagcttcatcaactcctcccaaatcatgttctgcagaagaagaagaagcactctacagaaggagtcaaactgactgcactcaatgactcttctcttgatttatctatggatagcgacaactccatgagtgtgccaagtccgacatccgccacaaaaacctctcccctgaattcgagcggctcttcccagggtaggaattctcccgcccccgcagtaacagccgcctccgtgaccaatattcaagccaccgaagtgtcagtaccccaggtgaattcgtcggaaagctccgggggcacatcatcagagtctataccccaaacagcaactcagcccgccatctccccaccaccaaaacccacagtgtcacgagtggtgtcttccacgagactggtcaatccacctcccaggtcaagcggtaatgcagccacatcggggaacgccgccactaagattcctacgcccattgtgggggtcaagagaacttcatccccccataaagaagagtcccccaagaaaaccaaaaccgaagaagatgagactagcgaggatgcaaattgccttgcgctgagcgggcatgataagacagaggccaaagaacaattggatacagagacatcaactactcagtctgaaacgatacagaccgctgctagccttctggcctcacaaaaaacctccagtacagatctctcagatattccagctctgccagcgaatcctataccagtgataaaaaatagcattaaacttaggttaaaccgctag

SEQ ID NO: 184201 - DNA, 1080 bp, Artificial Sequence
  Description of Artificial Sequence: Synthetic coding sequence
atgaaggagaacaaggagaacagcagccccagcgtgaccagcgccaacctggaccacaccaagccttgctggtattgggacaaaaaggacctagcccatacacccagtcaattggaaggccttgatcctgccactgaggccaggtaccggcgcgaaggagcccgatttatttttgacgttggaactcggctagggcttcactatgataccctcgctactggcattatctacttccatcggttctatatgttccactcattcaagcaatttcctaggtatgtaaccggagcatgctgtctttttctcgctggcaaagtggaagagacgcccaagaagtgcaaagacatcattaagacagcccggagcttgctgaacgatgtccagttcggccagtttggcgatgaccccaaagaggaggtgatggtcctcgagaggatcttgttacaaaccattaaattcgatttgcaagttgagcatccatatcaattcctgctgaagtacgccaagcagctcaaaggcgataagaataagatccagaaactcgtgcaaatggcatggactttcgtaaatgatcgaacttcactgtgtactacccttagtctccagtgggaacctgagattattgctgtcgctgtaatgtacctcgcgggacgactctgcaagttcgagatccaggagtggacttctaaacctatgtatagaagatggtgggagcagttcgtacaggatgtgccagtggatgtgctggaggatatctgtcaccagattctcgatctgtactcccagggcaaacagcagatgcctcaccacactccgcaccagttacagcaaccgccctcccttcagccaaccccgcaggtaccacaggtgcagcagtcccagccatcccagtcgtctgagccctctcagccccaacagaaggacccgcagcaaccagctcagcagcagcagcccgctcagcagcctaagaaaccctcaccgcagcccagctcaccacgacaggtgaaacgtgcagtagttgttagccctaaggaggaaaacaaggcagcagggaaggccagccttaagcacacgtggtag

SEQ ID NO: 184202 - DNA, 1743 bp, Artificial Sequence
  Description of Artificial Sequence: Synthetic coding sequence
atgaaggagaacaaggagaacagcagccccagcgtgaccagcgccaacctggatcacacgaaaccttgctggtactgggataagaaagatctcgcccacaccccctctcagttggaaggcctggatcccgctactgaggcgaggtacaggagggaaggggccaggtttattttcgacgtaggaacgaggctcggactccactacgacacgctggcaacaggcattatttacttccatcgcttttatatgttccatagtttcaagcagtttccacgctacgtgactggcgcttgttgcctgttcttagcaggcaaggttgaagagactcccaaaaaatgcaaggatattattaaaaccgcccgaagcttgttgaatgatgtgcagttcggacagttcggcgacgaccctaaggaggaagttatggtcctcgagcggattctacttcagacaataaagttcgatctgcaggttgaacacccttaccagtttctgctgaagtatgcaaaacaacttaagggcgataagaacaaaattcagaaacttgttcagatggcctggacttttgttaacgatagtttgtgcaccaccttgtctctacagtgggaacccgaaatcatagccgtcgcagttatgtaccttgccggacgcctgtgcaagtttgaaattcaggaatggacaagcaaacccatgtaccgaagatggtgggagcaatttgtccaggacgtccccgtggatgtgctggaggatatatgtcatcagattctagatctttattctcagggaaagcagcagatgcctcaccacacaccccaccaacttcagcagcctccatctctccagcccaccccgcaagtgccgcaggttcagcagtcacaaccaagtcagagctccgaaccatcacagcctcagcagaaggacccccagcagcccgcacagcagcaacagcccgcacagcaaccaaagaagccttccccacagccttccagccccaggcaggttaagcgcgctgttgtggtgtcaccaaaggaggagaataaggctgcggaaccaccacctcctaaaatcccaaaaattgagactacccatccaccactgcctccggcgcacccaccccctgaccggaaacctcccctagccgccgccctaggcgaagctgagcccccgggacctgttgacgccacagatttaccaaaggtacagataccacccccagctcaccccgcaccagtgcatcaacctcccccattgccgcatcgccccccacccccaccacccagcagctatatgacagggatgtcaacgacgtctagctatatgtctggggagggctaccagagcctacagtctatgatgaagactgaaggcccctcctacggcgcccttccgcctgcctatggccccccagctcatttaccctaccacccccacgtatatccacctaatccacctcctccgcccgttccacccccccccgccagctttcccccacccgctattcccccaccaacacccgggtatcccccccctccacccacttacaaccctaatttcccacctccccctcctcgactgcctcccacacacgccgtgcccccgcatcctccccctgggttagggctgcccccagcaagctacccccccccagccgtgcccccgggcggtcagccacctgttcccccgccgatcccaccgccaggcatgcccccggtgggcggactagggcgcgccgcatggatgaggtag

SEQ ID NO: 184203 - DNA, 1803 bp, Artificial Sequence
  Description of Artificial Sequence: Synthetic coding sequence
atgaaggagaacaaggagaacagcagccccagcgtgaccagcgccaacctagaccataccaagccttgctggtactgggacaagaaagacctggcgcacactcccagtcagctggaagggttggacccagcgaccgaggctaggtatcgcagggaaggcgctaggttcatattcgatgtgggcacccgtctgggcctccattatgataccctcgccacaggaattatttatttccatagattttacatgtttcactctttcaaacaattccctagatacgtgacaggggcttgttgcctttttcttgcaggcaaggtcgaagagaccccaaaaaaatgtaaggacataattaagaccgcgcggtctctgctgaacgatgtgcagttcggccagttcggggacgatcctaaggaagaggttatggtcctggagaggattctgctccagacgattaaattcgacttgcaggtggagcacccctaccagttcctgttaaaatatgctaaacagctcaaaggagataagaacaaaatacagaagctcgtccaaatggcttggacttttgtaaacgattccctttgtacaaccctcagccttcagtgggagccagagatcatcgccgtggccgtgatgtacctagccggtcgtctgtgtaagtttgaaatccaggagtggactagtaaaccaatgtacagacggtggtgggagcagtttgtccaggatgtacccgtggatgtgttggaggacatctgtcatcagattctggacctgtactctcagggtaaacagcagatgccacaccacaccccccaccaacttcagcaacctcccagtcttcagcctacacctcaggtgccccaggtacagcaatcccagccgtctcaatcaagtgagcccagccaacctcagcagaaggatccccagcagcccgcgcagcagcagcaacccgcgcaacagcctaagaagccctcccctcagccctcttctccccgccaagttaaacgtgccgttgtgtctggcctcaagcaggcactggggagagccggattcccaggtggcggaaacaccacggttgtgagtcctaaagaagagaataaggcagcagagcctccgcccccgaagataccgaagatcgaaactacccatccccccctgccccccgcacatccgcccccagatcggaagccaccgcttgctgcggcactcggcgaggcagaaccccccggacccgttgacgccactgacctcccaaaggtccaaatcccccctcctgcccacccggctcctgtgcatcagccgccacccctcccacacaggccacctcctcctcctccatctagctatatgaccggaatgtctactacctcaagctatatgagcggtgaaggctatcagtccctgcaaagcatgatgaaaaccgaaggcccgtcctatggcgcgttaccgccagcctatgggcctcccgcccacctcccttaccatcctcatgtttacccacccaaccccccaccaccacccgtgcctcctcctcccgcctcttttcctcctcctgctatcccacctccaacacccggatacccccccccaccccctacttacaatcccaattttccaccccctccaccccggctgccaccaacccacgccgtcccaccccaccctccccctggactgggactccccccagccagttatccaccgcctgcggtgccacccgggggtcagccccctgtgcccccgcccatccctcctcccgggatgccgcccgttggaggtctgggacgtgccgcctggatgcggtag

SEQ ID NO: 184204 - DNA, 333 bp, Artificial Sequence
  Description of Artificial Sequence: Synthetic coding sequence
atgaaggagaacaaggagaacagcagccccagcgtgaccagcgccaaccttgatcacactaagccctgttggtactgggataagaaggacttggctcacacaccttcccaactagaggggttggaccctgccacggaggcaaggtaccggagggagggcgctagattcatctttgacgtagggacgcgattaggcctccactatgataccctcgcaactggcatcatttattttcatcggttttacatgtttcactcattcaaacaatttcctcgctacgtcaccggagcctgctgtttgtttttggcgggcaaggttgaggagaccccatag

SEQ ID NO: 184205 - DNA, 684 bp, Artificial Sequence
  Description of Artificial Sequence: Synthetic coding sequence
atgaaggagaacaaggagaacagcagccccagcgtgaccagcgccaacttggatcacaccaaaccttgctggtactgggacaagaaagatctggcccacactcccagccagctagagggactcgatcctgccactgaagccagatatagaagagaaggcgccaggtttatttttgacgtgggtaccaggctgggactgcattacgacacattggcgactggcatcatttatttccaccgcttttacatgttccactcattcaaacagtttccccgatatgtaacaggggcatgttgtctttttctggcagggaaagtggaggagactccaaaaaaatgcaaggatataataaagaccgccagatctctgctgaatgatgttcagtttggacagttcggggatgatccgaaggaagaggtcatggtcctggaacgaatcttgctccagacaatcaaattcgatcttcaagttgagcacccgtaccaattcttattgaagtacgcgaaacaactgaagggcgacaagaataaaatccagaaacttgtgcagatggcctggacctttgttaatgatagtctgtgcacaacattatcacttcaatgggagcccgaaataatagccgtcgccgtgatgtatctggccggtcgactgtgtaaattcgagattcaggagtggacctcctag

SEQ ID NO: 184206 - DNA, 519 bp, Artificial Sequence
  Description of Artificial Sequence: Synthetic coding sequence
atggccagcggcccccacagcaccgccaccgccgccgccgccgccagttctgccgctcctagtgccgggggctcctcatctggtaccacgaccactaccaccacaaccactggcggcattctgattggagataggctgtatagcgaggtttctttgacaatcgatcactccctgatacccgaagagaggctgagcccaaccccctctatgcaggatggtcttgacctgcctagcgagacggacctaagaatcctaggctgcgaactaatccaggctgccggcatccttctgagattgcctcaggtggctatggctaccggacaggtgctgttccacaggtttttttatagcaagtccttcgtgaagcattctttcgaaatcgtggctatggcctgtatcaacctcgcgtccaaaatcgaggaggcaccccgcaggatcagagatgtaatcaacgtcttccaccaccttaggcagcttcgaggaaaaagcgatcaacttcaccttccaaaacccggatag

SEQ ID NO: 184207 - DNA, 1581 bp, Artificial Sequence
  Description of Artificial Sequence: Synthetic coding sequence
atggccagcggcccccacagcaccgccaccgccgccgccgccgccagtagcgctgccccaagcgccggggggagcagttccgggaccaccactaccactacaaccacaactggggggattcttataggggatagactgtattctgaggtgtccctgaccatagatcatagtctgatccccgaagagcgtctctcccctactccctctatgcaggatggcctcgatctcccctccgagaccgatctccgcattctgggatgtgagctgattcaggcagctggaattcttctgcggctaccccaagtagccatggcaacgggccaggtcttatttcacaggtttttttactcaaagagcttcgtgaagcactccttcgaaatcgtggcaatggcttgcataaatcttgccagtaaaatagaagaggcccctcggaggatcagggatgtaatcaacgtatttcaccacctcaggcagctacgcggaaagcggacaccatcccctttgatcctagaccaaaactacatcaatactaagaatcaggtgatcaaagcagaacggagggtgcttaaggaactcggcttctgtgtacatgtaaaacaccctcacaaaatcatcgtgatgtacttgcaggtcctggaatgtgaacgtaatcagacactggtgcaaacggcctggaattacatgaatgacagcttgaggaccaacgtttttgtcaggtttcagcccgagactattgcctgcgcctgcatctaccttgccgcaagagccctacagatcccacttcctacaaggcctcactggttcctacttttcggcaccaccgaagaggaaatccaagagatttgcatcgaaactctgcggttatacacgaggaaaaagccgaactacgagctgcttgagaaagaagtggagaagcgaaaagttgccctccaggaggccaagcttaaagccaagggacttaatccagacgggactcctgccttaagcacgctagggggtttttctcctgcttcaaaaccttctagtccacgggaagttaaggccgaggagaagagccctatttctatcaacgttaagactgtgaagaaggagcctgaagaccgccaacaggcctcgaaatccccatataatggggtgagaaaagatagtaagcggtcccggaatagcaggtcggcaagtcgctcccggtcccgaacccgtagtcggagtcggtctcacacaccaagaaggcattacaacaatcgccggtcgcggtctggaacctactcctcccgctctcgatcccgatcccgctctcacagcgaatcaccacgccggcatcataaccatggttccccccatctgaaagctaaacacactcgcgatgatctgaagagctcaaatcggcacggtcacaagcgtaagaagtctcgtagccgatctcagagcaaaagccgtgaccatagtgatgccgcaaagaaacatcggcacgagaggggccatcatcgagatagacgagaacgttccagatctttcgagcggtcacacaagtccaagcaccacggagggtctcggagcggccacggtagacatagacgttag

SEQ ID NO: 184208 - DNA, 1563 bp, Artificial Sequence
  Description of Artificial Sequence: Synthetic coding sequence
atggccgccgccgccgccgccgccggcgccgccggcagcgccgcccccgcggctgccgccggcgctccagggtccgggggcgctccgtctggatcgcaaggcgtcctgatcggggatcgattgtactccggagtgctgatcacccttgagaattgcctgctgcctgacgataagctgcgcttcaccccttctatgtcgagtggcctcgacactgataccgaaacagacctgcgggttgtcggttgcgaattgattcaggcggcaggaatcctcctgcgtctaccacaggtggcaatggcaacaggccaggtgttgttccagaggtttttttacaccaagtcattcgttaaacactctatggagcatgtcagcatggcatgtgttcatttggccagtaaaatagaggaggcgccacgcagaatccgggacgtaatcaacgtttttcaccgtctgcgccagttacgggacaagaagaagcctgtgccactcctactggaccaggactatgtgaacctgaaaaatcagattatcaaggccgaaagaagagtattaaaagaactggggttctgcgtgcacgtaaagcaccctcacaagattattgtgatgtacctccaagtgctggagtgcgagaggaaccaacacctcgtacagacaagctggaactatatgaatgattctctgcgcacggatgtatttgtccgatttcagccggaatccattgcttgtgcatgcatctatttagctgcgcgtactctcgaaattcctctgccgaacagacctcactggttcctgctgtttggcgccacggaggaagaaatccaagaaatttgtctgaagatactgcaactctatgcccggaagaaagtggatctcacccacctcgagggcgaagtggagaagaggaaacatgcgatagaggaggcgaaagcacaggctagaggtttgttgcctggcggaacacaggttctcgacggaacctccgggttctcccccgcacccaaactggtggaatcccccaaggaggggaaggggtctaagccgtcccctcttagtgtgaaaaatacgaaacgacggctggaaggcgcaaaaaaagccaaagccgatagcccggtcaatgggctgcccaaggggcgggagtctcgctcaagatcccgttctagagaacagagttacagcagatctccatcgagatctgcctcccccaaacggcggaaaagcgattctggcagcacttcgggaggcagcaagtcccaatcacgttcccgcagtagaagcgactccccgcctcgccaggccccccgctcagcaccttataagggcagtgaaattcgtggttcccgaaaatctaaagattgtaagtacccccagaagccgcacaagtcccgttctcggtcgagctcaagatctcgttcaaggagtcgcgagcgcgccgacaatcccgggaagtacaaaaaaaaaagccattattaccgcgaccagaggcgcgagagatccaggagctacgagaggacagggagacgctacgagcgtgaccatccgggacactctagacacaggcggtag

SEQ ID NO: 184209 - DNA, 681 bp, Artificial Sequence
  Description of Artificial Sequence: Synthetic coding sequence
atggccgccgccgccgccgccgccggcgccgccggcagcgccgccccagcagctgctgcaggtgcacccggaagcgggggcgcacctagcgggagccaaggggttttaatcggagaccgactctacagtggtgtgcttatcacattggagaactgcctgctgccagatgataagcttcggttcaccccctccatgtcctcgggtctagacacagacaccgagaccgaccttagagtggttggctgcgagctcattcaagccgctgggattctgcttcgactgccgcaggtagctatggcgactggacaggtgctgtttcaacgcttcttctacacaaagtcattcgttaagcattctatggagcacgtgtctatggcgtgtgtacacctagcatccaaaatcgaggaggctcctcgtcgcattcgggatgttattaacgtctttcaccgcttgaggcagctgcgagacaaaaaaaagccggtgccgctcttacttgatcaggactatgtgaatctgaaaaaccagattatcaaagctgaaaggagggtgttaaaagagttgggcttttgcgtacacgtcaaacaccctcataagataatcgtgatgtatctacaggtgcttgaatgcgagaggaatcaacacctcgtccagacatcatgggtggcctccgaaggcaagtag

SEQ ID NO: 184210 - DNA, 1044 bp, Artificial Sequence
  Description of Artificial Sequence: Synthetic coding sequence
atgaacgacagcctgcggaccgacgtgttcgtgcggttccagcccgaaagcattgcgtgcgcttgtatctatctggcagccagaactttggaaatcccactgccgaatcgcccccactggttcctgctgttcggggccactgaagaagaaattcaggaaatctgtctgaagattctgcagctttatgcccggaagaaggtggaccttacacaccttgagggggaggtcgagaagcgcaagcatgctattgaggaaggcccgagtccgggtccagtggcctggggccacacaggcgctgggtggtacctcggggtgctgtcctgtccccaagcaggctgctgggattacagccttgaatgtagcggggctatctgggaccactgtaagttgcgccttcctgatagcggcgactcctgtgcctcagccagccaggtggctggtatcgcaggagcacaccatcacgcacaatctcttgctgttttgccagtggagagtccaaaggaaggcaaggggtctaagccatcacccctctccgtgaagaataccaagcgccgtctagaaggagccaagaaagccaaggcagattccccagttaatgggttaccgaagggccgggagagccgtagtcgaagcagatcacgtgagcagtcatattcccgctccccatcaaggtctgcatcacctaagcggcggaagtccgacagtggttcaacgtctggggggtccaaaagccagagtaggagtcgatcacgaagcgattcacctccacgccaggcgcctcgcagcgctccctataaggggagcgaaatccgcgggagccgtaagtcaaaggattgcaagtatccccagaagccccacaagagccgctcaaggagtagcagccgctctcgttcacggtctagggagcgcgcagataatcctggaaagtataagaaaaaatcacattattaccgggaccagagaagggagaggagtcggagctacgagcggacggggcgccgatacgagcgtgatcatcccggacatagcagacaccggagatag

SEQ ID NO: 184211 - DNA, 2856 bp, Artificial Sequence
  Description of Artificial Sequence: Synthetic coding sequence
atggccgccgccgccgccgccgccgccgccgtgggcgtgcggctgagggactgctgctctcgcggtgcagtgctgctattattcttctctcttagcccaagaccaccagctgccgccgcctggctccttgggttgcgtccagaggacacagctggcgggagggtaagtttagaggggggcaccctgcgggctgccgagggtacctccttcctgctgagagtctactttcagcctggtccccctgcaacagccgctcctgttcctagtccaacattgaacagcggagaaaacggaactggtgactgggcccctcgtctggtgttcatcgaagagccccccggcggaggaggggtagcaccatccgcagtgcccactaggccgcccggacctcaaagatgccgtgaacaatcagactgggccagtgatgttgaggtcctcggtcctctgcgtccaggtggagtggccggctccgcactggtgcaggttcgtgtcagggagctgagaaagggggaggccgagagggggggggccggagggggcggaaagctgttctccctgtgtgcttgggatggacgggcctggcaccaccacggcgcggctggcgggtttttactgagggtgcgtcccagattgtatggaccaggcggagatttgctcccccctgcctggctcagggccctgggggcgcttcttttgctggctctatcagctctgtttagtggactgcgcttaagcttattgtcccttgacccagtggagttacgggtgctgaggaactctggttctgcagcggaacaggaacaggctcgtcgcgtgcaggctgtgcgtgggcgaggtacccacttactgtgtacactgctgcttggccaggccggcgcaaacgcagctttggcgggctggctgtacaccagcttaccacccggctttggcggcacgggtgaagactacagcgaggagggaatccatttcccatggctgccagctctggtgtgtaccggtgctgtgttcctcggcgcagagatctgtccatattcagtttgcagccgccacggcctggccattgcatcacactctgtgtgtttaaccagactactgatggccgctgccttcccagtctgctaccctctgggcaggctgctggactgggctttgaggcaagagattagcactttctacacccgagagaaacttttagaaaccctcagggccgccgacccctattcagatctcgtcaaggaggagctcaatataattcagggcgcgcttgagctccggacgaaggtggtggaggaggtacttacaccattgggggattgctttatgctaagaagcgatgccgtgctcgatttcgcaacagtgtcagagatcctgcgatcaggatatacccgaattccggtttatgaaggcgatcagagacataatatcgttgatattctgtttgtcaaagatctggcttttgttgaccctgacgactgtacccctctgctcacagtgacgcggttttacaaccgaccccttcactgtgtcttcaacgatactagactagacaccgttttagaggagttcaaaaagggcaagagccacctggcgatagtacagcgggtcaataatgaaggagagggagaccccttttacgaggtcatgggcatcgtgactttagaggacataatcgaggaaattatcaagtccgaaatactggacgaaacagatctctacacagataatagaaagaaacagcgcgtcccacagagagagagaaaacggcatgacttttccttgtttaaactttctgatacggagatgcgcgtgaagatttccccccaactgctcctcgcaacacacaggtttatggctaccgaggtcgaaccctttaaatccttataccttagtgaaaagatcttgcttaggcttctcaaacaccctaatgttatccaggaattgaagttcgatgaaaaaaacaaaaaagctccagagcactacctttatcaaaggaataggcctgtggactacttcgttctcttgctgcagggaaaggtggaggtggaagtcgggaaggaaggcctcagatttgagaatggagccttcacctattatggtgttcctgccatcatgaccaccgcgtgcagcgataatgacgtaaggaaggtgggctctctggccgggagttcggtattcctgaaccggagtccttcgagatgcagcggcctaaacagaagcgagtcccccaatagggagcgaagcgactttggtggaagtaacacacagctgtattcatcctcgaataacctctacatgccggactattcagtacatattctgtctgatgtgcagtttgtgaagattacaaggcagcagtatcagaatgctttaactgcttgccatatggattccagcccacagtcccctgacatggaagcgttcactgacggtgattccactaaggcgcctacaacacggggcacaccccagacaccaaaagatgatccagcaattaccctgctcaataacagaaatagtttaccatgtagcagatcggatggtttgagatcaccttcagaggtggtgtatctgaggatggaggaactggcttttacacaggaggaaatgacggatttcgaggaacatagtacacagcagctgacactgtccccagctgctgttccaaccagagccgctagcgacagtgagtgctgcaatattaacctggacacagagacatctccctgctccagcgacttcgaagaaaatgtggggaagaaacttctgcgtaccctgtccggccaaaaacgaaagcgatcaccagaaggtgaacgcacgagcgaggacaattctaatctgacaccactaataacgtag

SEQ ID NO: 184212 - DNA, 2493 bp, Artificial Sequence
  Description of Artificial Sequence: Synthetic coding sequence
atggccgccgccgccgccgccgccgccgccgtgggcgtgcggctgcgagattgctgttctcggggagccgtgcttctgctcttttttagtctgtccccgcgtcctcccgcagccgccgcctggttactaggcttacgccccgaagacacagccgggggccgcgtctcactcgagggaggaacacttcgagccgccgagggaactagtttcttactgagagtctactttcagcccggaccaccgagatgtagagaacagagcgattgggcctcagacgtagaggtattgggaccacttcgccccgggggagttgcaggttcagcactcgtgcagctgttctctctctgcgcatgggatggcagagcctggcaccaccatggggccgctggcggttttcttctgcgcgtgaggccacgattgtacggtccggggggcgaccttctgccacccgcttggctccgggctttgggagcactcctgcttctcgccctgtctgccttgtttagcggtttaaggctgtctctgctgagcctagatcccgtagagctccgcgttctgcgaaattccggaagcgcggctgagcaggagcaggctagaagagtccaggctgtcagggggcgaggcacgcacttactctgcacacttctcctgggccaggctggggccaatgctgcactagcaggctggctgtacacaagccttcctccagggttcggcggcacgggtgaagattactcagaggaaggcattcactttccttggttgcccgcattggtgtgtaccggcgctgtcttcctgggcgctgagatatgcccttactccgtgtgttcgagacacggcttggccatcgccagccactcggtgtgcctcacccgcctcttaatggctgcggcctttcccgtgtgttatcctttggggcggctgttagattgggcactccggcaggagataagcaccttctacactagggaaaaattactagagaccctgcgcgcagcagacccatattccgatctggttaaagaggaactgaatatcattcagggcgcactggagctgcgcaccaaggtagtcgaggaagtgttgaccccacttggggactgctttatgttgcggtcagatgccgtactggacttcgcaacagtgtcggaaatcctgcgctccgggtatacaaggattcctgtctacgaaggcgatcagagacataatatcgtggacattctcttcgtaaaagatctggccttcgtagaccctgatgactgcacgccactactcacggtcacccggttctataaccggccactgcattgcgtgtttaacgatactaggttagacaccgtgcttgaagagttcaaaaaaggaaagagccacctggcgatcgtccagcgagtcaacaacgagggcgagggcgatcccttctacgaagttatggggattgtcactctggaggatatcatcgaagaaatcattaaaagcgagatattggatgaaacggacctctataccgacaacaggaaaaagcagcgggtgcctcagagggagagaaaaaggcatgatttttccctttttaaactgagcgacaccgagatgcgtgtaaagatctctcctcagctgttgttagcaacccatcgcttcatggctactgaagtagagccctttaaatcactgtacctctcagagaagatcttgctaagactcttgaagcatccgaatgtcatacaggagttgaaatttgatgagaagaataagaaggcccccgagcattacctgtatcagagaaacagacctgtggactactttgtgctcctgctccaggggaaggtggaagttgaggtgggtaaagaggggttgagattcgaaaacggtgccttcacgtattacggagtgccggccatcatgactaccgcctgttctgacaatgatgtgagaaaggtaggttcactcgccggctccagtgtgttcctgaataggtcccctagccgctgttctggactgaatcggagtgaaagccctaatagagaaaggtccgatttcggggggagcaatacacaattatacagtagttctaataacctctacatgcctgactactccgtccacattctttccgacgtacagttcgtaaagatcaccaggcagcagtatcaaaatgcactgacagcatgccacatggatagcagcccccagtctccagacatggaggcattcaccgacggagattctaccaaagcccccacgacccgggggaccccccaaacacccaaggacgaccctgccatcacactgctcaacaatcggaacagcttgccctccagcgactccgaatgctgcaatattaacctcgatacggaaacttccccctgtagcagcgatttcgaagagaacgtaggtaagaaactgctgcgaaccctaagcggtcagaagcgcaagcgcagcccggagggagaacgcacatcagaggataatagtaaccttacaccattgatcacttag

SEQ ID NO: 184213 - DNA, 1824 bp, Artificial Sequence
  Description of Artificial Sequence: Synthetic coding sequence
atggccgccgccttccccgtgtgctaccccctgggccggctgctggattgggccctgcggcaggagatatctactttctacacacgggagaagctgctagagactttgcgcgctgccgatccctattccgacctcgtcaaagaagagctgaatatcattcagggggcactggagctgcgcaccaaggttgttgaggaagttctgactcctctgggagattgtttcatgctccggtccgatgccgtgctggactttgccacagtctctgagatccttagaagcggatatactcgtatcccagtttatgagggggaccagcgacacaacattgtggacatactttttgtcaaggacctcgcctttgtggaccctgatgattgtacccccctcctgactgtgacccggttttacaataggcctttacattgtgtgttcaacgacacccgtctcgataccgtgttggaagagttcaagaaagggaagtcccatctggcgattgttcagcgtgtcaacaatgagggggaaggcgatcctttttacgaggttatggggatcgtgacactcgaggacatcatcgaggagataatcaagtccgagatcctggatgaaacagatctctacactgataacagaaagaagcaaagagtgccacaacgcgagcgaaagagacatgatttcagcctttttaaactgtccgacactgagatgagggttaaaatatccccacagctcttactggccacgcatagatttatggctaccgaagtcgagcccttcaagagcctctacttgtcagagaagattctgctgaggttgctgaagcaccctaatgtcattcaggagctgaagttcgatgaaaagaataaaaaagctccggagcactatctgtaccagcgcaaccgccccgtagattacttcgtactcctcctccaggggaaagtggaggtcgaagtggggaaggagggcctgagatttgaaaacggggcgtttacctattacggcgtgccagcgataatgactacagcctgctcggacaacgacgttcgcaaggtcgggagcctagccggcagttctgtttttttacccgtctctgttagtaggacattcgctgtgagtaggggtgacagtcttgccggatcacccgtgaacaggagtccttcccggtgctctggcctgaaccgaagcgagagccctaatagagagaggtccgacttcggtggctccaatacacaactgtacagttcttctaacaacctgtacatgccagactacagtgttcacatcctttcagacgtgcagtttgtgaagatcaccaggcagcagtatcagaacgcactgaccgcctgccacatggacagttcccctcaaagcccagacatggaggcgttcacagacggtgattccacaaaggctccaaccacccgcgggactccacagacgcccaaggacgaccctgccataacactcctgaacaaccggaactccctcccctgcagccgctccgacggattgcggtccccttccgaggtggtataccttcggatggaagaactggcctttacacaggaggaaatgacggactttgaagagcactctactcagcagctcaccctgtccccagccgccgtgcccacacgggccgcatccgactccgagtgctgcaacattaatttggacaccgagactagcccctgctcctcagactttgaggagaacgttggtaagaagttgctgcgtacgctcagcggtcaaaaaaggaagaggtcgccagagggcgaacgaacatctgaagacaatagtaatctgactcccctgatcacatag

SEQ ID NO: 184214 - DNA, 2643 bp, Artificial Sequence
  Description of Artificial Sequence: Synthetic coding sequence
atggccgccgccgccgccgccgccgccgccgtgggcgtgcggctgagggactgctgctcaaggggagctgtcctgctactcttcttttcattgagccctcgacccccagccgccgccgcatggctgctggggttacggcctgaggatacagccggaggacgggtgagcctggagggagggaccctgcgggccgccgaaggcacctccttcctattgcgagtctacttccagccaggccccccccggtgtagggagcagagtgattgggcatctgacgtggaagtattagggcctttacggccaggcggtgtcgccgggagtgccctcgtgcagctcttctctctctgtgcttgggatggccgcgcttggcaccatcacggtgcagccggcggctttctcctgagggtgagaccacgcctgtatggccctggcggcgacctgcttcctcctgcttggttgcgcgcgcttggcgctttgttattgctggccctgagtgcgctatttagcggccttcggttgtcactgctctcccttgaccctgttgaactcagagtgctcaggaacagcgggagcgctgcagagcaggaacaagctcgccgtgtgcaagcggtcagagggagaggaacacatttgctgtgcactttgctgctgggccaggctggcgcaaacgccgccttagccggatggctctacacatcactgcctcccggatttgggggcacaggagaggattattccgaggagggaatccattttccatggttgcctgccctggtttgtactggggctgtcttcctgggcgctgagatttgcccctatagcgtctgtagccggcacgggcttgcaatcgcatctcactccgtgtgcctgacgcgcttactgatggcggcagccttcccagtgtgttaccccttgggccggttacttgactgggccctcaggcaggaaatctcgacgttctacacaagagaaaaactccttgagacccttcgggccgcagatccttatagcgatctcgtgaaggaggaactgaatatcatccagggggcgctggagctgcggaccaaggttgtcgaggaggtcctaacacctctcggagattgctttatgctcagatctgacgccgttttggactttgccacagtgagcgaaatcctgcgcagcgggtacacccggatccctgtatacgaaggggatcagcgacataacatcgtcgatatcctcttcgtgaaagacctggcattcgttgacccggatgattgcactcctctcctgaccgttacacggttctacaacaggcctcttcactgtgtgttcaatgatacaagactggacacagtgctggaagaattcaagaagggtaaatctcacctagccattgtgcagagagtaaacaacgagggggagggtgacccattctacgaagtcatgggtatagtcaccctggaagatataattgaggagatcatcaaatctgagatattggatgagactgacctgtacacagacaatagaaaaaagcaaagggtccctcagagagagcgaaagcgccatgatttcagtctgttcaagttgtccgataccgaaatgagagtcaagattagcccacagctgttgttagcaactcacagatttatggctactgaggtggagcccttcaagtctctatacctttcagaaaagatcctgctgcggctgttgaagcacccaaatgttattcaggaactgaagttcgatgagaaaaataaaaaggcgcctgaacattatttatatcagcggaaccgccctgtggattacttcgtgctcctgctgcagggaaaagtggaggtggaggtgggcaaggagggactgcgatttgagaacggagcttttacatattacggcgtcccggctattatgaccactgcctgttcagacaacgacgtgcggaaagtcggctctctggcgggtagtagtgtgttcctgaaccgcagccctagcaggtgcagtggcctgaatcgctcagagtccccaaaccgtgaacgttctgatttcggcggctccaacacacaattgtactctagctctaataatctgtacatgccggactatagcgtccacattctttctgacgtgcaattcgtgaagatcacgagacagcagtatcagaatgccctgaccgcctgccatatggacagtagccctcagagcccagatatggaagcttttaccgacggcgattcaactaaggcaccaaccacccgagggaccccgcaaacccctaaagatgatcctgcgattacacttctgaataatagaaattctctcccatgcagccgaagtgatggcttacggtcccccagcgaggtggtatatcttagaatggaagaactggccttcacacaggaggagatgacggactttgaagagcacagcactcagcagttgacactgtctcccgcggctgttccaacaagggccgccagcgacagtgagtgctgtaatattaatctggacactgaaacgtccccctgtagctccgatttcgaagagaacgtcgggaagaagctgctccgcacactgtcgggccagaagaggaagagatcgcctgaaggagagagaacatccgaggataacagtaacctcaccccgttgatcacctag

SEQ ID NO: 184215 - DNA, 1215 bp, Artificial Sequence
  Description of Artificial Sequence: Synthetic coding sequence
atgggcatcgtgaccctggaggacatcatcgaggagatcatcaagagcgaaatactcgacgaaaccgatctgtatacggacaataggaagaaacagcgcgtgcctcaacgggagcggaagcgccacgacttcagcctgtttaaactgagcgatactgagatgagggtcaagatttctccgcaactcctgctggctacccatagatttatggctacagaggtggaacccttcaagagtctgtacctcagcgagaaaatcctgctgcgcttgctcaaacaccccaatgtgattcaggaactgaagttcgacgagaagaacaagaaagcgcctgagcactatttgtaccagcggaataggcctgtcgattactttgttctgctgttgcaagggaaggtggaggtggaagttggaaaagaggggctgagattcgagaacggggccttcacctattacggtgtgcccgccattatgacgaccgcctgcagtgacaacgacgtgaggaaggttggctccttagcgggcagctcggtgtttctgaacaggtcacctagtaggtgcagtgggcttaaccggtcggaaagtccaaatagagaacggagtgattttggaggcagtaatacacagttatatagctccagtaacaatttatacatgcccgattacagcgttcatattctctcagacgttcagttcgttaaaataaccaggcagcagtaccagaatgctctgactgcctgtcatatggatagctcccctcagtccccagacatggaagctttcactgacggcgatagcacgaaggctcctactactaggggcaccccacagacccctaaagacgatccggctattactctcttgaataatcgcaatagcctgccttgctcccgtagtgatggtttacgctccccaagcgaagttgtgtacctgcggatggaggagctggcgttcacacaggaagagatgactgatttcgaggaacatagcacccaacagttgaccctctcccccgctgccgtaccaactcgtgccgcgtccgatagcgaatgctgcaatataaatctcgacacggagacttctccctgctcctccgactttgaagagaatgtgggcaaaaaacttctgcgcactctctctgggcagaaacgtaagcgcagccctgagggtgaaagaacaagcgaggataattcaaaccttactcccttaataacttag

SEQ ID NO: 184216 - DNA, 2562 bp, Artificial Sequence
  Description of Artificial Sequence: Synthetic coding sequence
atgatcggctgcggcgcctgcgagcccaaggtgaagatggccggcggccaagcagccgccgccctgcccacttggaagatggcggcacgtcggagtctatccgcccgaggaagaggcatccttcaggctgcagccggccggcttcttccgttgctcttactctcgtgttgctgcggagccggcgggtgtgcagccgtaggagagaatgaggagacagtgataatagggctccgtctcgaagataccaatgacgtaagcttcatggaagggggggcactgcgtgtgagtgagcgtactagggtgaagctcagagtctatggacagaacatcaataacgaaacatggtccagaattgcttttactgagcacgagaggcgcaggcactctcctggcgagagaggattggggggacccgcaccacccgagccagattcgggccctcaacggtgtggtataaggaccagtgacataatcatactgccacacatcattctgaacagacgcacatccggcataatagagatcgagatcaagccgttacgaaagatggagaagtccaagagctactacctgtgtacatcgctctccacaccagctctgggggctggcggctctggctctacgggaggggccgtgggcggtaagggggggtctggggtcgccggcttaccccctcccccctgggctgagaccacctggatatatcacgacggtgaggacaccaaaatgattgttggggaagagaagaaatttctgttaccattttggctccaggttatcttcatctctctcttgctgtgcctgtctgggatgttctctggactgaacctcgggctgatggcactcgaccctatggagcttcggatcgtacagaactgcgggaccgagaaagagaagaattatgccaagcgcatcgagccggtacgccgtcaggggaattatctgctgtgcagcttacttttggggaatgtgctggtaaataccacattgaccattctgctggatgacatcgccggatctgggcttgtggccgtggttgtgtctacaataggtatcgtgatatttggagagattgtgccacaggcaatttgttccaggcatgggctcgcagtgggcgcaaataccatcttcctgaccaaatttttcatgatgatgacatttccagccagctaccccgtcagtaaactcctggactgtgtactcgggcaggaaatcggaactgtctacaatagggaaaagctgctggagatgctgagagtgaccgacccctataacgacttggttaaggaagagctcaacatcattcagggggcattggaactccgcaccaaaacagtcgaggacgtgatgacaccactaagggattgcttcatgattaccggggaggcaatccttgatttcaatactatgagtgagattatggagtctgggtacactagaattccagtcttcgaaggcgagcggagcaacatcgtggacctgttgttcgtaaaggacttggcttttgtggacccagatgactgtacccctctaaagacaataacaaagttttataatcatcccctgcattttgtgttcaatgacaccaagctagacgcgatgttggaggaatttaaaaaaggcaaaagccacctcgctatcgtccagagggtgaacaacgagggggaaggggatcctttttatgaagtgctggggattgtaacattagaggacgtgatcgaagagatcatcaaatcagaaatcctcgatgaaactgacctgtacaccgacaacaggaccaagaagaaggttgcccaccgagagagaaagcaggattttagcgccttcaagcagaccgactccgagatgaaagtgaaaatcagcccccaactattattagccatgcaccgcttcttggcaacagaggttgaggctttttcccctagccagatgtctgagaaaattctgctgcggcttctgaagcaccccaatgtgatccaggaactgaagtatgatgagaaaaacaagaaagcgcctgagtactatctgtaccaaaggaacaaacctgtggactacttcgtactgatactccagggcaaggttgaggttgaagcaggaaaagagggtatgaaatttgaagccagtgctttctcatattacggtgtgatggctttgacggctagccccggcgaaaacaagtctccccctagaccttgtggactcaatcattccgactctctttccaggtccgatcgcatagacgccgtgacgcccacgctcggatctagcaacaaccagttgaactcatctctgttgcaggtttatatccctgactatagcgtgcgggccctatccgacctgcagttcgtcaagatcagccgccagcagtaccaaaacgcactgatggcctcgaggatggacaaaacaccacaaagcagcgactctgaaaacactaagatagagctgaccctgacggaactgcatgacgggctgccagacgagacagcaaacctgctgaacgagcagaattgcgtcactcattcaaaggcgaaccattctcttcataatgaaggggcaatttag

SEQ ID NO: 184217 - DNA, 1659 bp, Artificial Sequence
  Description of Artificial Sequence: Synthetic coding sequence
atgatcggctgcggcgcctgcgagcccaaggtgaagatggccggcggacaggccgcagctgccctacccacctggaaaatggccgctaggagaagtctctcggccagaggaaggggcattctgcaagcagcagcaggcaggcttcttccactgctgctgctcagctgctgctgcggagcaggtggctgcgccgccgtgggcgaaaacgaggaaaccgtcatcatcggacttagattggaagacacgaatgacgtgagtttcatggagggaggggctctgcgggtctcagaacgcacccgtgtgaagctgagggtgtatggccaaaacataaataacgaaacttggtcacgcatcgctttcaccgagcatgagcggcgacgtcactctcctggggagagagggctggggggacctgccccccctgaacccgacagcggacctcagcggtgcggaattaggacaagcgacataatcattctccctcatatcatcctgaaccgccgaacctcggggataatagaaatagaaattaaaccgctcaggaaaatggagaagagcaaatcttactacctgtgtacttccctgtcgacccctgccctcggtgctggcggctctgggagcacgggtggggccgttggaggaaaaggaggatcgggggttgctgggctacctcctcctccgtgggcggagacaacttggatctatcatgatggcgaagatacgaagatgatcgtgggcgaagagaagaaattcttgttgcccttttggctccaggtgatttttatctctctgctgctgtgcctgtcaggcatgttttccggcctaaacctcggcctgatggccctcgacccaatggaacttagaatcgtgcagaattgcggaacagagaaggaaaagaactacgcaaagaggatagagcctgtcaggcgccagggaaattatctcttgtgtagcctcctgctcggcaacgtcctggtaaacaccactctaaccattctgctggatgacatcgcaggctccggcctagttgctgtcgtggtcagtactataggcatcgtaattttcggggaaatcgtgccacaggccatctgctccaggcacggcctggctgtgggtgccaacacaatctttctaacaaagttttttatgatgatgacctttccagccagctaccctgttagtaagttactggactgtgtgctcggccaggagattggaacggtgtataaccgcgagaagttgctggaaatgcttcgggtgaccgatccttataatgacctggtaaaggaagagcttaatattattcagggtgcccttgaactgcgaacgaaaacggtggaggatgttatgacccccttgagagattgtttcatgattacgggcgaggccattttggattttaataccatgtctgagatcatggagtccggctacacaagaatcccggttttcgaaggtgagcgttcaaacatcgttgatcttctttttgttaaagacctcgcatttgtagaccctgatgattgcacacccctaaaaacaatcacaaagttttacaaccaccccttacacttcgtctttaacgatacaaaactggacgctatgttggaggagttcaagaaagagcatactaacaagaagcctaagagctaccagcactag

SEQ ID NO: 184218 - DNA, 2628 bp, Artificial Sequence
  Description of Artificial Sequence: Synthetic coding sequence
atgatcggctgcggcgcctgcgagcccaaggtgaagatggccggcggacaggctgccgccgcactgcccacttggaagatggccgcgcgccgtagcttatccgcccgcggaagaggaatcctgcaggccgccgcaggccggctccttcctctgctcttgttgtcctgctgctgcggcgcgggagggtgtgctgctgtcggtgagaatgaagagaccgtgatcattggtctaaggttggaagacacaaatgacgtgagttttatggaggggggagcacttcgcgtgtcagaacgcaccagggtgaaactcagggtttacggacaaaatatcaataatgaaacctggtcacggattgcattcaccgaacatgagaggagaaggcacagtccaggcgaaagagggctggggggccccgccccgccagagcccgacagcgggccccaacggtgcggtatacgaactagcgatattataatccttccacacatcatcctgaaccgccggacatccggaattattgagattgagattaagcctttgagaaagatggaaaagagcaagagctattacctgtgtacctctttgtcaacccctgctttgggagcagggggctcgggctcaaccgggggcgcagtgggtggcaagggtggatccggtgtggctgggctacctccaccaccctgggctgaaactacctggatctaccatgacggagaggacaccaagatgatagttggggaagaaaagaagtttctgctgccgttttggcttcaggttattttcatatccctactactttgcctttcagggatgttcagtggactaaatcttggcctgatggccctggatcccatggaactgcggatcgtacagaactgtggcacagaaaaagagaaaaactatgcaaagagaatagaacctgtgagacgccaagggaattatctcctctgtagcctgctgttggggaatgtcctggtcaacacgacgctgacaatactgttggatgatattgcaggctctggcttagtggcagttgtcgtgtctactataggcatagtgattttcggcgagattgtgccccaagccatctgctcacgccacggtcttgccgtgggagctaataccatctttctcaccaagttctttatgatgatgaccttcccggcgtcttacccggtatcgaaattacttgactgtgtgctggggcaagagatcggcacagtttataacagagaaaagttgctggagatgttgcgcgtgacagacccctacaacgacctggtgaaggaggagcttaacataatccagggcgcccttgagctgcggactaaaaccgtcgaagatgtgatgacccccttgcgtgattgttttatgataaccggtgaggctatcctcgattttaatacaatgtctgagatcatggagtcaggttacactcgcatccccgtgttcgagggcgaacggtctaatatcgtggatctcctgttcgtgaaagatctggcattcgtagatccagatgactgtactcccttaaaaactatcaccaagttctacaaccacccactgcatttcgtgtttaacgatacaaagcttgatgctatgctcgaagaattcaaaaaggggaagtcccacttggccatcgtgcaaagagtgaacaacgagggcgagggcgacccattttatgaagtgttgggaatcgtaaccctcgaggacgtgatcgaggaaattatcaaatctgaaattctggacgaaactgatctgtatacagataaccggacaaagaaaaaagtggcacatcgtgagagaaaacaggatttctccgcttttaagcaaaccgattctgagatgaaggtcaaaataagcccccagctcttgctggccatgcaccgctttctggcgactgaagtggaagctttctccccctcccaaatgagtgaaaaaatcctgctgcgtcttctcaagcatcctaatgtaatccaggaactcaagtatgacgaaaaaaataaaaaggcgccagaatattatctataccagaggaataagcccgtagactatttcgtcctcatcctccagggaaaggtcgaagtggaagcaggaaaggagggtatgaaattcgaggccagcgcttttagttattacggcgtaatggctctcactgcttcgcccgttcccctttccctgtctaggaccttcgtggttagcagaacagagctcttagcagctggctctccaggtgagaacaagtcacccccacgcccatgtggcctgaaccactctgacagcctgtcccgatcagatcggattgatgctgttactcctacgctggggtccagcaataatcagctcaacagtagccttctgcaggtctatattccagattacagcgtgcgggccctgtctgatctgcagtttgtgaagatcagtcgacaacaataccagaatgcactcatggcatcccggatggacaaaactcctcaatcttctgatagcgagaacactaaaatcgaattgacattaactgagcttcatgacgggctgcccgatgagactgcaaacctcctgaacgaacaaaactgtgtcacccactcaaaagcaaaccactccctgcacaatgagggagccatttag

SEQ ID NO: 184219 - DNA, 2565 bp, Artificial Sequence
  Description of Artificial Sequence: Synthetic coding sequence
atgatcggctgcggcgcctgcgagcccaaggtgaagatggccggcggccaggccgctgccgccctccctacctggaaaatggcagccagacgctccctcagtgcacgagggcgggggatcctgcaggccgccgccgggagacttctccccctgctgctgctctcctgttgttgtggcgctggaggatgcgccgccgtcggggaaaacgaggaaaccgtgattattgggctcaggctggaagacacaaacgacgtgtcattcatggagggaggagccctgcgggtgtcagagagaactcgagtcaaattacgggtgtacggccagaatatcaacaacgaaacgtggagtcgaatcgcgtttacagagcacgagcgacgtcgccactcgccaggggagcgcgggcttggggggccagctcccccagagccggactccggtccgcagagatgcggcatacgaacatctgacataataatccttcctcacatcatcctgaataggcggactagtggaatcatcgagattgagatcaaacccctcagaaaaatggagaagtcaaaatcctattatctgtgtaccagtctcagcacgcctgccctgggcgccggcggatccgggagcaccggcggcgccgttggcggtaaggggggaagcggggtcgccggcctgcccccaccaccatgggccgaaactacgtggatataccacgacggtgaagataccaaaatgattgtgggagaagagaagaaatttttgctaccattttggctgcaagtgatatttataagcctgcttctgtgcttgtctgggatgttttctggactgaatcttggcttgatggccttggacccaatggagctgagaatagtacagaattgtggcaccgaaaaagagaagaattacgcgaagcggatagaaccagtcaggcgacagggaaactatctactttgtagcctgctgctcggcaacgtactggtcaatacaaccctcaccatcttgttggacgacatcgcaggcagcggcctcgtcgctgtggttgttagcacaatcggcatcgtcatttttggcgaaatagtcccccaggccatctgctccaggcatgggctagcagtgggagctaacaccattttcctgacgaagtttttcatgatgatgaccttccccgcgagctatccagtaagtaagttgctggactgtgtgttaggccaagagatagggacagtctacaatcgcgagaagttactggaaatgctgcgggtgactgacccttataacgacctggtgaaggaggagctgaatatcatacagggagctctcgagctgaggacaaagaccgtcgaagacgtcatgaccccattgcgggattgtttcatgattactggcgaggctatactggactttaatacaatgtctgaaatcatggagagcggctacaccagaatacctgtattcgagggagagcgctctaacatcgtggacctgctttttgtcaaggatcttgcatttgtggatccagacgattgtacccccctcaaaacaatcaccaagttctataaccaccctcttcatttcgtttttaatgatactaaactggatgcaatgctggaagaattcaaaaaaggcaaaagtcaccttgcaattgtgcaacgggtgaacaatgaaggtgagggcgaccctttctatgaggttctgggaatagtcacactggaggacgtaatagaggagataattaagtccgaaattctggatgaaacagacctgtatacagataatcggacaaagaaaaaagttgctcaccgtgagagaaagcaggacttcagcgctttcaagcaaacagatagcgagatgaaagtcaagatctcccctcagcttctgctggctatgcatctggtgtttatctccatcgaagttgaggcctttagtcccagtcagatgtcggaaaaaatcctcttgcgcctgctgaaacatccgaatgtgattcaggagctaaagtacgatgagaagaacaagaaggcacctgagtactatttgtatcagcgcaataaacctgtggattatttcgttctaatactccagggtaaggttgaggtcgaggccggtaaggaaggcatgaagtttgaggccagcgcgttctcctattacggagtgatggcactgactgcctctcccggtgaaaacaagagccccccccggccatgtggcctcaaccattccgattcgctgagcagatccgataggatagatgcggtgactcctaccctgggaagcagcaacaatcagttaaattcttctctgctgcaggtgtacatcccagactatagtgtccgcgctctgtccgacctccaattcgtaaaaatctcccgacaacagtaccaaaatgcccttatggcttcaagaatggataaaactcctcagagttctgacagtgaaaatacaaaaatcgagctgacacttaccgagttgcacgatggattacctgatgaaacagcaaatctgctgaatgagcagaactgtgtgactcattccaaggcaaatcactcactacacaacgagggggccatctag

SEQ ID NO: 184220 - DNA, 2631 bp, Artificial Sequence
  Description of Artificial Sequence: Synthetic coding sequence
atgatcggctgcggcgcctgcgagcccaaggtgaagatggccggcgggcaagctgcggctgccctgccaacctggaaaatggcagctcgtagatctctttcagctcgcggccgagggattctgcaagcggctgcaggacggctgttgcctcttctcctgctgagttgttgctgtggtgctggggggtgcgctgctgtcggcgagaatgaagagaccgtgattatcggcctccgtctggaagacaccaacgacgtcagcttcatggaaggcggagcccttcgtgtgtccgagcggacaagagtaaagctaagggtgtacggacagaacatcaataacgaaacgtggtctaggatcgccttcactgaacacgagagaagaagacattcccctggcgaacggggactggggggacccgcccctcccgagccagatagcggtccacaaaggtgtgggataaggacgtccgacataattatcctgccacatatcattctcaataggcgaaccagtggaatcattgaaattgaaattaaacccttgcgtaagatggaaaagtcgaagagctattacttgtgcacctccttaagcacccccgccctgggcgccggcgggagtggttctaccggaggagccgtggggggaaagggcgggtcgggcgttgctgggctgcccccacctccctgggcggaaaccacctggatataccatgacggagaggacacaaagatgattgtcggcgaggaaaagaaattcctcctcccattttggctgcaggtgattttcatctccttgctgctttgtctgagcggaatgtttagcgggctgaacctgggcttgatggctctggatcctatggagctccggatagtccagaactgtgggacggaaaaagaaaagaactatgctaagcgtattgagcctgttagaagacaggggaactatttgctgtgtagcctcctgctcggaaacgtcctggtgaacacaactctgactatcctcctggatgacattgcgggtagcgggctggtggccgttgttgtctccaccatcggaattgtgatcttcggagaaattgtgcctcaggctatctgcagtcgccatggccttgcggtcggcgcaaataccattttcctgactaaattcttcatgatgatgacattcccagcttcataccctgtgagcaagctgctcgactgcgtcctgggtcaggaaatcggcaccgtgtacaaccgagaaaaactgttggagatgcttagagtgaccgatccatataatgacctagtgaaggaagagctgaatatcatccagggcgccttagaactgaggaccaagaccgtggaggatgttatgaccccactcagagattgcttcatgatcacgggtgaagccatattggactttaacaccatgtcggagataatggaatccggatacacaagaataccagtctttgaaggggagcgctctaatatcgtggatctgctgtttgtaaaggatctcgcatttgtcgacccagatgactgcacgccgcttaaaacaatcacaaaattctataatcacccactacactttgtctttaatgacaccaaactcgacgctatgctggaagagttcaagaaaggcaagagccaccttgctatcgtgcagcgcgtaaacaatgagggagaaggcgaccccttttacgaggtgttaggcattgtcacccttgaggatgtgattgaggaaatcatcaagtccgagattctggacgagacagacctgtatacagataaccgaactaagaaaaaagtggcacaccgcgagaggaagcaagattttagtgcatttaagcagactgactctgaaatgaaagtaaagatatccccacaactgctgctcgccatgcacctagtattcatttcgatagaagtggaggccttctccccttcccagatgtccgagaagattcttctcagattattgaaacaccccaatgttatccaggaattaaaatatgatgagaagaataaaaaagcccccgagtattacctttaccagcgtaacaagcccgttgattattttgtgttgattctgcagggcaaagtcgaagtggaggctgggaaggaggggatgaagttcgaagctagcgccttcagttactatggcgttatggcgctcacggcatcacctgtgcctctgtccctttcaaggacctttgtggtttccagaacggagctgctcgccgccggctcacctggggaaaacaaatcacccccacgaccttgcggcctcaaccactccgattctttgtcccgctccgatcgtatagatgcggtaacccccacactcggctcttctaacaaccaactaaacagctctctactgcaggtgtatataccggactatagtgtgcgggcgctcagcgacttgcagttcgtcaaaatatctcggcaacaataccaaaacgcactcatggcatcccgaatggacaagacacctcaatcctcggactcagagaacacaaaaattgagttgaccctgactgaattgcacgacggcctcccagatgagacagctaatctgttaaatgagcaaaattgtgtgacccattccaaggctaatcactccctgcataacgagggcgcaatctag

SEQ ID NO: 184221 - DNA, 1725 bp, Artificial Sequence
  Description of Artificial Sequence: Synthetic coding sequence
atgatcggctgcggcgcctgcgagcccaaggtgaagatggccggcggccaggcggccgccgcactgcccacgtggaagatggccgcgcgaaggagtctcagcgctcggggacgcggtattctgcaggcagcagctggacgcctccttccactcttgctgctctcctgttgttgcggggctggcggatgtgctgctgtgggggagaatgaggaaacagtcatcatcggcctaagactagaagatacaaacgacgtctcttttatggagggcggtgccctacgagtgtcagaacggacccgagtgaaactgcgggtgtatggtcaaaatataaacaacgagacttggtcacgcattgccttcactgaacacgagcggcgccgccactcccccggggaaaggggcctgggcggacctgcacccccagagccagattccgggcctcaacggtgcgggatccgcacaagtgatatcattatcctgccgcatattattttgaataggaggaccagtggtatcatcgaaatcgaaatcaagcccctgcgcaagatggagaagagcaagtcttattatctgtgcacatccctgtcaacacccgcactgggggccggcgggagtggatctacggggggtgctgtggggggcaagggaggcagcggagtcgccgggttgccaccaccaccgtgggctgagacgacttggatttaccatgatggagaggacactaaaatgatcgtcggagaggagaagaagtttcttctgcctttctggcttcaggtaatctttatcagcctgctgctctgtctgtccggcatgttttccggactgaatttgggcttgatggccctagatcctatggagctccggattgttcaaaactgcggcactgaaaaagagaagaattatgccaaaaggatagagccggtgaggcggcagggaaattatctgctgtgcagtcttttactgggtaacgttcttgtcaatacaaccctgactatactgttagatgacatagccggttccggactggtcgccgtggtggtcagcaccatcggtattgttatttttggcgaaatcgtgccacaagccatttgcagtcggcacgggctggcagtgggagctaacacaatcttcctcacaaagttcttcatgatgatgacttttccagcgagctaccctgttagtaagctgttggattgcgttctgggacaagaaatcgggaccgtatacaatagagagaaactgctcgagatgctgcgcgtgaccgacccttacaacgaccttgtcaaggaggagctgaatatcatccagggagccctggaactccgcacaaaaactgtcgaagacgtaatgacccctctacgcgactgctttatgatcaccggagaagcaattcttgattttaataccatgagcgaaataatggaatcaggttacactagaatccccgtgttcgagggtgaacgttctaacatcgtcgacttgctgttcgtaaaggatctcgcgtttgtggatcctgatgattgtacaccactcaagactattacgaaattttacaaccacccactgcactttgtttttaatgatacaaagttagatgctatgctcgaagagtttaaaaaggagcatactaataagaagcctaagtcgtatcagcattgtaacgagcaaaactgcgtcactcacagcaaagccaaccactccctccacaatgaaggggctatttag

SEQ ID NO: 184222 - DNA, 2124 bp, Artificial Sequence
  Description of Artificial Sequence: Synthetic coding sequence
atggccgccgccgtggccgccgccggccggctgggctggctgttcgccgctctatgcctgggtaacgcagccggcgaggcggcacctggccctcgggtgttagggttttgcctggaagaagacggggcagccggcgccgggtgggtccgcgggggcgcagccagggatacgcctgatgccacctttctgcttcggctgtttggccctggattcgccaacagttcctggagctgggttgctcctgagggggccggctgcagggaagaagccgcatctcccgccggcgagtggagagcgctgctgcggctaaggctaagagcagaggcagtgcggccacactcggccttgttggccgttagggtcgaaccggggggcggcgccgctgaggaggctgcgcccccctgggctcttgggctgggcgccgctggactcctggctctcgcagcactggcaaggggattacaactgtctgcgttggccctcgcgcccgcagaggtgcaagtgctgagggaaagcggatccgaagcagagagggcggctgcgcggaggctggaacctgcacggaggtgggctggctgtgcattgggcgctttgctgctgctggctagcttagctcaggctgccctggcagtcctgctgtacagagctgctggccaaagggccgttccagccgtgctgggtagcgccggcctggtctttctggtgggcgaagtagtgcctgccgctgtgagcggacgttggacgctggcgctcgcccctcgtgcccttggcttgtcacggctggccgtcttgctgaccttacctgtagccctgcctgtcggacaactacttgaactggcggcccgcccaggaagattgagagaacgcgtgctggagctggctcgcggaggtggcgacccgtacagtgatctcagcaaaggcgtcttacgatgtcggacagtggaggacgtgctcactccccttgaagattgctttatgctagatgccagtacggtcctcgactttggtgtgctggcgtccatcatgcagtccgggcatacacgaattcctgtttacgaggaggaacgttctaacattgtggacatgctatatctcaaagatctggcattcgtcgacccagaggattgtacgccattgtctactattaccaggttttataaccatccgcttcactttgtgttcaacgacacaaaactcgacgctgtgctggaggagttcaaaagggggaagtcccacttggccattgttcagaaggtcaataatgagggcgagggcgaccccttttacgaagtgctgggattggtcaccctcgaggacgtgatcgaagaaatcatcagatcagagattctcgacgagagtgaggactatagagatactgttgtaaaacgaaagcccgcctctcttatggcccccttgaaaagaaaagaggaattttctctcttcaaagtctcagacgacgagtataaggtgaccatttctccccagctactcttggcaacacaacggttcctgtctagagaggtggacgtgttcagtcctcttagaatctctgaaaaggtcttactgcaccttctgaagcatccaagcgttaaccaagaagtgagattcgacgagtcaaaccgcctggccacgcaccactacctctatcaacggtctcagcccgtggactactttatcctaatcctgcagggacgtgttgaggtagagatcggaaaggagggcttgaaatttgagaacggcgctttcacctactatggcgtgagcgcattaaccgtaccgtcaagcgttcaccagagtcctgtgtctagcttgcagcccatacgacacgatttacagcccgatccgggtgatgggacccactcttcagcatactgcccagattacaccgtacgagccctttccgacctccagctgatcaaagtaaccaggctgcagtatctcaacgccctcctcgctactcgagcccagaaccttcctcagtcacccgagaacacagacctgcaggtgatccccggctcgcagacccgcctgctgggggagaagactactactgccgccggctctagccacagcagacccggcgtacccgttgaaggatcaccaggtcgaaacccaggggtttag

SEQ ID NO: 184223 - DNA, 1980 bp, Artificial Sequence
  Description of Artificial Sequence: Synthetic coding sequence
atggccgccgccgtggccgccgccggccggctgggctggctgttcgccgctctctgcctgggcaacgcagcaggcgaggcagcccccgggccaagagtcttgggcttttgccttgaggaggatggcgcggccggggctggctgggtgcgggggggggcagcccgggatacacctgacgccaccttcttactccggttattcgggccagggttcgctaattctagttggagttgggtcgcacccgaaggggccggctgtagggaggaggccgcctcacctgccggcgagtggcgtgccttgctgcgcttacggttgcgggctgaggcggtcaggcctcattcagccttactagccgtgcgtgtcgagccaggcggcggggccgctgaggaggcagcccccccatgggccctcggattgggcgcagccggccttctggctctggccgctcttgctcgaggccttcagctttccgccttggccttggcacccgccgaggtccaggtgctcagggaaagtggaagtgaagctgaacgcgccgcagcacgcagactggagcctgcccgacgctgggcgggctgcgcccttggtgccttgctcctgctcgcaagccttgcccaggcagcgctcgcagtcctcctatacagagcagctgggcaacgggccgtccctgccgttcttggtagcgctgggctggtgttcctcgtgggggaggtggtgccggccgccgtgtccggccgctggacacttgccctcgccccaagggcattgggattgagcagactggcagttttgctgacgctgccggtcgccttgcccgtgggccagctgctcgaactggctgccaggccaggccgcctgagggagcgggtcctagaattggcccggggtggcggggacccttactccgatctaagcaaaggcgtcctgcggtgcagaaccgtagaggacgtactaacccctctggaggattgctttatgctggatgcctccacagtcttggactttggtgtgttggcaagcattatgcaaagtggacacacccggatacccgtttacgaggaggaaaggtctaatatagtggacatgttatatctgaaagacctggcctttgtggacccagaggactgcacaccgctttccacgatcacacgtttctacaaccacccccttcactttgtgtttaacgacaccaagctcgacgccgtgctcgaggaatttaagcggggtgacacagtggtaaaacgaaaacccgcgagcctgatggcccccctcaaaaggaaggaagagttttctctgtttaaggtgagtgacgatgagtataaggtcaccatttccccccagttgttgctggctactcagaggtttctatcgcgggaggtggacgtattttctcctctgcgaatctccgaaaaagttctgctccatcttctcaagcatccgagcgtgaatcaggaggtccgattcgacgaatcgaacagactggccacccaccattacctctaccagcgaagccagcccgtagactactttatactcattctacagggtagggttgaagtggaaatcggtaaagagggactcaagttcgagaatggcgcttttacctattacggcgtttccgcgcttactgtgccttccagcgtccaccagagccccgtatcctccctgcagcccattaggcacgatttgcagccagatcccggggatgggactcattccagtgcttactgccccgactatactgtgagagctctttcagatctacagctgatcaaggtgacgaggctacaatatttgaacgcgctgttggctacacgcgcccaaaaccttccccaaagcccagagaacactgacctccaggttatcccgggatcccagacccggttactcggggagaagactaccaccgcggccgggagctcccacagtcggcctggggtgccagtggaagggtcaccggggaggaaccccggcgtgtag

SEQ ID NO: 184224 - DNA, 2043 bp, Artificial Sequence
  Description of Artificial Sequence: Synthetic coding sequence
atggccgccgccgtggccgccgccggccggctgggctggctgttcgccgcattatgcctggggaacgcagctggagaggccgccccagggccaagggtcttgggattttgtctcgaggaggatggcgcggctggcgcagggtgggttagggggggcgctgctcgagatacccctgacgctactttcctgctaagactgttcggtcccggctttgccaattcatcctggagttgggtcgcccccgagggtgctgggtgcagggaggaagccgccagccctgctggggaatggcgggctctcctgcggttacgacttcgcgccgaggccgtgaggccccattcagctcttctagctgtgagggttgagcctggaggaggcgctgccgaggaagccgctcccccctgggcacttggtctcggcgcagcaggtcttctcgctctggccgccttggcgagaggactgcagctgtccgctctggcacttgcccctgccgaagtccaggtgctccgggagagcggcagcgaagcagagagagctgccgcccggagactggagccagccagacggtgggccgggtgcgcactgggcgccctactactgctggcctccctggctcaggccgctctcgctgtcctgctctatcgcgcggctggacagcgggcagtgcctgccgtcttgggttctgccggcctcgtgtttctggtgggagaggttgtacctgcagctgtgagcggaagatggaccctggcactcgcccctagggccctcggactgtcccgactggccgttctcctcactttgccggtggccctgccagttggtcagctcttggagctagcagctcgaccaggtcgcctgagagaacgggttctcgagctcgcaagaggtggaggcgacccctactccgacttgtcgaagggagtgctgcgttgtagaaccgtagaggatgtgttgaccccgctcgaagattgtttcatgctagatgcatccactgtgctggatttcggggttcttgcttccattatgcagtccggtcacactcgtatccctgtgtacgaggaggaaaggagcaatatcgtggacatgttgtacctcaaggatctcgctttcgtcgatccagaggattgcaccccactgtctaccatcacccggttctataaccaccccttacatttcgtttttaacgatactaagttggatgccgtcctggaagagtttaagcgcggcgatactgtggtaaagaggaaacccgcatctctgatggcacctctgaaaagaaaggaagagtttagcctttttaaagtgagcgatgacgaatataaggtgaccattagcccgcagcttctgctggcgactcagagattcctgtcccgtgaggtggacgtgttctctccgctgcgaatctcagagaaagtgctcttacacttgctaaagcatccttctgtcaatcaggaagtccgctttgatgaaagtaacaggctcgccactcaccactacctgtaccagcgcagtcagcccgttgattacttcatcctgatcctgcaggggcgagtcgaggtcgagataggaaaggaggggctcaagtttgagaatggcgcattcacctattacggggtctctgccctcaccgttccatcctccgttcatcagagccctgtgtcctctctgcagcccatacgccatgacctccaacctgaccctggtgacgggacccattcaagcgcatactgcccagactataccgtgcgggctctttccgacctgcagctgataaaagtgacaagactacaatacctgaacgccctcttggccacgagagcgcaaaatttgccccagagccccgaaaacaccgacctgcaggtaataccaggctcccagactcgccttttaggagagaagaccactaccgcagccggaagctcacattcaagaccatcacttcccctgttgcctagaggccgtgacagcgcggcatactcagactccgatctgttcgggctctcacacttggtctccgctgttacagcctttgtgtggccttag

SEQ ID NO: 184225 - DNA, 2328 bp, Artificial Sequence
  Description of Artificial Sequence: Synthetic coding sequence
atggcccccgtgggcggcggcggccggcccgtgggcggccccgcccgcggtcgcctactcctggctgcaccggtgctgctggtcctattgtgggcactgggggcacgcggccagggatctccacaacaagggacgatcgtaggcatgaggctagcctcctgtaataaaagctgcggcaccaacccagacgggattatttttgtttcggagggttctaccgttaatttgaggctgtatgggtattcactggggaatataagctcaaacctgattagtttcaccgaagtcgacgacgccgagacactccacaaatctactagctgcctggaactaaccaaagacctggtggtacaacaattggtgaacgtaagtaggggtaatacatccggggtgctcgtcgttctgacaaaatttctgcgaagatcggagtctatgaaactgtatgccttgtgcactcgagcgcagccagatgggccatggctaaagtggacagataaggatagtctgctttttatggtggaggagccggggcgcttcctgcccctgtggctccacattctcctcattaccgtcctgcttgtgctctcggggattttcagtggtctgaatttagggctgatggcattagaccctatggagttgcgaattgtgcagaattgcggcacggagaaggaacgacgatatgctcgcaagatcgagcctatacggagaaagggtaactatctgctttgttccttgctcctgggcaacgtccttgtcaatacaagcctcacaattctgctggataacctgatcggcagtgggctcatggcggtggcctcttcaaccatcgggattgtcatctttggggaaattctgccccaagcgttgtgctcccgccacggtctggccgtaggcgccaacaccatcttactcacaaagtttttcatgcttctaacattccctcttagttttcctataagcaagctgctggacttctttttagggcaagaaatccgcaccgtgtacaatcgcgagaagctcatggagatgctgaaggtgaccgaaccctacaatgacctcgtaaaagaagagcttaacatgattcaaggcgcccttgaactgcggactaagaccgtggaggacattatgacacagcttcaggactgtttcatgatacgctccgatgccatcctggactttaatactatgagtgagatcatggaaagtgggtacacccggatccccgtcttcgaggatgaacagtctaatatagtggacatcctgtatgttaaagatctcgcatttgttgacccagatgattgtacgccactgaaaacaattactaggttctacaatcacccagtacatttcgtcttccatgacacaaaactcgacgctatgctggaagaattcaaaaaaggcaagagccatctggccatcgtccagaaagtgaacaatgagggcgagggcgacccattctacgaagtgctgggccttgtgacccttgaagacgtaatcgaagagatcatcaagtctgagatcttagatgaatccgacatgtatactgataaccgctccaggaaaagggttagtgaaaagaataaacgggatttttccgccttcaaagacgctgataacgagctgaaggtgaagatcagtcctcagttgcttcttgcggcccaccgctttctagctaccgaggtgtcccagttttcaccatcactgattagcgagaagatcctcctccggctgctgaaataccccgacgtaatccaagaactgaagtttgatgaacataacaagtactatgcccggcactacttgtatacaaggaataaaccagccgactactttattctcatcctacaggggaaagtggaagtcgaagccgggaaggagaacatgaagtttgaaacaggggcctttagctattatgggaccatggccctgaccagcgttcccagcgaccgtagcccagcccaccctacacccctcagccgtagtgcttccttaagttatcctgatagaactgacgtgtctactgcggcgacccttgctgggtcctctaatcagtttgggtcctccgttctcggacagtatataagcgatttcagcgtaagggccctggttgacttgcagtacatcaagatcactcggcagcagtatcagaacgggctcctcgcatcccgaatggaaaactctcctcagtttcctattgacggatgcacaacccatatggagaaccttgccgagaagagtgaattgccagtcgtggacgaaacaaccaccctcttgaacgagagaaactcactgctgcacaaagcctcccacgagaatgccatctag

SEQ ID NO: 184226 - DNA, 792 bp, Artificial Sequence
  Description of Artificial Sequence: Synthetic coding sequence
atgtacaccgacaaccggagccggaagcgggtgagcgagaagaacaagagggacttctccgccttcaaagacgccgacaacgaattgaaggtcaaaatcagccctcagttactgctggccgcacacaggtttctcgcaacggaggtatcccaattcagtcctagtctaatcagtgaaaagattctgctgcgtctcctgaagtacccagatgtgatccaggagctgaagtttgacgaacataataagtattatgcacggcactacttgtataccaggaataaacccgctgactattttattctcattcttcagggtaaggtagaagtggaggctgggaaagaaaacatgaagtttgaaactggcgcattctcttactacggaacaatggccttgacttcagtgcccagcgacagaagtcctgctcacccgacacctctcagcaggagtgcctcgttatcataccccgatcgaacggacgtaagcactgccgctacactggctggcagctcaaatcagtttggttctagcgtgcttggccagtatatatctgacttctctgtccgcgcgctggtcgatctgcagtatatcaagccacagtcttggccctgcttttcccgtccgggagacagagtctgtcttccagcccccccatccatgaacagcagtttacctcatgccgatcactctgccgcagtccctgagagagcggccggattttcacatggtgaacagcccagtgtttctcatcgtagggtccatcatccgcacggcgagctgggaagagaagtttag

SEQ ID NO: 184227 - DNA, 2193 bp, Artificial Sequence
  Description of Artificial Sequence: Synthetic coding sequence
atggccagcggccggggcgccagcagccggtggttcttcacccgggaacagctggaaaacacaccaagcagacggtgtggggtggaagccgacaaggaactgagctgccggcagcaggccgccaacctgatccaagaaatgggccaaaggctgaacgtctcacagcttacaattaatacagccatcgtttatatgcaccggttttacatgcaccacagtttcacaaagttcaacaagaatatcattagctccactgcgctattcctcgcagctaaggttgaggaacaggcgcgcaagctggagcacgtaataaaagtggctcacgcctgtcttcacccactcgagccgctgctagataccaagtgtgacgcctaccttcaacaaactcaggaattggtaatactcgagacaatcatgctgcagaccctgggatttgaaatcaccatcgagcacccacatactgacgtggtaaagtgtactcagcttgtgcgcgcatcgaaagatttggcacagaccagctacttcatggccacaaatagcctacaccttaccaccttttgtctgcagtataaacctactgtcatcgcatgtgtctgtatacacttggcctgtaagtggtcaaactgggaaatccccgtgtccacggatggcaagcactggtgggaatatgtcgatccaacggtgacgctggagcttctagacgagctgactcatgagtttcttcaaatcctggagaagactccgaatcgcttaaagaaaatacgcaactggagagctaatcaggctgcccgcaagccaaaggtcgatggacaggtcagcgagacaccacttctgggtagcagcttagtacagaactctatccttgttgactcagtgaccggcgtgcctaccaatccgtctttccagaagcctagtacttcggcttttcccgcacctgtccctctgaactccggtaacatcagcgtccaggatagtcatacctccgacaatttatccatgctcgcgactggcatgcccagcacatcatatgggctttccagccaccaggagtggcctcaacaccaggactctgcacggacggaacagttgtactcacagaagcaggaaacttctctctccggttcccagtacaacataaatttccaacagggtccatcgatttccctccactccggcctgcatcaccgaccagacaaaatcagtgatcacagctccgttaagcaagaatatacacacaaagcaggcagcagcaagcaccatggacctattagcaccacaccgggcattattcctcagaagatgagtctggataaatatcgcgaaaagaggaagctagagaccttggatttggacgtgagggatcattatatcgctgcacaagtcgagcagcagcataagcagggtcagtcccaagccgccagtagtagctctgtgaccagtccgattaagatgaagattcctatcgcgaatactgaaaagtacatggcagacaaaaaggagaagtccgggtccctcaaattacgcatcccaatcccgcccactgacaagtctgcctcgaaagaagaactcaaaatgaaaatcaaggtgagctctagcgaacgtcactcctcttcagatgaggggtcagggaagagtaaacacagcagcccacacatctcaagggatcacaaggaaaaacacaaagaacatccctcctcccgccatcacacgtccagccataaacattctcatagccattccggaagctcttctggaggctcaaagcatagtgccgatggcataccccccacagttctgagaagtcccgtcggcctgtcgtccgacggtatctcctccagctcgtctagttcccgaaaaagactgcacgtgaatgacgcttcccacaaccaccacagcaagatgtccaagtccagcaagagcagcggaagtagctcaagcagttcatcatccgtgaagcaatatatctcctctcacaactctgtgttcaaccatcccctgcctccgcccccacccgttacatatcaggttggttacggacacctctccacccttgtgaaactggacaagaaacccgtggagacaaacggtcccgatgctaatcacgagtactctacttcctcacagcatatggactataaggacaccttcgacatgctcgactcccttttgagcgctcagggcatgaatatgtag

SEQ ID NO: 184228 - DNA, 1992 bp, Artificial Sequence
  Description of Artificial Sequence: Synthetic coding sequence
atggccagcggccggggcgccagcagccggtggttcttcacccgggagcagctcgaaaatacccccagccgcaggtgcggcgtagaagccgacaaagagctctcgtgccgccagcaggccgcaaacctcatccaggagatggggcaacggctcaatgtcagccaactgacaattaacacagcaattgtgtacatgcacaggttttacatgcatcacagttttacaaaatttaataagaacatcatctcatccacggcgctgtttttggccgcaaaggtcgaggagcaggcccggaaacttgagcacgtgatcaaagtggctcatgcctgcctgcacccacttgaaccgctcctcgacactaaatgcgacgcatacctccagcagacacaggagcttgttatccttgaaacaattatgctgcagacactcgggtttgagatcaccatagagcatccccacactgacgtagtaaaatgtacccagttggtgcgtgcgagcaaggacctcgcccagacatcctatttcatggcgacaaacagcctgcacctcacaactttttgtctgcagtacaagccgacagtaatcgcatgcgtctgtatccatttggcctgcaagtggtctaattgggagattcctgtgtccactgatggaaagcactggtgggaatacgtggacccaaccgtaaccctcgagctgcttgacgagctcacacatgagttcttacagattctcgagaagacgcccaacaggctgaagaagatcagaaattggcgcgctaaccaggccgccaggaagccaaaggttgacggtcaagtcagtgaaacgcccttgctcggtagttcactggtgcagaatagcattttagtggatagtgtgactggggttcccacgaacccgtctttccagaagccatctacatcagcctttcctgcacccgtcccccttaatagtgggaatatctccgtgcaggactcacatacttccgacaacctgtccatgctggccaccggaatgccctctacaagttacggtttaagctcacaccaggaatggccgcagcaccaggacagcgcccgaacagaacagctgtacagccagaaacaagagacgtctctctccggttcgcaatacaatattaacttccaacaggggcccagcatttcgttacactccggtctgcatcaccgccccgacaagatctcggaccattcttccgtgaaacaagagtacacgcacaaggctggctctagtaagcatcacggtcccattagcaccacccccggcattatcccacagaagatgtcacttgataagtacagagaaaagagaaaactggagacactggatttagatgtccgagatcattacatcgctgcacaggtagagcagcaacacaaacagggacagagccaggccgcgtctagcagctctgtcactagtcccattaagatgaagattcctatcgccaacaccgagaagtatatggccgataaaaaggagaaaagcggctcactcaaacttcgaatacccatccctccaaccgataagagtgcgtcaaaggaagaattgaagatgaaaattaaggtaagttcatctgaaagacactctagttcagatgaaggaagtggcaagtcaaagcactccagcccccatatctccagagaccacaaggaaaagcacaaggagcatccatcttctcgacatcatacctcttctcataagcactcgcacagccatagtgggagctccagtggaggctcaaagcacagtgcggatggcatacctcccacagttctgaggtctcccgtgggtctgtcttccgatgggatttcttcgtcctcctcctcgagccgtaagcggctacatgtgaacgatgcctcgcacaatcatcattcaaagatgtccaagagcagcaaaagctctgggggtcttaggacctcacagcaccctcgagaaaccggacaggaggcatctggcgaccaacgatcctag

SEQ ID NO: 184229 - DNA, 1467 bp, Artificial Sequence
  Description of Artificial Sequence: Synthetic coding sequence
atggccaccaacagcctgcacctgaccaccttctgcctgcagtacaagcctacagtgattgcatgtgtgtgtatacatctggcgtgtaagtggtccaactgggagattcccgtgtctaccgatggaaagcactggtgggagtacgtagacccaacggtgaccctggaactgctcgacgagctgacgcacgaattcctgcaaattcttgaaaagactcccaatcggctgaaaaagatccgcaactggagagccaaccaagcggcccgcaaaccaaaagttgatggccaagtatccgagacgccactgttgggtagcagtctggtccagaattccattctggtggactcggtcaccggcgttccaactaatccatcttttcagaagccaagcacaagcgcgtttcccgcgccagtgcccctcaattcaggaaacatttccgttcaagactcgcatacttccgataatctatcgatgctagctacaggcatgcctagtacaagctacggtctgtcttcccaccaggagtggccacagcatcaggactcggccagaactgagcagctgtacagccagaaacaggaaacctcactaagcgggtcacagtataatattaatttccagcagggaccctccatcagcctccactccggcctgcaccacaggccggacaaaatctctgaccactctagtgtcaagcaggagtacacccacaaggccgggtcttctaagcatcatggaccaataagcacaacacccggcataataccacagaaaatgagccttgacaagtatagggaaaagcggaagctcgaaacactggatctagacgtcagggatcactacattgccgcccaagtcgagcagcagcataaacagggccagtcccaggctgccagctctagcagcgtgacgtctcctatcaagatgaagatccccatcgctaataccgaaaaatacatggcagataagaaagagaagtcgggtagtctgaaactgcggattcccatacctcccactgataaatccgccagtaaagaggaactcaaaatgaagatcaaggtctcgtcatctgagcgccactcaagcagtgatgagggatctggaaaaagcaagcactcctctccacacatatccagggaccacaaggagaagcacaaggagcatccctcctccaggcaccacacatcttcacacaaacattcccattcccacagcgggagcagcagcggcgggtctaaacattccgcggatggaatccctcccaccgtcttgaggtctcccgtggggctgagtagcgacggcatctcaagcagctcctcatcctcacggaagaggctacacgtcaatgatgcgagccacaatcaccattcaaaaatgagcaaaagctccaagtccagtgggggcctaaggaccagccagcatccgcgggaaacaggccaggaagcatcaggtgatcagagaagctag

SEQ ID NO: 184230 - DNA, 864 bp, Artificial Sequence
  Description of Artificial Sequence: Synthetic coding sequence
atggagttcaaccccagcgaccacccccgggccagcaccatcttcctgtctaaaagccagaccgatgtccgcgaaaaacgcaaatctctgttcattaatcaccaccccccagggcagatagcaagaaaatatagttcctgttcgaccatcttcctggacgactctaccgtatcccaacccaatctcaaatacacaatcaagtgcgttgcccttgctatctactaccacatcaagaatcgggatcccgacggccggatgcttttggatatttttgatgaaaatctgcacccattatccaagagcgaggtcccgccggattatgacaagcacaacccggaacagaaacaaatataccggtttgtgaggaccctgttctctgcggctcagcttaccgcagagtgcgcaattgtgactcttgtttatcttgagcgcctactcacctatgccgagatcgacatttgccctgcgaactggaaacgaatcgtgctaggggccatactgctcgcttcaaaggtatgggatgaccaggcagtatggaacgtcgattactgccaaatacttaaggacataacagtggaggatatgaatgagttggaaaggcagtttctggagctgctgcaattcaacataaacgtgccgtccagtgtatacgccaagtactacttcgatctgaggagtctcgccgaagccaacaacctttcgtttcccttagaacccctgtctagggaaagagctcacaagctagaagccatcagtcgcctgtgcgaagataagtacaaggacctaagacggtcagcccgaaagaggtcagcgtccgctgataatttgacacttccgagatggtctcctgcgattattagctag

SEQ ID NO: 184231 - DNA, 951 bp, Artificial Sequence
  Description of Artificial Sequence: Synthetic coding sequence
atgggcaacaccaccagctgctgcgtgagcagcagccccaagctgagacgcaacgcacacagcagactggagtcctatagacccgacacggatctgtctcgggaggatactggatgcaacctccagcacatttctgacagagaaaacattgatgtgcgtgaaaaacggaagtccctgtttataaaccaccatccacctggccagatcgcacggaagtactcctcttgttccacgattttcctcgatgattccactgtgtcacagcctaaccttaaatataccattaagtgcgtggccctcgctatctactatcatattaagaatagggaccctgacgggcgcatgctgctggacatcttcgatgagaacctgcaccccctgtctaagtccgaagttcctccagactatgacaaacacaacccagagcagaaacagatctataggttcgtgcgaacacttttcagcgcagcccaactgactgcagagtgtgcaattgtgacactagtgtacctggaaaggttactcacctatgcagagatcgatatatgcccggcaaactggaaacgtatagtgctgggcgccattctcctcgccagcaaggtgtgggatgatcaggcagtatggaatgtggactattgtcagattttgaaggatataactgttgaggacatgaatgagctagagagacaatttctggagctgctgcagttcaatattaatgttcccagcagcgtgtatgctaagtattatttcgacctgcgctccttggccgaggccaataatctctctttcccactggaaccgctgtcccgtgaacgcgcccataagctggaagccatctctcggctgtgcgaggacaagtataaggatcttaggcgcagtgcacgtaagcggtccgcatcagccgacaacctgacattaccaagatggagccccgcgattatttcctag

SEQ ID NO: 184232 - DNA, 1026 bp, Artificial Sequence
  Description of Artificial Sequence: Synthetic coding sequence
atgggcaacaccaccagctgctgcgtgagcagcagccccaagctgcgccgaaacgcgcattctcgtctcgagtcttacagacctgatacagacctaagtagagaggacacgggttgtaatctccagcatatatcagatcgcgaaaatattgacgatttgaatatggaatttaatccgtccgatcacccacgcgcgtctacaatatttctctcaaaatcacagactgacgtccgcgaaaaaaggaagtccctgttcattaatcatcatcctcctggccagatcgcacgaaagtatagcagctgttccaccatcttcctagacgatagcaccgtgagccagcccaacctcaagtacactattaaatgtgtcgccctagctatctattatcacattaagaaccgcgatcctgatggacgcatgctgctggatatttttgatgagaacttgcatcccctgtcaaaatcagaggtgcccccggattatgataaacacaaccctgaacaaaaacagatctacagatttgtgagaacgctgttttctgctgcgcagctgacggcagagtgcgccatcgtgactttggtgtatcttgaacgcttactcacgtatgccgagattgacatctgccctgccaactggaagcgcattgtgctgggcgctattctcctagcaagcaaggtatgggacgaccaggcggtgtggaatgtggattactgccagatcctgaaggatattacagtggaagatatgaacgagcttgagcgccaatttctagagttgttgcagtttaatattaacgtgccgtctagcgtctatgcaaagtactatttcgatttacggtcactcgccgaagccaataatctgagtttccctctggagccactcagtcgggagcgggcccacaaactggaggcaattagcagactgtgcgaggataaatataaggatctgcgaagaagcgcgcgcaagaggagcgcctctgccgacaacctgactctcccgcgctggtcccctgccattatctcttag

SEQ ID NO: 184233 - DNA, 864 bp, Artificial Sequence
  Description of Artificial Sequence: Synthetic coding sequence
atggagttcaaccccagcgaccacccccgggccagcaccatcttcctgtccaaaagtcaaactgacgtccgggagaagcggaaatccttattcataaatcaccacccacctggccagatagcacggaaatactcaagttgtagcacaatttttctggatgactcaacagtgtctcaacctaatctgaagtacaccataaaatgtgttgctttagccatctactaccacatcaagaatagggatcccgacggcagaatgctccttgatattttcgatgagaacctgcaccccctgagcaagagtgaggtgccgccagattatgacaagcacaaccctgagcagaaacagatctaccgctttgtgagaacactgttctccgccgcccagctcaccgctgagtgtgcgatagtgactttagtttacctggagaggctcttgacgtacgccgaaattgacatctgtcctgcaaattggaaacggatcgtcctgggggctatcctactggcctcgaaggtgtgggatgaccaggcggtgtggaatgtagactactgccaaatcctgaaggatattactgttgaggacatgaatgaactagagcgacagttcctcgagctactgcaatttaacattaatgtgccttcctccgtctacgccaagtattattttgacttaaggtccctcgccgaggcaaacaacctctcttttccactcgagccattatccagagaaagggctcataagctggaggccatcagtcggttatgcgaagacaagtacaaggatttgcggaggagcgcacgcaaacggtcagcttcagccgacaatctgacactgcctaggtggtctcctgccattatctcctag

SEQ ID NO: 184234 - DNA, 627 bp, Artificial Sequence
  Description of Artificial Sequence: Synthetic coding sequence
atggaccccgacggccggatgctgctggacatcttcgacgagaacctccacccactcagcaagagtgaagtgccccctgattacgacaaacacaaccccgaacaaaagcagatttatagattcgttaggacattgttcagtgctgcccagctgacagctgagtgcgccatcgtgacccttgtttaccttgaaagattgcttacatatgccgaaattgacatctgcccagcaaactggaaacgcattgtcctcggcgccatcctcctcgcgtccaaagtgtgggatgaccaagccgtatggaacgtcgactactgccagatactcaaagatatcactgtggaggatatgaacgagttagagagacagtttctggagctcctgcagtttaacatcaatgtacctagtagtgtgtacgccaaatattacttcgacctcaggtcgctggcagaagctaataatctcagttttccactggaaccattatccagagaacgagctcataagcttgaggctatctctcgactctgcgaagacaaatataaggacctgcgacggagcgcccgtaagcgaagtgcctcggcagataacctcaccctgcccaggtggtctccagcaattatttcatag

SEQ ID NO: 184235 - DNA, 1026 bp, Artificial Sequence
  Description of Artificial Sequence: Synthetic coding sequence
atgggcaacaccaccagctgctgcgtgagcagcagccccaagctgcggcgcaacgcgcactcaaggctcgaatcctatcgcccagatactgacctcagccgggaggatacaggttgcaatcttcagcacatatctgatcgagagaacatcgacgatttgaacatggaatttaacccgtcagatcatcctagggcctctactatcttccttagcaagtcccagacagatgtgagggagaagcggaaatcgctcttcatcaatcatcacccacccggacagatagccaggaagtactcaagctgcagcacgatatttttagatgattccaccgtatcccaaccaaatctcaagtacaccattaagtgcgtcgccttggccatatactatcacattaaaaatcgggatccagatggcaggatgcttctcgatatctttgacgagaatcttcaccccctgtctaaatccgaggtgcctcccgattatgataaacataaccctgaacagaaacagatttaccggttcgttaggactctcttctccgccgcccagctgacagcagagtgtgctatcgtgactctcgtttatctggaaagactgcttacatatgcagaaatcgatatctgtccagctaattggaaacgaattgttttgggcgctattctgctcgccagcaaagtgtgggacgatcaagcggtctggaacgtggactactgccagattttaaaggatatcaccgtggaggatatgaatgagctggaacgccaattcctcgagctgctccaatttaacatcaacgtgcctagttccgtctacgcaaaatattactttgatctccggtctttggccgaggccaacaacctgtccttcccactcgaacccttgagtcgcgagcgggctcataagcttgaagcgatttctaggttatgtgaagacaagtataaggatctgcgaaggtcagctcggaaaaggtccgccagtgcagataacctgactcttccccgctggagccccgccatcatctcatag

SEQ ID NO: 184236 - DNA, 942 bp, Artificial Sequence
  Description of Artificial Sequence: Synthetic coding sequence
atggagcccatgtaccaggaccgggcccgggacacccagaccgacgaaatagtggctctgaaaaaggtgcggatggataaggagaaagatgggattccaatctcctcattgagagaaatcacactgttactgcgccttaggcatccaaacatcgtggagctcaaggaagtggtggtgggaaatcatcttgaatccatattcctcgtcatgggctattgcgaacaagacttggcaagcctgcttgaaaatatgcccaccccttttagcgaagcacaggtaaagtgtattgtcctgcaggttctccgcggactgcaatatttacacaggaactttattattcaccgcgatctgaaggtgtccaatttgcttatgaccgataagggttgcgttaaaacggctgattttggcctagcacgcgcatatggcgtcccggtcaagcccatgacacccaaagttgtaacgctgtggtaccgtgctccggaactcctgttaggcactacaactcagaccaccagcatcgacatgtgggccgtgggatgcattctggccgagctgctggcccatcgtccactccttccaggcacttccgaaattcaccaaattgatctgatcgttcagctgttaggtaccccttctgaaaatatatggccaggctttagtaaactcccactcgtaggtcaatacagcttgagaaaacagccctataataatctgaagcataaatttccatggttgagtgaggcagggctgagactgttacactttttattcatgtacgacccaaaaaagcgcgctacagcaggagattgtttggaatcaagctatttcaaggaaaaacctctgccctgcgaacctgaattaatgcccactttccctcaccacagaaacaaacgggcagcgcctgccacctccgaaggtcaatctaagaggtgcaagccttag

SEQ ID NO: 184237 - DNA, 1083 bp, Artificial Sequence
  Description of Artificial Sequence: Synthetic coding sequence
atggccgagcccgacctggagtgcgagcagatccggctgaagtgcatccgcaaggagggattttttacggtgccccctgagcatcggctcggccgttgccggtccgtcaaggaattcgagaagctcaatcgcatcggcgagggcacttacgggatcgtgtacagggccagagacacacagaccgatgagattgtcgcgctgaagaaggttcgcatggataaggaaaaagatggtatacccatttcatccttgcgggaaattactctcctcctgaggctgagacacccaaacatcgtagagcttaaagaagtggtggttgggaaccaccttgagagtatcttcctggtgatggggtactgtgagcaggatctagcctcgcttcttgagaatatgcctacgccgttttctgaggcacaggtaaagtgcatcgttttgcaagtgttgcgaggactgcagtacttgcaccgtaacttcatcattcatagggatcttaaagtaagcaatcttctgatgaccgacaagggatgcgtcaaaaccgccgattttggcctggctcgggcttacggagtgcccgttaaacccatgactcccaaggtggtgaccctgtggtacagggccccagagctgctgctcggaacaacaacccagacaacatcaatagatatgtgggccgtgggatgtattttagccgaactcctggcccaccgacccctgctgcctggcactagcgaaatccaccagatcgatctcatcgtgcaattgctgggtacccccagtgagaacatctggcctggcttttctaagcttcctcttgtgggccagtactcattacgcaagcaaccttataacaacctgaagcacaagttcccttggctgagtgaagctggacttaggttacttcattttttattcatgtacgaccctaagaagcgagctacagccggcgactgcctagaatctagttactttaaagaaaagcctctcccctgtgagccggaactgatgcccacctttccccatcataggaataagagagccgccccagccacgtctgagggccagtccaagagatgcaaaccttag

SEQ ID NO: 184238 - DNA, 819 bp, Artificial Sequence
  Description of Artificial Sequence: Synthetic coding sequence
atggacaaggagaaggacggcatccccatcagcagcctgcgggagatcactctgctgctgcggctgagacatccaaacatcgtcgaactcaaggaggttgttgtaggcaaccaccttgagtcaatctttctggtcatgggctactgcgaacaagatctcgctagtctgttagaaaatatgcctacaccgttcagtgaagctcaggtcaagtgcatagtgttgcaagtcctgcgggggctccagtatctgcacagaaactttatcatacatcgggacctgaaagtgtctaatcttctcatgactgataagggctgtgttaagaccgcagatttcggtctggcccgcgcttatggcgtacccgtgaagcccatgacgcccaaggtggtgaccctttggtacagagctcctgagctgctgctaggtacgaccacgcagacgacctcaattgacatgtgggcggtaggttgcatacttgccgagctcctggcccatagacctctgcttccgggtacctccgaaatccatcagatagaccttatcgtgcagctcctgggaacacccagtgaaaacatctggccaggtttctctaagctccctctggttggacagtactccctgcgcaaacaaccttacaataacctcaaacataagttcccgtggctctccgaggcggggctgagattgttgcacttcttgtttatgtatgatccaaaaaagcgagctaccgctggcgactgcctagagagctcatacttcaaggagaagcctttaagattacccattagtggcgtatgtgaaggctgtagggaacccggatag

SEQ ID NO: 184239 - DNA, 504 bp, Artificial Sequence
  Description of Artificial Sequence: Synthetic coding sequence
atgggcaagaccgaggagaagggcaacggcaagggcgccttccaggagcggaaagggcctttgggagccgtgcgcaaagaggcaggtgcaggtgcccaggacgccggagccgccgagggtgccgcggtgaagaaaatgacctttagcgagcatccctacaacaaccttcgaaaacgtttcggggctctgttgtcggaccagggctttgacctgatgaacaagttcctgacttacttcccaggcaggaggatttccgctgaagacggactgaaacatgaatactttcgagagaccccccttcccattgatccgagcatgtttccaacctggccagcaaagagcgaacaacagcgcgttaaacgcgggacatctccccgcccccccgagggaggactgggatatagccaactgggggacgatgacctgaaggaaactggctttcacctgacaaccacaaatcagggcgcctcagcagccgggcctgggttctccctgaagttttag

SEQ ID NO: 184240 - DNA, 2241 bp, Artificial Sequence
  Description of Artificial Sequence: Synthetic coding sequence
atgagccagagcgacgaccgggacagcaagcgggacagcctggaggaaggagagctgagagaccattgcatggagatcacaatccggaactccccctatagacgagaggacagcatggaagatcggggcgaagaggatgactcgctggctataaaacccccccaacagatgtctcgaaaggagaaagtgcaccatagaaaagacgagaaaagaaaggagaaatgccgccaccactcgcacagcgcggagggtggtaagcacgcccgtgtaaaggagcgggagcatgaaaggaggaagaggcacagggaagagcaggacaaggccaggcgtgagtgggagcgtcaaaaacggagagaaatggcaagagaacactcgcgccgggagagagaccgactggagcagttggaacgcaagagagaacgagagcgtaagatgagagagcagcagaaagagcaaagggaacagaaggagagggagagacgcgcagaggagcgtcgcaaagaacgggaagcacgccgggaggtgtctgcccatcatagaactatgcgtgaagattattcagacaaggtcaaggcttcccactggtctaggtccccgccaaggcctcccagagaacgcttcgagcttggagacgggcgtaagcccgtcaaggaagagaaaatggaagaacgcgatctcctgagcgacctgcaggatatcagcgacagcgagcgcaagacttctagcgctgaaagctcctcggccgagtcaggcagtgggtccgaggaggaagaggaggaggaagaagaggaggaagaagaaggaagtacgtcagaagagtcagaggaagaggaggaggaggaagaagaggaggaagaggaaactggcagcaacagcgaagaagcgagtgagcaatcagccgaggaagtgagcgaggaagaaatgtcagaagacgaggagcgagagaatgaaaatcatctgctggtggttcccgagtcacgctttgatcgggacagcggggagagtgaggaggccgaggaggaagtcggcgagggaacccctcagtcgagcgccctgacggaaggcgactacgtcccagactcacccgcattgctccccattgagcttaaacaggagctgccgaaatatttgcctgctctgcaggggtgccgatctgtcgaggagttccaatgtctcaatagaattgaagagggcacgtacggcgtcgtatacagagccaaagataaaaagactgacgaaatagttgctctcaaacggcttaaaatggagaaggaaaaagagggattccctatcacaagcctgagagagatcaacacaattctgaaggcccaacatcccaacattgtgactgttcgagaaatagtggtcggctcaaacatggacaagatctatatagtgatgaattatgtagagcatgatcttaaatccctgatggaaaccatgaagcagccattcttacccggtgaagtgaagactctgatgattcaactcctgagaggagtgaaacatcttcatgataattggatcctacacagagacctgaaaactagcaaccttctgcttagccatgccggaattctgaaagttggggactttgggctggcaagggagtacgggtcgcccctgaaggcttacaccccagtcgtggtcacgcagtggtatcgggccccagagctgcttctgggtgctaaggagtacagcacagcggttgacatgtggtctgtggggtgtatctttggagagctactcacccagaagcccttgttccccggtaacagcgaaatagaccaaatcaacaaggttttcaaagagcttgggacacccagcgagaaaatttggccaggctattctgagctgcccgtggttaaaaagatgacctttagtgagcatccctacaataatctgcgcaaacgattcggcgcccttttgagcgaccaaggattcgacctgatgaacaaatttctcacttacttccccggtaggaggataagtgcggaagatgggctcaagcatgagtactttcgggagacacctctgcctattgacccgagcatgtttcctacatggcccgcaaagagcgagcagcaaagagtgaagcgcggcacaagcccccgaccgccggaggggggactgggctatagtcagctgggcgatgacgacttaaaagagactggtttccacctgacaacaacgaatcaaggagcctcggccgcaggaccaggcttcagccttaaattctag

SEQ ID NO: 184241 - DNA, 2340 bp, Artificial Sequence
  Description of Artificial Sequence: Synthetic coding sequence
atgggcgacgagaaggacagctggaaggtgaagaccctggacgagattttgcaggagaagaagaggagaaaggaacaggaggagaaggccgaaatcaagcgactaaagaatagtgacgacagagatagcaaacgcgacagcctagaagagggggagctccgcgaccattgcatggagattacaatccgcaactccccatatcggagagaagactccatggaggacagaggtgaggaagacgacagtcttgctattaagccccctcagcaaatgtcccgaaaggaaaaagtacaccaccgtaaagacgagaagcgcaaagaaaaatggaagcacgcccgggtgaaggagcgggagcacgagcgacgcaagcggcatagagaagagcaagacaaagcgaggcgcgaatgggagaggcagaagagaagagagatggccagggagcatagccgccgcgagcgtgggaatgacggagtttgtctttttagagaccgcctggagcagttagagcgcaagagggagagggaaaggaaaatgagagagcagcagaaggagcaaagagagcaaaaagagagggagaggcgcgccgaggaacgacgtaaggagagagaggcaagaagggaggttagcgctcaccataggaccatgcgcgaagactactctgataaggtcaaggcctcacactggtctagaagtcctccccggcccccccgtgaacgcttcgagttaggcgatggacgtaaaccagttaaagaagagaaaatggaggagcgggatctcttgagcgacctgcaggatatcagcgattctgaacgaaagacaagcagcgccgagagctctagtgctgaaagcggatccggctcagaggaggaggaggaagaagaggaggaggaagaggaggaaggaagcacatccgaggaatccgaagaggaagaagaggaagaggaagaggaagaggaggaaaccgggtccaattctgaggaagcctccgagcagtctgccgaggaagtgtccgaagaggagatgtcagaagatgaagagagagagaatgagaatcacctgctggtggtcccagaaagtagatttgacagggattctggagagtcggaggaggcagaggaagaggtgggcgagggcacccctcagtctagtgccttgacagagggagattacgtgcccgactcacccgcccttcttccaattgagttgaagcaggagctaccaaagtatctgcctgccctccagggatgcaggagcgtcgaggagtttcaatgtctaaacaggattgaagagggaacttatggagtggtgtacagggcgaaggataaaaaaaccgacgagatcgttgctctgaaaagactaaaaatggagaaggaaaaggagggcttccctatcacaagcctgcgcgagattaatacaatcctgaaagcccaacacccaaatattgtgaccgtccgcgagattgttgttggctcaaacatggataagatctacattgtaatgaactacgtggaacacgaccttaaaagcttgatggaaactatgaagcaacccttcctgcctggggaggttaaaaccttgatgattcagctactgagaggggtgaaacatctgcacgacaactggatcttgcatcgcgacctcaagacgtctaacctgctcctgtctcacgcaggcattctgaaagtgggggatttcggtttggctcgcgaatacggcagtccactcaaagcatacactccagtcgtggtcacccagtggtatagggcgccagagcttttgctaggggctaaggaatactcaacagctgtggacatgtggagtgtggggtgtatttttggggaactcttgacccagaaaccccttttcccagggaactctgagattgaccagattaataaagtgtttaaggagctcggcaccccatcggagaagatctggccaggttattctgaattgcccgtcgtcaagaaaatgaccttctccgagcacccgtataataacctgcggaagcgcttcggagcgctgctttccgaccagggattcgacctcatgaacaaattcctcacgtatttccctggtaggagaatttccgctgaggacggcttgaagcatgaatattttcgcgagacacccctgccaatcgatccctccatgttccccacttggcccgctaagagcgagcagcagagagttaaaagaggcacttctccgcgcccacccgaaggcggcttgggctactcccagctaggagatgatgacctgaaagagaccgggtttcatctcacaaccaccaaccaaggcgcttctgctgccggcccgggattcagtctgaagttttag

SEQ ID NO: 184242 - DNA, 2313 bp, Artificial Sequence
  Description of Artificial Sequence: Synthetic coding sequence
atgggcgacgagaaggacagctggaaggtgaagaccctggacgagatcctgcaggagaagaaacgccgcaaggagcaggaagaaaaggccgagattaaacgcctgaagaattctgatgatagggactctaagcgggatagtttggaagagggtgagcttagggaccattgcatggagattactattagaaactctccatataggagggaagacagcatggaggatcggggggaggaagacgattcattggctatcaagccaccacagcagatgtcccgcaaggaaaaggttcaccaccggaaggatgagaagaggaaggagaagtggaaacatgcaagagtcaaagagagggaacatgaaaggaggaaacgccaccgggaggaacaagataaggccaggcgcgaatgggagcgccaaaagcgccgcgaaatggccagggaacatagtcgcagggaaagggataggttggagcaactcgaacgcaagagggagagggagagaaaaatgcgggaacagcagaaggaacagcgtgagcagaaagagagggaacgcagagcagaagaacggcgaaaggagcgcgaggcgagacgggaggtctcagctcatcatagaaccatgagagaggattacagtgacaaggtcaaagcgtcgcactggagtaggagccctccgcgcccaccacgagaacgcttcgagctgggagacggacgtaagcctgtgaaggaggaaaagatggaagaaagggatcttttgtccgatcttcaagatatttccgatagcgagagaaagacgtcatccgcagagagtagtagtgccgaaagcggttcgggctccgaagaagaggaggaagaggaggaggaggaggaggaagagggatccaccagcgaggaaagtgaggaagaggaagaggaagaagaggaggaggaagaagaaactggctctaacagtgaggaagcctccgagcaaagtgccgaggaggtgtcagaggaggaaatgtcggaagacgaggaacgcgaaaacgaaaatcacctgctggtggtccctgagtcacgcttcgatagagacagcggcgagtctgaagaggccgaagaagaagtcggggaaggcacgccacagtcctcagctctgaccgagggggactatgtgcctgactctcccgccctcctgccgattgagctgaaacaagaactaccaaagtacctgcctgctctacagggttgtcgtagcgtggaagaatttcagtgtctaaaccgcatagaggaggggacatacggcgtcgtgtatcgggccaaagacaaaaaaaccgacgagatcgtggctcttaaaagactgaaaatggagaaggagaaagaaggcttcccaatcacttctctacgtgaaatcaatacgatcctcaaggctcagcatcctaacatagttacagtcagggaaatcgttgtgggctcaaacatggacaagatttatatagtcatgaactatgttgaacacgatctgaaatctcttatggaaaccatgaaacagccattcctgccaggggaagtcaagactctgatgatccagctgctgaggggcgttaagcacttgcatgacaactggatattgcatcgggaccttaaaaccagtaacctgctgctatcccacgcaggtattctaaaagtgggtgacttcggcctggcaagggagtatggttcccccctgaaggcctacaccccagtggtggttacccagtggtatcgcgccccggagctactgctgggcgccaaggagtactccactgcagtcgatatgtggagcgtgggctgtatcttcggcgagttgctgacccaaaagccactctttcccggtaattctgagattgaccaaatcaacaaagtctttaaggagctcggcacgccttcagaaaagatttggcctggatatagcgagctgcctgtggttaaaaagatgactttctccgagcatccttacaataacttgcgaaagcgctttggcgctctgctctcagatcaaggatttgaccttatgaacaagttcctcacatattttccgggaaggagaattagcgccgaggacggcctgaaacacgaatacttccgtgaaacaccacttcccatagatccaagtatgtttcccacatggccagctaagagtgaacagcaacgggtaaaacgggggaccagtccccggccccctgagggcggactcggctattcccaactgggggacgatgatttgaaggagacaggctttcatttgactacgacaaatcagggagcctccgcagctgggcctgggttttccctaaagttctag

SEQ ID NO: 184243 - DNA, 2241 bp, Artificial Sequence
  Description of Artificial Sequence: Synthetic coding sequence
atgagccagagcgacgaccgggacagcaagcgggacagcctggaggagggggagctaagagatcactgtatggagattaccatccgaaactcaccctatcggagggaggatagtatggaagataggggcgaggaggacgactccctggctatcaaacccccccagcagatgtctagaaaagagaaagtgcatcaccgtaaagatgaaaagcgcaaagagaagtgccgacaccattcacattccgccgaaggaggcaagcatgcacgggtcaaggagcgggagcacgagaggcgtaaacggcacagagaagaacaagacaaagcccgcagagaatgggagcgacaaaaacgtagggaaatggctcgggagcactcaaggagagagcgcgacaggcttgagcaattggagcgtaaaagggagcgagaacgaaaaatgcgcgagcaacagaaagaacaacgagagcagaaggagcgggaaaggcgggctgaagagcgacgaaaagagcgagaggctagaagggaggtgtcagcacaccataggacaatgcgagaagattatagtgataaggttaaggcttcacactggagccgctcaccccctcgccctccgagggagcggttcgagttgggtgacggacgaaagccagtaaaagaagagaaaatggaggagcgcgatctcctgtcagacttgcaggatatctctgactctgaaaggaagacttcaagtgccgaaagcagctcagcagagagcgggtccggtagcgaggaggaggaggaagaagaagaggaagaggaggaggagggttcaacatctgaagaaagcgaagaggaggaagaggaagaggaagaggaagaggaagagactggttccaactccgaggaagcatcagaacagtcagcagaggaggtgtccgaggaggaaatgtctgaggatgaagagcgagagaacgagaaccacttactggtcgtgccggagagtcgtttcgatcgggactccggcgagtctgaggaggcagaagaggaggtgggagaaggtacacctcagagtagcgcgctgacagaaggcgattacgtcccagacagccccgccctcttacccatagagcttaagcaggagctcccgaagtatctgccggctctgcagggctgtcgatcggtcgaggaattccagtgtctcaatcggatagaggagggaacgtacggagtggtttatagggccaaagataagaagacagatgaaatcgtcgccctcaagcgcctaaagatggaaaaagagaaagagggttttcccatcacaagcttgcgagagattaataccattctgaaggctcagcaccctaatattgtaactgtgcgggagatcgtcgtgggctcgaatatggataaaatctacattgtgatgaactacgtcgaacacgatctcaaatctctgatggagacaatgaaacagccttttctgccgggagaggtcaagacgctgatgatccagctgcttcggggcgtgaagcatctccacgataattggatcctgcaccgtgacctgaagactagtaacctcttgctgtcccacgccgggattctgaaagtcggagattttggactggcaagagagtatgggagcccactgaaggcgtacactcctgtggtagtgacacagtggtaccgggcccctgagctgctactaggagccaaggaatacagtacagctgttgatatgtggagtgtcgggtgtatatttggtgagctacttacccagaagcccttgtttcccggaaacagcgagatcgatcagattaacaaagtgttcaaagagctggggacaccttccgagaaaatatggcccggatatagcgagttgccagtggtaaagaaaatgacattttccgagcatccatataacaacttgcggaaaaggtttggcgccttgctgagtgatcaaggctttgaccttatgaataaattcctgacctatttccccggccgacgcatatccgcggaagacggccttaaacacgaatactttcgagagaccccgctgcctattgatcccagtatgttcccaacatggccggcaaaatccgagcagcagcgggtgaaacggggtacgtcacctcgcccccctgagggggggctgggatacagccagctaggagatgatgacctgaaagaaaccgggtttcaccttacaaccactaaccagggcgcaagtgccgctggccctgggtttagcctgaagttttag

SEQ ID NO: 184244 - DNA, 2352 bp, Artificial Sequence
  Description of Artificial Sequence: Synthetic coding sequence
atgggcgacgagaaggacagctggaaggtgaagaccctggacgagatactccaagaaaaaaagcgtcgcaaagaacaggaggagaaagccgagatcaagagactaaaaaactcggatgatagggacagtaagagggatagtttagaggagggcgaattaagagatcactgcatggaaatcacaatcaggaactcaccttatagaagggaggactctatggaggacagaggggaggaagacgactccctggccataaaaccgcctcagcagatgagtcgcaaggagaaagttcatcatcgcaaggatgaaaaaaggaaagagaagtggaaacacgcccgcgtaaaagaacgggagcacgagcgacgcaagcgacacagagaagaacaggataaggctaggagagagtgggaacgacaaaagaggagggagatggcgcgggaacacagtagacgggaacgggaccgactagagcagctggaaaggaagagagagcgtgagcgaaagatgagggagcagcagaaagagcagagagaacagaaggaacgggaaaggcgggcagaagagcggcggaaggagcgcgaggcaaggagggaggtgtccgctcatcaccgaactatgagagaagactatagcgataaggtgaaagcgtcccactggagtcggagccctccaagacccccccgcgagcgttttgagttaggcgacggcagaaagccaggcgaagctcggccagctcctgcacaaaagccagcccagctgaaggaagaaaagatggaggagagagacctgctttcggacctgcaggatatctcagatagtgaacgcaagacttcttccgcagaatcaagtagcgcagagtccggatcgggatctgaagaggaagaagaggaggaagaggaagaagaagaagaagggtccactagtgaggaaagtgaagaggaggaagaggaggaagaggaagaagaggaggaaaccggctctaacagcgaggaggcctctgagcagagtgccgaggaggttagcgaagaggaaatgtcagaggatgaggagcgcgaaaatgagaaccacctcctcgttgtgcctgaatccaggttcgacagagatagtggagaatccgaggaagccgaagaagaggtgggcgagggaacacctcagagttctgctctgacggagggcgattatgtacccgacagtcccgcgctccttccaatcgaattaaagcaagagctgccaaaataccttccagctcttcaagggtgtcgttccgtcgaggagttccagtgtttaaaccggatagaggaaggtacctacggcgtcgtgtacagagctaaggacaaaaaaaccgacgagatagttgcgcttaaacggctgaaaatggagaaggaaaaggaaggcttccctatcacctcactgagggagatcaacaccatcttgaaagcccagcacccaaacattgtgactgttagagagatcgtcgttggtagtaacatggacaagatttatattgtaatgaactatgtggagcacgatctcaaatctctgatggagaccatgaaacaaccattcctgcccggcgaagtcaagacgctgatgattcagcttctaagaggcgtaaaacatctgcatgataactggatcctgcaccgtgacctcaaaacctcaaacctactgctctctcatgctgggatcctgaaagtgggtgattttggactggcccgcgaatatgggtcccctttgaaagcttacactccagttgtcgtcacccaatggtatcgggctccagagctgctgcttggcgctaaagagtacagcacggcagtggacatgtggagcgtgggttgcattttcggggaactcctgacccagaagcccctcttcccggggaattctgagattgatcaaataaataaggtgttcaaagagttgggaacaccgtcagaaaaaatctggccaggctattcagaattgcctgtggttaagaaaatgaccttctctgagcacccctataataatcttaggaagcgattcggggctctgctttccgaccaggggttcgacttgatgaataaattcctcacatacttcccaggtcgccgaatatccgctgaggacggcctcaagcacgagtacttccgcgaaaccccattgcctatagatccaagcatgtttccaacatggcccgccaagagcgaacagcagcgcgtgaaacgaggtacgtccccccggccacctgaagggggccttgggtattcacagctaggtgatgacgatctgaaggagaccggtttccacctgacaaccacgaatcagggcgcaagcgctgctggtcctggattctcactgaaattctag

SEQ ID NO: 184245 - DNA, 699 bp, Artificial Sequence
  Description of Artificial Sequence: Synthetic coding sequence
atgggcgacgagaaggacagctggaaggtgaagaccctggacgagattctccaggagaagaagcggaggaaggaacaggaagagaaggccgagattaagagattaaaaaatagtgacgatagggactctaaacgagattcccttgaagagggcgaacttagggaccactgcatggaaatcactataaggaacagtccataccggcgtgaagactcaatggaggaccgcggagaagaagatgattcgttggccatcaagccaccccaacagatgtcgcggaaagagaaggtgcaccaccgcaaggatgagaaacgcaaggagaaatggaagcacgcacgcgtgaaggagcgggagcatgagcggcggaagcggcaccgcgaagagcaggataaagctcgaagggagtgggaaagacaaaagcgccgtgagatggcccgggagcattcaaggcgcgaatccgtgtgcacttcacctaatgatgaaaggggcctgcagagacagtccgagtcccagccgctcgaatctcagcccgcatcggccgccgcaggcgctgttagagtggggaggagacctgaggcaagcaagaggcgggagaatgggaggaaaggccccgctgttagattgaccggacaccagcgccagcgcgaagaagaccagctcggtcgagttttggttagtgggatacgcctgagattctag

SEQ ID NO: 184246 - DNA, 2241 bp, Artificial Sequence
  Description of Artificial Sequence: Synthetic coding sequence
atgagccagagcgacgaccgggacagcaagcgggacagcctggaggaaggcgaactgcgtgaccactgtatggagatcacaatcagaaacagcccctacaggagggaagattcaatggaggataggggggaagaggacgatagtttggccatcaagccacctcagcagatgtctagaaaggagaaagtgcaccataggaaagatgaaaaaagaaaggagaagtgccgacatcattcacatagcgccgaaggagggaagcatgcccgcgtgaaggagagggaacacgagcgccggaaaaggcatcgtgaggagcaggacaaagctcgcagggaatgggagaggcagaaaagaagggagatggcccgggaacactcacgccgggaacgggatcggttggaacagcttgaaaggaagagagagcgcgaaaggaagatgcgggaacagcagaaggagcagcgggaacaaaaagaacgcgaacgtagagccgaagagagacgtaaggagcgggaggctcggcgggaagtgtccgctcatcaccgaacaatgcgcgaagattactctgacaaggtgaaggcctcccactggagcagatcccctcccagaccacccagggaacgctttgaacttggggacggaaggaagcctgtcaaagaggaaaagatggaggagagagaccttctgtccgatctgcaggatatttctgacagtgaaaggaagaccagcagcgccgaatcaagctcggcagagtcaggctcgggcagcgaggaggaggaggaagaggaagaggaagaggaggaagaaggaagcacttccgaggaaagcgaggaagaggaagaggaggaggaagaagaagaagaagagactggctctaatagtgaagaggcttccgagcagagcgccgaggaggtgagtgaggaggaaatgagtgaggatgaagaacgcgaaaacgaaaatcatctgcttgttgtaccggaaagtaggttcgatagagattctggtgagtccgaggaggcggaggaggaggtgggcgagggtacgccacagtcttccgctctcaccgaaggggattatgtccctgactcacctgccttgctgccgattgagctgaagcaggagttgccaaaatatctgcccgcattacagggttgtcgtagcgttgaagaattccagtgcttgaatcgcatcgaggaaggaacctacggcgtggtataccgcgctaaagacaaaaagactgatgagatcgtggctctaaagcggcttaagatggagaaggaaaaggagggcttccccataaccagcctccgtgagatcaacactatcttgaaggctcaacaccctaacatagtcaccgtgagagagattgttgtgggtagcaatatggataagatttacatcgtgatgaactacgtggaacatgatctcaaatctttgatggagactatgaaacagccttttcttcccggggaagtaaagactctcatgatccagttactgcgcggcgtcaagcatctccacgacaattggatccttcatcgagacttgaagacatccaatctcctgttaagccacgccgggatcctgaaagtgggagacttcggactggctcgcgaatatgggtcacctttgaaagcgtacaccccagtggttgtgacccagtggtaccgtgctccagaacttctcctgggagccaaggagtatagcaccgctgtcgacatgtggtcagttggctgcatcttcggagaattgctcacgcagaagcccctttttcccggaaacagtgaaatagaccagatcaataaggtctttaaggagttgggtacaccgtccgagaagatttggcctggatattctgagttacccgttgtgaaaaagatgaccttcagcgaacacccttacaataatcttcgaaaacggttcggggccttactgagtgaccagggcttcgatctgatgaataaatttctcacatacttcccgggaagaaggatctcagccgaagacggactgaaacacgagtattttagagagactccgttgcccatagatccatcaatgttccctacttggcccgcaaaatccgagcaacaaagggtaaagagggggactagcccaaggccacctgaggggggcctcgggtacagtcagctaggcgatgacgacctgaaggaaactggattccatctgaccacaactaaccaaggggccagcgcagctgggccgggcttcagcctcaagttctag

SEQ ID NO: 184247 - DNA, 114 bp, Artificial Sequence
  Description of Artificial Sequence: Synthetic coding sequence
atgggcgacgagaaggacagctggaaggtgaagaccctggacgagatactgcaagagaaaaagagacggaaagaacaggaagaaaaggctgagatcaagaggctgaagaactag

SEQ ID NO: 184248 - DNA, 2343 bp, Artificial Sequence
  Description of Artificial Sequence: Synthetic coding sequence
atgggcgacgagaaggacagctggaaggtgaagaccctggacgagattttgcaagagaagaaacgtcggaaagaacaggaagagaaagccgaaattaagcgactgaagaactctgacgaccgggattctaagcgggattctttggaggagggagaactgagggaccactgcatggaaatcaccattcggaatagcccataccgccgagaagattcaatggaagataggggggaagaggacgattctctcgccataaagcccccacagcagatgtcacggaaagaaaaagtgcaccacaggaaggatgagaaaagaaaagagaaatgtcgccatcactctcattctgccgagggaggaaaacacgctcgagttaaagagcgtgagcacgagcgccgaaaacggcaccgcgaagagcaggataaagcccggagggaatgggaaagacagaagcggagggagatggctcgagagcacagccggcgcgagagagatcgattggaacagctggaacgcaaaagggagagagaaagaaagatgagagaacagcagaaagagcagcgagagcaaaaagagcgcgaacgccgggccgaggagagacggaaagagcgggaagccagaagggaagtgtcggcgcaccaccgcaccatgagagaggactacagcgacaaggtcaaagcaagtcactggtctcgctcaccaccgcgtccaccgagggagagatttgaactgggcgacggccgcaaacccgtaaaagaagagaagatggaggagcgggatctgctgagcgacctgcaggacatctcagacagtgagagaaaaactagctcagctgagtccagctcggcggaaagcggatcagggtccgaagaagaggaggaggaagaggaggaagaggaagaggagggatctacttctgaggagtcagaagaagaggaagaagaggaggaagaagaggaagaagagacaggaagtaatagcgaggaggcgtctgaacagagtgcagaggaggtgagcgaggaagagatgagcgaagacgaagaacgggaaaatgaaaaccatctcttagttgtgccagaatcacggttcgatagggattccggggagtctgaagaggcggaggaggaagtgggcgaggggacccctcagtcctcagctctgaccgaaggggactatgttcccgacagcccagccctattgccaattgagttgaaacaggagctgccaaagtatctccccgccctgcaagggtgtaggtccgtcgaagagtttcagtgcctgaaccgcattgaggaaggtacctatggtgtcgtatatagagctaaagataagaaaaccgacgagatcgtagcgctcaagcggctgaagatggagaaggagaaggagggcttccccatcacctctctgcgcgagattaacaccattcttaaggcacaacatcctaacatagtgactgtcagagaaatcgtagtgggcagtaacatggataagatttacatcgtcatgaactacgtggagcatgatctgaagagccttatggagaccatgaagcagccattcctgcccggggaggtaaagacgctcatgatccagcttttgaggggcgtgaaacatctgcatgataactggatcttacatagagacttgaagacttcaaatctgcttctgtcccatgcaggcattctaaaggtcggagatttcggcctcgcaagggaatacggatcacctctcaaggcttatacgcctgtagtcgtcacgcagtggtatagagccccggaattgctgctgggcgccaaagaatactccaccgcagtggacatgtggtccgttggatgtatttttggtgaactgttaactcaaaagccgctgttcccgggaaatagcgagatcgatcagatcaataaagtcttcaaagagctgggcaccccctctgagaagatctggcccggctacagcgaactgcccgttgttaagaagatgacattctctgaacacccctataacaacctgcggaagcgtttcggcgcactcctgtctgaccagggattcgatctgatgaacaagttcctcacctatttccccgggcggcgtatctctgcagaggacgggctcaaacatgagtacttccgcgagaccccactgccaattgatccctctatgttcccaacttggcccgccaaatcagaacagcaaagagtcaagcggggaactagcccccgtcccccggagggcggtctgggctatagccaattgggagatgatgacttgaaagaaaccggcttccacctcacaaccacaaaccaaggggcatccgccgctgggccaggatttagcctgaaattttag

SEQ ID NO: 184249 - DNA, 456 bp, Artificial Sequence
  Description of Artificial Sequence: Synthetic coding sequence
atgggcgacgagaaggacagctggaaggtgaagaccctggacgagatcctgcaggaaaaaaaaaggcgcaaggagcaggaggaaaaagccgaaattaagcgcctcaaaaacagcgatgatcgagacagcaaacgggacagtctcgaggaaggcgaactgcgggaccattgcatggagatcacaattcgtaattcaccctaccgccgcgaggacagcatggaggatcgtggagaggaggacgactccctcgccatcaaacccccccagcagatgagccgtaaggaaaaagttcaccatcgcaaagacgaaaaaagaaaagagaaatggaaacatgcgcgggtaaaagaacgggagcacgaacgccggaaacggcacagagaagagcaggacaaggccagaagggagtgggagcgtcagaaaagacgggagatggcccgcgagcattccaggcggtag

SEQ ID NO: 184250 - DNA, 1263 bp, Artificial Sequence
  Description of Artificial Sequence: Synthetic coding sequence
atgggcgacgagaaggacagctggaaggtgaagaccctggacgagatcctgcaggaaaaaaagaggaggaaagaacaggaggagaaggccgagattaagaggctaaaaaacagtgacgatcgagacagcaaacgagatagcctggaagaaggcgagctgagagaccattgcatggagattactattcgaaacagcccgtacagaagggaagattccatggaggatcggggcgaggaggacgacagtcttgcaataaaaccccctcagcagatgagcaggaaggaaaaagtgcatcaccgtaaggatgagaagcggaaagaaaagtgccgtcatcatagtcacagtgcagagggggggaagcacgctcgggtgaaagagcgggaacacgaaaggcgaaaacggcaccgtgaggaacaggataaggcgagacgtgagtgggaacgccagaagcgaagggaaatggcccgggaacatagtcggcgtgagcgggataggttggaacagctcgaacgaaagcgcgaacgcgagagaaaaatgcgcgaacagcaaaaagaacagcgcgagcagaaggagagggaaaggagagctgaagaaagaaggaaggagcgtgaggccaggcgcgaggtctctgcccaccataggacgatgagggaggattattctgacaaggtgaaggcctctcactggtctagaagtccaccacggccaccaagagaaaggttcgagttgggagacggccgaaagcctggcgaggccaggccagctcccgcacagaaacctgctcagcttaaagaagaaaagatggaggagagagacttgctgtccgatctgcaggacatttcagactcggagagaaagacatctagcgcagaaagctcatccgctgagagcgggtcaggtagcgaagaagaagaggaggaggaagaggaggaagaagaagaaggctctacctccgaggagagcgaagaagaggaagaggaggaggaagaggaggaggaggaaaccggatccaattccgaagaggcctcagaacagagcgccgaagaggtgtctgaggaggaaatgagtgaggacgaggaacgggagaacgaaaatcatttgctggtagtgccagagtctcgttttgatcgggattctggtgagtcggaggaggcagaagaggaggttgggctgcctgaaaggcggggagttcccgtgccagagcaagaccgtggtgggcatttgtggagtgggctgcagtctaagagacaggaaaacagatag

SEQ ID NO: 184251 - DNA, 1686 bp, Artificial Sequence
  Description of Artificial Sequence: Synthetic coding sequence
atggccatcgccaccagcacccagctggcccgggccctgtacgacaatactgctgagagccctcaggagcttagcttcaggaggggtgatgtcctgcgcgtcctacagcgagagggtgccgggggactggatggctggtgtttatgcagtctacacggtcagcaaggtatcgtgcccgccaatcgcgttaagttactgcctgcaggaccggcaccaaagccctctctttcgccggcttctccagcccagcctggtagtccctaccccgccccagatcacagtaacgaggatcaagaggtatacgtggtgcccccccctgccaggccttgtccaacaagtgggccaccagccggtccatgcccaccatcaccagacttgatttataaaattcccagagcctcaggaactcaactggcagcaccacgggacgccctcgaggtgtatgacgtgccccctaccgcacttcgggtgccctcctcggggccatacgattgtcccgctagtttctcccatccactgactagggtggccccacagcctcccggggaagacgatgctccatacgacgtcccgcttactccaaaaccaccggccgagctcgagccagatcttgaatgggaaggcggcagagagccaggcccacctatctatgccgcaccttctaacctcaaacgtgcttctgccctgctcaatttgtacgaagctccagaggaacttctggccgacggggaaggagggggcacagacgaagggatctacgatgttcccttactcggtcctgaagcacccccgagtccagagccgcctggcgctctcgccagccatgaccaggacaccttagcccaactgctcgctcgctccccgccaccaccccacaggccacgtctcccaagtgcagagagtcttagtcgtcggccactccctgctctgccagtccctgaagcaccatctccgtctccggttcctagccccgcacctggtagaaagggaagtatccaggaccgcccactcccaccaccgcctccccgcctcccagggtatggcgggccaaaggtcgaaggcgaccctgaaggcagagaaatggaggacgatccagcgggacaccataatgaatatgagggtatccccatggctgaagagtacgactatgtgcatttgaagggaatggataaagcacagggaagcagacctccagatcaggcttgcacaggcgatcctgagttacctgagcgtgggatgcccgctccacaggaggccttgagccctggagagcccctggtggttagtacgggcgatctccagttgctctatttttacgcaggccagtgtcagtctcactacagcgccctgcaggcagccgttgctgccctaatgtcctcaacacaagcaaatcagcctcccaggctgttcgtaccccatagcaaaagggtggtggtggccgcccatcggctcgtctttgtcggggatacactggggaggttagctgcttctgcccctcttcgtgctcaggtgagagctgctggaaccgccctggggcaggcactccgagctaccgtgctagctgtgaaaggcgctgccttggggtacccatcctcaccagcgattcaagagatggtgcagtgtgttacagagctggccggacaggcactgcagttcaccaccctgttaaccagtctggcaccatag

SEQ ID NO: 184252 - DNA, 684 bp, Artificial Sequence
  Description of Artificial Sequence: Synthetic coding sequence
atgaacggcaccatctacgccaacgagtgccagcagatccggcacccgaactctaaaactttaggcacggtgaccccacggaaaccagtgttgagcgtgagtgctagaaagattaaagataacgccgccgactggcacaatcttatcctgaaatgggagaccctaaatgatgctggctttactacagcaaataacatcgccaatttaaagatatctctgctgaataaagataagattgagcttgactcaagttcgcctgcaagcaaggagaatgaggaaaaggtgtgtctcgagtataatgaggaactagagaagctctgtgaggagttgcaagcaaccctagatggcctcaccaagattcaggtgaaaatggaaaagctgagctccactactaagggcatatgcgagctggaaaattatcattatggagaagaatcaaagaggccccccctattccacacatggcccacaacacacttctatgaggtgagtcataagcttctagagatgtatcgaaaggagctgctgcttaagcggacagtggctaaggagctggctcacaccggcgaccccgatttgactctgagctatctctctatgtggctgcaccagccatatgttgaatccgactctcgcctgcatcttgagagtatgcttctcgagactgggcatagagctctgtag

SEQ ID NO: 184253 - DNA, 357 bp, Artificial Sequence
  Description of Artificial Sequence: Synthetic coding sequence
atggaggccaagaccctgggcaccgtgaccccccggaagcccgtgctatcagtgagcgcacggaagatcaaagataatgccgccgattggcacaaccttattctcaaatgggaaactcttaacgacgccgggttcacaacagcaaacaacattgctaatctgaagataagcctcttgaacaaggataagatcgaattagactcttcctccccagcatctaaggagaacgaggagaaggtttgccttgaatataatgaagagcttgagaagctatgcgaggagctccaggccaccctcgatgggctcatgcggttccgaatatcctcctggagatgtaccggaaggtcttgcagttag

SEQ ID NO: 184254 - DNA, 639 bp, Artificial Sequence
  Description of Artificial Sequence: Synthetic coding sequence
atggaggccaagaccctgggcaccgtgaccccccggaagcccgtgctctcagtaagcgccagaaagatcaaggacaacgctgctgattggcacaacctgattttaaaatgggagacgctgaacgatgctggcttcaccacagctaacaatatcgcaaatttgaaaatctctctactgaataaggataagatagaattagacagctcctcgccggccagcaaggagaacgaagagaaggtgtgcctggagtataatgaagagttggagaagctttgtgaagagttgcaagccaccctggacggtctcacgaagatccaggttaaaatggaaaaactgtcctccacgaccaagggaatatgcgaattggagaattatcactatggggaggagtcgaagcgccctccgctgttccacacatggcccacaacacatttctacgaagtgagtcacaagctgctggagatgtacaggaaggaacttctactgaagcgcacggtggccaaggagttggcccacacaggggacccagacctaaccctttcttatctgagtatgtggctccatcaaccatacgtggagagtgattcccgcctgcatctggagtctatgctcctggagacaggacacagggcgctctag

SEQ ID NO: 184255 - DNA, 918 bp, Artificial Sequence
  Description of Artificial Sequence: Synthetic coding sequence
atggacatgttccagaaggtggagaagatcggcgagggcacctacggcgtggtgtataaagcgaaaaatcgggagacagggcagttggtcgctctcaagaagatccgtctggatctggagatggagggcgttccaagtaccgcgatacgggagatctctttgctgaaggagttgaagcatccaaatatcgtacggctcctagatgtggtccataatgaacgtaaattgtatttggttttcgagttcctcagtcaagacttgaaaaaatatatggatagtacgcctgggtcagagctcccactccacttgataaagtcttacttgttccagcttcttcagggagtgagcttctgtcactcacacagagttatccacagagacttaaagccacagaacttgctgatcaacgaactgggagccattaagctggcagactttgggctcgctagagctttcggcgtgcctctgcggacgtacacacacgaggttgttactctgtggtaccgcgcgcccgaaatcctgctcggtagcaaattttacaccaccgccgttgacatttggtcaattggttgcatttttgctgagatggttacgcgcaaggcgctctttcccggagactcggagattgatcagttgtttcgaatcttccgcatgctggggacgccttcagaggacacctggcctggtgtgacgcagctgcccgactacaagggcagcttccctaaatggactagaaagggactggaggaaattgtacctaacttggagcctgaaggacgcgacttactgatgcagctgttgcagtatgacccatctcaacgcatcacggccaagacggcactggcccacccatacttctctagcccagagccttcaccagctgcacgccaatacgtgctgcagagattccgacactag

SEQ ID NO: 184256 - DNA, 918 bp, Artificial Sequence
  Description of Artificial Sequence: Synthetic coding sequence
atggacatgttccagaaggtggagaagatcggcgagggcacctacggagtggtgtataaagctaaaaaccgagaaactggacaactcgtcgcccttaagaagattcgccttgacctggaaatggagggcgtgccgagcaccgccatcagggagatatccctcttgaaggagttgaagcatcccaacatcgtgagactcctcgacgtggtacacaatgaacgcaagctgtatctggtgtttgagttcttaagccaggatctgaagaaatacatggacagtaccccgggaagcgaactccctctgcacctaatcaagagctatctcttccagctcctacagggcgtcagtttctgtcattcacaccgagtcattcaccgcgatcttaagccacagaatctgctaattaacgagttgggggcgattaaactcgccgattttgggctcgctagggcttttggggtgccactccgtacgtatactcacgaagttgtcaccttgtggtacagggctcctgagatcctgctgggatcaaaattttacactactgcagttgacatctggtccataggctgcatctttgctgagatggtgacccgtaaggccctctttccaggcgattctgaaatagatcagctcttcagaatcttccgcatgttgggcacaccatcagaggatacatggcccggagtgacccaactgccggattataaggggagttttcccaagtggactagaaagggactcgaggagatcgtgccaaatttagagcctgaagggcgcgatttactaatgcaactcctccaatatgacccgtctcagcgaatcaccgctaagactgctctggcccatccctattttagctctccagagccttctccggccgcccggcagtacgttctgcagcggttccggcattag

SEQ ID NO: 184257 - DNA, 879 bp, Artificial Sequence
  Description of Artificial Sequence: Synthetic coding sequence
atgcagaagtacgagaagctggagaagatcggcgagggcacctacggtacagtatttaaggccaaaaacagggaaacccatgagattgtcgcccttaaacgtgtgcgccttgacgacgacgacgagggtgttccatcatccgcattgcgtgaaatctgcctcctcaaggagctgaaacataagaatatcgtgcggcttcacgacgttcttcacagcgataagaagctcaccctcgtgtttgaattctgcgatcaggatttgaagaagtacttcgattcctgtaacggagacttggacccagaaatcgtgaaaagtttccttttccaactcctgaagggtctggggttctgccactctagaaatgtgctgcaccgcgatctcaagcctcagaacctgctgataaatcgaaatggcgaactgaagttggctgactttggactggctagagctttcggcatccctgtgcgctgttattcagcagaagtagtaaccctttggtacaggcccccagacgttctttttggggcaaaattatacagcactagcattgatatgtggtctgcgggctgtatctttgccgaacttgctaacgccgggagacctctgtttcccggcaatgacgtggacgatcagttgaagagaatattcagattgctgggaacccctacggaagagcaatggccatccatgaccaagttgccagattataagccctacccgatgtaccctgccactacgagcttagtcaacgtcgtccccaagctgaatgctacgggacgggacctgctacagaacctattaaaatgtaaccccgtccaaagaattagcgcagaggaggctctccagcatccttatttctctgacttttgtcctccttag

SEQ ID NO: 184258 - DNA, 783 bp, Artificial Sequence
  Description of Artificial Sequence: Synthetic coding sequence
atgcagaagtacgagaagctggagaagatcggcgagggcacctacggtacagtgtttaaagcgaagaatagggagacgcatgagatcgttgctctaaaaagagtgcgcctggacgacgatgacgagggcgtcccaagctcggcccttcgtgagatttgtctgctgaaagaactcaaacataagaacattgtgcgcctgcacgatgtcctgcattcagataagaagttaacactggtctttgagttttgtgaccaagacctgaaaaaatactttgattcctgcaatggagacctggacccagaaattgttaagaacggggaactgaaactagccgatttcggcttagctcgcgcctttggcatcccagtgcgctgttactcagctgaagtcgtcacactgtggtatcggcctccagatgtgttgttcggtgctaaactgtactctacctcaatagatatgtggagcgcgggatgcatatttgcagagctggcaaacgccgggcgtcccctgtttcccggcaatgacgtagatgatcagctgaaacggatctttcgactcttaggcactcccacggaggagcagtggccatctatgaccaagctgccagactataagccttacccaatgtatcccgctaccacgagcctagtcaatgtcgttcctaaactcaatgctaccggccgcgatctgctgcagaacctgctgaagtgtaacccggtccagaggatcagcgccgaagaggccttgcagcatccctacttctccgacttctgtcccccttag

SEQ ID NO: 184259 - DNA, 1104 bp, Artificial Sequence
  Description of Artificial Sequence: Synthetic coding sequence
atgggcaccgtgctgagcctgagccccgccagcagcgccaagggcagaaggcccggaggactccctgaggaaaaaaagaaggctccaccagcaggagacgaagccctgggaggctacggcgctccgcctgtgggcaagggcggtaagggagagtctaggctgaagagaccctctgtcctgattagcgcacttacctggaagaggttggtggcagcctccgcaaagaagaagaagggaagcaaaaaagttactccaaaaccagctagcactggccccgatccacttgttcagcagaggaacagggagaatctgctgcggaaaggacgagatccaccagacgggggaggtactgcaaagcctctggccgtccctgtccctaccgttccagctgccgcagctacctgcgagcccccatcaggaggatccgctgcagcacagcctcctggttcgggaggtggtaagccaccccccccgcctcctcccgccccgcaggtggccccaccagtgcctggaggttcccccagacgtgtaattgttcaagcatcgactggagagctgctccgctgtcttggcgattttgtctgtcgtagatgctacagactgaaagaactgagccccggcgagttggtggggtggttccgcggtgtagatcgctctttgctcctgcagggctggcaagaccaagccttcattactcctgctaatcttgtattcgtctaccttctctgtagagaaagcctgcggggcgacgagctagcgtcggccgccgagctgcaggcagcttttctcacatgtctgtatcttgcttattcgtacatgggcaacgagatctcttaccccttaaaaccctttctcgtggagccagacaaagagagattttggcagcgatgtctcagactgatccagcggttaagcccacagatgctccggcttaatgctgaccctcattttttcacacaggtgttccaggatttgaagaacgaaggtgaagccgcagcctcggggggtggccctcccagtggtggcgctccagcagcgtctagcgcagcacgagacagttgtgcagccggaactaaacactggacgatgaatctcgatcggtag

SEQ ID NO: 184260 - DNA, 1779 bp, Artificial Sequence
  Description of Artificial Sequence: Synthetic coding sequence
atggagatgtacgagaccctgggcaaggtgggcgagggcagctacggaaccgttatgaagtgtaagcacaaaaacacgggtcaaattgtggcaattaaaatcttctatgaacgcccggaacaaagcgtgaacaaaatcgcgatgagagagattaagttcttgaagcaattccatcacgagaatctcgtgaatctgatcgaagttttccggcagaaaaagaagattcacctcgtgttcgagtttatagaccatactgtgctggacgagctgcagcactactgccacggtcttgagagtaaacggcttagaaagtacctgttccagattctgcgcgctattgattatttacattccaacaatattattcatagagacatcaagcccgaaaacattttagtgagtcagagcggtataacaaagctatgcgactttggctttgctcggacccttgctgcaccaggagatatatacactgattatgttgcgacgaggtggtacagagcacccgaacttgtcctcaaggatacttcttatggtaaaccagttgacatctgggccctgggctgcatgattatcgaaatggcgacaggcaatccatatctgccctcctcctccgacctcgacctgctccataagatcgttctgaaggtgggaaacctgtccccgcatctgcagaatattttctcaaaaagccctatctttgccggcgtggtgctgccccaagtgcagcacccaaagaatgctcgaaaaaagtacccgaaacttaacggcctactggccgatattgtccacgcatgcttacagatcgatcccgctgatcggatcagtagttccgatttgctacatcacgagtacttcactcgagacgggtttatcgagaaattcatgcccgagctgaaagcaaagctgctacaggaagctaaagttaattcactcatcaagcctaaggaatccagcaaggagaacgaacttagaaaagacgaacgtaaaacggtgtatacaaacactctgctgtcctcttcggtgttaggaaaagagatcgaaaaagagaagaaacctaaggaaattaaagttcgggtcattaaggtaaagggaggacgtggcgatatttcggagccgaagaagaaagagtatgaggggggcctgggccagcaggatgctaatgagaatgttcatcccatgagccctgacactaagcttgtcacaatcgaaccgcccaaccctattaacccctctactaactgtaatggtctcaaagaaaacccccattgcggaggtagcgtaaccatgccacccatcaatctgaccaacagtaaccttatggcagccaatctcagcagcaacctttttcatccatccgttagattaactgagagggccaagaaacgacgaacgtcctcacagtcaatcggccaggtcatgccaaactctcggcaggaggaccctggaccgatccagagccagatggagaagggaatattcaatgagcggaccgggcattctgatcagatggccaatgagaataaaagaaagttgaacttctcaaggtccgatcgcaaagaattccacttccccgagctgccagtgaccatccagagcaaagacaccaagggcatggaagtgaagcaaataaaaatgttgaagagagagagcaaaaagacggaaagttccaagatcccaaccctgctgaatgtcgaccaaaaccaagaaaaacaagaaggaggcgacggccactgtgagggcaaaaatcttaagcggaatcgcttctttttttggtag

SEQ ID NO: 184261 - DNA, 1368 bp, Artificial Sequence
  Description of Artificial Sequence: Synthetic coding sequence
atggagatgtacgagaccctgggcaaggtgggcgagggcagctacgggactgtcatgaagtgcaaacacaagaacaccggccagatcgttgccattaagatattctatgagcggcccgaacagtctgtgaacaagatcgccatgcgcgagatcaaattcctaaaacagtttcaccatgaaaaccttgtcaacttgatcgaggtgtttcgtcagaagaaaaagatacacctggtgttcgagtttattgatcataccgtcctggacgagctccagcattactgccacggcttggagagcaagcggctgcgtaaatacctgtttcagatcctccgagctatcgattaccttcactccaacaacatcatccaccgtgacattaaacctgagaacatcttagtctcgcagtcaggaattactaaactgtgtgactttggcttcgcccgcaccttggccgctcccggtgatatctataccgactacgtcgcaacccggtggtaccgcgcccctgagttggtcctgaaggatacttcctatggcaagcccgtcgatatatgggccctaggttgcatgatcatcgagatggccacaggcaacccgtatctgccctccagttccgatttagatcttcttcataaaatagtgcttaaagtgggcaatctaagcccccacctccagaacatttttagcaaatcaccaatcttcgccggagtggtactgccccaggtacagcaccccaaaaatgctcggaagaaatatcctaaactgaacggactgctcgccgacatagtccacgcatgtttgcaaattgatccagcagaccgaatttcctccagtgatctcttgcatcacgagtactttaccagagacggcttcattgaaaaattcatgcctgagctcaaggctaagctgttgcaggaggctaaagtcaattcacttattaaacccaaggaatcatctaaagagaatgagctccgaaaagacgaaagaaaaacggtctacaccaacacactgttatccagctccgtattggggaaggagatagaaaaggaaaagaaaccgaaagaaattaaagttagggttatcaaggtcaaaggaggacgcggggacatctcagagccgaagaagaaggagtatgagggcgggcttggccagcaagatgccaacgagaacgttcatccaatgtcccccgacacaaagctcgttactatcgagccccccaaccccatcaatccttcaactaactgcaacgggttaaaagagaatccccattgtggtgggtcggtgaccatgccccccattaacttgacaaactcaaacttgatggccgcgaatttatcctcaaatctgtttcaccctagtgtccgttag

SEQ ID NO: 184262 - DNA, 1092 bp, Artificial Sequence
  Description of Artificial Sequence: Synthetic coding sequence
atgcccgagctgaaggccaagctgctgcaggaggccaaggtgaactctctaatcaaaccaaaagaaagctccaaggagaatgagttgaggaaggacgaacgtaagaccgtttatacaaataccttgctgagttcgtcagtactgggaaaagagattgaaaaggagaaaaagccaaaagaaataaaagtgagagtgattaaggtgaaagggggccgaggcgatattagtgagcccaagaagaaagaatatgaaggcggcctgggtcagcaggacgccaacgagaacgtgcatcccatgagtccagataccaagctggtgaccatcgaacctcccaatccgatcaatccgtcaaccaactgtaacgggctaaaagaaaacccccactgtggcggctccgtgaccatgccgccgatcaacctcaccaactccaatttaatggccgcgaatctttcatcaaacttgttccacccttcagtgcgactaaccgagcgggccaaaaaaagacggaccagttcacaatcaatcgggcaggtaatgccaaactcacggcaggaagaccctggtcccatccagtctcagatggaaaagggcatttttaatgagaggaccgggcactcagatcagatggcaaatgagaataagcggaaactgaacttttctcggtccgaccgaaaagagtttcattttcccgagctgcctgttaccatccagagtaaggatactaaggggatggaggtaaagcaaatcaagatgcttaagcgggaatcaaaaaagactgaaagcagcaagattcctaccttgctaaatgtggaccaaaatcaagagaaacaagagttcatccctctcagcctcttgtctgcatgttgccccattttcacaaacatatgcagccagctcaccatcagatacgtgtttatttcgggaatgaaaaccgaccagtactcagagctggttccagtagagtggggtattgcagagaaaatccccaagaatgtcgaggctaccctagaactgggcaataggcagcgattcgagcagtttggggagctccggaggcgccaagagaacgtcggaaagtttgggactttctag

SEQ ID NO: 184263 - DNA, 1773 bp, Artificial Sequence
  Description of Artificial Sequence: Synthetic coding sequence
atggagatgtacgagaccctgggcaaggtgggcgagggcagctacggaacagtgatgaagtgcaaacacaaaaacaccggacagatcgtggccattaaaatcttctatgagcgccccgagcagtcagttaacaagattgccatgagagagatcaagttcttaaaacagttccaccacgagaatcttgtaaatctcatagaggtgttccgccagaagaaaaaaatccatcttgtcttcgaatttatagaccataccgtccttgacgaactgcagcactactgccatggtctcgaaagtaagcgactgcgcaaatacctgtttcaaattctgagggccattgactacctccacagtaataatattattcatcgcgacatcaagccagagaatatcctggttagccagagcggaatcacaaagttgtgcgatttcggttttgctcgtaccttggccgctcctggggatatttatacagactacgttgcgactaggtggtaccgggccccagagctcgttctgaaggacacttcctacggcaagcctgtcgacatctgggctttgggttgcatgatcatcgagatggccacaggaaacccatacctgcccagctcctcggacttggacttactccataaaattgttctgaaagttggcaatctgagcccacatctgcagaacatcttttctaagtcaccgatttttgctggggtggtcttaccccaggtccagcatccaaagaacgcacgcaagaagtacccaaaattgaacggcctacttgcagatatagttcatgcctgtctacagattgaccctgccgaccgcatcagtagctcagacttactccaccacgagtacttcacacgagatggctttatagaaaagtttatgccggaactcaaggcaaaactgctgcaggaggccaaagtgaattccctcatcaagcccaaggaaagcagcaaagagaatgagttacggaaggacgaaagaaagaccgtgtacaccaatacgttgctgagctctagcgtgctcggtaaagagatagagaaggagaagaaacccaaagagattaaagtgagggtgatcaaggtaaaaggcggacgaggggacatttccgaaccgaaaaagaaggaatacgagggaggactgggacagcaggacgccaacgagaatgtgcatcccatgagcccagacaccaagttggtgacaattgagccacctaatccaattaaccccagtactaactgcaatggtctcaaggaaaatccccactgtgggggctcagtgaccatgcctcccataaatctgactaacagcaacttgatggccgcgaaccttagcagcaacctttttcatcccagtgtccgcctgacggagcgcgctaaaaaaagaaggacaagcagccagagcattggtcaagtcatgcctaatagcagacaggaagaccctggacccatacagtctcagatggagaagggcatttttaacgaaagaacaggacactcagaccagatggcaaatgagaataagcgtaaactcaatttttcgcgcagcgatcgaaaagaattccatttcccggaactccccgtgactattcagagtaaggatactaagggaatggaagtcaaacagatcaagatgctcaaaagagaaagcaaaaagacagaaagctccaaaatccccacgcttttgaacgtggatcaaaatcaagaaaaacaagaaaacactggtaacgcccagaccgaacgaaagaagaaccttccagacgtggaatag

SEQ ID NO: 184264 - DNA, 1368 bp, Artificial Sequence
  Description of Artificial Sequence: Synthetic coding sequence
atggagatgtacgagaccctgggcaaggtgggcgagggcagctacggcacggtgatgaagtgcaagcacaagaacacggggcagatcgtcgcaattaaaatcttctacgaaagacccgagcaatcagttaacaaaatcgctatgcgcgagatcaaattcttgaaacagttccaccatgaaaacctggtgaacctgatcgaggtgtttcgacagaaaaaaaagatccatctggtcttcgagttcatcgatcacaccgtactggacgagctgcaacattactgccatggactggagagcaaacgactccggaagtacttgttccagatcctgagggctatcgactacttacactctaacaatattattcaccgggacattaagcctgagaacatactcgtttctcaatccggcatcacaaaactctgcgatttcgggttcgcacgcacccttgctgcccctggtgacatctacactgattatgtggctacccgatggtatcgtgctcccgagcttgtgctcaaggatacatcctacggaaaaccagtggatatttgggccctgggatgcatgattattgagatggctacgggtaatccttatctgccatcttcctccgatttggatctgcttcacaaaattgtattgaaggttgggaacctctctccccacctccaaaacatcttcagtaagtctcctatcttcgccggagtagtcctaccacaggtgcagcacccgaagaacgctcggaaaaaataccccaagctgaacggcctcttagccgatattgtgcacgcatgccttcaaattgaccccgccgatagaatttctagcagcgatctcctgcaccacgagtacttcactagggacgggttcatcgagaagtttatgccagaactgaaagctaagttgctgcaggaggctaaggtgaactctctgatcaaaccaaaggagtcttctaaagaaaatgagctccggaaagacgaacgcaagacggtctacacaaacacattgctctcaagcagtgtgcttgggaaagaaatagaaaaagagaagaagcctaaagaaataaaagtgcgtgtgattaaagtgaaagggggacggggcgacatatcggagccaaagaagaaagaatacgagggggggctcggacagcaggatgctaacgaaaatgtccacccgatgagtccggacactaagctggtcacaattgagcccccgaaccctatcaacccaagtaccaactgtaacggcctgaaggagaacccacactgcggcggctctgtgacaatgccgcccatcaatttgacaaatagcaatcttatggccgccaatttgtctagtaacttgttccacccatccgtgaggtag

SEQ ID NO: 184265 - DNA, 876 bp, Artificial Sequence
  Description of Artificial Sequence: Synthetic coding sequence
atgcccgagctgaaggccaagctgctgcaggaggccaaggtgaactctctgatcaagcctaaagaatccagcaaggaaaacgaactgcggaaggacgagcggaagacagtgtacacaaacacactcttaagttcctctgtgctcggaaaagaaatcgagaaggagaaaaagcctaaggagatcaaagtgcgagtgattaaagtcaaaggaggccggggggacattagtgagcccaagaaaaaggagtacgaggggggcctggggcagcaggacgcgaatgaaaatgtgcaccccatgagtcctgatacaaagctggtgaccatcgagcctcccaaccctattaacccaagcactaactgcaatggattgaaagaaaatccacactgcggcggctctgttacaatgccacccatcaacctgaccaactccaatctcatggccgccaatctcagctcaaatctcttccaccctagcgtgcgcctgaccgagcgagctaagaagcggcgcacctctagtcagtccattggacaggtcatgccaaacagcagacaggaagatcctggccccattcagagtcagatggaaaaaggtattttcaacgaaaggactggccactctgatcagatggccaacgagaacaaaagaaagctaaactttagtcgttcggatcggaaggagttccacttccctgaactgcctgtgacgatccagagcaaagatacaaaggggatggaggtgaagcagattaagatgcttaagagggagagcaagaagacagagtcctctaagattcccactttattaaatgtcgaccagaaccaggaaaagcaggaggtccgattgtaccagcggcatgaggaccggcccatccagtag

SEQ ID NO: 184266 - DNA, 3093 bp, Artificial Sequence
  Description of Artificial Sequence: Synthetic coding sequence
atgaagatccccaacatcggcaacgtgatgaacaagttcgagatcctgggcgtggtgggggagggcgcatatggtgtcgtcctgaagtgcaggcacaaagagacacacgaaatcgtagcgatcaagaagtttaaggattcggaagagaatgaagaagtgaaagaaaccacactgagggagctcaagatgttaagaacgttgaaacaggaaaatattgtggaactcaaggaagcgtttcgcaggagggggaaactatatctggtgttcgaatatgttgaaaaaaacatgctggaactgctggaggagatgccaaatggtgtgccccccgagaaggtgaaaagctacatttaccagctaatcaaggccatccactggtgccacaagaatgacatagtacacagggacataaaaccggagaatcttctgatctcacacaatgatgttctgaagctgtgcgactttggattcgctaggaatttgtctgaggggaacaacgccaattacactgaatacgtggccacgagatggtacagatccccagagctgctgcttggcgccccctacggcaagagtgtagacatgtggtccgtcggctgcatcctgggagagctctcagacggacagccgctgtttccaggagagagcgagattgatcagctttttactatccagaaggtcctgggccccctgccttcggagcagatgaagttgttctattctaatccacggtttcatggccttcggtttcccgcagttaatcacccacaaagcctggaacggcggtatcttgggattctgaactcagtcttgttagacctgatgaagaatcttctaaagctcgaccctgcggacaggtaccttacagagcagtgcttaaatcatcccacattccagacacagaggctgctggatcgctcgccatctcgctccgcgaagaggaagccttatcacgtcgagtccagtacactctcaaacagaaaccaggctggaaaatcaaccgctctgcagagccatcacaggagcaatagcaaagatatccagaacctgagtgtgggcctgccacgtgctgacgagggtctccccgccaacgagtcattcctcaacggtaaccttgctggggcttccctttcacctctgcataccaagacataccaggcttcgtcccagcccggatcaacgtctaaggatctgaccaacaacaacatcccacatttgttatccccaaaggaagccaaatccaaaacggagtttgactttaatatagatcccaaaccctccgaaggccccggaaccaagtatctgaaatctaattctcggtctcaacagaataggcactcctttatggagagctctcagtctaaggcgggtactctacaaccaaacgagaagcaaagtcgacactcttacattgatacaattccgcaatcaagcaggtcaccgtcttacaggaccaaagccaaatcccatggggccctatcagactctaaaagtgtgagcaatcttagcgaggctagagcacaaatcgcagaaccctctacctcccgctactttccttctagctgcctggatctcaattcccccactagcccaactcctaccagacactctgatacgcggactctgctgtctccttccggaaggaacaatcggaatgaaggcaccctggattcgcggaggaccacaacccgccacagcaagaccatggaggaattaaaactgccagagcacatggattccagccattcccattccctgtccgctccacatgaatccttctcttatggactggggtacactagccccttcagtagccagcagagaccccaccgacattccatgtatgtgacccgagacaaggtacgagcaaaagggttggacggctccctgagtatcggacagggaatggcagccagggcaaactcactccagctccttagcccgcagccgggcgagcagctcccaccagagatgacagtagccagatcatcagttaaagagaccagtcgggaaggtacatcctcatttcacactaggcaaaagagtgagggaggggtctaccacgatcctcactcagatgacgggactgcccccaaagagaatcgccacctgtataacgatcccgtccctcgccgtgtcggctcattctatcgcgtcccatcccctcgacccgacaactcctttcacgaaaacaatgtctcaactagggtgtcatccctgccatcagagtcctcctccgggaccaaccatagtaaaagacaacctgctttcgatccctggaaatctcccgaaaatatatctcactccgaacagctgaaggagaaggagaagcaaggattctttaggtccatgaaaaaaaaaaagaagaagagtcagacagttcctaacagcgactcacccgacctcctcacgctgcagaaaagtatccactctgcttctacaccatctagccgaccaaaagagtggcggcctgaaaagatctccgatctgcagactcagtcccagccactcaagtctttgcgcaaactccttcacctttccagcgccagtaatcacccagcttcatcagatccccgcttccaacccctgacagcccagcagactaagaacagtttcagtgagatccggatacaccccctgagccaagcttccggaggtagtagtaacatcaggcaagagccggcacctaagggacgcccggccctccagttacccgacggtggatgtgacggacgcaggcagagacaccactctggaccccaggatcgccggtttatgctgaggacaaccgaacagcagggggaatatttttgttgtggagatccaaaaaaaccacacaccccctgcgtgcctaatagggcacttcaccgtccaatcagttcacctgcgccctatcccgtcctgcaggtgcgcggcacatccatgtgtccaaccttgcaggtccgaggcactgatgccttcagctgcccaacccagcagagcggattctctttcttcgttcggcacgtgatgcgcgaagcgctcatccatagagctcaggtcaaccaggcagccctcctgacctaccacgaaaacgctgctctcaccgggaaatag

SEQ ID NO: 184267 - DNA, 3093 bp, Artificial Sequence
  Description of Artificial Sequence: Synthetic coding sequence
atgaagatccccaacatcggcaacgtgatgaacaagttcgagatcctcggcgtggtgggcgaaggggcgtacggagtagtgcttaagtgcaggcataaggaaacacacgagattgtcgccattaaaaagtttaaggatagcgaagagaatgaagaggtgaaagagactacgctgcgagaactgaagatgcttcggactctgaagcaggagaacattgtcgagctgaaggaggcgttcagaaggcgcggaaaactataccttgtgtttgaatatgtggagaaaaatatgttagaactgttagaagagatgccaaacggggtgcctccagaaaaagtcaagagctatatttaccagctgatcaaagccattcattggtgccacaagaacgacattgtgcatagagatattaaacccgagaacctgctcattagccacaacgatgttttgaaattgtgtgactttggattcgccaggaacctgtcggagggtaataacgctaactataccgaatacgtcgctacaagatggtaccgatccccggaactgttactcggcgcaccgtatggcaagagcgtggatatgtggtcagtgggctgcattctgggggaactgtccgacggacaacctctgtttccaggcgaaagtgagatcgatcagctcttcaccattcaaaaagtgctaggcccgttgcctagtgaacagatgaagttgttttatagtaatccacgattccatggtctgcgatttccagccgttaatcacccacagagcctggaaaggcgctacctgggcattctcaattcagtgttattagacctcatgaagaacctgctgaaactcgatcccgccgaccgctacctgaccgaacagtgtctaaatcacccaacatttcagactcagcgcctgttggatagatccccctctcgatcagcaaagcgcaagccttaccacgtagaatcgtccacactcagcaataggaatcaggccggcaagagcacggcccttcagtcacatcacagatctaactccaaagatatccagaacctctcggtaggactgcctcgagctgatgagggtctgcctgcgaatgagagtttcttgaacggcaatctggctggagcaagtctgagcccgctccacacaaagacctaccaggcaagctcgcaaccaggttctacttctaaggacctgaccaataacaatatcccacacttactaagtcctaaagaggcaaaatccaagactgaatttgactttaatattgaccctaagccctcggaggggccgggcactaaatatctgaaaagtaacagtaggtctcaacagaataggcacagcttcatggaatcatcgcagagcaaggccgggacccttcagccaaacgaaaagcagtctcggcactcatacatcgacaccatcccccagtcttcccggtccccttcgtatcggacgaaggcaaagtcccacggggcattatcagactccaaaagtgtctctaacctctccgaggccagggctcagatagcagagccaagtacgagccggtattttccctcctcgtgcttagatcttaactctcccacatcccccactcccacccgtcattccgacacccgaaccctgctctcgccctcaggccgcaataaccggaatgaaggcactctggatagcaggagaacaacgaccagacacagcaagacaatggaggagttaaaactgccagagcacatggattcaagtcattctcattcccttagcgctccgcatgaaagcttctcatacggattaggttatacatcacctttttcttctcagcagcggccgcaccggcatagcatgtacgtgaccagggacaaggtccgcgcaaaagggctcgacggaagcctcagcatcggtcaaggtatggctgcccgagctaattccctgcagttgttgtccccgcagcccggagagcagcttcctccagaaatgactgtggctaggtcaagcgtgaaagagaccagcagggagggaaccagcagctttcacactcgccaaaagtctgaaggtggagtttaccatgatccccactccgacgacggtaccgctcctaaggagaatcgacatctgtataatgatcctgtcccacgccgtgttggcagcttttaccgtgtaccctcaccccggccagacaatagttttcatgagaacaatgtttccacccgcgtctcctccctgccatccgaatccagttcaggaaccaatcactccaaaagacagccagcttttgacccctggaagtcacccgagaacatatcgcattccgagcagctgaaggaaaaggagaaacaggggttcttcaggtccatgaagaagaaaaagaagaagagccagaccgtacctaatagcgatagtcccgatcttctcacccttcagaaaagtattcactcagcatctaccccttcctctcgtcctaaagagtggcgtcccgagaagatatctgacctgcagactcagtctcagcccctaaaatctcttcgtaaattgctgcacctctcatccgcttcaaatcaccctgcttcaagtgacccacgattccaacccctgaccgcccagcagacaaaaaactctttttccgagattcgcattcacccgctctctcaggcttcaggggggtctagcaatataagacaggaacccgcccccaagggtcgacccgctctccagcttccggatggaggctgcgatgggcgcagacagaggcaccactctggccctcaggacaggagattcatgcttcgcactaccgaacagcagggggaatatttttgttgcggggaccccaagaaacctcatactccatgtgtgccgaaccgagcgctgcaccgaccaatctcttcccccgccccctaccccgtgctgcaggtaagaggaaccagtatgtgtccaacactccaggtgagagggactgatgctttcagctgtccaacacaacagtcgggtttcagcttctttgtcagacacgtcatgagggaagctcttatccatagggctcaggtcaaccaggccgccttactgacctatcacgagaatgcggcgctgaccggcaagtag

SEQ ID NO: 184268 - DNA, 1956 bp, Artificial Sequence
  Description of Artificial Sequence: Synthetic coding sequence
atgagcctgccccggctgctgaaggtgaacatccggacctacgacaatagtatccctatatctgaatcttcacggaaatcctggaaccagaaacactttgctcttacatttcccaagccactgcagcgtggcaccaatgataagagccggccattgaagtctcagattactgtgaccaggcacgacaaaaggaagttggaagaagggcagaagcccgcccataagtggattcgccactcgttcaggaaaattcttcaatggccaccaatctatacagccgctcgcgagcagactcccttcagacacttgtacacttctaagacacatctaaaaaaagctgagtataaaaagtccaaagacgagaagggcggaacacccctgaagaaggacagcaagaagaaaggcgggtcttatgccacaaacccagagtccaaacagatcgttgaagaaaaaacaaagagacagaacgaggcggacaagacccccctgaagtcttcccatgagaatgaacagtccaagaagtctaagtcaagcagcgagaccaaccctgagtctcagaacagtaagacagtgtccaagaactgtagtcagaaggataaaaaagactccaagaactccaaaaagaccaatacggagttcctacataccaaaaacaaccccaagaaggatttgaagcgttcaaagactagcaatgaccccattagtgaaatctgtagcgaaaattcgctcaacgtcgactttctgatgctcgtgggccagagtgacgatgaatcaataaacttcgacgcttggttgaggaattacagccaaaacaactcaaaaaactacagtcttaaatacactaaatacacgaaaaaggataccaaaaaaaacgctaaaaagagctccgatgcggaatcggaggactccaaggacgctaaaaaggatagcaagaaggtcaagaagaatgtcaaaaaggacgataagaaaaaggatgttaagaaggacaccgagagcaccgacgccgagagtggcgactctaaagacgaaagaaaggatactaagaaggataaaaagaaattgaagaaggatgacaagaaaaaggatacaaaaaaatatccggagtccaccgacaccgagtctggagacgcaaaggatgcgcgcaacgattctagaaatctgaagaaagcttcgaaaaacgatgacaagaagaaagatgccaagaaaatcacattttccacagacagtgaatctgaactcgagagcaaagagtcacaaaaagacgaaaagaaggacaagaaagacagcaagacggataacaagaaaagcgtgaagaacgatgaggagtccaccgatgctgactcagaacctaagggtgacagcaagaaagggaagaaagacgagaagaagggcaagaaagattcaaaaaaagacgataagaagaaggatgccaagaagaatgccgaatctaccgaaatggagtccgatttggagctcaaaaaggataagaagcactctaaggaaaagaaagggagtaaaaaggacattaaaaaagatgcacgcaaagatactgagtccaccgacgctgaatttgatgagtctagtaaaacgggctttaaaacctctacaaagataaaaggcagcgatacggaatcagaggaaagcctgtacaagccaggcgctaagaaaaaaatcgatgaatcggacggaacctcagccaactccaagatggagggactggaaagcaaacgcgggttccgcatgagctctaaaaaaacgacctttaacgagaagggcgaaaaggcgagcacaggaagggtgccaccctcccgcgagaagccccctctgccagcctgcgagcctagtctaccgagcccaaaagttaggcgactgtgctggtgcaagatgcccccacccccccccaaaccacggtatgccccactgccagaagccccttggatccataagctgctgtag

SEQ ID NO: 184269 - DNA, 1974 bp, Artificial Sequence
  Description of Artificial Sequence: Synthetic coding sequence
atgagcctgccccggctgctgaaggtgaacatccggacctacgacaacagcatcccaatctctgagagtagcaggaaatcttggaatcagaagcatttcgccctgacattcccaaaacctctgcagaggggaacaaatgacaaaagtagaccgcttaaatcgcagatcaccgttacacgccatgataagcgtaagcttgaagaaggccagaagccggctcacaagtggatcaggcatagcttcaggaagatcctgcagtggccacctatctataccgccgccagagaacagaccccgttccgccacctatacacttcaaagactcacctcaaaaaagcagaatataagaaatctaaagatgaaaaaggaggcacaccactgaaaaaggacagcaagaaaaaaggggggtcatatgccaccaaccctgagagtaagcagatagtagaggagaaaacaaaacggcagaatgaggccgataaaacccctctgaaatccagtcacgaaaacgaacaaagcaagaagtctaagagctctagcgaaactaacccagaaagtcaaaactctaagaccgtgtcaaagaactgctcccaaaaggacaaaaaggactcaaaaaactccaagaaaacaaatacagagtttttgcacacgaaaaacaacccaaaaaaggatcttaagaggtctaagacatctaacgaccctatcagcgagatctgttcagagaactcacttaacgtggattttctgatgctggtcggccagagtgacgatgagagtatcaatttcgacgcctggctgcggaactactctcagaacaacagtaagaattactctctgaagtatactaagtacaccaaaaaagacaccaagaagaatgcaaaaaaatccagcgatgcagagtcagaagattcaaaagacgcgaaaaaggactcaaagaaggtcaaaaagaacgtgaaaaaagatgacaagaagaaggacgtgaaaaaggatactgaatccactgatgccgagagcggggattctaaggacgaaaggaaggataccaagaaggacaaaaagaagttaaaaaaggatgataaaaagaaagacactaagaaatacccggaatctacggatacggaaagtggggacgccaaagacgcaaggaatgacagtcgcaaccttaaaaaagcatccaaaaacgacgataagaaaaaggacgctaagaagattacattcagtaccgactccgagtccgagctggagagtaaagagtcccagaaagacgagaaaaaggataagaaggactctaaaactgataataaaaaatctgtcaaaaacgacgaagaaagtaccgacgctgacagcgaaccgaaaggtgactctaagaaaggcaaaaaagacgagaaaaaaggtaagaaagattccaaaaaagatgacaaaaagaaggatgccaagaagaacgcagaatctaccgagatggaaagcgatctggagctcaaaaaggacaagaagcacagcaaggagaaaaaaggcagtaagaaagacatcaaaaaagatgcacggaaagataccgaatccacggacgcagagttcgacgaatctagcaagaccggattcaagacttccaccaaaatcaaaggctccgacactgaatcagaggagagtctttacaagcccggcgccaagaagaagattgatgaaagcgatggaacttcagctaactcaaagatggaggggctcgaatccaagcgcggcttccggatgtctagcaagaagacaaccttcaatgagaaaggagagaaagccagtactgggcgggtgccaccgagcagggagaaaccccctctgcctgcctgtgagccttctctgccaagcccaaaggtaagaaggctgtgttggtgcaagatgccacctccccccccgaagcctagatacgcaccattaattcagcgtaggcagaggctgggagtgcgtaggtgtcagctcttaatgtag

SEQ ID NO: 184270 - DNA, 1086 bp, Artificial Sequence
  Description of Artificial Sequence: Synthetic coding sequence
atgcaggagaaggacgccagcagccagggcttcctgccccacttccaacatttcgcaacacaagctattcacgtgggacaagatcctgagcaatggactagccgcgctgtggtccccccaatttctctgtctacaaccttcaaacagggagctcccgggcagcactctgggttcgagtacagtcggtccggcaacccaacccgcaactgcctggagaaagccgttgccgctctcgacggcgcgaaatactgcctcgcatttgcttctggactggccgcgactgtaactataacacatctgctgaaggccggcgatcagataatctgtatggatgacgtctacggggggaccaataggtactttcggcaggttgcttcagaattcggacttaaaatttctttcgtggactgctcgaagattaaactcctggaggcagccataacaccagagaccaaacgtcccctagcgttgggcgccgacatctccatgtatagtgcaactaagtatatgaacggtcattctgacgtggtcatgggcctcgtctcggtgaactgcgaatctctgcataaccgcttaagatttttgcagaatagtctcggggctgtgccgtcacccatagactgctatttatgcaatagaggcttgaaaactctccatgtaagaatggagaagcacttcaaaaatggcatggcagtggcacaatttttggagtccaatccatgggtcgagaaggtcatctacccaggactaccaagccacccacaacacgaacttgtcaagagacagtgcaccggttgtacaggcatggtgactttttatatcaagggcacgctgcaacacgccgaaatctttctgaagaatctaaagctattcacccttgccgaaagtctgggcgggttcgaatccctggcagagctccccgctattatgacccacgcatccgtgctgaagaacgaccgggacgtgctgggcatctcagacacactgatacggctttctgtgggattagaagatgaggaagatttactcgaggatctcgatcaggccttgaaggccgctcatccaccctctgggtcacacagctag

SEQ ID NO: 184271 - DNA, 1218 bp, Artificial Sequence
  Description of Artificial Sequence: Synthetic coding sequence
atgcaggagaaggacgccagcagccagggcttcctgccccacttccaacacttcgctacccaagccatccatgtgggtcaggaccctgagcagtggacctctagggccgtggtaccacctatctctctgtctaccaccttcaagcagggagcacctgggcagcacagcggatttgagtacagcaggtctggtaatccaacacgcaattgtttggaaaaggctgtcgccgcgttagacggggccaaatactgcttagctttcgcctctggactagctgccaccgtgacaatcacacacctacttaaggccggtgaccagattatctgtatggacgacgtttacgggggtacaaataggtattttaggcaggtcgcaagtgaattcgggctgaagatctcttttgtggattgttctaaaattaagctcctggaggccgctattactccagagaccaagttagtgtggattgaaaccccgacaaaccccactcagaaagtcatcgatatagaagggtgcgcccacatcgttcacaagcatggtgacatcatcctcgttgtggacaacacctttatgtcaccttacttccaacggcctctcgccctgggagccgatatcagtatgtattctgccactaaatacatgaatggccattccgatgtggtgatgggactggtgtccgtgaactgcgaatcgctgcacaacagactgcgcttcttacagaattcacttggcgcagtgcccagccctatcgattgctacttgtgcaatagaggactcaaaaccctccacgtcaggatggagaaacattttaaaaacggtatggccgtcgcccagttcctggaaagcaatccttgggttgagaaggtgatctaccctggcctgccgagtcatcctcagcatgagctggtgaaaaggcagtgtacaggctgcaccggcatggttaccttttacataaaggggaccctccaacatgcagaaattttcctaaagaatctcaaattgttcacgttggctgaatctctgggggggttcgaaagtctggcagagctgcctgccattatgacccacgcctcagtgttgaagaacgatagagatgtcctgggcatatctgacactctgatccgcctaagcgtcggactggaagatgaggaggacctactggaagatttggaccaggccctgaaagcagctcacccgccttctggaagtcattcctag

SEQ ID NO: 184272 - DNA, 1122 bp, Artificial Sequence
  Description of Artificial Sequence: Synthetic coding sequence
atgcaggagaaggacgccagcagccagggcttcctgccccacttccagcactttgcaactcaggctatccacgtgggccaggatcctgaacagtggaccagccgggcggtggttccccctatctctctttctacaactttcaaacagggagcgccagggcagcacagcggtttcgaatatagtagaagtggcaacccaacgcggaattgcttggaaaaagctgtcgctgccctggacggagctaagtactgcacgaaccgttacttccgacaagtagcctcggaattcggccttaagatctcatttgttgactgttctaagatcaaattgctcgaagccgcaatcacaccggagactaaactggtgtggattgaaacccccacgaaccctacacagaaagtgatcgatatcgaggggtgtgcccacattgtgcataagcacggggacataatcttggtcgttgacaacaccttcatgagcccctattttcagcgtcctcttgctcttggagcagatatcagtatgtattctgcgacaaaatatatgaacggacactctgatgttgtgatgggactggtgagcgttaactgcgaatcacttcacaaccgtctgcggttcctgcaaaattcactcggcgccgtccctagccctattgactgttacttgtgcaaccggggactgaagacccttcacgtccgaatggagaagcacttcaagaatgggatggctgttgcacagttcctggagtccaacccatgggtcgaaaaagtgatctacccaggccttccttctcacccccagcatgagcttgttaagcgccagtgcacgggctgcaccggtatggtgacattctacatcaaaggtaccttacagcacgcagaaatttttttgaagaatcttaaacttttcacactcgcagagtcactaggcggctttgaatcactggccgaactcccagccatcatgactcacgcctctgttctgaaaaatgatcgggacgtgcttgggatcagtgacacactcatccggctctcagtgggtctggaggacgaagaggatctcctggaagacctcgatcaggctctgaaggccgcgcacccacctagtggttctcattcctag

SEQ ID NO: 184273 - DNA, 1656 bp, Artificial Sequence
  Description of Artificial Sequence: Synthetic coding sequence
atgcccagcgagaccccccaggccgaggtgggccccaccggctgccctcataggagtggtccccattcagccaagggaagtctggagaaggggtccccagaagacaaagaggctaaggagcccctctggatcaggcccgacgctcccagtaggtgcacttggcaacttggcaggccggctagcgaatctccacatcaccacaccgcgcccgccaagtccccaaagatcctccctgacatcctaaagaaaattggagatacccctatggtgcggatcaacaagatcgggaaaaagtttggcttgaagtgcgagcttttggccaagtgcgagttcttcaacgctggcggatcagtaaaggaccggattagcctgaggatgatcgaggacgcagagcgggatggaactcttaaaccaggcgacacgattattgaacccacttctggtaacacaggaatcgggcttgctttggccgcagccgtgcggggatatagatgcatcattgtaatgccagagaagatgagctccgagaaggtagacgtattgagagcattgggtgccgagattgtgcgcacacccaccaacgctcgctttgatagccccgagtcccatgtgggcgtagcctggcgcttgaagaacgaaattcctaatagccacatcctggatcaatatcgcaatgcttctaatcctctggctcattatgacactaccgcagacgagattctgcagcaatgtgatggcaagttggatatgttggtagcaagcgtggggaccggtgggactatcacgggcatagcaaggaaactgaaggaaaaatgcccaggctgtagaattattggcgtggatcctgagggatcaatcctggccgagcctgaagaactgaaccagactgagcagacaacatacgaggtggaggggattggctatgatttcattccaaccgtgctggatcgtacggtggtggacaagtggtttaagtccaatgacgaggaggcctttacctttgctcgcatgcttatagcccaggaaggcttgctgtgcggtggtagcgcgggtagtaccgtcgccgtggccgtgaaagccgcccaggagttgcaggaagggcagagatgcgtcgtgattctgccagactcagtgcggaactatatgacgaagtttctctcagatcgttggatgctgcaaaagggctttctgaaggaggaagacctgacagaaaagaagccatggtggtggcacctccgggtgcaggagctgggattgagtgctcctctgactgtcctccctaccattacttgtggacacaccatagagatcctgagggaaaaggggtttgaccaggccccagttgtggatgaggccggagtaattttgggcatggtgacacttggaaatatgctatctagcctcctcgcgggcaaggtgcaaccctcagaccaggtgggtaaggtcatttataagcagttcaagcagatcagactgaccgataccctgggaaggctgagtcatatcctggaaatggatcacttcgcccttgtggtccacgagcagattcaataccattctacagggaaaagctctcagagacaaatggtcttcggagtagttacagccatcgatctgctgaatttcgtagcagcgcaagagcgggaccagaagtag

SEQ ID NO: 184274 - DNA, 1656 bp, Artificial Sequence
  Description of Artificial Sequence: Synthetic coding sequence
atgcccagcgagaccccccaggccgaggtgggccccaccggctgcccacaccgaagtggccctcatagcgcaaaaggctcacttgagaagggctcccctgaggataaggaagctaaggaaccactgtggattagacctgatgccccgtcccggtgtacctggcagttaggcagacctgcctcagagtccccgcaccaccacacagccccagctaagtcccccaaaatccttcctgacattctcaaaaagattggcgacacccctatggtgcggattaacaagattggcaagaaattcggactgaaatgcgaattattagccaagtgcgagtttttcaatgctggaggctctgtgaaagacaggattagccttcggatgattgaagacgccgagcgggatgggacactcaagcccggtgacactattatcgagcccacctcggggaacacaggcattgggttggccctcgccgccgcagttcgtggttacagatgcataatcgtcatgcctgagaaaatgagcagcgaaaaagtggacgtactgagagccttgggcgccgaaatagttcggacgcccaccaatgctagatttgactcacccgagtcgcacgtgggagtggcttggaggctgaagaacgagataccaaactctcacatcctcgaccagtaccgaaacgcgtctaacccgctggctcactacgataccacagcagatgaaattcttcagcagtgtgatggcaagctggatatgttggtggcttctgtcgggactggcggtacaataaccggaatagctcggaaactgaaggaaaaatgccctggatgccggataattggggttgatcctgaggggtctatcttggcagagcccgaagaactaaatcagactgagcagaccacatatgaagtggagggaattggatatgacttcattcccacagtgctggatcgtaccgtagtagataagtggtttaagagcaatgacgaggaggccttcacttttgccaggatgctgatcgctcaggaaggattattgtgtggcgggtctgcgggatctaccgtggctgtcgcagtgaaagccgctcaggagctccaggaaggccagcgttgcgtggtcattttgcccgatagtgtgagaaactacatgaccaaattccttagcgacaggtggatgctgcagaagggcttccttaaagaagaggacttgactgaaaagaaaccatggtggtggcacttacgtgttcaggagctaggcttgtctgcaccccttacggttctgccgacaattacatgtggtcacacgatcgagattctccgggagaagggatttgaccaggcccctgtcgtcgatgaggctggtgtgattctgggcatggtaaccctgggaaacatgctgtcaagtctgcttgccggtaaagtgcagcccagcgatcaagttgggaaggtgatctacaagcagtttaagcaaatacgcctgaccgatacgttagggcgcctatcccacattctggagatggaccactttgctctggtagttcatgagcagattcagtaccactccactggtaagagttctcagcgccaaatggtctttggggtggtgacggccattgacctcttaaattttgttgccgctcaggagagggaccagaagtag

SEQ ID NO: 184275 - DNA, 1656 bp, Artificial Sequence
  Description of Artificial Sequence: Synthetic coding sequence
atgcccagcgagaccccccaggccgaggtgggccccaccggctgcccccacagaagcggccctcatagcgctaaaggtagtctcgaaaagggttcgcccgaggacaaagaggccaaagaaccgctttggattagacccgatgcaccttctcgctgcacttggcagctgggtcgcccagccagtgaatcacctcaccatcacaccgcgcctgccaagtcacccaaaattctcccagacattctgaaaaagatcggcgacacccctatggtgcggattaataaaatcggtaagaagttcgggctaaaatgcgaattgctggccaagtgcgagttctttaatgccggggggagcgtgaaggacagaatttctctgaggatgatcgaggacgccgagcgcgatggaacccttaaacctggagatactattatcgaacctacgtcggggaataccggcatcggccttgccctagcagctgccgttagaggctatagatgcatcatcgtgatgcctgaaaagatgtctagcgaaaaggttgacgtgctcagggcactaggagcagaaattgttcggacacctaccaacgcccgctttgattcgccagaaagccatgtgggtgtggcttggaggttaaagaacgagataccaaactctcacattctcgaccagtatcgtaacgcttcaaatccattggctcactatgatactacagctgatgagatactgcaacagtgcgatggcaagctagacatgctggtggcaagtgtggggacaggcggcaccatcaccggcatcgcacggaaacttaaagagaaatgtccaggctgtaggattatcggcgtcgaccccgagggtagcatactggctgagccagaggagttgaaccaaaccgagcagaccacctatgaggtagaaggcatcgggtacgattttatccccaccgtcctcgacagaactgttgttgataagtggttcaagtcaaacgatgaagaagcttttacgttcgccagaatgcttattgcccaggagggactcttgtgtggtgggtctgcaggatcaactgtcgcggtggctgtcaaggcagcccaagagcttcaagagggccagaggtgcgtggtgattttgcccgacagtgtgaggaactacatgacaaaattcctcagcgaccgctggatgttgcagaaaggattcctgaaggaggaggacctcaccgagaagaagccttggtggtggcacctgcgagttcaggagctggggcttagcgctccgctcaccgtgctccctacgatcacctgtggacatacaattgagattctcagagagaagggttttgaccaagccccggtggttgatgaagccggagtgatcttaggcatggtgaccctcgggaatatgctcagctcattattggcaggcaaggtacagccttctgaccaagtcggcaaggtgatttataagcaatttaaacaaatcaggctgaccgatactcttggaaggctgtcacatatactagaaatggatcatttcgccctggtcgtgcatgaacaaatacaatatcacagcacaggaaaatcatcccaacggcagatggtttttggggtggtgacagccatcgatctgcttaactttgtggcagcccaggagagagatcagaagtag

SEQ ID NO: 184276 - DNA, 1656 bp, Artificial Sequence
  Description of Artificial Sequence: Synthetic coding sequence
atgcccagcgagaccccccaggccgaggtgggccccaccggctgcccccaccggagcggcccccactcagctaaaggctccctcgagaagggttcgccagaagataaagaagcgaaggagcccctatggatacgtcccgatgcacctagtagatgcacatggcaactagggaggcccgcttctgagagcccccaccatcacaccgcaccagccaaatcacctaagatcctgcctgatatcctgaaaaagattggcgacacgccaatggtgcggattaataaaatcggcaaaaagttcggtcttaaatgtgagctcttggccaaatgtgaattcttcaatgctggtggaagtgttaaggaccgcatttcgctgcggatgatcgaagatgcagaaagagatgggaccctcaaacctggtgacaccatcattgaacccacttctggcaacaccgggataggattggcattagccgcagcagtgcgaggatatagatgcattattgtcatgcctgaaaaaatgagctccgagaaggttgatgtcctcagagccttgggtgctgagattgtcaggacacccactaatgcgcgcttcgacagcccagagagtcacgtcggcgtagcttggaggctcaaaaacgagattccaaattctcacatcttagatcagtaccggaatgcgtccaaccccttagcccattatgacactacagctgatgagattctccagcaatgcgatggcaagctagacatgctggtcgcctctgtgggtacaggcgggactatcactggaatagcaaggaaactgaaagaaaagtgtcctgggtgtcggatcataggcgtcgaccctgagggaagcatcttggcagagcctgaagagctcaaccaaacagagcagaccacctacgaggtggagggaatcggctatgactttatccccaccgtgttggaccgcaccgttgtagataagtggttcaagtctaacgatgaagaagcattcaccttcgctcgaatgctgatcgcacaggagggactcctctgcggcggatctgcagggtccacagttgctgtggcggttaaggccgctcaagagcttcaggagggacagcgatgcgttgttatccttccagactccgtaaggaattacatgaccaaatttctcagcgatcgatggatgctccagaaggggttcctgaaggaggaagatctgactgaaaaaaaaccgtggtggtggcatctgagggtgcaggagctcggtttaagcgcccccctcaccgtcttacctactataacttgcggccataccatagaaatcctgcgggaaaaaggctttgaccaggctcccgtagtggacgaagctggagtgattttaggaatggtgacactgggcaatatgctaagtagtctgcttgctggaaaggtgcaaccgagcgatcaggtcggcaaagtgatttataagcaattcaaacagatccggctgaccgacacactgggccggctctcccatatactcgagatggaccattttgccctggtcgtacacgaacagatccagtaccactcaacagggaaaagctctcaacgccagatggttttcggagttgtgactgccatcgacctgttaaactttgttgccgcccaggagagagaccaaaagtag

SEQ ID NO: 184277 - DNA, 1698 bp, Artificial Sequence
  Description of Artificial Sequence: Synthetic coding sequence
atgcccagcgagaccccccaggccgaggtgggccccaccggctgcccccatcggtccgggccacatagtgccaagggcagcctggaaaagggttccccagaagacaaggaagcaaaggagccgctgtggatccggcctgacgccccttctcggtgcacctggcaactgggccgccccgcgtccgaaagcccacaccatcataccgctccagcgaagagtccaaaaattctacctgacatactcaagaagattggcgatacccccatggtccgtattaacaagatagggaaaaaattcggcctgaagtgcgaactgcttgctaagtgtgagttttttaacgccggcgggagtgtgaaagatcggattagtctccggatgattgaggatgcagagcgggatggaaccctaaagcctggagataccattattgaacccactagcggcaatacagggatcggtctcgcccttgccgccgccgtcagaggataccgctgtataatcgtaatgccagagaaaatgagtagcgagaaggtagacgtacttagggctctcggagcagaaattgtgcgaaccccgacaaacgccaggttcgacagtcccgagagtcatgtcggggttgcctggcgcctaaaaaatgaaattccgaactcccatatactagatcagtacaggaacgctagcaaccctttagcacactacgacaccacggcagatgagattctgcagcaatgcgatgggaaattagatatgctggtcgcttcggtggggacaggcggaaccatcacaggtattgcccgcaaactgaaagagaaatgcccaggctgccgcattattggcgtggaccccgagggctccatcctggccgagcctgaggaactgaaccagactgagcagaccacatatgaagttgaagggatcggttacgatttcatcccaacagtgctggaccgcacggtagtggacaagtggttcaagtctaatgacgaggaggctttcaccttcgcccgaatgctgatcgcccaggagggcctattgtgcggcggttccgcgggtagcacagttgccgtagccgtgaaggctgcccaagagctgcaagaaggtcagcgttgcgttgtcatcttaccagactctgtcagaaattacatgaccaaatttctgagcgatcgttggatgctgcaaaagggcttcctcaaagaggaagacctgacggagaaaaagccctggtggtggcacttgagagttcaagagctgggcctctcagcccctctgacggtgctgccgacgatcacctgtggccacaccattgagatcttgagagagaaaggatttgatcaggcccccgtggtggatgaggcgggagtaatcttgggaatggtgacacttggaaacatgctgtcctctctccttgcagggaaagtacagccaagtgaccaggtgggcaaggttatctataagcagttcaaacagatccgcctgaccgacacgttgggtcgccttagccacatcttggagatggaccatttcgcattggtggtacacgaacagatccagtcgcaggatcaggcttgggccggtgtggttgggggccctgcggatcattccacaggtaagagtagccagcgacagatggtctttggcgtcgtgacggctatagacctcctcaacttcgtggctgcccaagagcgcgatcagaaatag

SEQ ID NO: 184278 - DNA, 534 bp, Artificial Sequence
  Description of Artificial Sequence: Synthetic coding sequence
atgcccagcgagaccccccaggccgaggtgggccccaccggctgcccacaccggtctggcccgcattccgcaaaggggtctctcgagaagggctcaccagaagacaaggaggccaaagagccactgtggatccggcccgatgctccaagccggtgcacctggcagctgggcagacctgcgagtgaatcccctcaccatcatactgccccagccaaatcccctaaaattctgccggacatcctgaagaagatcggagatacgcccatggtccgaattaataaaatcggaaaaaaattcggtcttaaatgtgagctgctagccaagtgcgagttctttaacgccggcggctctgtaaaagatcgtatcagccttaggatgattgaagacgctgaacgggatggtaccctgaagcctggcgacacaattatcgagcccactagcggcaatacaggcatcggcctcgcacttgctgcggctgtgcgtgggtatcgttgcatcatcgttatgcccgagaaaatgtctagcgagaagtag

SEQ ID NO: 184279 - DNA, 1527 bp, Artificial Sequence
  Description of Artificial Sequence: Synthetic coding sequence
atgcccagcgagaccccccaggccgaggtgggccccaccggctgccctcacagatccggcccgcaccaccacaccgccccggcaaagagcccgaagatccttcccgatatactgaaaaagatcggggacacccctatggtgcgtatcaataaaattggcaaaaaattcggcctaaagtgcgaactgctggctaagtgtgaatttttcaatgccggggggtctgttaaggacaggatcagcctcaggatgattgaggatgcagaacgggatgggacacttaagcctggggacacaatcatcgaacccacttctggaaacaccggaattggccttgcgcttgccgcagcagtccgcggttatagatgtattatagtgatgccagaaaaaatgtcttcagaaaaggtcgatgtgttgagggccttgggggccgaaattgttcgaaccccaaccaacgctaggttcgactcaccggaatctcatgtaggagtcgcatggcggttgaagaatgaaattccaaatagccacatcttggatcagtaccgaaacgcaagcaatcctctggctcactatgacaccactgcggatgagatactgcagcagtgtgatggaaagcttgacatgttggtggctagtgtggggactggagggactattacaggaatcgcgcgcaagctgaaagaaaagtgcccaggttgtaggattattggagtcgatcccgaaggcagcatcctggcagaaccagaggagctaaaccagacagagcaaaccacgtacgaggtggagggaattggctacgacttcatacctaccgtgctggaccgcacagtggtggacaagtggttcaaatcaaatgatgaggaagcgttcaccttcgcaaggatgctgatagcccaagaaggactcctgtgtgggggaagtgcaggaagtacagtggccgttgcagtgaaggccgctcaggagttacaggaggggcaacggtgcgtggtcattctccctgattctgtgcggaactacatgacaaagttcctgtccgatcgctggatgcttcagaaaggatttctgaaagaagaggatctaaccgagaaaaaaccgtggtggtggcacttgcgcgttcaagaattgggtttgtctgctccgctgaccgtgctgcctactattacatgtgggcataccattgagattctcagagaaaagggattcgaccaggcccctgtggttgatgaggccggcgtaattctggggatggtgacccttgggaacatgctcagctcactcctcgcaggcaaagtacaacccagtgaccaggtgggtaaagttatatacaaacagttcaaacagataaggttgacggacacacttggaagactgtctcacatcctcgagatggaccatttcgccctagtcgtccacgagcaaatccagtaccacagtactgggaaatccagccagcgtcagatggtgtttggagtggtcaccgctatcgacttgctgaactttgtggcagctcaggagcgtgatcagaaatag

SEQ ID NO: 184280 - DNA, 1392 bp, Artificial Sequence
  Description of Artificial Sequence: Synthetic coding sequence
atggtgcggatcaacaagatcggcaagaagttcggcctgaagtgcgaattgctggccaagtgtgagtttttcaacgcaggcggctctgtgaaggacagaatatctcttaggatgattgaagacgcggagagagacgggaccctcaagccaggggataccatcatagagcccacttcgggcaataccggcatcggcctggcactagcggcggccgtaaggggataccgttgtataattgtcatgcccgagaagatgagctctgaaaaggtagacgtcttgcgcgccctcggcgccgaaattgtgcgcactccgaccaatgcgcggtttgactcccccgaatctcatgtgggcgtggcctggagactcaagaacgaaataccaaatagccatatcctagaccagtaccggaatgcatccaatcctctggcgcattatgatacaactgctgatgagatattacagcaatgcgatgggaagcttgatatgctcgttgcatctgttggcacgggcggtacaataacggggatagcgcggaaactgaaggaaaaatgtcccgggtgcagaatcattggtgtcgatcccgaagggtctatactcgctgagcctgaagaactgaaccaaaccgaacagacaacttacgaggtggaagggatcggttatgatttcatcccgaccgttctggatcggacagtggtggataagtggttcaagagcaatgatgaggaggcctttacattcgcccggatgttgatagctcaggagggattgctgtgcggtggatccgccggcagtacagtcgccgtggctgtgaaagctgcccaggaactccaggagggccagaggtgtgttgtcatactgcccgactctgtgagaaactatatgaccaaatttctgagcgaccggtggatgctgcagaagggctttctgaaagaagaagacctgacggagaagaagccatggtggtggcatcttcgggtccaagagctgggactttccgctcctctaacggttctgcccacaatcacttgtggacacactattgaaattcttcgtgagaaaggctttgaccaggcacctgtggttgacgaggctggggtcatcttgggcatggtcacgctgggaaacatgctgtcctccctcttggccggaaaggtccagccttccgatcaggtcgggaaggtcatttacaaacagttcaaacaaatccgtctcacagacactcttggaaggctgtcacacatcctcgaaatggatcactttgccctggtagtgcatgagcaaattcagtaccatagtaccggcaaatcttcacaacggcaaatggtgtttggcgttgtgacggctattgatctgcttaactttgtcgccgcacaggagcgggatcagaaatag

SEQ ID NO: 184281 - DNA, 312 bp, Artificial Sequence
  Description of Artificial Sequence: Synthetic coding sequence
atgatggccgagccctggcaggccctgcagctgctgctggccatcctgcttaccctcatggctctgccctaccaagcccgaaaaaagacattcctttctgtgcacgaggtaatggccgttgagaattatgccaaagacagcttgcagtggataacagatcagtataacaaagaatcagacgataaatatcactttagaatttttcgtgttctgaaggtgcaaaggcagcaggtgaattgctttttctctgtctttgctgtcccatggtttgagcagtataagattctgaacaagtcatgctcatcagactag

SEQ ID NO: 184282 - DNA, 417 bp, Artificial Sequence
  Description of Artificial Sequence: Synthetic coding sequence
atgatggccgagccctggcaggccctgcagctgctgctggccatcttactcaccctaatggctctaccctatcaagccaggaagaaaactttcctgagtgtgcacgaagtaatggccgtagaaaactacgccaaggacagtcttcagtggatcaccgatcagtataataaggagtcagacgataagtatcactttcgaatcttccgagttctcaaagtgcagagacaggtgacggatcaccttgagtaccatctgaatgtagagatgcagtggaccacatgccagaagccagagaccactaactgcgtgccccaggaacgggagctgcataagcaggtaaattgcttcttttctgtgttcgctgtgccttggtttgaacaatataaaatactcaataagtcttgttcttccgactag

SEQ ID NO: 184283 - DNA, 297 bp, Artificial Sequence
  Description of Artificial Sequence: Synthetic coding sequence
atgatccccggcggcctgagcgaggccaagcccgccacccccgagatccaggagatcgttgacaaagttaaacctcagctggaggagaaaaccaatgagacctatggtaaactcgaggctgtgcagtacaagactcaagtcgtggccgggaccaactattacatcaaggttcgcgcaggcgataacaaatacatgcacctcaaagtatttaagagtctgcccggacagaacgaggaccttgtgctcactggttaccaggtggataagaataaagatgacgagctcactggcttctag

SEQ ID NO: 184284 - DNA, 297 bp, Artificial Sequence
  Description of Artificial Sequence: Synthetic coding sequence
atgatgtgcggcgcccccagcgccacccagcccgccaccgccgagacgcagcatattgccgaccaggtcaggagtcagttggaggagaaagaaaacaaaaagttcccagtctttaaggcagttagctttaagtcacaagtcgttgccggcactaactacttcataaaggtacatgttggagatgaagattttgtccatctgcgcgtgttccagtcactacctcatgagaataaaccacttactctgtcaaactaccaaacgaacaaggccaagcatgatgagctaacctatttttag

SEQ ID NO: 184285 - DNA, 441 bp, Artificial Sequence
  Description of Artificial Sequence: Synthetic coding sequence
atggccggccccctgcgggcccccctgctgctgctggccatcctggccgtcgccctcgctgtgagtccagccgccggctcttccccggggaaaccccctcggcttgttggtggaccgatggacgcctccgtcgaggaggagggggtgcgcagagcactcgatttcgccgtgggcgagtacaataaggcttctaatgatatgtatcacagtcgcgcactccaggtcgtgagagctcgcaaacagattgtggctggtgtcaattacttcctggacgtggagctcggccggactacatgtactaaaacccaaccaaatctagataattgcccttttcacgaccagccacacctgaagaggaaggcattttgtagcttccaaatatatgctgtgccatggcagggtactatgacactgagcaagagtacttgccaggacgcttag

SEQ ID NO: 184286 - DNA, 441 bp, Artificial Sequence
  Description of Artificial Sequence: Synthetic coding sequence
atggccggccccctgcgggcccccctgctgctgctggccatcctggcagtcgcgctggccgtgtcacctgccgcaggatcttctccaggaaagccacccaggttggtgggaggtccaatggacgcttctgtcgaggaggaaggtgtccgtcgggcactcgacttcgcggttggagaatacaataaagcatcgaacgacatgtatcactctagagccctccaggtagtccgtgctcgtaagcagattgtggctggagtgaactactttcttgatgttgaactgggtaggaccacctgtaccaaaacacagccgaatcttgacaactgccctttccatgatcagcctcatttaaagcggaaagccttttgtagcttccagatctacgccgtaccctggcagggtaccatgactctgtcaaaatcaacctgtcaggatgcctag

SEQ ID NO: 184287 - DNA, 441 bp, Artificial Sequence
  Description of Artificial Sequence: Synthetic coding sequence
atggccggccccctgcgggcccccctgctgctgctggccatcctggctgtggcactggcggtctcccctgctgcagggtctagtcctgggaagcctccacgccttgtgggcgggcctatggacgcctccgttgaggaggagggggtgagacgtgctcttgactttgcagtgggggagtacaacaaggcgtccaatgacatgtaccactctcgggcgcttcaggtggtgcgagcccgcaagcagattgtggctggcgtaaattactttctagatgtggaactcggcagaaccacatgtacaaagacacaaccgaatctggataattgcccatttcacgaccagccgcacctgaaaaggaaggccttttgcagtttccaaatctacgctgttccttggcaggggactatgacattatctaagtctacgtgccaggatgcctag

SEQ ID NO: 184288 - DNA, 429 bp, Artificial Sequence
  Description of Artificial Sequence: Synthetic coding sequence
atgatgtggcccatgcacacccccctgctgctgctgaccgccctgatggtcgcggtggctggcagtgcctccgcccagtcacggaccctggccgggggcattcacgctacagatttgaatgacaagagtgtgcagtgcgcgctggacttcgccattagcgaatataacaaggttattaataaggacgaatactacagccggcctcttcaggtgatggccgcttaccagcagattgttgggggtgtgaactactacttcaatgtcaaatttggaaggacaacctgtaccaagtctcaaccgaacctggataattgtccgtttaatgaccaaccgaagcttaaggaggaggaattctgcagctttcagataaacgaggttccctgggaagacaagatctccattctcaattacaaatgtaggaaggtttag

SEQ ID NO: 184289 - DNA, 1578 bp, Artificial Sequence
  Description of Artificial Sequence: Synthetic coding sequence
atggccaccctgctgcggagcaagctgagcaacgtggccaccagcgtaagcaacaagagccaagcgaaaatgtctggcatgtttgcccggatgggttttcaggcagccactgatgaggaagctgtagggtttgcccactgcgacgatcttgacttcgaacatagacagggcttgcagatggacatcctgaaggcggaaggggagccatgcggcgacgaaggtgccgaggcaccagtggagggagatatccactatcaaaggggatccggcgctccactacccccatccggaagcaaggatcaggtaggtgggggaggcgagtttggtggccatgataagcctaagatcacggcttgggaggctgggtggaacgtgaccaacgccattcagggtatgtttgtcttgggcctaccctacgccatcctacacggaggttacttggggctgttcctaattatcttcgccgctgttgtatgttgttacaccggaaagatcctgatcgcctgcctgtacgaggaaaatgaggatggagaggtggtgcgagtgagagactcctatgtggccatcgcaaacgcctgctgcgctccccgtttccctacattgggcggtagggtggtgaacgtagctcagattatcgaactggtgatgacgtgtattttgtacgttgtggtcagcggcaacctaatgtacaacagcttcccagggctacccgtaagccagaagtcctggagtattatcgcaacggcagtattactgccctgcgcctttctcaaaaacctcaaagcggtttccaaattttcactcctctgtactttagcccacttcgtgattaacatcctagtgattgcttactgtttgtctcgggctagagactgggcgtgggagaaagtgaaattctacatagatgttaagaagtttcctataagcattggcatcattgtctttagttacacctcccaaatttttttgcctagcctggagggcaatatgcagcagcctagcgaattccattgtatgatgaattggacccatattgctgcttgtgtgttgaagggattgttcgctctagtcgcctatctgacgtgggcagatgaaaccaaagaggtcatcacagataaccttcccggatccattcgcgccgtggttaacattttcctcgtggccaaggccttgttgagttatcctcttccatttttcgcagctgtcgaggtgctcgaaaaaagcctcttccaggagggcagccgagctttcttccccgcatgctacagcggggatgggaggttaaagtcttggggacttactcttcgctgtgctcttgttgtatttacactcttaatggctatttatgtgcctcactttgctttgcttatgggtctgactggaagcctcactggcgctggtttatgtttcctgttgccatccctattccacttgcgattactttggaggaagttgctttggcaccaagtcttttttgacgttgctatctttgtgattgggggcatttgttcagtttctggatttgtccactccttggagggtttgatcgaagcttataggactaatgctgaggactag

SEQ ID NO: 184290 - DNA, 426 bp, Artificial Sequence
  Description of Artificial Sequence: Synthetic coding sequence
atggcctggcccctgtgcaccctgctgctgctgctggccacccaggccgtggccctcgcttggagcccccaggaagaggatcgaatcatcgaaggagggatatatgacgctgacctgaatgacgagagggtgcagcgggccctccacttcgttatctccgaatataacaaggccaccgaggatgaatactacagacgtctgctgcgcgtccttcgcgccagggagcagatcgtcgggggcgtcaactacttttttgacattgaggtcgggcgcacgatttgcaccaaatcccagcccaatctcgacacatgtgccttccacgagcaacccgaactccagaagaagcaactgtgttcttttcaaatctacgaagtgccgtgggaggatcggatgtctttagttaacagtcgatgtcaggaagcctag

SEQ ID NO: 184291 - DNA, 426 bp, Artificial Sequence
  Description of Artificial Sequence: Synthetic coding sequence
atggcccagtacctgagcaccctgctgctgctgctggccaccctggccgtggcacttgcttggtcacctaaggaggaggatcgtattatccccggaggcatctataatgctgatctgaacgatgagtgggtccagcgtgcgctgcacttcgccatttctgagtacaataaggccactaaagacgattattataggcgaccccttcgggtgctgcgggcacgccagcagactgtgggcggggtgaattactttttcgacgtagaagtgggaagaacaatatgcaccaaaagccagccaaatctcgatacatgcgccttccatgagcagccagaactgcagaaaaagcaactatgcagctttgagatatacgaagtgccatgggaaaaccggcgctccctggtgaaatcgcgatgtcaggaatcctag

SEQ ID NO: 184292 - DNA, 426 bp, Artificial Sequence
  Description of Artificial Sequence: Synthetic coding sequence
atggcccagtacctgagcaccctgctgctgctgctggccaccctggcagtcgcactagcttggtcccctaaggaagaggatcgcatcattcctggaggcatttacaatgctgatctgaatgatgaatgggtacagagggcgctacacttcgctatctcagaatataacaaggccacaaaggacgattactaccggaggcctctaagagttttgagagcgagacaacagactgttggcggcgtgaattacttttttgacgtggaggtgggccgtactatttgtaccaagagccagcctaacttggacacgtgcgcatttcatgaacaacctgagcttcaaaagaagcagctgtgttcttttgagatttacgaagtgccgtgggaaaatcgcaggagccttgtcaagtctcggtgccaggaatcctag

SEQ ID NO: 184293 - DNA, 582 bp, Artificial Sequence
  Description of Artificial Sequence: Synthetic coding sequence
atgcccaactggggcggcggcaagaagtgcggcgtgtgccagaagacggtgtacttcgctgaggaagtgcagtgtgaaggtaactctttccacaagagctgtttcctgtgcatggtgtgcaaaaagaatctggacagtaccactgttgctgtgcacggcgaggagatttactgcaaatcttgttacggaaagaagtacggccccaagggatatggttatgggcagggtgctggcacattaagtacagataagggagaatcccttggcatcaagcatgaggaagcgcccgggcatcgtcccacaaccaatcctaacgccagcaagttcgcccagaaaatcggcggttccgagagatgtcccagatgctcacaggccgtttacgccgcagagaaagtcatcggcgctgggaagagctggcacaaggcctgcttcaggtgtgcaaagtgtggcaagggcttggagtccacaaccctggccgataaagatggcgaaatctattgtaaaggctgctatgccaagaactttggccccaaaggttttggattcggccagggtgctggggccctcgtgcacagcgagtag

SEQ ID NO: 184294 - DNA, 582 bp, Artificial Sequence
  Description of Artificial Sequence: Synthetic coding sequence
atgcccaactggggcggcggcaagaagtgcggcgtgtgccagaagactgtctactttgctgaggaagtccagtgcgagggaaattcctttcacaagtcttgctttctgtgtatggtatgcaagaaaaatcttgatagcacaacggtggctgtgcacggggaggagatttattgcaaaagctgctacgggaagaagtatggtccaaaaggatatggctacgggcagggggccggcactctaagcacggataagggggaatctttaggcatcaagcatgaggaagcgcctggccatcgcccgaccacaaaccccaatgcctccaaatttgcacagaaaatcggcgggtcagagcgatgccctcgctgctctcaggcagtctatgcagctgaaaaggtcatcggagcgggaaagtcctggcataaagcatgcttccgctgcgccaaatgcggaaaaggactggagagcacgaccttggctgacaaggatggggaaatttattgcaaagggtgctacgccaaaaacttcgggcctaaaggattcggtttcgggcagggagccggagccctggtacacagcgagtag

SEQ ID NO: 184295 - DNA, 582 bp, Artificial Sequence
  Description of Artificial Sequence: Synthetic coding sequence
atgcccaactggggcggcggcaagaagtgcggcgtgtgccagaagaccgtatactttgccgaagaggtgcaatgtgaaggtaacagtttccataagtcttgctttctgtgtatggtatgcaaaaagaacctggatagtaccaccgtggcggtgcacggagaagagatctattgcaaatcatgctacggcaagaagtacggaccaaagggctacggctacgggcagggagcgggtaccctgtccactgacaaaggtgagtctctcgggatcaaacatgaagaagctccgggccataggcccacgaccaaccccaacgcatcaaagttcgctcagaaaatcggagggtctgaaaggtgcccacggtgctcccaagcggtctatgctgctgaaaaagtgattggggccggaaaatcctggcataaagcatgcttccgatgtgctaaatgcgggaagggcctggagagcacgacactagctgacaaggacggggagatttattgcaagggatgctacgccaagaatttcggccccaagggctttggatttggtcaaggcgccggggcacttgtacactccgaatag

SEQ ID NO: 184296 - DNA, 582 bp, Artificial Sequence
  Description of Artificial Sequence: Synthetic coding sequence
atgcccaactggggcggcggcaagaagtgcggcgtgtgccagaagaccgtgtacttcgcagaagaggtgcagtgcgaaggaaatagctttcataaatcctgctttctgtgtatggtctgtaaaaagaaccttgatagtacaacagtggccgtgcacggggaggagatatactgcaagagctgttacggcaaaaagtatggcccgaaggggtacgggtacgggcagggcgcaggtactttgtcaactgataaaggcgaaagcctgggcatcaaacacgaggaggcccccggtcaccgacccaccactaaccctaacgcctccaaattcgcccagaagatcggggggtcagagaggtgtcccaggtgctctcaagcagtctatgcagccgaaaaagtgatcggggcaggtaaatcctggcacaaggcctgcttccgatgtgctaaatgtggaaaaggactcgagagtaccacccttgccgataaggacggtgagatttactgcaaaggctgctacgcgaaaaatttcgggccgaaggggttcggttttgggcagggagcaggggccctggtgcactcggaatag

SEQ ID NO: 184297 - DNA, 513 bp, Artificial Sequence
  Description of Artificial Sequence: Synthetic coding sequence
atgcccaactggggcggcggcaagaagtgcggcgtgtgccagaagacagtctatttcgctgaagaggtgcaatgcgagggcaattcatttcataaaagttgctttctgtgcatggtatgtaaaaagaatctcgacagtactaccgtggccgtgcacggggaagaaatctattgtaagagttgttacggcaaaaaatacggtcccaaagggtacggctatgggcagggggctgggacaaatcctaatgcaagcaaatttgcacagaagattggcggcagcgagcgctgtcctcgatgttctcaagcagtgtacgctgccgagaaggttattggcgccgggaaaagctggcacaaggcctgcttcagatgcgcaaagtgcggcaaagggctggaatccacaacgctcgcagacaaagacggagagatctactgtaaaggttgctatgcgaagaattttggcccaaaaggcttcggcttcgggcagggggccggcgcactggtgcacagcgaatag

SEQ ID NO: 184298 - DNA, 582 bp, Artificial Sequence
  Description of Artificial Sequence: Synthetic coding sequence
atgcccgtgtggggcggcggcaacaagtgcggcgcctgcggccggactgtttaccacgctgaagaggttcagtgcgatggacgatctttccacagatgctgtttcttgtgcatggtatgcagaaaaaacctcgattccacaacggtggccattcacgacgaggagatttattgcaaaagctgctacgggaaaaagtacggccctaagggatacggatatggccagggtgccggaaccctgaacatggatcggggcgagcggctcgggattaaaccggagtctgttcagccgcacaggcctacaactaatcccaataccagcaaatttgctcagaaatacggaggggccgagaagtgctcccgctgtggcgactccgtttatgcagcagagaagatcatcggggcaggtaaaccttggcacaagaattgcttccgttgtgctaagtgtggaaagtctctggaatctacaactcttacagagaaggaaggcgagatctattgcaagggatgttacgctaagaattttggtccaaaaggattcgggtatgggcagggggcaggcgctttggttcacgcccagtag

SEQ ID NO: 184299 - DNA, 582 bp, Artificial Sequence
  Description of Artificial Sequence: Synthetic coding sequence
atgcccgtgtggggcggcggcaacaagtgcggcgcctgcggccggacagtttaccacgctgaagaagttcaatgcgatgggcgctctttccatcgttgctgcttcctgtgtatggtctgcagaaagaatcttgattccacaaccgtcgccatccacgacgaagagatttactgcaagagttgttacggcaaaaagtacggccccaagggctacgggtacggacagggcgctggcacgttgaacatggatcggggcgaacgcttaggtattaagccagaatcggtgcagccccaccgccccacaactaaccccaatactagcaaatttgcacaaaagtatggcggcgcagagaaatgttcccgatgtggcgactcagtgtatgccgccgagaaaataatcggcgctggcaagccctggcataagaattgcttcagatgtgcaaagtgtggcaagtcacttgagtctactacacttacagaaaaggagggggagatttattgcaaaggttgttatgccaaaaactttggcccgaaaggcttcgggtacggccaaggggctggcgcactagtccatgcacagtag

SEQ ID NO: 184300 - DNA, 585 bp, Artificial Sequence
  Description of Artificial Sequence: Synthetic coding sequence
atgcccaactggggcggcggcgccaagtgcggcgcctgcgagaagacggtttaccacgccgaagagatacagtgtaatgggaggagcttccataagacttgctttcactgtatggcctgccgaaaggcactggacagcacaaccgtggctgcacacgaatcagagatctattgcaaggtgtgttacggtcgcaggtacggtccgaaaggcatcggctatggccagggagccggttgtctttcaacggatacaggtgaacacctgggtcttcagtttcagcagagtccaaaacccgcgagaagcgtgactacctctaatcctagcaagtttaccgcgaagtttggcgaatcggagaaatgccctagatgcggcaaaagcgtgtacgcagcggagaaggtaatgggggggggaaagccttggcacaaaacctgcttccgctgtgctatttgtggcaaaagtcttgagtctactaatgttacagataaggacggagaattatactgtaaagtgtgttatgccaaaaatttcggaccgactggcatcggatttggtggtttaactcagcaggtggagaaaaaagagtag

SEQ ID NO: 184301 - DNA, 585 bp, Artificial Sequence
  Description of Artificial Sequence: Synthetic coding sequence
atgcccaactggggcggcggcgccaagtgcggcgcctgcgagaagaccgtgtaccacgcggaggagatccaatgcaacgggagaagtttccacaaaacttgtttccactgcatggcctgccgaaaggccttggatagtaccactgtggctgctcatgaatctgagatctactgtaaggtatgctacgggagacgttacggaccaaagggtatcggctacggacagggagccggctgtttatccactgacaccggggagcatctgggactgcagtttcagcagtcaccgaaacctgcccgctctgtaacaacctctaatccaagtaagtttaccgccaagttcggcgagagcgaaaagtgccccaggtgcggaaagtctgtgtatgcggctgagaaggtaatggggggtggaaagccatggcataaaacttgtttcaggtgtgcaatttgtgggaagagtttggaaagcacaaatgttaccgacaaagacggcgagctctactgcaaagtgtgctacgctaagaatttcggtcctaccgggataggcttcggaggactgacccaacaagtggagaagaaagagtag

SEQ ID NO: 184302 - DNA, 1365 bp, Artificial Sequence
  Description of Artificial Sequence: Synthetic coding sequence
atgttcctggcccagcggagcctgtgcagcctgagcggccgggccaagttccttaagaccattagcagctccaaaatcctgggcttcagtacatcagctaaaatgagtcttaaatttactaacgcgaagaggattgagggcctagatagtaatgtctggattgaatttacgaagcttgctgcagatcccagcgtagtgaacctcgggcagggtttccccgacatttcacctcctacctacgtaaaggaagaactgtcaaagatagctgccatagacagtttgaatcaatatacacggggctttggtcatccatccctagtgaaagcccttagctacctctacgaaaaattataccaaaagcagattgactcaaataaagaaattcttgttaccgtcggcgcttacggttctctgtttaacaccatccaggcactgatcgacgagggcgacgaagtgattctgatagtaccattctacgactgttatgagcctatggtgagaatggctggggctacgcccgtattcatacccctgcgttccaaacctgtttacggcaaacgctggtcaagttccgactggacactggacccccaggaactcgaaagtaagttcaactccaaaaccaaggcgattatcttgaacacgccgcataatcctcttggcaaagtgtataatcgagaagagttgcaggtgatagctgacctgtgcatcaaatatgacactctgtgtatttccgatgaggtgtatgaatggctcgtctactctggtaacaaacacttgaaaatcgcaactttccccggcatgtgggagcgcaccattaccatcggttctgcagggaagaccttttctgttaccggttggaaacttgggtggtcaattggcccaaaccacttgattaagcatttgcaaacggttcaacagaacaccatatacacctgtgcaacaccacttcaggaagctttggcgcaggccttctggatcgatatcaagcgtatggacgaccccgagtgctatttcaactcactgcctaaggaactggaggtgaaaagggaccggatggtcagattgctggaatccgtgggactgaaacctattgtccccgacggaggatatttcatcattgcagacgtgtcactgttggacccggacttatcagatatgaagaacaatgagccctacgattataagttcgtgaagtggatgactaagcataagaaactcagtgccattcctgtatctgcattctgtaactccgaaactaagtctcagttcgagaaattcgtgaggttctgtttcatcaagaaggatagcaccctggatgccgcagaagagattatcaaagcgtggtcagtgcagaagtcttag

SEQ ID NO: 184303 - DNA, 504 bp, Artificial Sequence
  Description of Artificial Sequence: Synthetic coding sequence
atgttcctggcccagcggagcctgtgcagcctgagcggccgggccaaatttctcaagacaatctcatcaagcaagatcctgggcttcagtacttcagccaagatgtcactgaagttcacaaatgctaagcggatcgagggtctagactcaaatgtttggattgagtttaccaagcttgctgccgatcctagtgtcgtgaacttaggtcagggatttcccgacatctcacccccaacatatgtgaaggaagaattgagcaagatcgccgccatagatagcttgaaccagtataccaggggattcgggcacccatctttggttaaggccttgtcctacctgtacgaaaaattatatcagaaacagattgatagtaataaagagatccttgtgacagtgggcgcctacggttcactctttaataccatccaggccttgatagatgaaggggatgaatacaacgcatgtacagtgaagtttaccaatctcaaatgcaccgccggttag

SEQ ID NO: 184304 - DNA, 789 bp, Artificial Sequence
  Description of Artificial Sequence: Synthetic coding sequence
atgttcctggcccagcggagcctgtgcagcctgagcggccgggccaagttcctgaaaacaatctctagctccaagatccttggtttcagcacgagtgcaaagatgagccttaaattcacaaacgctaagaggattgaaggtcttgacagtaatgtctggattgaatttactaaacttgcagccgatccatctgttgtgaacctgggtcaggggtttccggacatctcaccacctacctacgtcaaagaagagctaagcaaaatcgcagccatcgattccctaaaccagtacactcgcgggtttgggcatccttctctagtgaaggccctgtcatatttatatgaaaagctgtatcagaaacagatagatagtaacaaggagattctggtcacagtcggagcgtatggcagtctattcaatactatacaggcacttattgatgagggcgacgaggtgattcttatcgtgccattttatgattgttacgagcccatggtgcgcatggctggtgcgacccctgtgtttatccccttgcggtccaagcccgtgtatggaaaacgctggtcaagcagtgactggacattagatcctcaggagctagaatctaagttcaatagcaaaactaaagcaattatactcaacaccccacataaccccctcgggaaggtgtacaatcgcgaggagctgcaggtgatcgctgacctgtgcattaaatatgacacgctctgtatctctgatgaagtgtacgagtggctcgtctactcgggaaacaagcatctaaaaatctag

SEQ ID NO: 184305 - DNA, 1263 bp, Artificial Sequence
  Description of Artificial Sequence: Synthetic coding sequence
atgagcctgaagttcaccaacgccaagcggatcgagggcctggactctaatgtgtggatagagttcacaaagctcgcagcggatccttctgttgtgaacttgggacaagggtttcccgacatctcaccccctacctacgtaaaggaagaactgagcaaaattgccgcgattgactctcttaatcaatacaccagaggtttcggccaccccagcctcgtgaaggcactttcttacttgtacgagaagctctatcaaaagcagatcgattcaaacaaggagatcctcgtgacggtaggggcatatgggtccctgtttaataccatccaggccctcattgacgagggtgacgaagtgattctgatcgtccctttctacgactgctatgagcccatggtgaggatggccggcgcaacgccagtctttattccactacgcagcaaacccgtttatggcaagaggtggtcctcctccgattggaccctcgacccacaagagctggagtctaagttcaattcaaagacaaaggcaattatcctcaacacacctcacaaccccctcggaaaagtgtacaatcgcgaggagctgcaggtcatagctgacctatgcatcaagtacgacacgctttgcattagcgacgaagtgtatgagtggctcgtgtacagcgggaataaacacctgaaaatagccacctttcccggcatgtgggagaggaccatcaccattggaagtgccggtaaaacctttagcgtgacaggctggaagctgggctggtcaatcggtccaaaccacctaattaagcacctgcagaccgtccaacagaacacaatctacacctgcgctacaccactgcaagaggccttggctcaggctttctggattgacataaaacggatggacgatccagagtgttacttcaattcattgcctaaagaactggaggttaaacgcgatcgcatggttcgacttctggaatcagtgggccttaaacctatagtccccgatggcggatactttatcatcgcagatgtcagtctactggatcccgatctgtctgacatgaagaataacgaaccctacgattacaagttcgtaaagtggatgaccaaacacaaaaaactctctgctatccccgtgtccgctttctgtaatagcgagacaaaatctcagtttgaaaaattcgtgcggttctgctttattaaaaaagactctacactcgatgccgccgaggagatcatcaaggcgtggtccgtgcagaaatcttag

SEQ ID NO: 184306 - DNA, 1269 bp, Artificial Sequence
  Description of Artificial Sequence: Synthetic coding sequence
atggccaagcagctgcaggcccggcggctggacggcatcgactacaacccctgggttgaattcgtgaagctcgcgagcgagcacgacgtggttaacttgggccagggcttccccgacttcccccctccagatttcgcggtggaagccttccagcacgctgtgagcggtgactttatgttaaatcagtacaccaaaaccttcggctatcccccactgaccaagattctggcaagcttttttggggaactattagggcaggagattgaccctctccgcaacgttctggttactgtgggcggctacggcgccctgttcactgcctttcaggccttggtggacgagggggacgaggtcattatcatcgagcctttctttgactgctatgagccaatgacaatgatggctggggggaggccagtctttgtatcattgaaacctggccctatccaaaacggcgaacttgggtcaagctctaattggcaactggaccccatggagcttgccggaaaatttacctctaggacaaaagccctggtactgaataccccaaacaatccgctgggtaaggttttcagtagggaggagctcgaactcgtagcgagcctctgccaacaacatgacgtggtttgtataacagatgaggtctatcagtggatggtgtatgacggacatcagcacatctcaattgcaagtctcccaggaatgtgggaaaggacactgaccattggctctgccggtaaaacattctccgcgaccggatggaaggtcgggtgggtccttggacccgatcatatcatgaagcacctcaggacagttcatcagaattcagtgttccattgccctactcagagccaggctgctgtagcggaatcttttgagagggaacagctgctcttcaggcagcctagtagctatttcgttcagttcccacaagctatgcagaggtgtcgggaccatatgattagatcacttcagagcgtagggttgaagcccatcatcccacaaggcagttattttctcataactgacatctccgacttcaagagaaaaatgccagacctgccaggcgccgtggacgaaccctacgatcggcggtttgtgaaatggatgattaaaaacaaaggactggtggccattcccgtgtctattttctattctgtgccccaccaaaaacatttcgaccattatattagattctgttttgtcaaagatgaagcaaccctgcaggccatggatgaaaaactgagaaaatggaaggtcgagctttag

SEQ ID NO: 184307 - DNA, 1119 bp, Artificial Sequence
  Description of Artificial Sequence: Synthetic coding sequence
atggccaagcagctgcaggcccggcggctggacggcatcgactacaacccctgggtcgagtttgtgaagcttgccagcgaacatgacgtggtgaatctcggccaggggtttccggatttcccccctcctgactttgctgtcgaggcctttcagcatgctgtaagcggagatttcatgctcaatcagtacacaaagaccttcgtgattatcattgagccctttttcgactgttacgaacccatgaccatgatggcaggtggaagacccgtgttcgtctccctgaaaccagggcctatacagaacggggaattaggctccagttcgaattggcaactggaccctatggagctggcagggaagtttaccagcagaaccaaagcactggttctgaatactccgaataaccctctcggtaaagtcttttcccgggaggagctggagttggttgcatccctgtgccagcagcacgacgtagtgtgcattacagatgaggtctaccagtggatggtctacgatggacaccaacacatcagtatagcttcactcccgggcatgtgggagaggactttgaccattggcagtgccggaaaaacgtttagcgccactgggtggaaagtgggctgggtgctgggcccagatcatattatgaaacatctgagaactgtgcatcagaattccgtcttccactgccctactcagagtcaggccgctgtggccgagagttttgaaagggagcaactcctgttcagacagcccagttcctacttcgtacaattcccacaggcaatgcagagatgcagggatcatatgatacgcagcctacagtctgtggggctgaagcccatcatccctcaagggtcctacttcctcattaccgatatttctgactttaagagaaaaatgccagacctgcctggcgccgtggatgagccctatgatcgcaggtttgtcaagtggatgataaaaaacaagggccttgttgctatcccggtcagcattttttacagtgtaccccatcaaaagcacttcgaccactatattcgcttttgctttgtcaaggatgaggcaacgttacaagccatggatgaaaagctccgcaagtggaaagtagaactgtag

SEQ ID NO: 184308 - DNA, 480 bp, Artificial Sequence
  Description of Artificial Sequence: Synthetic coding sequence
gccatggccaagcagctgcaggcccggcggctggacggcatcgactacaacccttgggtggagtttgtaaagctcgcgtctgaacacgatgtcgttaacctggggcaggggttccccgactttccacctccagattttgcagtcgaggcttttcaacacgctgtttcaggagatttcatgctgaaccagtacacgaagacatttgtatctctgtgttatcctggttggagtgctatggtccgttcctggagtactgcggcattaaccttgccggtatcctccggtccgcctacctcagcttccggcgttactgggactacgggctggagtcagtcctggctcgagtcctccttcttcgaccctaagaagaagaagattatttggggctaccctcctctgacaaagatactcgcgtctttctttggggaattgctggggcaagagatcgaccccttgcggaacgttcttgtgaccgtgtag

SEQ ID NO: 184309 - DNA, 555 bp, Artificial Sequence
  Description of Artificial Sequence: Synthetic coding sequence
atggccaagcagctgcaggcccggcggctggacggcatcgactacaatccttgggtggagttcgtaaagctcgccagcgaacatgatgttgtcaacctgggccaggggttccctgacttccccccgcctgatttcgctgtggaggcatttcagcatgctgtcagcggagattttatgctgaatcaatatactaagacattcggataccccccgctgactaaaattctggcaagcttcttcggcgagctgctggggcaggaaatcgatccacttagaaacgttcttgtaaccgtaggaggctacggcgctctgttcacggcttttcaggcccttgttgacgagggggacgaagtgataatcattgagcccttttttgactgctacgaacccatgactatgatggccggtggtcgccctgtgttcgtaagtttaaaacccggcccaattcagaatggcgagcttggctcatcctccaactggcagctcgatcccatggaattggcgggcaagttcacatctagaaccaaggctctggtgctaaatacacccaactag

SEQ ID NO: 184310 - DNA, 480 bp, Artificial Sequence
  Description of Artificial Sequence: Synthetic coding sequence
gccatggccaagcagctgcaggcccggcggctggacggcatcgactacaatccctgggtcgaattcgtcaagctggcgagtgagcatgacgtggtcaacctcggccagggctttccagactttccaccacccgattttgctgttgaggcctttcagcatgcagtgagtggggactttatgttgaaccagtacacaaaaacgtttgtctctctctgttatccagggtggagcgccatggtccgttcttggagcacagccgctctcacactcccagtaagcagtggacctcccacaagcgcatccggcgtcactggcaccaccgggtggtctcagtcttggctcgaatccagttttttcgaccccaaaaagaagaagatcatttggggctaccctcctctaactaagattctggcctcgttttttggtgagcttctcggccaggagattgacccactgcgcaacgtcttggtgacagtctag

SEQ ID NO: 184311 - DNA, 1551 bp, Artificial Sequence
  Description of Artificial Sequence: Synthetic coding sequence
atgttccggaccgccgccgccatcagcgtgcacctggtgggccccctccaaggccgtaaagctggggctcccctgacatggttcctgcaccagactcaggttgcggaaaagaatgtgggaagcccggcacccagacccacatctcacctaggcctagccaatccacaggaacgtaaggtcccacaggggccacagtccccatgtgaggtgcccgctgctgaggggatcctacggactgggggagcaaagctgcccatacagggccatcctgccaagcttgccatggcaaagcaactgcaggctaggagactcgacggaattgactataacccatgggtggaatttgtgaagcttgcctccgagcacgatgtggtcaacttagggcagggcttccctgactttcctccgcccgattttgcggttgaagctttccagcacgcggtgtccggcgacttcatgcttaatcagtacaccaagaccttcggctacccccctctgaccaagatactggcgtcctttttcggggagttgctaggacaggaaattgaccctctgcggaatgtgctggtcacggtgggcggctacggcgccctctttactgcctttcaggccctggttgatgaaggtgacgaggtcattatcattgaaccattctttgattgctacgagccaatgaccatgatggctggtggtaggcccgtgtttgtatcattaaaacctggtcccatccagaatggcgaattaggaagcagtagcaattggcaactcgaccctatggagttggcaggcaagttcacctcgagaacaaaggcactcgttctgaatacccctaacaacccgctgggcaaggtgttttcaagggaagaactagagctggttgcctctctttgccagcagcatgacgtggtctgtatcaccgacgaagtgtaccagtggatggtgtacgacggtcaccaacacattagcatcgcttccctgccagggatgtgggagagaaccctgaccatcgggtctgcgggtaagaccttcagtgcaactggatggaaagtcgggtgggtgctgggccctgaccacatcatgaagcatttaaggaccgttcaccaaaatagcgtgtttcactgtcctacccaaagccaggccgcggtggccgagagctttgaacgggaacaattgctgtttagacagccttctagctattttgtgcagtttccccaggctatgcaaaggtgtagggatcatatgatacgcagcttgcagagcgttgggctgaagcccattatcccacagggctcatattttctcattacagacattagcgactttaagaggaaaatgcccgacctgcccggggcagtggatgagccgtatgacagaaggtttgtcaaatggatgatcaaaaataagggcttggtcgctattcccgtctccattttctactctgtcccccaccagaagcactttgatcactacattcgattctgcttcgtgaaagacgaagccaccctgcaggctatggacgaaaagctgaggaagtggaaggtggaactgtag

SEQ ID NO: 184312 - DNA, 756 bp, Artificial Sequence
  Description of Artificial Sequence: Synthetic coding sequence
atggccaagcagctgcaggcccggcggctggacggcatcgactacaacccgtgggtggaattcgtgaaacttgcttcagagcacgatgttgtaaaccttgggcaggggtttcccgacttccccccgccagacttcgctgtagaggcttttcagcatgctgtttctggcgattttatgttgaaccagtacactaagaccttcggttacccaccccttacaaagatactggcttcattctttggggagctgctcggccaagagattgatcctctccgcaacgtgctagtgaccgtgggaggatatggagccctgttcacagctttccaggcccttgtcgacgagggcgatgaagtcattattattgagccatttttcgactgctacgaacctatgactatgatggccggcggaaggcctgtgtttgtatcattgaagcctgggccaatccaaaacggtgagctaggtagctcttcgaattggcaactggatcctatggaactggcggggaagttcacttcccgcactaaagccctggtcctaaacacacccaataatcctctcggtaaagttttcagtagagaggaactcgaactggtggccagcctgtgtcaacagcacgatgtggtttgcattaccgatgaggtctaccagtggatggtctatgatgggcaccagcatatctccatcgctagccttccgggaatgtgggaacgaacacttaccatcggcagtgctggtaagactttctctgcgtag

SEQ ID NO: 184313 - DNA, 603 bp, Artificial Sequence
  Description of Artificial Sequence: Synthetic coding sequence
atggagcagaccgaggtgctgaagccccggaccctggccgacctgattagaatcctacatcagctgttcgctggcgatgaggtgaacgtcgaagaggttcaggcaatcatggaagcctatgaatctgaccccaccgaatgggcaatgtacgctaagtttgatcaatacagatatactcggaatctcgtcgaccagggaaacggcaagtttaaccttatgattctctgctggggcgagggtcatggctcttctattcacgatcatacaaactctcactgctttttgaaaatgcttcagggaaatctaaaagagacgctgttcgcttggcccgacaagaagtcaaacgaaatggtcaagaagagcgagagagtgctgcgagagaatcaatgtgcctacatcaacgactctatcggattgcaccgggtcgaaaatatcagccacactgagccggccgtcagtctgcatctctattctccaccattcgatacttgtcacgcttttgatcagaggacagggcataagaacaaggtgacgatgacattccatagcaagtttgggatcaggactcccaacgcgacttctgggtccctagaaaataattag

SEQ ID NO: 184314 - DNA, 3111 bp, Artificial Sequence
  Description of Artificial Sequence: Synthetic coding sequence
atgtacctggtggccggcgaccggggcctggccggctgcggccacctgctggtctctcttctggggctgctgctgctgctggctagatctgggacgcgtgcacttgtgtgcttgccatgtgacgaaagtaaatgcgaagaaccccgcaactgcccaggctcaattgtgcagggtgtttgtgggtgctgctacacctgcgcctctcagcgcaacgaatcttgtggggggacatttggcatctacggaacttgtgaccgcggactccggtgcgttattcggcctccacttaatggggattccctcaccgagtatgaagccggcgtgtgtgaagacgagaattggacggacgatcagctgcttggctttaagccctgtaacgagaacctgatcgctggttgtaacattatcaatgggaagtgcgaatgcaatactattaggacctgctccaatcccttcgaatttccctcccaggacatgtgcctgagtgccctgaaaaggattgaagaagaaaagccagattgttccaaagcgcggtgtgaggttcagttttccccacggtgccctgaggacagcgttttgatcgaggggtatgctccaccaggagaatgctgtccacttccaagccgctgtgtgtgcaaccctgccggctgtcttaggaaggtttgtcagcctggaaatctgaatattctcgtaagtaaggctagtggaaagccaggggaatgctgtgacctgtatgaatgtaaacccgttttcggagtagactgtcggacagtggagtgccctcccgtccaacagaccgcctgtccaccagactcatatgagacccaagtgcgcttgacggctgatggctgttgcacactgcccacacgttgtgaatgccttagcggactttgcggctttccagtgtgtgaggtgggctcaacacctcgtatcgtctctagaggggatgggacgccgggaaaatgttgcgatgtattcgaatgcgtgaatgacaccaagccggcgtgtgtttttaataatgtcgagtattacgatggagacatgttccgtatggataattgcaggttttgccgatgtcaaggtggtgttgccatctgcttcaccgctcagtgtggagagattaactgcgagcgatattatgtgcctgagggggagtgttgccccgtgtgcgaagaccctgtttacccctttaataacccagcaggctgctacgccaacgggctgatccttgcccatggagatcgttggcgcgaggatgattgcaccttttgtcagtgtgtaaacggcgaacgacactgcgtcgcaaccgtatgcggccagacttgcacaaatccggtaaaagtcccaggggagtgttgccctgtctgtgaggagccgaccatcattacggttgacccacccgcgtgtggggagctgtctaactgcacgctgacaggtaaagactgtataaatggctttaaacgagatcacaacgggtgtagaacttgccagtgcattaatacagaagagctgtgttctgagagaaaacagggctgtactctgaattgcccattcggattcttgacggacgcccagaactgcgagatttgtgagtgccgccccagacctaagaagtgtagacccatcatttgcgataaatactgtccattggggctgttaaaaaataagcacggatgcgacatctgcagatgcaagaagtgtccagaactctcctgtagcaaaatttgccctctgggcttccagcaggacagccacggttgccttatctgcaagtgtagggaggcaagcgcctcagctggacctcccatcctctcaggcacttgcctcacggtggatggtcaccatcataagaatgaggaaagctggcatgacgggtgccgggagtgctattgcttgaatggacgggaaatgtgtgccctgattacatgccctgtgccagcctgcgggaacccaactatccatcctggtcaatgttgtccgagctgcgctgacgacttcgtcgtgcaaaagcctgagctcagtaccccaagcatatgtcacgctccggggggtgagtacttcgttgagggagagacctggaacatagatagctgcacacagtgcacatgccattcagggcgcgttctgtgcgagacagaagtctgtccgcccctcctgtgtcagaacccctccagaactcaagactcttgttgcccacagtgcactgatcagccctttagaccgagcctcagtcgaaacaatagtgtgcccaactattgtaaaaacgatgaaggcgatatctttttagctgcagagtcatggaaacccgacgtgtgcacctcatgtatatgcattgactccgtcattagctgcttttccgagtcttgtccctcagtgtcctgcgaaaggcctgttctgaggaagggacagtgttgtccctactgtattgaggataccattccaaagaaagtggtgtgccatttttccggaaaagcatacgctgatgaggaaagatgggatctggattcatgtactcattgttactgcctgcaggggcagaccctgtgctctactgtgagttgcccacccttgccatgtgtagaacctattaatgtggaaggttcatgttgccccatgtgccccgaaatgtatgtgcctgaacctactaacattcctattgaaaaaacaaaccataggggcgaggtagatctcgaggtccctctgtggccaactccttcggaaaacgacattgtgcacctgcctagggacatgggccatctgcaggtcgattatagggataatcggctgcaccccagcgaggatagttcattggactcaattgcatctgttgtcgtccccatcattatctgtctgagtataatcatcgccttcttgtttatcaaccagaagaagcagtggatcccactgctgtgctggtatcgcactcccactaagccgagtagcctgaataatcagctggtgagtgtggactgcaagaagggtaccagggtgcaggtcgattcctcacagcgtatgctacgcatagccgagccggatgccaggtttagcggcttctattctatgcagaagcagaaccacctgcaggccgataatttctatcaaaccgtctag

SEQ ID NO: 184315 - DNA, 498 bp, Artificial Sequence
  Description of Artificial Sequence: Synthetic coding sequence
atggccgacttcgacgagatctacgaggaggaggaggacgaggagagggctctggaggagcagctgctgaaatactctccggatcccgttgtcgtgcgaggctcaggccacgtgaccgtgtttggcctgtcaaacaaatttgagtcagagtttccttcaagcttgacaggtaaggtggcaccagaagaattcaaagcctccattaaccgggtcaactcatgcttgaagaagaacttacccgttaacgtccgctggctgttgtgtggatgtctttgctgttgttgcacactgggctgcagtatgtggcccgtgatttgcttgtccaaacgcactcggcgctccatcgaaaagctattggagtgggaaaataacaggttgtaccacaaactgtgcttacattggaggctcagcaagaggaagtgcgagaccaataacatgatggagtacgttatcctaatagagttcctgcccaaaacaccaattttcagacccgattag

SEQ ID NO: 184316 - DNA, 234 bp, Artificial Sequence
  Description of Artificial Sequence: Synthetic coding sequence
atgcccaagtgccccaagtgcaacaaggaggtgtacttcgccgagcgcgtcacctcactaggcaaagattggcatagaccttgtcttaagtgcgagaaatgtggcaagactctaacgtccggagggcacgctgagcacgagggcaagccgtactgcaaccatccatgttatgcagcaatgtttgggccaaaaggcttcggcagaggcggcgcagaaagtcatacttttaaatag

SEQ ID NO: 184317 - DNA, 234 bp, Artificial Sequence
  Description of Artificial Sequence: Synthetic coding sequence
atgcccaagtgccccaagtgcaacaaggaggtgtacttcgccgagagggtcacctcactgggaaaggattggcaccgcccgtgtttaaagtgtgagaaatgtggaaagacgctgaccagcgggggccatgcagagcatgaaggaaagccatactgtaatcacccctgttatgccgctatgtttggacccaaagggttcggccgcggcggtgctgagagtcatactttcaagtag

SEQ ID NO: 184318 - DNA, 234 bp, Artificial Sequence
  Description of Artificial Sequence: Synthetic coding sequence
atgcccaagtgccccaagtgcaacaaggaggtgtacttcgccgagagggtcacctctctgggcaaagattggcatcggccatgcttaaagtgcgagaaatgtggcaaaacactgacctcaggcggccacgccgagcatgaggggaagccatactgtaaccacccatgctacgccgcaatgtttggacccaagggcttcgggaggggcggcgcagaatcgcatacttttaaatag

SEQ ID NO: 184319 - DNA, 627 bp, Artificial Sequence
  Description of Artificial Sequence: Synthetic coding sequence
atggccagcaagtgccccaagtgcgacaagaccgtgtacttcgccgagaaagtgtccagtttgggaaaagactggcacaagttttgtctgaagtgcgaacgatgctccaaaactctgaccccgggggggcacgccgagcacgacggcaaacccttctgccataagccatgttacgctacactttttggacctaaaggcgtcaacattggcggagccggcagttatatatacgagaaacctctggcagagggcccgcaggtcaccgggcctatcgaggtaccggcggctcgtgccgaagaaagaaaagcctctggccctccaaaaggaccctccagagcctcttcggtgacaacctttacaggagagccgaacacttgcccacgctgctccaagaaagtgtatttcgcggagaaagtaacatcacttggcaaggattggcacagaccgtgcttacgctgcgagaggtgcggcaagactctgaccccaggtggccatgcggagcacgacggccaaccttattgccataagccttgttacggtatccttttcggcccgaagggcgtcaacactggcgccgtcggaagctacatttatgatagggatcctgaggggaaggttcagccatag

SEQ ID NO: 184320 - DNA, 849 bp, Artificial Sequence
  Description of Artificial Sequence: Synthetic coding sequence
atgcccccccaccacctgctgccctggctggcccaggtgcccagcgcagagggcgagctggtacggctcgtgtcccgggccggtgggagaggcgcctgtttttggcccgccgttacaatggagatggccgtggcagccggatgcgtttgtaagggcggtggatgctgtcacagggaacctagccaggaccatcatgagtcacaagaacataggggacccctggtagggagtcagacatgcctcgtacaccaggccgaagggaccgcggaaaaagtgtccagcctcggcaaggattggcataaattctgtttgaagtgcgagagatgttctaaaacccttactcccggtggccatgctgagcatgatggcaaaccattctgccacaagccctgctatgcaacactgttcggccctaaaggggtgaacatcggaggcgctgggtcatatatttacgaaaagcctcttgctgaggggccgcaggttaccggtccgatcgaagtgcccgccgccagagccgaggagaggaaggccagcggcccacctaaagggccttccagagctagcagcgtaaccacgttcacaggagagccaaacacgtgccctcgatgtagcaaaaaagtgtattttgctgaaaaggtcacctcactggggaaagattggcatagaccgtgcctgaggtgtgagcggtgcgggaagacccttacccccggtggtcacgcggaacatgacggccagccatactgccataagccctgctatggcatattgtttggccccaagggagtgaacacgggggccgtcgggtcttatatttacgaccgggaccccgaaggcaaagtgcaaccttag

SEQ ID NO: 184321 - DNA, 315 bp, Artificial Sequence
  Description of Artificial Sequence: Synthetic coding sequence
tgacccggcggcgagcgggccgagggcgccggccggcccggcgccccaactatggcatcaaagtgcccaaaatgcgacaaaaccgtatactttgccgaaaaggtcacctctcttggcaaagactggcatagaccatgtctccggtgcgaaagatgcggaaaaactcttacccctggtggccatgctgagcacgatggacaaccttattgccataagccctgctacgggattctgtttggtcctaagggggtaaatacgggcgctgtcgggtcttatatctatgacagggatccggaggggaaagtacaaccgtag

SEQ ID NO: 184322 - DNA, 537 bp, Artificial Sequence
  Description of Artificial Sequence: Synthetic coding sequence
atggagatcaagcacctgctgttcctggtggccgccgcctgcctgctgccaatgctgtctatgaaaaaaaaaagtgctcgggatcagttcaataaactggtcacagaccttcccaatgttcaggaggagatcgtgaacattcacaacgctctgcgaaggagggtagtgccacctgccagcaatatgcttaaaatgtcttggtcagaggaagccgctcagaacgctaggatattctctaaatactgcgacatgaccgaaagtaatcctctggaaagacgccttcctaacactttctgtggagagaatatgcacatgacctcttatcccgtgtcctggtccagcgtgataggggtgtggtacagcgagtcaacatcattcaagcacggtgaatggacaacaacagatgacgatattacgactgatcactacacgcagatcgtttgggctaccagttacttgattggctgtgctatcgcaagctgtcggcagcagggcagtcctagatatctgtatgtatgccactattgccatgattag

SEQ ID NO: 184323 - DNA, 750 bp, Artificial Sequence
  Description of Artificial Sequence: Synthetic coding sequence
atggagatcaagcacctgctgttcctggtggccgccgcctgcctgctccctatgctgtctatgaagaagaagtcggctagagatcagttcaacaaactggtcactgatctgccaaacgtgcaggaggagatcgtcaacatccataatgctctgcggcgccgtgtagttcccccagccagcaacatgctgaagatgtcctggtcagaagaggccgctcagaacgctcgcatcttcagcaaatactgcgatatgactgaaagtaatccccttgagcggaggctcccgaatactttctgtggggagaacatgcatatgacctcataccccgtgagctggtcaagcgtaattggagtgtggtactcagaatccacaagcttcaagcacggtgagtggaccaccacagacgatgacatcacaaccgatcactatacccagatagtctgggccacctcttacctcatcggatgcgcaatcgcatcctgcagacaacagggttcacctagatacctgtatgtgtgtcattactgccatgagggaaatgaccccgagaccaaaaatgagccatacaaaaccggtgtcccttgtgaagcctgcccttcaaattgcgaagacaaattgtgtactaatccttgtatctactatgacgagtactttgactgcgatattcaggtgcactacctaggctgcaaccattctaccactattctgttttgtaaggctacctgtctgtgcgatactgagatcaaatag

SEQ ID NO: 184324 - DNA, 750 bp, Artificial Sequence
  Description of Artificial Sequence: Synthetic coding sequence
atggagatcaagcacctgctgttcctggtggccgccgcctgcctgctcccaatgttgtctatgaagaagaaatccgctagagaccagttcaataagctggtaacggacctacccaacgtgcaagaggagatcgtgaatattcacaatgcgctccgcaggcgggtggtgccacccgcttcgaatatgctgaaaatgagctggagcgaagaggctgcccagaatgcacggatcttctccaaatactgcgatatgactgagtcaaatccgctggaaaggaggctaccgaacactttttgcggagagaatatgcatatgacatcgtaccctgtgtcctggtcatccgttatcggcgtgtggtatagcgagtcaactagttttaagcacggagaatggacaactaccgacgacgatatcaccacggatcactatacacagatcgtctgggccacaagctacctaatcggctgcgccattgccagctgcaggcagcagggatcccctaggtacctgtatgtgtgccactattgccacgagggcaacgaccctgaaacgaagaacgagccctacaaaacaggggtaccttgcgaggcctgccctagtaactgcgaggacaaactgtgcaccaatccctgtatctattatgacgagtacttcgattgcgatatccaggtccactatctgggctgcaatcactctacaaccattctgttttgtaaagcaacatgtctgtgcgatactgagataaagtag

SEQ ID NO: 184325 - DNA, 750 bp, Artificial Sequence
  Description of Artificial Sequence: Synthetic coding sequence
atggagatcaagcacctgctgttcctggtggccgccgcctgcctgctgccaatgctgtccatgaagaagaaatccgcacgtgatcagtttaataagttggtgaccgacctaccgaacgtccaggaagaaattgtgaatatccataacgctttgaggcggcgagttgttccacctgccagtaacatgctgaagatgagctggagtgaggaagccgcacagaacgctcggatcttctctaagtattgcgatatgactgaatctaaccctctggagagacggctgccaaacaccttttgcggagaaaacatgcatatgacctcctaccctgtgtcctggtcctctgtgattggcgtgtggtatagtgagtctacctctttcaagcacggcgaatggaccaccactgatgacgatataaccaccgaccactatacacagatagtgtgggccacctcatatttaattgggtgcgccatagccagctgcaggcaacagggaagcccaagatacctgtatgtgtgccattattgccatgaagggaatgatccagaaacaaagaatgagccatataaaactggagtgccatgcgaggcctgccctagcaattgcgaagacaaattatgtactaacccttgtatttattatgacgagtactttgactgtgatatccaagtgcactatctaggctgcaaccattccacaactattctgttttgcaaggccacctgtctttgcgatactgaaattaagtag

SEQ ID NO: 184326 - DNA, 537 bp, Artificial Sequence
  Description of Artificial Sequence: Synthetic coding sequence
atggagatcaagcacctgctgttcctggtggccgccgcctgcctgctccccatgctgtcgatgaaaaagaaatcagcccgggaccagttcaacaagctggttacggacctgcccaatgtccaggaggaaatcgtgaacatccataatgccttgcgcaggcgggtggtccccccagcttccaatatgctgaagatgtcttggtccgaagaggccgcccaaaatgccagaatcttctccaagtattgcgacatgactgagtcgaacccattagagaggaggctgcctaacacattttgtggcgaaaatatgcatatgacgtcataccctgtgtcctggagctcagtgattggagtatggtatagcgaatccacaagttttaagcatggcgagtggaccacgacagatgacgatattacaaccgaccattacacacagatagtatgggctacaagctaccttatagggtgtgcgatcgcgtcatgccgacagcaggggagtcctaggtatctctacgtgtgccactattgtcacgactag

SEQ ID NO: 184327 - DNA, 537 bp, Artificial Sequence
  Description of Artificial Sequence: Synthetic coding sequence
atggagatcaagcacctgctgttcctggtggccgccgcctgcctgctgcccatgttaagcatgaaaaagaagagtgctagagatcagtttaataagctcgtgactgatctgcccaacgtgcaagaagagatcgtgaacatccacaatgcgcttagacgtagggtggtgccccccgcttccaacatgctcaaaatgagttggagcgaagaggccgctcagaatgctcgaattttttcaaagtactgtgatatgacagaaagcaaccctctggaacgccgtttaccaaataccttctgcggcgaaaatatgcatatgacgtcatatcccgtcagctggtcctctgtgattggtgtgtggtacagtgagtcaacatcattcaaacacggagagtggaccactacggacgacgacattacaacagaccactatacccaaatagtttgggctacatcctatttaatcggatgtgcaattgcttcctgtcgtcaacagggctcacctaggtacttgtacgtctgccactattgccacgattag

SEQ ID NO: 184328 - DNA, 669 bp, Artificial Sequence
  Description of Artificial Sequence: Synthetic coding sequence
atggccggcaagcccaagctgcactacttcaacggccggggccggatggagccaatcaggtggttgctagccgcagctggggtggaattcgaggaaaagtttatcgggagcgcggaggacctaggcaagctcagaaatgatgggtctttgatgtttcagcaagtgcctatggtagagattgacggaatgaaactagttcagacccgtgccatactgaattacatcgcctccaagtacaatctgtacggcaaggacattaaggaaagggccctgatcgacatgtatactgaagggatggctgatctgaatgagatgatactcctcctgcccttgtgcaggcctgaggagaaagatgctaaaatagctttaatcaaggaaaagaccaagtctaggtattttccagcctttgaaaaggtcctgcagtcccatggacaggactacctggtgggcaacaaactctcgagagcagatatctccttagtggagctgctgtattatgtggaggaactggacagttcactcattagtaacttccccctgctcaaagcactaaagaccaggatttcaaatctccccaccgtcaaaaagttcctgcagcccgggagtccacgcaagccccctgctgacgcgaaggccctagaagaggccaggaaaatttttcgattttag

SEQ ID NO: 184329 - DNA, 732 bp, Artificial Sequence
  Description of Artificial Sequence: Synthetic coding sequence
atggccctgctgcccgtgctgttcctggtgaccgtgctgctgccctctttgcccgccgaggggaaagacccagccttcacggcccttctgaccacccagctgcaggtccaaagagagattgtgaataaacacaatgaattgcggaaggcggtgagcccacctgcgagtaatatgctgaagatggagtggtcaagggaggtcactaccaacgcgcagagatgggctaataagtgcaccctccaacactccgatccagaggaccggaagacatctaccagatgcggagaaaacctgtacatgagcagtgaccccacatcctggagcagtgccatccagtcatggtatgacgaaatactggatttcgtgtatggtgtcggaccaaaatcccctaacgccgtggtgggccattacactcagctggtttggtattctacctaccaggtcggttgtggaatagcctactgccccaatcaggatagcctcaaatactattatgtatgtcagtactgtccggccggcaacaatatgaaccggaagaataccccctatcaacagggcaccccttgtgcagggtgcccggacgattgtgataagggcctgtgtaccaattcatgtcagtaccaagacttactgtccaactgtgacagcctaaaaaacacagctggctgcgaacacgaactgttaaaggaaaaatgtaaagcgacatgcctgtgtgaaaataaaatatattag

SEQ ID NO: 184330 - DNA, 1494 bp, Artificial Sequence
  Description of Artificial Sequence: Synthetic coding sequence
atgagctgcgtgctgggcggcgtgatccccctgggcctgctgttcctggtgtgtggctctcaagggtatcttcttcctaacgtgacccttctggaagagcttttaagcaaatatcaacataacgaatctcattctagggtcaggagagccattccgagggaggataaagaagagattctaatgcttcacaacaaactgaggggtcaggtacaacctcaggcttctaacatggagtacatgacttgggacgacgaactggagaaaagtgccgcagcctgggctagccagtgtatctgggagcatgggccaacctcattgctggtgagcattggccagaatctcggggcccactgggggcgctaccgaagccccggctttcacgtgcagtcttggtacgacgaagtgaaggattatacatacccatatcccagtgagtgcaatccatggtgccctgaacgatgcagcggacccatgtgtactcattacactcagatcgtttgggctacaacaaacaagatagggtgcgccgttaacacttgtagaaaaatgacagtatggggcgaggtatgggagaatgcagtttattttgtgtgcaactacagtcctaaagggaactggatcggggaggccccatacaaaaatggccgaccatgtagtgagtgtccaccatcatacggcgggtcttgtaggaacaacttatgttacagagaggaaacgtacacccccaaacctgagacggacgagatgaacgaagttgaaacggcaccaattcccgaggagaaccacgtctggctgcagcctagagttatgcgcccaaccaaacccaagaagaccagtgctgtgaattacatgactcaagtggtacgctgtgacacaaaaatgaaagatcgatgtaaaggctccacatgcaacaggtatcagtgccccgcaggctgtctgaaccataaggcaaagatcttcggcactctattctatgagtcttcctcatcaatctgtagggctgccattcactatggtatcctggacgacaagggcgggctggtggatatcactaggaatggaaaagtcccattctttgtgaaaagcgagagacacggagtgcagtcactctctaaatataagcccagtagtagctttatggtgagcaaggttaaagtccaggacctggactgctataccactgtggcccagctgtgtccctttgagaaacctgctacccactgccctaggatccattgcccggcgcattgcaaagatgagcccagttattgggctcctgtatttggaaccaacatttacgccgatacaagtagcatatgcaagaccgccgtgcacgctggtgtcatttcaaacgagtccggtggagacgtcgacgtcatgcctgtggataaaaaaaagacatacgttggctctctacggaacggagtgcaaagcgagtcactcggaaccccgcgggacggtaaagcattccgcattttcgccgtcagacaatag

SEQ ID NO: 184331 - DNA, 1269 bp, Artificial Sequence
  Description of Artificial Sequence: Synthetic coding sequence
atggccccctggccccccaagggcctggtgcccgccatgctgtggggcctctcactgttcctgaatcttcccgggcccatttggctgcagcctagcccaccacctcagagtagcccaccgccccaaccccacccgtgtcacacatgccgggggttggttgattcctttaacaaaggcctggagcggaccatccgagataatttcggaggcggcaatacagcatgggaagaggagaacctatctaaatataaggactctgaaactcggctggttgaagttctggagggagtgtgctctaaaagcgactttgaatgtcaccgtctcctcgaactttccgaagaactggttgagagctggtggttccacaagcagcaagaagcccccgacctgtttcagtggctgtgcagtgacagcttgaagttgtgttgtcccgcgggcacattcgggccctcttgcctcccgtgtcctggcggtaccgaaagaccttgtggtggatatggccagtgtgagggagaaggcacgaggggaggttccggccattgtgactgtcaggccggctatggtggagaggcttgtggccagtgtggactaggctacttcgaggccgaacgcaacgcctcccacctcgtgtgcagcgcatgcttcggaccatgtgcccgatgcagtgggcccgaggaatccaattgcctgcaatgtaagaagggctgggccctgcatcacctgaagtgtgttgatatcgatgaatgcgggacggagggcgctaactgcggggctgaccagttctgcgttaacacagaggggtcctatgagtgcagggattgtgcaaaagcatgtctgggctgtatgggagcaggccctggacgttgcaaaaagtgcagtccagggtaccagcaggtgggatccaagtgtttagacgtggacgaatgcgagaccgaagtctgtccgggcgagaacaaacagtgcgaaaacaccgagggagggtaccgatgtatttgtgcggagggatataagcaaatggagggcatttgtgtgaaagaacagatccccggggcttttcccatcctgacagacctcaccccggagaccacgaggcgctggaagctgggatcccacccacacagtacctacgtgaagatgaagatgcagcgcgacgaggctaccttccctgggctgtatggaaagcaggtggcgaaacttggcagtcagtctaggcaatctgataggggcaccaggttgattcattcgcagcaggcttcaagtcagcgctag

SEQ ID NO: 184332 - DNA, 1263 bp, Artificial Sequence
  Description of Artificial Sequence: Synthetic coding sequence
atggccccctggccccccaagggcctggtgcccgccatgctgtggggtctgtcgcttttcttaaacttgcctgggcccatttggctccagccaagtccaccaccccagagctcccctccacctcaaccacacccctgtcatacctgcagaggcctcgttgatagcttcaacaagggactcgaaagaaccatccgggacaacttcgggggcggcaataccgcttgggaagaggagaatctgagtaaatataaagattctgaaaccaggttagtggaggttttagaaggagtgtgcagtaagtcagacttcgagtgtcaccgccttctggaactgagtgaggagctagttgagtcatggtggttccacaaacagcaggaggcccctgacttgtttcagtggctgtgctccgattccctcaagctgtgctgcccagcaggaacattcgggcccagctgcctaccctgccctggtggaactgagagaccttgtggaggatacggccagtgcgaaggtgaaggaacaaggggagggtccggccactgcgattgtcaagctgggtatggaggtgaagcgtgtggccaatgcgggctgggctactttgaagccgaacggaatgcgtcccacttggtctgcagtgcctgcttcggaccatgtgcgcgctgttcaggccccgaggaatcgaactgccttcagtgcaagaaggggtgggctttacaccatttgaaatgcgttgacatcgacgagtgcgggacagagggcgctaattgcggggcagaccagttctgcgtcaatacggagggctcttacgagtgccgggactgcgccaaggcctgcttgggttgtatgggcgctggccccggcaggtgcaagaagtgctctccagggtatcagcaagttggtagcaaatgtctcgatgtcgacgagtgcgagactgaagtgtgtccgggagaaaacaaacagtgtgaaaacacagagggcggttatagatgtatttgtgccgaggggtataaacagatggaaggtatatgtgtcaaggaacagattcctgagtcggccgggtttttttcagaaatgacagaggatgaactggtggttctccagcaaatgttttttggaattatcatatgcgcccttgctaccctcgctgccaagggagatctcgtctttaccgcaatctttatcggcgctgtggccgcaatgacgggctactggctctccgagagaagcgacagggtgctggagggattcataaaggggaggtag

SEQ ID NO: 184333 - DNA, 1263 bp, Artificial Sequence
  Description of Artificial Sequence: Synthetic coding sequence
atggccccctggccccccaagggcctggtgcccgccatgctgtggggacttagtcttttcctgaacctgcccggccctatttggctccagcccagcccacctcctcagtcttctcctccccctcagccccatccatgtcacacatgtcggggtctagtggactctttcaataaggggttagaaaggacaatcagggacaacttcggcgggggcaataccgcgtgggaagaggagaacctctcaaaatacaaggattctgagacgagactcgtggaagtcctggagggagtgtgctcgaagagcgacttcgaatgccaccggctgctggagctgtcagaagagcttgtggagtcctggtggttccataagcagcaggaagctcctgatctgtttcaatggctctgcagtgattcactaaagctgtgctgtccagcagggacttttggcccttcttgcttgccttgccctggcggcacagagaggccttgtggggggtacgggcagtgcgagggggagggcactcggggcggaagcggacactgcgattgccaggctgggtatggaggcgaggcgtgtggacagtgtgggctcggctattttgaagctgagcgcaatgcatctcacttagtatgctccgcttgttttgggccctgcgcaaggtgtagtgggcctgaggagagcaattgcctgcagtgtaagaaggggtgggcactccaccacctgaaatgcgttgacatcgatgagtgcggaaccgaaggagcgaactgtggtgcagaccagttttgcgtgaacaccgagggtagttacgagtgtagagactgcgcgaaagcctgcttgggatgcatgggagcgggccctggtagatgtaagaaatgctctcctggatatcagcaggtcggctcaaaatgcctagacgtcgacgaatgcgagacagaagtctgcccaggagagaacaaacaatgcgagaacacagagggcggctaccgatgtatctgcgctgagggatacaagcagatggaaggcatctgtgtcaaagaacagatccctgagtccgcaggcttcttctctgaaatgacagaggacgaattggtagtcctgcaacagatgtttttcggcatcatcatctgtgccctcgccaccttggctgctaagggggacctggtgttcactgccatcttcattggtgctgtagcagcaatgaccggatactggctgagtgagcgctccgatcgagtgttggagggattcatcaagggccgatag

SEQ ID NO: 184334 - DNA, 1263 bp, Artificial Sequence
  Description of Artificial Sequence: Synthetic coding sequence
atggccccctggccccccaagggcctggtgcccgccatgctgtggggtctgtcattgttcctgaatcttcctggaccaatatggctgcagccctccccaccgcctcagtcaagccccccaccccaaccacacccctgtcatacctgtcgcgggttggttgactccttcaataaaggtctcgagcggaccattcgagataatttcggtgggggcaacactgcatgggaggaggagaacctgtccaagtataaggattccgagacacggctggtggaggtgctggagggggtctgcagtaaaagcgattttgaatgccatcgtttgctcgagctatccgaggaattggtggaatcttggtggtttcataaacaacaggaggctcctgacctgtttcagtggctttgttccgatagcctcaaactgtgctgccccgcaggtaccttcggcccgtcctgtctaccatgtccaggagggactgaacgaccttgtgggggctacggccagtgtgagggagaggggacgagaggaggctctggccactgcgactgccaggcggggtacggaggggaagcatgcggacagtgtggattagggtactttgaggctgagagaaacgcctcgcacttagtgtgtagtgcttgttttgggccttgcgcgaggtgttctggccccgaggagagcaattgtctccaatgtaagaaggggtgggcgcttcaccatttgaagtgcgtcgacattgatgaatgtggcactgagggggcaaattgtggagcggatcagttctgcgtgaatacagaaggcagctacgaatgccgggattgcgccaaggcttgcctggggtgcatgggggccgggccgggtcgctgcaagaagtgtagccctggttatcaacaggtaggctccaagtgcctcgatgtcgatgaatgtgaaacggaggtctgccccggtgaaaataagcagtgcgagaacaccgaaggaggctaccgctgcatttgtgcggagggctataaacagatggaaggtatctgcgtcaaggagcaaattcctgaatcagctgggttcttttcggaaatgacagaagacgagcttgtcgtgctgcagcagatgtttttcggcataataatctgcgcactcgccactttagcagccaaaggggatctggttttcacggccatcttcattggtgccgtggccgctatgaccggctactggctgagcgaaagatccgacagagttctcgaaggctttatcaagggccggtag

SEQ ID NO: 184335 - DNA, 1140 bp, Artificial Sequence
  Description of Artificial Sequence: Synthetic coding sequence
atgagcagccggatcgcccgggccctggccctggtggtgaccctgctccatctaaccaggcttgccctgagcacctgtcccgccgcatgccactgccccctggaggcccccaagtgtgcccctggcgtgggcctagtgcgggatggttgcgggtgctgtaaagtgtgcgccaagcaactgaacgaggactgttctaagacgcaaccctgcgaccacacaaaagggttggagtgcaattttggagcaagtagcaccgcactcaagggcatctgccgagcacaatcggagggcagaccttgtgagtacaatagtagaatctaccagaatggcgaatcttttcagccgaattgcaagcatcaatgcacatgcatagacggggccgtgggttgtataccactgtgtccgcaggaactgtccttgccaaaccttgggtgtcccaaccctaggcttgtgaaagtgaccggccagtgttgtgaggagtgggtgtgtgacgaggactctataaaggatcccatggaggaccaggacggcctgttgggtaaggagctaggcttcgatgcctctgaggtcgagttaactcgtaataatgaactgatcgctgtgggcaaggggtcgtcacttaagaggctaccagtcttcggcatggagccacgaattctctacaaccccctacagggccagaaatgcatcgtgcagaccacgagctggtcccagtgttcaaaaacttgcgggacagggattagcacgagggtgaccaacgataaccccgagtgtcgccttgtaaaagagacgcggatttgtgaagtgcgtccgtgtggccagcccgtatattcaagcctgaaaaagggtaaaaagtgctcgaaaacaaagaaatcaccggagccagtacggtttacatatgccggatgcttgagtgtcaaaaaatataggccaaagtactgtggctcctgcgttgacggacgatgttgcactcctcagctgacaagatgcgaggatgccgtacccctgcggcgttggggggacatttttcaggagagacatgatgacccagtgaagtgtaattacaattgtcctcatgccaacgaggccgctttccccttctatagactctttaacgacatccacaaatttcgcgactag

SEQ ID NO: 184336 - DNA, 1146 bp, Artificial Sequence
  Description of Artificial Sequence: Synthetic coding sequence
atgagcagccggatcgcccgggccctggccctggtggtgaccctgctgcatctgactcggctggccttgagcacctgccccgcagcctgccactgtcccctagaggcccctaagtgcgcccccggggtcggactcgtcagggacggctgtggttgttgtaaagtctgtgctaagcagcttaatgaggactgttccaagactcaaccatgtgatcacacaaaggggcttgagtgcaattttggagcctcctccactgccctgaagggcatttgtcgcgcccagagcgaaggaagaccttgcgaatacaactccaggatatatcaaaacggcgagtccttccaaccgaattgcaagcatcagtgcacctgcattgatggggccgttggctgtatacccctgtgccctcaggagctaagtctccccaacctaggctgcccaaatccaagattggttaaggttactggccagtgttgcgaagaatgggtgtgtgacgaggactctatcaaggatcctatggaagaccaggatggtctgttgggtaaggaattaggttttgatgcctcagaagttgagctgactcgtaacaacgagctcattgcagtaggaaagggttcttcccttaaaagactaccagtctttggaatggaacccagaatcctatacaatccacttcagggccagaaatgcatcgtgcagaccacttcttggagtcaatgttccaaaacctgcggcaccggaatttcgactagagtcaccaatgataatccagagtgtcgcctagtcaaggaaacaaggatatgcgaggtgaggccctgtgggcagcccgtgtacagctccttgaagaaggggaagaagtgcagtaagaccaaaaaatccccagaaccggtccgctttacatatgcaggctgcctctccgtcaaaaagtaccgtcctaagtactgcggctcctgcgtcgacggccggtgctgcacaccccaactcacccgtaccgtgaaaatgaggttcaggtgcgaagacggagaaaccttttcaaagaatgttatgatgatccagagttgcaaatgcaactacaattgtccacacgccaacgaagccgccttccctttttatagactcttcaacgatatccacaagtttagggattag

SEQ ID NO: 184337 - DNA, 1074 bp, Artificial Sequence
  Description of Artificial Sequence: Synthetic coding sequence
atgagcagccggatcgcccgggccctggccctggtggtgaccctgctacacctgactcgactggccttgtccacgtgcggttgctgcaaggtatgcgccaagcagcttaatgaagactgcagcaagacacagccctgcgaccataccaaaggcctcgagtgtaatttcggcgccagttctactgccctgaagggaatttgtagagcacaaagcgagggccgtccatgcgagtataatagccgaatttaccagaatggcgaatctttccaacctaactgtaagcaccaatgtacctgtatcgatggggccgtgggatgtatacctctttgcccccaggaactgtctcttccgaaccttggctgccctaacccccgcctggtgaaggtaacaggtcagtgctgcgaggagtgggtctgcgatgaagacagtattaaggaccccatggaagatcaagacgggctgctgggaaaggagctagggttcgacgccagcgaggttgaattgaccagaaacaatgaactgatcgccgtggggaaaggtagtagcttaaaaagactgcctgttttcggcatggaaccaagaattctgtacaatccactgcagggacagaagtgtatagtgcagacaacctcctggtctcaatgttccaagacttgcggtaccggaatctctacacgggttacaaacgataatcccgagtgccggctggtgaaagagacaagaatttgtgaagtgcggccatgcggacagccagtgtactccagtctgaagaaaggcaagaagtgctcgaaaacaaagaagtctcctgagccagtcagattcacctacgccggatgcctttctgtcaaaaaataccgtcccaagtactgcggaagctgcgttgatgggagatgctgcaccccacagttgaccaggactgtgaagatgagattccgatgcgaggatggggaaactttctcaaagaacgtgatgatgatccagtcctgtaagtgtaattataattgcccacacgccaacgaagcagccttcccattttatcgcctgttcaatgatattcacaagtttagggactag

SEQ ID NO: 184338 - DNA, 1014 bp, Artificial Sequence
  Description of Artificial Sequence: Synthetic coding sequence
atggacgagaccggcaacctgaccgtgagcagcgccacctgccacgatacaatcgatgacttccggaatcaggtctatagcacgctctacagtatgatctcagtcgtgggtttctttgggaacggttttgtgctgtacgtgctgattaagacgtaccacaaaaagtccgcttttcaggtttacatgatcaacctcgctgtcgcggacctactgtgtgtgtgtaccctccccctgagagtggtgtactatgtgcataagggcatctggctatttggtgattttctgtgtcgcctgtccacctatgctttgtacgtcaatctctactgttctattttcttcatgacggctatgtcatttttccgctgcatcgcaattgtattccctgtgcagaacataaatctcgtgacccagaaaaaggctaggttcgtctgcgttggtatctggatcttcgtcatcctcacatcttcaccttttctgatggccaagccacagaaagatgaaaagaataataccaaatgttttgagccgccacaagacaaccaaacgaagaaccacgtgttggtgttgcactacgtctccttgttcgtgggcttcattatcccttttgtgattatcatagtgtgctatactatgataatcttaacccttttaaaaaagtctatgaaaaaaaatttaagctcacataaaaaggccattggaatgatcatggtagtaacggctgcctttcttgtgtccttcatgccctaccacattcagcggacaatacacctgcactttttgcacaacgagacgaaaccgtgcgattcagttctccgaatgcagaagagcgttgtgatcacgttgagtttggccgcaagcaactgttgtttcgatcctttactgtactttttctctgggggcaatttcaggaaaagactgtccacttttagaaaacatagcctgagctccgtgacttacgttccgcgcaagaaagccagtctgccagaaaagggcgaagaaatctgcaaggtgtag

SEQ ID NO: 184339 - DNA, 1041 bp, Artificial Sequence
  Description of Artificial Sequence: Synthetic coding sequence
atggagcggaagttcatgagcctgcagcccagcatcagcgtgagcgagatggaacctaatggcaccttctcaaacaacaacagccgcaattgcactattgagaactttaagcgtgaattttttcccattgtctatttaattatctttttctggggggtgctggggaatggcctctcaatctacgtatttctgcaaccgtacaaaaagtctaccagtgtcaacgtctttatgttgaatctagcgatcagtgatcttctatttatttccacgctgccatttagagctgattattatctacgggggtctaactggatcttcggtgatctagcatgtcgaattatgtcttactctctatatgtgaacatgtacagcagtatctacttccttacagttttgtccgtggtaaggttcctggccatggtgcacccttttagattgcttcatgtgacttctatccgcagtgcctggatcctctgcggcatcatttggattctgattatggcaagttccatcatgcttttggactccggcagtgagcagaacgggagcgtgaccagttgtttagagctaaacctgtataaaattgcaaaactgcaaactatgaattatatagccttagttgtcggatgccttttgcccttcttcaccctctcaatatgttatctgttgatcattagggtacttttgaaggtggaggtgccagagtccggactgcgcgtaagccaccgaaaggccttgacaactattattatcactctgattatcttctttctgtgctttctgccttatcatacgctcaggaccgtgcatctaacgacatggaaagttggactgtgcaaggacaggcttcacaaggccctcgtgattaccctggccctggcagccgcaaacgcttgctttaaccctctgttgtactatttcgccggcgaaaacttcaaagatcggctgaaaagcgccctgagaaagggtcatccgcagaaggccaagaccaagtgtgtgttccctgttagtgtctggctgagaaaagaaactagagtgtag

SEQ ID NO: 184340 - DNA, 2181 bp, Artificial Sequence
  Description of Artificial Sequence: Synthetic coding sequence
atggccgacagcagcggccagcagggcaagggccggcgggtgcagccccaatggtcacctccagcaggtacacagccatgccgacttcacctgtacaactctctgacaaggaataaggaagtgttcatcccacaagacggcaaaaaggttacctggtactgctgcggcccaacggtttatgacgcttctcacatggggcatgcccggagctacatttcttttgatatcctcagacgcgtgctaaaggactatttcaagttcgatgtgttctactgcatgaatataaccgacatcgacgataagattattaagagggccagacagaatcatctgtttgaacagtaccgggaaaagcgtccggaagccgcccaattactcgaagatgtgcaagccgcacttaagcccttcagtgtaaaactcaacgagacgaccgaccccgacaaaaagcagatgctggaaaggatccaacatgctgtgcaacttgctaccgagccccttgaaaaagcagtccagtcccgcctgactggtgaagaggttaacagttgtgtggaagtgctcctggaggaagctaaggacctcctgtcggattggctggatagtaccttgggctgcgatgtgacggacaactctatctttagcaagttgccaaagttctgggaaggagatttccatcgtgacatggaggcactcaacgtgctgccacccgatgtgcttactcgcgtatccgagtacgtgcctgaaattgtaaatttcgtgcagaaaatcgtggataatgggtatggctacgtgagtaatggttctgtttactttgacacagcaaaattcgcttctagcgagaagcattcatatggcaaactggtgcccgaagcagtaggggaccagaaagcattgcaggagggtgaaggggacctgtcaatctctgcagatcggctttcagagaagcgctctcctaacgacttcgctctctggaaagcaagcaagccgggtgagcccagttggccctgtccctgggggaagggacgccccggctggcacatcgagtgtagtgcaatggccgggaccctactgggggcttcaatggatattcatggcggagggttcgatttgcgttttcctcatcacgataacgagctcgcccagagtgaagcatatttcgagaacgattgctgggtgagatattttctccatacagggcacttaacgatcgctggatgtaagatgtctaagtctcttaagaactttattacaattaaggacgcccttaagaaacactctgctcggcaactgcgactcgcttttttgatgcactcttggaaggacacattggactactctagcaacactatggagtcagccctccagtatgaaaagtttctgaacgagttctttctaaacgtgaaggatatccttcgcgctccagtggatatcaccggccagttcgagaaatggggagaagaggaagccgagcttaataagaacttttatgataagaagacagcaatacacaaggctctctgcgacaacgtagatactcggacagttatggaagaaatgcgagctctcgtgtctcagtgtaatctctatatggcggctcggaaagctgtccgcaagaggcccaaccaggctcttctggaaaatattgcgctgtacctgactcatatgcttaaaattttcggtgcagtagaggaagacagcagcctcgggttccccgtgggaggccccgggacctctttgtctcttgaggctaccgtgatgccatatctgcaggtactaagcgaatttagggagggggtgaggaaaatcgcaagggaacaaaaggttccggagattctgcaactgtctgacgctttgagggacaacattttgccggagctgggagtgcgtttcgaagaccacgaaggccttccaaccgtggtaaagctggtggaccgaaatacattactgaaagaacgcgaggaaaaaaggcgcgttgaagaggagaagcgcaaaaagaaagaagaggctgccaggcggaagcaggaacaggaagccgccaaactcgccaaaatgaaaatccctccatctgagatgttcctgtctgagacagataaatactccaaatttgatgagaatgtatcaatggtgtgtcctcacatgacttggcgcgccaagtcttccgccaagggcaaacctagaagttag

SEQ ID NO: 184341 - DNA, 2496 bp, Artificial Sequence
  Description of Artificial Sequence: Synthetic coding sequence
atggccgacagcagcggccagcaggcccccgactaccggagcatcctctccatttcagatgaggccgcacgagcgcaggccctgaatgagcacctgagtacacgctcctacgtccaaggatattccctgtcacaggccgatgtggacgctttccgacagttgagcgctcctccagctgacccgcagttattccatgtggcccgctggttcagacacatcgaggctctgctggggtctccgtgcgggaaaggacaaccatgccgactacaggcctcaaaagggcgcagggttcaaccacaatggagccccccagccggcacacagccatgtcgcctccatctgtataattcactgacgcggaacaaggaggtgtttatcccccaagatggcaaaaaggtgacgtggtactgctgcggtccaactgtttatgacgcttctcatatgggccacgccaggagctatattagttttgatattctgcgcagagtgctaaaggattactttaaatttgacgtgttttactgtatgaacatcaccgacattgatgacaagatcataaaaagagctagacaaaatcacctgttcgagcaatatcgagaaaagaggcctgaggctgctcagctgttggaagatgtacaggctgccctgaagcctttctccgtcaaactgaatgagactactgacccagacaaaaaacagatgctcgagaggatccagcatgccgtacagctggcgacggagcccctggagaaagccgttcagtcaaggttgaccggggaagaggtaaactcttgcgttgaagttctgctcgaagaggccaaggaccttttgagtgattggttggactctacgctgggatgtgacgtaacggacaactcaatattctccaagctgccaaaattttgggaaggggattttcatcgagacatggaggccctgaatgtcctaccaccagacgtgctgactagagtttccgagtatgtgcctgagatcgtgaactttgtccagaagatagtggacaacgggtatggctatgtgagcaacggatcagtgtatttcgatactgcaaagttcgcatcttcagagaagcattcatacggtaagttggtgccagaggcagtcggagaccagaaggcgctccaggaaggcgagggagatctctccattagtgccgatcgcctaagtgaaaaacggtctccaaatgactttgccttatggaaagcttcaaagcctggcgagcccagttggccttgcccttggggtaagggacggcccggctggcacatcgaatgtagcgcgatggcaggcaccttgcttggcgcaagcatggacatccatggaggagggttcgatctccggtttcctcaccacgacaacgagctcgcccagtctgaggcctactttgagaacgactgctgggtaaggtattttcttcatactgggcacttgacaattgctggttgtaagatgtcaaaatccctcaaaaactttatcacaattaaggatgccctgaaaaaacactcagctcgacagctgagactcgccttccttatgcattcctggaaagacactctggattattcctccaacacaatggagtctgcactgcagtatgagaagtttctcaacgaattcttcctgaatgtcaaagatattctgagggcccccgtggacatcaccggacaatttgagaaatggggtgaggaggaagcggagttgaacaaaaatttctatgataagaagaccgccatccataaagcgctgtgtgataacgtcgacacacggacagttatggaggaaatgcgagctttggtctcccagtgcaacttgtacatggcagcacggaaggccgtgcgcaaacggcctaaccaggctctgcttgaaaacatagctctgtaccttacccacatgctaaagatcttcggagctgtcgaagaagattcttccctcggcttccccgtgggagggccagggaccagcctcagcctggaagccactgtgatgccatacctgcaggttctctccgagtttcgggagggtgtgagaaagatcgctcgagagcagaaggtgccagagattcttcagctgagtgacgctcttcgggataacattctgcctgagctcggcgtgagattcgaagatcacgagggtctgccaaccgtggtgaaattggtagaccggaacactctattgaaagaaagggaggagaagcgtcgcgttgaggaggagaagcggaaaaagaaagaagaagccgctaggagaaagcaggagcaagaggcagccaagctcgccaaaatgaaaattccccctagcgagatgttcttgtcagagacagataagtactccaagttcgatgaaaatggacttccgactcatgatatggaaggaaaggagctgtccaagggccaggctaaaaagctcaagaagctgttcgaggcccaagagaaactgtacaaagagtatcttcagatggcccagaatggcagttttcagtag

SEQ ID NO: 184342 - DNA, 2247 bp, Artificial Sequence
  Description of Artificial Sequence: Synthetic coding sequence
atggccgacagcagcggccagcagggcaagggccggcgggtgcagccccaatggtcccctccagccggcactcagccctgcaggctccacctctacaactcgctgactagaaataaggaggtgtttatccctcaggatggcaagaaagtgacctggtattgctgcgggccaactgtatatgacgcgagccacatggggcatgcccggagctacatttcctttgatattttgaggagagtgctcaaggactacttcaagtttgatgtgttttactgcatgaatattacagacatcgacgataaaatcataaaaagggccagacagaatcatctctttgaacagtacagggaaaagcggcccgaggccgcacaactgttggaagacgtacaggccgctctgaagcccttcagcgtgaagctaaacgaaacgactgacccagataagaagcagatgctggaacggatccagcacgccgtgcagctggctacagagcccctggaaaaggctgtccagtcccgccttaccggggaggaggtgaacagttgcgtagaagtactactcgaggaagcaaaagatctgctctccgattggttagactcaactttgggctgtgatgtcactgataatagcattttttctaaactgcccaaattttgggagggggacttccatagggatatggaggcgctaaacgttctgcctcccgacgtgctcacaagagtcagcgagtatgtgccagaaatcgtgaacttcgtccagaaaatcgtcgacaacgggtatgggtatgtcagtaacggctcagtgtacttcgacactgctaagttcgcgagcagtgagaagcactcttatggcaaactggtccctgaagccgtcggcgaccagaaggcgttgcaggagggcgagggcgatctgtcgataagcgcagatcgcctgagtgaaaagaggtcaccaaacgattttgctctgtggaaagcctctaaacccggtgagcccagctggccatgtccttgggggaaaggtcggccaggctggcatattgagtgtagtgccatggcagggaccttactcggtgccagtatggacatccacggtggtggcttcgatcttaggttccctcatcacgacaatgagttggcgcaaagcgaggcctacttcgaaaacgattgttgggttagatattttctccacaccggccatctaacaatagctggctgtaagatgtccaagagtctgaaaaacttcattaccattaaggacgctcttaagaaacatagtgctagacagctgcgactggcctttctgatgcattcctggaaggacacacttgactattccagcaacacaatggagtcagctttgcagtacgagaagttcctgaatgaattttttctgaatgtcaaggacatcctgcgagcccccgtcgacattacaggacagttcgaaaaatggggtgaggaagaggctgaattaaacaagaacttttatgacaagaaaacagctatccacaaagctctgtgtgacaacgtagacacaagaactgtcatggaggagatgagggccctcgtgagccaatgtaatttgtacatggcggctaggaaggctgtgcgcaagaggcccaaccaggctctgctggagaacattgccctctatctaacccatatgctcaagattttcggcgctgtggaggaggactcgagtctgggttttcctgtgggggggccagggaccagcctctccctcgaggctactgtgatgccgtatctgcaggttttatccgagttccgtgagggggtgagaaagattgcccgagaacagaaggtacctgaaatcttgcagctaagcgatgcactgcgcgacaatatactgcccgagctcggcgtaagattcgaggatcacgaggggctaccaactgtggtcaaacttgtcgaccgcaacacactgcttaaggaaagggaggagaagcgacgagtcgaagaggaaaaaagaaagaaaaaggaagaggccgctcggaggaagcaggagcaggaggcggctaagttagccaagatgaaaatcccgccctccgaaatgtttttaagtgagaccgacaaatacagcaaatttgatgagaacggcctgccgacacatgatatggaggggaaagaactctctaagggccaggcaaagaagttaaaaaagctcttcgaggcacaggaaaagctttacaaggaatacctgcagatggctcagaatggaagtttccagtag

SEQ ID NO: 184343 - DNA, 2217 bp, Artificial Sequence
  Description of Artificial Sequence: Synthetic coding sequence
atgcagaccccccccctgcagcagccccaccaggagcaggtgttcctggcttttctcgtcatcgtgatcccatcctttttaaccaaagaggtctttatcccgcaggacggaaagaaggtgacctggtattgctgcggccctaccgtgtacgacgctagccacatgggacatgctcgctcctacatcagtttcgatatattgagacgggttttaaaggactatttcaagtttgatgtcttctactgcatgaatatcactgatatcgacgacaaaattatcaaaagggctcgacagaaccatttgtttgaacagtaccgagagaagaggccggaggcagcacagctccttgaggacgtccaggcagcactcaagcctttttcagtcaagctgaacgaaaccacagaccctgacaagaaacagatgctggaacggatccagcacgctgtgcagctagctacagaaccattagaaaaagcagtgcagagcagacttactggcgaagaagttaactcatgcgttgaggttctgcttgaggaagccaaagatttgctgagcgattggttagactccacactgggatgtgatgtcaccgacaactccatctttagcaagctccccaaattttgggaaggcgactttcacagggacatggaggcactcaatgtcctccccccggatgtcctgaccagagtgtccgagtatgtacccgaaattgtgaattttgtccagaagatcgtcgataacgggtatggatacgtctctaatggaagtgtgtattttgataccgcaaagtttgcttccagcgagaaacactcctatggtaagctggtgccagaagcggtcggcgatcagaaggccctccaggagggagagggtgatctgtccattagcgcagatagattgtctgaaaagagatcacctaatgacttcgccctttggaaggcaagcaaacctggtgaaccatcctggccttgtccctggggcaaaggcagaccgggttggcatatcgaatgtagtgccatggcgggcactctgctgggagcatctatggacatacacggcggcggcttcgatcttcgttttccccaccacgacaacgaactggcccagtctgaagcttattttgagaacgactgctgggtcaggtattttctgcatacaggacatctcacaattgcaggatgcaagatgtctaaatctcttaaaaattttatcactatcaaggatgccctcaaaaagcattctgcccggcaactgcgcttggccttcttaatgcatagctggaaggataccttggactactcaagtaacacaatggaaagcgcattacagtacgaaaagtttctgaacgaattttttctgaatgtgaaggacatactccgcgcacccgtcgatattacggggcagttcgaaaagtggggcgaggaggaggcggaattgaacaagaacttttacgacaaaaaaactgctatccataaggcactctgcgataacgtcgataccaggacagtgatggaggaaatgcgggcacttgtgtcgcagtgtaatttatacatggcggccaggaaagctgtcagaaaacgccccaaccaggccttgcttgagaacattgcactgtacctgactcacatgctcaagatcttcggtgccgttgaggaggatagctcactcggcttccctgttggtggacccggtacctctctgtcactggaagccactgtgatgccctacctgcaagtactgtcagagtttcgcgaaggggtacgcaaaatcgcaagagagcagaaggttcctgagatccttcagctgagcgacgctctgagggataacatcctgcccgaacttggcgtccggtttgaggaccacgaaggactgcccacagtggtcaagctggtggatcgaaatacgttgctgaaagagagggaggagaaacgcagagttgaagaagagaagcggaaaaaaaaagaagaggcagccaggagaaagcaggaacaggaggcagctaagttggcaaagatgaaaatccctccctccgagatgttcttgagcgagaccgacaaatatagcaagttcgacgaaaacgggctgcccacccatgatatggagggcaaggagctttcaaagggccaggccaagaaactgaagaagctgtttgaggcccaggagaaactgtacaaggagtatctccagatggctcagaacggatcttttcaatag

SEQ ID NO: 184344 - DNA, 2220 bp, Artificial Sequence
  Description of Artificial Sequence: Synthetic coding sequence
atggagcccaccagcggccccttccggaccgacctgggctaccacttggtgggatgttcttctggtaaaggtagacgcgtgcagccgcagtggagtccaccagctggcactcagccgtgtcggctgcatttgtacaacagtctgactagaaacaaggaagtgttcatcccacaagatggaaagaaagtgacctggtactgctgcgggcctaccgtgtacgacgctagtcacatgggacacgctcgcagttatatctcgtttgacattctgaggagagtgcttaaagactacttcaagtttgatgttttctattgcatgaatattaccgacatcgatgacaagataattaagagggcccgtcagaaccacctcttcgaacagtaccgggagaaacggccagaggctgcccagctcctagaagacgtccaggcagcactgaaaccgttctctgtcaagctgaacgaaacaaccgatccagacaagaaacagatgctggagcggatacagcatgccgtgcagttggccactgagcctctcgaaaaagctgttcaatcacggctgactggggaggaagtcaattcttgtgtggaagtgctgctcgaagaggctaaggacctcctcagcgactggctcgacagcaccctgggttgcgacgtcaccgacaattcaatcttttctaaattacccaaattctgggagggggattttcaccgagacatggaggctcttaacgtgctccctccagatgtgctcacacgcgtgtcggagtacgtcccggaaatagtcaacttcgtacagaaaattgtcgacaacggatatggttatgtgtccaatggatcagtctacttcgatacagcaaaattcgcaagcagcgagaagcattcctatggaaagcttgttcctgaagccgtaggtgatcagaaggcattacaggagggggaaggggacctgtccatttcagccgatcggctgtctgagaaacgtagcccaaatgacttcgccttgtggaaagcttccaagcctggggagcctagttggccctgtccctggggcaaaggccgacctggatggcacattgaatgtagcgcaatggctggcactcttctgggggcctccatggatattcatggtggcggcttcgatttgcgctttccacatcatgataacgagttagcacagtctgaagcctattttgaaaacgattgttgggtgcgctattttcttcacacggggcaccttaccatagcaggttgtaagatgagcaaatcactaaagaactttattacgataaaagacgccctgaagaaacacagcgctcgccagttgcggttagcctttctcatgcacagttggaaggacaccctggactattcttccaacacaatggaatctgccctacagtatgagaagttcctgaatgaattctttcttaatgtaaaggacattctacgggcccccgttgatataacaggacagttcgagaagtggggagaggaagaggctgagttgaataagaacttctacgacaagaagaccgcaattcacaaggccctctgtgataatgtggacacacgaacagttatggaggagatgagggcgctcgtgagtcaatgcaacctgtatatggctgcccgaaaagccgtgaggaaaagacccaaccaagccctgctggagaacattgctctttacctcacccacatgctcaagatatttggagcggtggaagaggactcatctcttggattcccggtgggcgggccagggacctccctcagcctggaggctactgtgatgccttatctgcaggtgttaagcgagtttcgagaaggggtcaggaagattgccagagagcagaaagttccagaaattctgcagttgtccgacgccctcagggacaacatcctgccggagctgggtgtcagatttgaagaccatgagggattgcccaccgttgttaaacttgtagaccgcaacaccttgttaaaggaacgggaggaaaagcggcgagttgaagaagaaaaacgaaagaagaaagaggaagctgctcgccgcaaacaggaacaggaagctgcgaagttggccaagatgaagatccctcctagcgagatgttcctgagtgaaactgataagtattcaaagttcgatgagaatgtatcaatggtctgtccccacatgacttggagagctaaaagcagtgctaagggcaagcctcgctcctag

SEQ ID NO: 184345 - DNA, 1695 bp, Artificial Sequence
  Description of Artificial Sequence: Synthetic coding sequence
atgctgcggaccacccggggccccggcctgggcccccccctgctgcaggcagcactgggcctaggccgcgccggatggcactggcctgcaggccgagctgctagcgggggccgtgggcgagcgtggctccaacctaccggcagagaaacaggagtccaggtctacaattccctgacgggaaggaaggagcctctcattgtcgcccacgctgaggccgcttcttggtactcttgcggccctactgtgtatgatcacgcacacctggggcacgcctgttcctatgtgagattcgatatcattcgaagaatactaactaaagtgtttgggtgtagtatagtgatggtaatgggaatcaccgatgtcgacgacaaaatcattaagcgagccaacgagatgaatatttcccctgcgagtctcgcctccctgtacgaggaggatttcaaacaagatatggccgccctgaaggtacttccccctaccgtgtatctgagagtcaccgaaaacattccccagattatcagctttatagagggcatcatcgcgagaggcaacgcttattccacggctaaagggaatgtttacttcgatctgaaaagccgaggtgacaagtacggcaaactggtgggagttgtgccaggacccgttggcgagcccgcagattctgacaaacgacacgcatcagacttcgctttgtggaaagctgccaagccacaagaggtcttctgggccagcccttgggggcccggtaggccggggtggcacattgagtgttccgcgattgctagcatggtgttcggatcacagctagacatccattccggaggcattgatctcgcctttccccaccatgagaatgaaattgctcagtgtgaagtgtttcaccaatgcgagcagtggggcaactatttcttgcacagtggtcatcttcacgccaaggggaaggaagaaaagatgagcaagtctctcaagaactacatcactattaaggacttccttaaaacgttcagcccagatgtgtttcgatttttttgcctgcggagttcttacaggtccgccatcgactattccgactccgccatgttacaggcacagcaactcctgctggggctgggcagcttcttggaagacgcgcgtgcatatatgaagggtcagctggcctgtggatcggtgcgagaggcaatgctttgggaaagacttagttccacaaagcgagccgttaaagcggccctcgctgacgatttcgacacgccccgggtggtggatgctatcctgggtctcgctcatcacggaaatggacaacttcgggcctctctcaaggagcctgagggccccagaagccccgcagtgttcggcgccattatatcatattttgaacagttcttcgaaaccgtgggtatttccctggccaatcaacagtacgtcagcggcgacgggtccgaggctactctccacggcgtcgtggacgaacttgtgcgctttcgccagaaggtccgccagttcgccttagcaatgcctgaagccactggcgatgccaggaggcagcagctacttgaacggcagcctctgctggaagcttgcgatacgcttcgtcgcggattaacagcccatggcataaacatcaaggatcggagctccacaacttccacctgggagctcctggaccaacgcaccaaggaccagaaatccgcaggctag

SEQ ID NO: 184346 - DNA, 549 bp, Artificial Sequence
  Description of Artificial Sequence: Synthetic coding sequence
atggtgttcggcagccagctggacatccacagcggcggcatcgacctggcatttcctcatcatgagaatgagatagcgcagtgtgaagtctttcatcagtgtgaacagtggggaaattatttcctgcactcagggcacttacatgcaaaaggaaaggaggagaaaatgagcaaaagcttgaagaactacatcacaataaaagacttcctaaagacattctcgcctgatgtattcagatttttctgtctgcggtctagttatcgcagcgccattgattatagtgacagcgctatgttgcaggcccagcagctgctgctcggactggggtcctttctggaggatgctcgggcttatatgaagggccagttggcctgtggcagcgtgcgggaagccatgctgtgggagcggttgagcagcactaagagagccgtgaaggctgcgctggctgacgatttcgatacacctcgcgtggttgatgcaattttggggctggcccatcacggaaacggacagctccgcgcctcactgaagaagccaggctcagcctag

SEQ ID NO: 184347 - DNA, 441 bp, Artificial Sequence
  Description of Artificial Sequence: Synthetic coding sequence
atggcccagaagcggcccgcctgcaccctgaagcccgagtgcgtgcaacagcttctggtttgctctcaggaggctaagaagagtgcctactgcccatacagccattttcctgttggcgcggccctgctgacacaggaagggagaatattcaaaggatgtaacattgagaacgcctgctaccccctggggatatgtgcagagagaactgccatccaaaaggcggtttcggagggttataaggactttagggccatcgctattgcctctgacatgcaggacgattttattagcccttgcggtgcttgcagacaggtaatgagagagttcggcactaattggcctgtgtacatgaccaagccggatgggacttacattgtcatgactgtgcaggagctcttgccatcttcgttcggacctgaagatttgcagaagacccagtag

SEQ ID NO: 184348 - DNA, 687 bp, Artificial Sequence
  Description of Artificial Sequence: Synthetic coding sequence
atgctgagccggtgccggagcggcctgctgcacgtgctgggcctgagcttcctgctgcagacccgccggccgatactactctgcagtcctcggctgatgaaaccactggtcgtgtttgtgctaggcggtccgggagctgggaaagggacacagtgcgccagaatcgtggagaagtacgggtatactcacttgtcagccggcgagctgttacgcgacgaaagaaaaaatcctgatagccaatacggagagctcattgagaaatacattaaagagggtaaaattgtacctgtagagattacgatttcactgcttaaacgagagatggaccagacgatggccgcaaatgctcaaaagaataagtttttaatagacggattcccccgaaaccaggacaacttacaggggtggaataagactatggacgggaaagccgacgttagtttcgtcctattctttgactgtaataatgagatttgcatcgagcgatgcctcgagaggggtaagagctctggtaggtccgacgataaccgagaatcattagagaagcgcatacagacatacctgcaaagtaccaagcctatcattgatctctacgaggagatggggaaggtgaagaagatcgacgcaagcaaatccgtggatgaggtattcgacgaagttgtgcagattttcgataaggagggttag

SEQ ID NO: 184349 - DNA, 540 bp, Artificial Sequence
  Description of Artificial Sequence: Synthetic coding sequence
atgctgagccggtgccggagcggcctgctgcacgtgctgggcctgtccttcctgcttcagactcgccgacccattctcctgtgtagtccccgactgatgaagccgctggtggtgttcgtcctgggggggcctggcgccggcaaggggacccagtgcgccaggatcgtcgaggagatggatcagacaatggccgccaacgctcagaagaacaagttcttaatcgacggatttccccggaaccaggacaatctgcagggctggaataaaaccatggacggcaaggctgacgtgtctttcgtgctgttcttcgactgtaacaatgagatttgcatagaacgttgtctcgagcgtggaaaatcctcagggcggagcgacgataacagggaatcactggagaagcgcattcaaacatacctgcagtccactaagcccataatcgatctgtatgaggaaatgggaaaggttaagaagattgacgcctcgaaaagcgtcgacgaggtgttcgatgaagtggtgcagatcttcgataaagagggctag

SEQ ID NO: 184350 - DNA, 1230 bp, Artificial Sequence
  Description of Artificial Sequence: Synthetic coding sequence
atggccttcgcccggcggctgctgcggggccccctgagcggccccttactgggcagaagaggggtctgcgccggagctatggctccgccaaggcggtttgttttggaactaccggattgcaccttggcccacttcgcactgggtgccgacgctccaggagacgcagatgctcccgatccgcggttagcggctctgctcggaccacccgagcggagctactccctttgtgtgccggtcacccctgacgctggctgcggtgcacgcgttcgcgccgccaggctccaccaacggctactacatcagttgcgcagggggccattccagcggtgtcagctgttaagactactgtgttactgccccggaggccaagccggtggggcgcagcagggcttcctattgagggaccccctcgacgaccctgatacccgacaagccctactggaattgctcggagcctgccaggaggcacctcgccctcacctgggagagttcgaggctgacccaagaggtcaactgtggcaacggttatgggaggttcaggacgggcgtcgtctccaggtgggatgtgctcaagtagtcccagtccccgaacctcctttgcaccccgtggtccctgaccttccatcatccgttgtgtttcccgatcgagaagctgcccgggctgtgctcgaagaatgtacctctttcatccccgaggcccgtgccgttctggacctagtggatcaatgccccaaacagatccaaaaaggaaagttccaggtcgtggccatcgaaggactagatgcgacaggcaaaaccactgtgacccagtctgttgcagatagcctgaaagcggtgttgctgaaatcacccccatcgtgcatcggacagtggcgcaagatctttgacgatgagccaacaattatacggcgcgctttctactccttgggtaactacattgtcgcctccgagattgcaaaagaatccgctaaaagccctgtgatcgtcgatcgttactggcacagtaccgctacctacgctatcgccacggaagtctctgggggcctacaacacctgccacctgcgcaccatccagtgtaccagtggccagaggatttacttaaacctgatctgatattactgctaacagttagtcctgaggagagacttcagcggctgcagggtcggggaatggaaaaaacacgagaggaggcagagttggaggctaactcggttttccggcagaagtag

SEQ ID NO: 184351 - DNA, 1350 bp, Artificial Sequence
  Description of Artificial Sequence: Synthetic coding sequence
atggccttcgcccggcggctgctgcggggccccctgagcggccccctcctgggaagacgcggggtgtgcgctggagctatggcaccaccaagacgcttcgtgttggagttaccggattgtacactggcacacttcgcactgggcgctgacgctcccggcgacgccgacgctcctgacccacgactcgctgcacttttgggtccacctgagcggtcgtactcgctctgcgtgccagtcaccccagatgctgggtgtggcgcccgtgtgagagccgcccgtctccaccagcgactgttgcatcagctcagaagaggccctttccagagatgccagctgctcagactcctttgctactgtccaggcgggcaggccggcggtgcacagcagggttttctgctccgagacccgcttgacgatccggatacgcgtcaggctttgctggagctgctaggcgcttgtcaggaggcgccaaggccacacctcggggagtttgaagccgatccaagaggacaactttggcaacggctgtgggaagtccaagatgggcggcggctccaggtcgggtgtgcgcaggtggtccctgtgcctgaaccccctctccatcccgtggtgcctgacctgccctcctctgtggtcttccctgaccgggaagctgcgcgggcagttctcgaagagtgtacctccttcattcctgaagcccgcgcggtactggacctcgtcgaccagtgtcccaaacaaatccagaaagggaagttccaagtggtcgcaattgaaggcctcgatgctaccgggaaaaccactgtgacacagagcgtcgccgacagcctcaaagccgtactcctgaagagccctccaagttgtatcgggcaatggcgcaaaattttcgacgatgaacctactataatcaggcgtgctttctatagcctagggaattacattgtcgcctccgagattgctaaggagagtgccaagtctcccgtgatagttgatcggtattggcactctactgccacatacgcaatagccacagaggtctctggaggtctgcaacaccttccgcccgcccaccacccagtttaccagtggccagaggatcttttgaagccagatctgatcctgctgcttaccgtatcacccgaggagcggcttcagcgtctgcagggcagaggtatggaaaagactcgggaagaggccgaactggaagccaactcggttttcaggcaaaaggtagagatgagctatcaaagaatggaaaatcccggatgccacgtcgtggacgccagtccttctcgcgaaaaagtgctgcagaccgttttgtccctgattcagaactcttttagtgagccctag

SEQ ID NO: 184352 - DNA, 1101 bp, Artificial Sequence
  Description of Artificial Sequence: Synthetic coding sequence
atggccttcgcccggcggctgctgcggggccccctgagcggcccccttctagggaggcgaggcgtttgtgctggcgctatggcacctcccagaagattcgtactcgaactccccgattgcactctggcccattttgctcttggagctgacgctcctggggacgctgacgcccccgatccacgactcgccgccttgctgggacctccagaacgcagctacagcctttgcgtccccgttactccagacgctggttgcggcgcccgtgtgcgggctgcccgtttgcaccaaagactgctgcatcaactacgccgcgggccgtttcaaaggtgccagttgctccggctcctgtgctactgcccaggtggtcaggcaggcggggcacaacaaggattcttactccgcgacccccttgacgaccccgatactaggcaagcacttctggagttactgggagcctgccaggaagcaccacggcctcatcttggagaattcgaggcggacccccgcgggcagctctggcagcgattgtgggaggtccaagacggccgtagactccaggtcggctgtgcccaggttgtgcccgtgccagagccgccactccaccccgtggtacctgatctgccatctagcgtggtgtttccggatagggaagctgcgcgcgccgtgttagaagaatgcaccagcttcattcccgaggctcgagcggtcctggatctagtcgatcaatgccccaagcagatacagaagggaaaatttcaggtcgtggcaattgaggggctggacgccacaggcaagactactgttactcaatcagtggctgacagtctcaaagctgtactgctgaagagccccccctcgtgtattggacaatggcgcaagatctttgatgatgagcccactataatacggcgagcattttatagcttaggcaactacattgtggcctcagagatcgccaaggaatcagccaaatcacccgtgattgtagatcgctcacagctcggcggtacgctatatcaccccagcttacatctacttggctcagaggtctgtgggacaggtatactcgacagcagtcattcgtcccagggccttgagtag

SEQ ID NO: 184353 - DNA, 813 bp, Artificial Sequence
  Description of Artificial Sequence: Synthetic coding sequence
atgggcaacaccagcagcgagcgggccgccctggagcggcacggcggacataaaacgcctcgaagggatagtagtggcggcactaaagacggggacaggcccaaaatcctgatggattccccagaggatgcagacctgtttcattccgaagaaattaaggctccggaaaaggaagagtttctggcctggcagcacgatctggaggtgaatgataaggcgcccgcacaggcacggcctactgtgtttagatggactggtggagggaaggaggtatatctgagcggcagctttaacaattggtcaaagctgcctctcaccaggagccacaacaacttcgtagctattttggacctgcccgagggcgagcaccaatataagtttttcgtcgatgggcagtggactcatgacccttccgagcccatcgtgacatcacagttgggtaccgttaacaacatcatccaggtgaaaaagaccgatttcgaggtttttgatgcgctcatggtcgacagtcaaaagtgctcagacgtgtccgagctgagttcttcaccccccggaccataccatcaagagccctacgtttgcaagcccgaagagcgcttccgggcaccccctatcttgcctccccatttgctgcaagtaattctgaataaggacacaggaatatcctgtgatccagccctgctgccggagcccaaccacgtcatgctcaaccacttgtatgccctgtcaatcaaggacggcgtcatggtcctcagcgctacgcatagatacaagaagaagtacgtcacgacacttttatacaaacctatatag

SEQ ID NO: 184354 - DNA, 588 bp, Artificial Sequence
  Description of Artificial Sequence: Synthetic coding sequence
atgggccagatcgagtgggccatgtgggccaacgagcaggccctggcatccggcctgattctaattaccgggggtattgtggcgacagccgggcgttttacacagtggtatttcggggcttactctatcgtggctggagtattcgtctgtctcttagaatacccaagagggaaacgcaaaaagggcagcacaatggaacgctgggggcaaaaatacatgactgctgttgtgaagctcttcgggccattcaccagaaactactacgtccgcgctgtgctgcacttattgctgagcgtcccagctggctttttgctggccacaatcctgggcaccgcctgcctagccattgcctctggtatttatctactggccgctgttcggggagagcagtggaccccaattgagcccaagccccgcgagaggccacagatcgggggtacaattaagcagccgccatccaatccccccccgaggcccccggctgaggctcgaaaaaagccctctgaagaagaggcagccgtggccgctgggggccccccaggcggacctcaggtcaatccaatcccagttactgacgaggtagtctag

SEQ ID NO: 184355 - DNA, 1713 bp, Artificial Sequence
  Description of Artificial Sequence: Synthetic coding sequence
atgggcaactgggccgtgaacgagggcctgagcatcttcgtgatcctcgtttggctgggcctcaacgttttcctgttcgtgtggtattatcgagtctacgatattccaccaaagttcttttacacacggaagctgttaggtagcgcactcgctttggctcgagcccccgctgcttgcctgaactttaactgcatgctgattctccttccagtgtgtcgtaatctactgtcatttcttagaggaagttccgcatgttgttctacccgtgtgaggcgacagctggacagaaacctgacattccacaagatggtcgcttggatgatcgctctgcactctgctattcacactattgctcacttgtttaatgttgaatggtgtgtgaatgcccgcgtgaacaacagtgacccttattccgtcgcgttgagcgaactgggagacaggcagaacgagtcctacctgaattttgcaaggaaacgcattaagaatccggagggcggtttgtacctggcagtaacactcctcgccggaatcaccggggtggtaattacactttgtctgatactcattatcacttccagcactaagactatacgtcgctcttactttgaggtgttctggtacacgcaccatctcttcgtcattttcttcatcggcctggcaatccacggcgctgagcggatcgttagaggacagacggctgagtccctcgccgtgcacaatattacagtgtgtgaacagaagatctccgagtggggaaagattaaggaatgtcccatccctcagttcgcaggtaacccccctatgacctggaagtggatagtaggcccgatgtttctctacctatgtgaaagactggtgcgcttttggagatcccagcagaaagtggttattaccaaggttgttacacacccctttaagaccatcgagctgcagatgaagaagaaggggtttaagatggaggtcggccagtacatcttcgtcaagtgccctaaagtgtccaagttggaatggcatccgttcacgctaacttcagctcctgaggaggacttcttctccatacacatcagaatagtgggcgattggaccgaaggtctgtttaacgcgtgcggatgcgataagcaggagtttcaggacgcctggaaactgcctaaaattgctgtggatgggccctttggcactgcctccgaagatgtgttctcctacgaggtagtgatgctcgtcggtgcagggatcggagtgaccccgtttgcttccatcctgaagagcgtgtggtacaagtattgtaacaacgccactaatctcaaacttaagaagatctacttttactggctgtgccgagatactcacgctttcgagtggtttgccgacttgctacaactgctggaaagtcagatgcaggagcggaataatgcagggttccttagttacaacatttaccttactgggtgggacgagtcccaggctaatcactttgccgtgcaccacgatgaagagaaggatgttattaccggactcaagcagaaaactctctacggcaggcctaactgggataatgaatttaagaccatcgcttcccagcatccaaacacgaggattggggtgttcctgtgtgggcccgaagccctggcggagacgctgtcaaagcagtccatttcaaattcagagtctggacccaggggcgtacacttcatctttaataaagagaacttctag

SEQ ID NO: 184356 - DNA, 912 bp, Artificial Sequence
  Description of Artificial Sequence: Synthetic coding sequence
atgacctggaagtggatcgtgggccccatgttcctgtacctgtgcgaacggctggtccgcttctggcggtcacagcagaaagttgtgatcacaaaagtcgttacccatccatttaagaccattgagctgcaaatgaaaaaaaaggggttcaagatggaggttggccagtacatattcgtcaagtgtccgaaagtatccaagctggaatggcaccctttcactcttacgagcgcacctgaggaggatttcttctctattcacatcagaattgtcggcgattggactgaggggctgtttaacgcttgtggctgcgataaacaggaattccaggatgcctggaaactgcctaagattgctgtcgatggtcctttcgggacagcctccgaggatgtgtttagttacgaagtggtgatgcttgtgggagcaggtattggggtcaccccttttgcgtcaattcttaaatccgtgtggtacaaatattgtaataatgcgacgaacctgaagctaaagaagatatacttctattggttgtgccgcgacacccatgcgttcgagtggtttgcagacctgctccagctgctggagagtcaaatgcaggaaaggaacaacgccggatttttgagttataatatttatctgaccggttgggacgagtcccaggcaaaccattttgccgttcatcatgatgaagagaaagacgtaataaccgggttgaaacaaaagactctctacggccgccctaactgggacaacgagtttaagaccattgcaagtcaacatccaaataccagaattggagtctttctctgtggaccagaggcgttggctgaaaccctgagcaagcaaagtatatctaattccgaatcgggccctcggggggtgcactttatattcaacaaagagaacttttag

SEQ ID NO: 184357 - DNA, 1617 bp, Artificial Sequence
  Description of Artificial Sequence: Synthetic coding sequence
atgggcaactgggccgtgaacgagggcctgagcatcttcgtgatctcggccttggccctggctcgagctcccgctgcctgcctgaacttcaactgcatgctgattttgttgcccgtgtgccgcaacctgctgagctttctgcggggcagcagcgcgtgttgctccacccgggtccgtagacagttagaccggaacctcacatttcataagatggttgcctggatgattgccctccacagtgctatccatacgatcgctcatctgtttaatgtcgagtggtgcgtgaatgcccgcgtgaataattcagatccttattctgtggctctgtctgagctgggcgaccgacaaaacgaaagctatcttaatttcgcgcgcaagagaatcaagaatcccgaaggggggctgtatttggctgtgactctactcgcagggatcaccggagtcgtgattaccctctgtttgatcttgattatcacatcaagcaccaagacaatacgtcgctcatattttgaggttttttggtatactcaccatctgttcgtcatcttctttatagggctcgccatccatggcgctgaaaggattgttcggggtcagacagccgagtctcttgctgtccacaacataacagtttgtgaacagaaaataagcgaatggggcaagattaaggagtgccctattccccagtttgctggcaatccgccaatgacctggaagtggattgtgggaccaatgttcctctatctttgcgagagattggtgcggttttggagaagccagcagaaagtcgtaatcaccaaagtggtgactcacccatttaagactattgaactgcagatgaaaaaaaagggcttcaaaatggaagtgggccagtacatttttgtgaaatgtccaaaggtcagcaagctcgaatggcacccttttacactgacctctgctcctgaagaggacttcttttcaatacacattagaatcgtgggagattggacggaggggctgtttaacgcgtgcggttgcgataaacaagagtttcaggatgcttggaagttgccaaagatcgccgtggatgggcctttcggaacagcgtcagaggacgttttttcatatgaggtcgttatgctggttggtgccggcatcggagtgacacctttcgctagcatccttaaatccgtgtggtataaatactgtaacaacgccaccaacctgaagcttaagaagatttacttttactggttgtgccgcgatacacatgcattcgagtggttcgctgacttgctgcagcttctggagagtcagatgcaggagagaaacaacgccggatttctaagctacaacatctatctcaccggatgggatgaatctcaggccaaccacttcgctgtgcaccatgatgaggaaaaagacgttattaccgggctaaagcaaaaaacgttatacggaagaccgaactgggataatgaatttaagacaatcgccagccagcatccgaatacccgcataggcgtgttcctgtgtggtcccgaggcccttgctgagacactatccaagcaatctattagtaatagcgagagtggtcctagaggagtgcatttcatttttaacaaagagaacttctag

SEQ ID NO: 184358 - DNA, 714 bp, Artificial Sequence
  Description of Artificial Sequence: Synthetic coding sequence
atgaacagccggcggcgggagcccatcaccctgcaggaccccgaggcgaagtacccactgcccctcatcgaaaaggagaagatttcgcataacactagaagatttcgcttcgggcttcctagtcccgaccatgtgctaggacttcctgtaggtaactatgtacagcttctcgcaaagatcgataacgagcttgtggttagggcctacacacctgttagcagcgatgatgatcgtgggttcgtggatctcattataaagatctacttcaagaacgtgcacccccaatatccagagggggggaaaatgacccagtaccttgaaaatatgaaaattggcgaaacaatattcttccgaggaccccgcggtcgcctcttctatcacggcccaggaaatctggggattaggcctgaccagacttctgagccaaagaaaaccttggctgaccacctgggcatgatcgccggtggcaccggtataaccccaatgctccagcttattaggcacattacaaaggacccttccgacagaacccggatgtccctgatcttcgcaaaccagactgaagaggacatcctggtacggaaggaattggaggagattgcacgcactcatcctgatcaattcaacttgtggtatactctcgacagaccaccaatcggcccatggtccgccgaaggtgcaactctcttatctaattcagcgcaattccattag

SEQ ID NO: 184359 - DNA, 831 bp, Artificial Sequence
  Description of Artificial Sequence: Synthetic coding sequence
atgaacagccggcggcgggagcccatcaccctgcaggaccccgaggcaaagtatcccctgcctctgatcgaaaaagagaaaatctcgcacaatacccgacggttccggtttggactgccctctcccgatcatgtgttggggctgcccgtcgggaattacgttcagttactggccaaaattgataatgagctagttgtgagagcatatactccagtgtcgtctgacgatgaccgggggttcgttgacttgataataaaaatctacttcaaaaacgttcacccacaataccccgagggcgggaaaatgacccagtacctggaaaacatgaaaattggagaaactatctttttccgggggcctcggggacgactgttctatcacgggccggggaatctgggcattagacccgatcagacatctgagcccaagaagactctggcagaccatctgggaatgatcgctgggggcactggaattacacctatgctccagctaattcggcacatcactaaagacccctctgaccgcacccggatgagtttgattttcgcaaaccaaactgaagaggacatcctggtcaggaaagagctcgaggaaattgccagaacccacccagatcagttcaatctctggtataccctggatagaccaccaattggctggaagtactcatctggcttcgttacggccgacatgattaaagagcatttaccacccccggcaaagtcaacgctgatcctcgtctgtgggcccccccccttgatccaaacagccgcacaccctaacttagaaaaattaggatatactcaagacatgatatttacttactag

SEQ ID NO: 184360 - DNA, 351 bp, Artificial Sequence
  Description of Artificial Sequence: Synthetic coding sequence
atgaacagccggcggcgggagcccatcaccctgcaggaccccgaggcaaaataccccctccccctgattgaaaaagagaagatatcccataacacaagacgttttcgatttggcttaccctctcccgatcacgtcttgggattacccgtggggaattatgttcagctgttagcgaaaattgataatgagctggttgtaagagcctacacccctgtatcaagcgatgacgacagggggttcgttgaccttatcataaagatctatttcaagaatgtccacccacagtacccagagggggggaaaatgacacagtacctggagaatatgaaaatcggtgaaaccatcttttag

SEQ ID NO: 184361 - DNA, 714 bp, Artificial Sequence
  Description of Artificial Sequence: Synthetic coding sequence
atgaacagccggcggcgggagcccatcaccctgcaggaccccgaggccaaataccccctcccgctgattgagaaagaaaagatttcacacaacacccggagatttcgcttcggcctgccatcccccgaccacgttctgggtttgccagtaggaaactacgttcagttgctggccaaaattgataatgagctggtcgtgcgggcatatactccagtatctagtgacgacgaccggggttttgtcgacttaatcattaaaatatatttcaagaatgtgcatccccagtatcctgaaggaggcaagatgacccaatatttggaaaacatgaagatcggggaaacaatttttttcagaggcccacgggggcgtctgttttaccacggtccaggaaatttagggatcagacccgaccagacgtctgagccaaagaagactctcgccgatcaccttggcatgatcgcgggaggcacaggcataacgccaatgctccagctgatcaggcacattacaaaggacccgagtgataggacaagaatgtctcttatcttcgccaatcagactgaggaagacattctcgtccggaaggaactggaagagatcgctaggacacaccctgaccagtttaacttatggtacaccctcgaccggccgcctattggaccctggagtgccgagggagctactctcctgtccaacagtgcccagttccattag

SEQ ID NO: 184362 - DNA, 441 bp, Artificial Sequence
  Description of Artificial Sequence: Synthetic coding sequence
atgaacagccggcggcgggagcccatcaccctgcaggaccccgaggcgaaatatcccctacctttgatagagaaagaaaaaatttcccacaacacaaggagattccgtttcgggttgcctagtccggaccatgtgctcggcttaccagtggggaattatgtccagctcctggctaagatagacaacgagctggtagttagggcctacactcccgtgagctctgacgatgaccgcggattcgtggacctgatcatcaagatttactttaagaacgtgcacccacagtaccccgagggaggtaagatgacccagtatctggaaaatatgaagattggagaaaccattttcttccggggcccgcggggtcgcctcttttaccatggtccggggaacttgggaatccggcctgaccaaacgagcgaacccaaaaagactttatag

SEQ ID NO: 184363 - DNA, 516 bp, Artificial Sequence
  Description of Artificial Sequence: Synthetic coding sequence
atgaacagccggcggcgggagcccatcaccctgcaggaccccgaggccaaatatcccctgcctctgattgaaaaggaaaagataagccacaatactcgccgtttcaggttcggcctccctagccccgaccacgttttagggctcccagtgggtaactatgtgcagctgcttgccaagatcgataacgagttggtggtcagagcctacactcctgtttcttctgacgacgatcgcggcttcgtggacctcattatcaagatttactttaagaatgtccatccacagtatcccgagggtggaaaaatgactcagtacttagagaacatgaagattggagaaacaatctttttccgcggaccacgtggtcggctgttctaccatggacccgggaatttggggattagacctgaccagacctctgagccgaagaagacactcgctgaccatctcggcatgatcgcgggcggcaccgggatcaccccaatgcttcagcttattcgacacataaccaagtag

SEQ ID NO: 184364 - DNA, 831 bp, Artificial Sequence
  Description of Artificial Sequence: Synthetic coding sequence
atgaacagccggcggcgggagcccatcaccctgcaggaccccgaggcgaaatacccgttgcccctaattgaaaaggagaagatttcacacaatactagacgattcagattcggactcccaagccccgatcacgtgctgggccttcccgtggggaactatgtgcagttattggccaaaatcgataatgaactagtagtccgtgcctacacccctgttagcagcgatgatgatagaggatttgttgacctgattatcaagatctacttcaagaatgtccacccgcagtacccagagggaggcaaaatgactcagtacctggagaatatgaaaattggcgagaccatatttttccgggggccacgcgggcgcttgttttaccacgggcctggtaacctcgggatccggcctgaccagacttcagaacctaaaaaaaccctggccgatcacctaggcatgatcgctggtggaacaggcataacacccatgctccaacttatcagacacataacaaaagacccaagcgacagaacccgtatgtccctgattttcgctaaccagacggaggaggatatactcgtgcggaaggagctggaagaaatcgctcggactcatcccgatcagttcaacctgtggtataccctggacaggcctcccataggatggaagtatagttcaggatttgttaccgccgatatgattaaggaacacctccctcctcccgccaagtccactcttattttagtgtgtggccctccccccctcatacagacagcggcccacccgaatctggagaagctcggatacacgcaggacatgatatttacatactag

SEQ ID NO: 184365 - DNA, 906 bp, Artificial Sequence
  Description of Artificial Sequence: Synthetic coding sequence
atgggcgcccagctgagcaccctgggccacatggtgctgttccccgtctggttcctctatagcctgcttatgaagctgtttcagcggagcacccccgcgatcactcttgagtctccagatattaaataccctctccggctgatagatagagaaattatcagtcatgacacaaggcgctttcgctttgctttgcctagtccacagcacattctaggtctccctgttggccaacacatctacctttcggcacgaattgacggcaacttagtggtcagaccctacacgccaatttctagtgacgatgataagggattcgttgatttagtgattaaagtctactttaaggacactcaccctaagtttcccgctggtggcaagatgtcacaataccttgaaagcatgcagattggcgatacaatcgagttcagggggccatctggcctgctcgtctaccagggcaagggtaaattcgctattaggcccgacaagaagagtaaccctatcatccgtaccgtgaaatcagtagggatgatagccggagggactggtattacacctatgttgcaggtgattagagcaattatgaaggatcccgacgatcacactgtatgtcatctgctctttgcgaaccagacagagaaagatatcctgctgaggcccgaattagaggagttgagaaacaagcattctgccagattcaagttatggtatacactcgacagggccccagaggcctgggattacggacagggcttcgtaaacgaggagatgattcgcgatcaccttccgccaccagaagaagaaccacttgtgctgatgtgcgggccgccccccatgattcagtatgcttgtctgccgaatctggatcacgtgggacatcctaccgaaaggtgttttgtgttttag

SEQ ID NO: 184366 - DNA, 1005 bp, Artificial Sequence
  Description of Artificial Sequence: Synthetic coding sequence
atgaaccggagcctgctggtgggctgcatgcagagcaaggacatctgggggcgagaggagtcgatctgtgaaaggctcaaacaggacggactggacgtcgagcgagccgaaagctgggaactggggcacatggtgctcttcccggtgtggttcctgtattccctgcttatgaaactgtttcagagatctacccctgcgattaccctggaatctcctgacatcaagtaccccctgagactaatcgatcgggagattataagccatgataccaggaggtttaggttcgctttgccttcacctcagcacatactgggcttaccggtcggccagcatatttacctctcagcccgtattgacggtaatctagtcgtacgcccgtacactcctattagcagcgatgacgacaagggcttcgtggacctggtgatcaaggtgtattttaaagacacccatccaaagttcccggcgggcggtaaaatgagtcagtatcttgagagcatgcaaattggagatactattgagttcagaggcccatccggcctgcttgtttatcaggggaaaggaaaatttgccatcagaccagacaagaagagtaacccgatcatcagaaccgtaaagagtgtcggaatgatcgctgggggcacagggattacccccatgctgcaagtcattcgcgccatcatgaaggaccctgacgaccataccgtgtgtcatctgctgttcgccaaccaaacagaaaaggacatcctgctcagacccgagctcgaagagttacgaaacaagcactctgcgcgattcaagctgtggtacactttggatagagcaccggaggcctgggactatggtcaggggttcgtaaacgaagaaatgatacgtgaccaccttcctccacctgaagaggagcctctggtgttaatgtgtgggcctcctcctatgatccagtacgcctgccttcctaaccttgatcatgtgggacatccgaccgagcggtgtttcgttttctag

SEQ ID NO: 184367 - DNA, 837 bp, Artificial Sequence
  Description of Artificial Sequence: Synthetic coding sequence
atgaagctgttccagcggagcacccccgccatcaccctggagagcccggatatcaaatatcctctacgattaatagatagagaaatcatcagccatgacacccgccgattccgctttgccctaccatccccacaacatatcctgggcctgcccgtggggcagcacatctatctgagtgcccggatagatgggaatttggtagtgagaccttataccccaataagttcagatgatgacaaagggtttgtggatctggttattaaagtgtatttcaaggacacgcatcctaaattccccgccggaggcaagatgtcgcagtatctggaatctatgcaaataggagacaccatagagtttcgcggtccctccggcctgttagtctaccaggggaaaggcaagtttgccattagacccgataaaaaatcgaatcctatcatcagaacggtaaagtccgtgggaatgatagcgggtggcactggaattacgcccatgctgcaggtgatcagagcgatcatgaaggatcctgacgatcacaccgtatgccatctgctgttcgcgaaccagacagagaaagacatcctgttaaggcctgaattggaagaactgcgcaataagcacagcgctcgcttcaaactttggtacacccttgacagagccccagaagcatgggactatggacaaggcttcgtgaatgaggagatgattcgtgaccacctccctccgccagaggaagaacccttggtcctgatgtgtgggccgccgcctatgatccagtatgcttgtctgccgaatctagatcacgtggggcatcctacagagcgatgttttgtgttctag

SEQ ID NO: 184368 - DNA, 837 bp, Artificial Sequence
  Description of Artificial Sequence: Synthetic coding sequence
atgaagctgttccagcggagcacccccgccatcaccctggagagccccgacattaaataccccttgcggctgattgatcgagagataataagccacgacacccgccggtttagattcgcactgccgtcccctcagcatattctgggactgcccgtcggccagcacatctacctgagtgctcggatcgatgggaatctcgtcgtgagaccgtacacacctatctcaagcgacgacgacaaaggcttcgtggacctggtcattaaagtgtacttcaaagacacccatcctaaattccccgctgggggcaaaatgagccaatatttagagtctatgcagattggagacaccatagaattcaggggccctagcggcctcctggtgtaccagggtaaagggaaattcgccatccgacctgataagaaatccaacccgatcattcgaactgtgaaatcagtgggtatgatcgcgggcggaacaggaatcacgcccatgcttcaagtcatcagagctatcatgaaagatcccgacgaccatacggtatgccatttgctctttgctaaccagacagagaaggatattctcctacgtcccgagctggaggaattgcgcaataaacactctgcccgattcaagctctggtataccctggacagagcccctgaggcctgggactacggacaaggttttgtgaatgaggagatgattagggaccatctccccccgccagaagaagaaccgctggtgctgatgtgcgggcccccgcccatgattcagtatgcatgtctgcctaacttggatcatgtgggacacccaactgagcggtgctttgtgttctag

SEQ ID NO: 184369 - DNA, 837 bp, Artificial Sequence
  Description of Artificial Sequence: Synthetic coding sequence
atgaagctgttccagcggagcacccccgccatcaccctggagagccctgacatcaagtacccgctgcggctgattgaccgggagatcatcagtcacgacacccgtcggtttcggttcgcactcccttccccacagcatatcctgggcctgcctgtcgggcagcatatttacctgagtgctagaattgatggaaacttagttgtaaggccatacacccccatatcaagcgacgatgacaaggggttcgttgatctggtgatcaaggtgtacttcaaagatacacatcctaaattcccagcaggaggtaaaatgtcccaatacttggaaagcatgcagattggagacacgattgaattcagagggccctccggcctcctagtttatcaaggcaagggcaagtttgcgattagacctgataaaaagtccaacccgattatacggaccgttaaatcagtgggcatgattgccggcggtaccgggatcaccccaatgctgcaggtgattagggccatcatgaaagaccccgatgatcacactgtctgtcacctactctttgctaaccagacggaaaaagacatcctccttaggccagaactggaagagctccgtaacaaacatagtgcacgctttaagctctggtacacacttgatagagcgccggaggcctgggactacggccagggctttgtcaacgaagaaatgatccgcgatcatctaccaccaccggaggaagaacccttggtcctgatgtgtggacctcctcccatgatccagtacgcttgccttccgaatctggaccatgtgggccatccaacagagaggtgttttgtcttttag

SEQ ID NO: 184370 - DNA, 837 bp, Artificial Sequence
  Description of Artificial Sequence: Synthetic coding sequence
atgaagctgttccagcggagcacccccgccatcaccctggagagcccagacataaagtaccctcttcgacttattgatagagagattatctcccatgacactcggcggttccggttcgctttgccaagcccacagcacattctcggcctcccagttggtcaacacatctatctgtcagcacgcatcgacggcaatctcgtggtaaggccttacactccaatctcctccgatgatgacaaaggctttgtcgatctggtgattaaagtgtatttcaaagacactcacccaaagttccccgccggaggaaagatgtcacagtatctggagtctatgcagataggggacaccatagagtttagggggccctccgggctgctggtgtaccaaggcaaagggaagttcgccatcaggcctgataaaaaaagtaatcccatcataaggacagtgaagtccgttgggatgatcgccggcggcaccggcatcacacctatgctgcaggtcattcgcgccatcatgaaagacccagatgaccacacggtgtgtcacctgctcttcgcaaaccagaccgagaaggacattctgctgcgccccgagctggaggaactgcgtaataaacacagtgctcgtttcaaattgtggtatacactggaccgcgcgccagaggcctgggactatggacaggggttcgtgaacgaggagatgatcagagaccatctccctcccccagaggaggaaccgctcgtgctcatgtgtggacctccccccatgattcagtatgcttgcttgccgaatctagatcatgtggggcacccaactgaaagatgttttgtcttttag

SEQ ID NO: 184371 - DNA, 444 bp, Artificial Sequence
  Description of Artificial Sequence: Synthetic coding sequence
atgaagctgttccagcggagcacccccgccatcaccctggagagcccagatattaagtatcccctgagattgatcgatcgcgaaatcatcagccatgatacaagacgtttccggtttgcattgccctcaccccagcatatactggggctgcctgtgggtcagcatatctacctgagcgcccgcatcgacggtaatctagttgtgcggccatacaccccaataagttccgacgatgacaaaggattcgtggacctggtgatcaaggtgtatttcaaggatacccacccaaagtttcctgccggtggcaagatgtcccagtacctggaaagtatgcagatcggggacaccatagagttccggggccctagcggcctgctggtctaccaaggtaagggcaagtttgccattcggccagacaagaagtccaacccaatcatccgttag

SEQ ID NO: 184372 - DNA, 330 bp, Artificial Sequence
  Description of Artificial Sequence: Synthetic coding sequence
atggactggatccggctgaccaagagcggcaaggacctgaccggcctgaagggacgtctgattgaggtaaccgaggaggagcttaagaagcacaataagaaagacgactgttggatctgtatccgcggttttgtgtacaacgtatctccatatatggagtaccatcctggaggtgaagacgaactgatgcgcgctgctggtagcgatggtaccgagctgttcgatcaagtgcaccggtgggttaactatgagtccatgctgaaggagtgcctagtgggaagaatggccataaagcccgctgttctgaagggtaaactttggcatttgtag

SEQ ID NO: 184373 - DNA, 1566 bp, Artificial Sequence
  Description of Artificial Sequence: Synthetic coding sequence
atgctgaacgtgcccagccagagcttccccgccccccggagccagcagcgggtcgcctctggcgggagatccaaggtgccactgaagcagggccgctcacttatggattggattagactgacaaaatctgggaaagacttgactggactaaaaggccgcttaatcgaagttaccgaagaggagctgaagaaacacaacaagaaggatgattgctggatatgcatccgtgggttcgtttacaatgtgtccccctatatggagtatcatccgggcggggaagacgagctcatgcgggccgctggatccgacggtaccgagcttttcgatcaggtgcatcgctgggtcaattatgaatctatgctcaaagaatgcctcgtagggagaatggccattaaaccagcagtgcttaaagactaccgcgaagaggaaaagaaggtcctcaacggtatgctcccgaagtcacaggtgaccgatacgctcgccaaggaaggtcccagctacccgtcgtatgactggttccagaccgactctctggtgactatcgcaatatacacaaaacagaaagacatcaatctcgactccattatcgtagaccatcagaacgacagcttccgtgcggaaaccatcatcaaggattgtctatacctgattcatatcggtctgagccacgaggtgcaggaagatttctcagtgagggtggtggagagtgtggggaagattgagattgtattgcagaagaaagagaacactagttgggactttctaggccatcccctgaagaatcataatagtttgattccgcggaaagatactggcctttactatcggaaatgtcagttgatcagtaaggaagatgtgacacacgatactcgtcttttctgcctgatgctccccccaagcacacatctgcaggtccccataggccagcacgtttatctcaaactccctattactggcactgaaatagtgaaaccatataccccagtgtccgggagcctactgtccgaatttaaagaacccgtactgccgaataacaaatatatatatttccttatcaagatttaccccacggggctgtttacaccagagctggatagactgcagatcggagactttgtcagcgtctctagcccggaaggaaactttaaaattagtaagttccaggagttagaagacctgtttctgcttgctgcaggaacagggtttacaccaatggttaagatcctgaattacgctctcaccgacatcccctctcttaggaaggtcaaactgatgttctttaacaaaactgaggatgacattatttggagaagtcagctcgagaagcttgctttcaaagacaaaagactggatgtcgagtttgttctttcagcacctattagcgagtggaatggcaaacagggtcacattagtccggccctcttgagtgagtttcttaagagaaatctggataaaagtaaggtactggtctgcatttgcggtcccgtccccttcaccgaacaaggggttagacttctgcacgacttaaacttctccaagaacgaaattcattccttcacagcttag

SEQ ID NO: 184374 - DNA, 297 bp, Artificial Sequence
  Description of Artificial Sequence: Synthetic coding sequence
atggccgagcagagcgacgaggccgtgaagtactacaccctggaggagatccaaaagcataaccacagcaaatccacatggctgattttacaccataaggtgtacgatctcactaagtttctggaagagcatccgggcggagaagaagtcctgagagaacaggccggcggcgatgccacagagaattttgaggacgtgggccattccacggatgcccgcgagatgagcaaaaccttcataatcggcgaactccacccggacgaccggcctaaactgaataagcctcccaagccttag

SEQ ID NO: 184375 - DNA, 405 bp, Artificial Sequence
  Description of Artificial Sequence: Synthetic coding sequence
atggccgagcagagcgacgaggccgtgaagtactacaccctggaggagatacagaaacataaccatagcaagtcaacctggctgatcctgcaccacaaggtgtatgatcttacaaagtttcttgaggagcacccgggaggagaagaggtgttgagggaacaggccgggggggatgccaccgagaatttcgaggacgttggtcactctaccgatgcccgggaaatgtccaaaactttcattataggtgagctccatcctgacgacaggcccaaattgaataaacctccagagaccctcataaccaccattgatagcagctcgtcttggtggacaaattgggtgatccctgctatatctgcggttgcagttgctttgatgtataggctgtacatggccgaagactag

SEQ ID NO: 184376 - DNA, 375 bp, Artificial Sequence
  Description of Artificial Sequence: Synthetic coding sequence
atggccgagcagagcgacgaggccgtgaagtactacaccctggaggagatccagaagcacaatcactctaagagtacctggctgatcctccatcacaaagtttacgatcttacgaagtttctggaggaacatcccggaggggaggaagtcctcagagagcaggcagggggcgacgcaacagagaacttcgaggatgtggggcactccacagacgctcgagaaatgtcgaagacttttatcattggcgagctgcaccccgaaacgttgatcacgaccatcgatagctcgtccagttggtggacgaattgggtgatacccgccatcagtgctgtggcagttgcgctgatgtatagactgtatatggcggaggattag

SEQ ID NO: 184377 - DNA, 297 bp, Artificial Sequence
  Description of Artificial Sequence: Synthetic coding sequence
atggccgagcagagcgacgaggccgtgaagtactacaccctggaggagatccaaaaacataatcactcaaaatcaacttggctcatcctgcatcataaagtttatgatcttactaagttcctcgaggaacatcctggcggtgaggaggtgctccgggaacaggctggcggcgatgctacagagaacttcgaagacgtggggcacagcaccgacgcacgtgagatgtcaaaaacttttataataggcgagctacacccagatgatcgacctaagcttaacaagccccccgagccttag

SEQ ID NO: 184378 - DNA, 453 bp, Artificial Sequence
  Description of Artificial Sequence: Synthetic coding sequence
atgagcggcagcatggccaccgccgaggccagcggcagcgacggcaaagggcaggaagtggagacgtctgtgacttattatcgactggaagaagtggccaaaaggaactcactgaaagagctgtggttggtcatacacgggcgcgtttatgacgtcacccgctttctaaatgagcaccctgggggggaagaagtcctgctggagcaagccggcgtggatgcttcggaatctttcgaggacgtcggacactcgagcgatgctcgggagatgctgaaacaatattatatcggagacattcacccgagcgatttgaaacctgagtcaggctccaaggatccttcaaagaatgacacgtgcaagtcctgctgggcctattggatcctgccaataataggcgccgtgttgctggggtttctgtacaggtactataccagcgagtccaaatcatcttag

SEQ ID NO: 184379 - DNA, 441 bp, Artificial Sequence
  Description of Artificial Sequence: Synthetic coding sequence
atggccaccgccgaggccagcggcagcgacggcaagggccaggaggtggaaacttctgtcacatactatcggttagaagaagttgctaaaagaaattcattaaaggaactgtggctcgtaatccatgggcgggtgtacgatgtcacgcggtttcttaatgagcaccccggtggcgaagaggttctgcttgagcaggctggagttgacgcctcagagtcatttgaggatgtgggtcacagctctgacgctagggagatgctgaagcagtattacattggggacatccatccttccgacctgaagcccgaatctggtagcaaagatccctctaaaaatgacacttgcaagtcctgttgggcctattggatacttccaatcatcggggcagtgcttttggggttcctatacagatactacacctccgaatcaaagtccagttag

SEQ ID NO: 184380 - DNA, 756 bp, Artificial Sequence
  Description of Artificial Sequence: Synthetic coding sequence
atggagggcggcgccgccgccgccacccccaccgccctgccctactatgtggcctttagtcagttgctagggcttactctagtggcaatgaccggcgcgtggctgggcctttacaggggcggaatcgcttgggaaagtgatctgcagtttaacgctcaccccctgtgtatggtgattggactgatctttctccagggtaatgcgttacttgtgtatcgcgtttttcgtaatgaagctaaacgaacgaccaaggtgttgcacggtctgctccacatttttgctctagtgatcgccctggtgggtcttgtggccgtctttgactaccataggaaaaaaggttacgcagatctgtatagcctacattcatggtgcgggatcctggtgttcgtactttattttgtgcaatggcttgtaggctttagtttctttctgtttccaggtgcatccttttctctgcgatcaagatatcgaccccagcacatcttctttggagctacaatttttctcctctctgtcggcactgccttgctggggctcaaggaggccttgctgttcaatctcggaggtaaatacagtgcgttcgagcccgaaggagttctggctaacgtgttgggtctactgctggcatgcttcggtggtgcagtattatatatactgacccgagcagactggaagcggccatctcaggccgaggagcaggcactcagcatggatttcaagactctgacagagggcgactctccaggatctcagtag

SEQ ID NO: 184381 - DNA, 756 bp, Artificial Sequence
  Description of Artificial Sequence: Synthetic coding sequence
atggagggcggcgccgccgccgccacccccaccgccctgccctactacgttgcgttcagtcagctactcggtctgacactggttgccatgaccggagcttggttgggcctgtatcgagggggcatcgcctgggaaagtgatctgcaatttaatgcgcaccctctctgcatggttatcggacttatattcctgcagggcaacgcccttctggtttaccgtgtgttcagaaatgaagccaagagaacaacaaaagttctccatggattattgcacatttttgccctcgtcatcgcactggtcggattggttgccgtttttgactaccaccgaaagaagggatacgctgacctctacagcctgcacagctggtgcggcatcctagtgttcgtcctgtattttgtccagtggttggtcggtttctccttctttctgttcccaggtgccagcttcagcttgaggagccgctacagaccacagcacattttttttggcgccaccatcttcctcttgagcgtggggacagccctgcttggcctgaaagaggccctgctgtttaatttgggaggtaagtactccgccttcgaaccggagggggttttggcaaacgtccttggccttcttcttgcttgttttggcggtgccgttttatacatacttacgcgggcagactggaagcgtccgtctcaggctgaggaacaagcactttcaatggacttcaagacattgaccgagggcgattcacctggtagccagtag

SEQ ID NO: 184382 - DNA, 756 bp, Artificial Sequence
  Description of Artificial Sequence: Synthetic coding sequence
atggagggcggcgccgccgccgccacccccaccgccctgccctactacgtggctttcagccagttactcggactcacgctcgtggccatgacaggagcctggctcggactttaccggggaggcattgcttgggagtccgaccttcagttcaacgcgcatcccctgtgcatggtgattggcctgattttcctgcaagggaatgcactgctagtgtatagagtgttcaggaatgaggccaagagaaccactaaggtcttgcacggcctgcttcacatcttcgcactcgtcattgcactggtagggctggtggcagtctttgactaccaccgaaaaaagggctatgcggatctgtactcactccatagttggtgcggcattctcgtttttgttctgtatttcgtgcaatggctggttggcttcagtttctttctgtttccaggagccagcttttccctgagaagccggtacagacctcagcatattttcttcggcgccaccatcttcctgctcagcgtaggtacagctttgctgggactgaaggaggccctcttatttaacctgggcgggaaatacagtgctttcgagcccgaaggagtgctggccaatgtgctgggcctgctgttggcgtgcttcggcggcgctgtcctttacatcctgacccgtgcagactggaagcgcccctcacaggcagaggaacaggcgctgagcatggacttcaagacccttaccgagggcgacagccccggaagccaatag

SEQ ID NO: 184383 - DNA, 417 bp, Artificial Sequence
  Description of Artificial Sequence: Synthetic coding sequence
atggagggcggcgccgccgccgccacccccaccgccctgccctactatgtggccttctctcaacttctgggtttaactctggtggccatgaccggtgcatggctgggcttgtatagaggcggaatcgcttgggagtctgaccttcaattcaacgcccacccactttgcatggtcattggactcatttttctgcagggaaacgccctgctggtttacagggtgtttcgcaacgaggcaaaacgcacaactaaggtgctccacgggttgcttcacatttttgctctagtgatcgccctggtgggtttggtcgccgtgttcgactaccaccgcaagaaggggtacgcggatttatactctctccatagctggtgtggcatcttggtgtttgtgctatatttcgtgcagggccaggtttag

SEQ ID NO: 184384 - DNA, 957 bp, Artificial Sequence
  Description of Artificial Sequence: Synthetic coding sequence
atgaagcagaagaccaagcccggcaccggccccctgagcagcctggagttcggcgtgagtttcttagcgccatctccccacatggagttgctggcttcatgcccccggagccggttgagcccttggggcggatgggcccctcctcctagccacagccgcgatctgcggcccttacctcaggacgacggagtgtgcctgagcatggaggggggagcagcagccgccacccccacagctctaccctattacgtggcattttcacagctcttgggcttgacgctggtcgccatgactggagcttggctgggactctatagaggtggtatcgcctgggagtcggatctccagtttaatgcgcatccactttgcatggtcattggattaatatttctgcaggggaacgctttgctggtgtatcgagtgttcagaaacgaggcaaagcggaccactaaggtgctccacggattgctccacatattcgcgctcgtgattgcattggtcggcttggtcgctgtctttgattaccaccgcaagaagggctacgccgacttgtattcgctccacagctggtgtggcattctggtgttcgtactctatttcgttcagtggctcgttggattctctttttttttatttccaggcgcaagtttctctttacggtcgcggtaccgcccacaacacattttcttcggagcaaccattttcctgctgagcgtcggaactgcactgttgggtcttaaagaagcattactctttaatctcggaggcaagtatagcgcatttgaacccgagggggttctggctaatgttctagggctcttgctggcatgctttggcggcgcagtcctgtacatcctcaccagagcggattggaagaggcctagccaggcggaggagcaagccctcagcatggatttcaagacactcaccgagggcgactctcccggttcccaatag

SEQ ID NO: 184385 - DNA, 1143 bp, Artificial Sequence
  Description of Artificial Sequence: Synthetic coding sequence
atgggcagcggctgccggatcgagtgcatcttcttcagcgagttccaccctacacttggaccgaagattacctatcaggttcctgaggattttatatctcgggagctgttcgacactgtccaagtgtacatcatcacgaagccagagctgcagaataagctcatcacagtcacagcaatggaaaagaaactcataggatgccctgtctgcatagagcacaaaaagtacagccggaatgctctgctgttcaatttaggatttgtgtgcgacgcccaggctaagacatgcgccctggagcctattgtgaagaagctagctggttacttgactacccttgaactggagtcttccttcgttagcatggaggaaagcaaacagaagctggttcccattatgaccatactcctcgaggaattgaacgctagtggccggtgtactttgcctatcgatgaaagtaacactatacacctcaaggtaatagagcagcgcccagaccctcccgtagcacaagaatacgatgtcccagtttttacaaaagataaggaagatttcttcaacagccagtgggacttaaccactcagcaaattttgccttacattgacggctttaggcacatccagaagatctcagctgaagcggatgtcgagctgaacctggtccggatcgctatccaaaatctgctctattatggagtggtcaccttggtgtcaatcctgcagtactccaatgtgtattgtcccacccccaaggttcaggatttggtggatgataaaagccttcaggaggcctgcttgagttacgtgaccaaacagggccacaaacgcgccagcctgagagatgtgttccagctgtactgttccctgagccccggtacgacagttcgagacctcatcggccgtcaccctcaacagctgcagcacgtggacgagagaaaactcatacaattcggtctgatgaaaaacctgatcagacggctgcagaagtacccagttagagtcactcgggaggagcagtcacatcctgctcgcctgtataccgggtgccacagttacgatgagatctgctgcaagacgggcatgtcctaccacgaactggacgagcggttagaaaacgatcctaacattataatttgttggaaatag

SEQ ID NO: 184386 - DNA, 669 bp, Artificial Sequence
  Description of Artificial Sequence: Synthetic coding sequence
atggccctgagcgccgagaccgagagccacatctaccgggccctgcgcaccgcctcaggtgccgccgcccacttggtggctcttggctttactatcttcgtggcagtcctcgccaggcctgggtccagtctcttttcttggcaccccgtgttgatgagcctcgcgttttccttcctgatgaccgaagcactgcttgttttcagcccagagtcttccctgctccactcactgagccggaaaggccgagccagatgtcactgggtcctccaattgttggccctcttgtgcgccctactgggactgggtctggtgatcctccacaaagaacagttgggaaaagcccatctggtcacgaggcacggccaagcggggttactggccgtgctgtgggcgggtctgcaatgctccggcggtgtgggactcctgtacccaaagctgcttccccgatggcccctcgccaaactgaagttgtatcatgccacatccgggctagtcggataccttctgggatctgcgtcactcttacttggtatgtgtagtctctggttcacagcctctgtcacaggggcagcgtggtatctcgcggtcctttgcccggtactgactagtctggttataatgaatcaggttagcaacgcctatctgtaccgtaaaagaatccaaccttag

SEQ ID NO: 184387 - DNA, 669 bp, Artificial Sequence
  Description of Artificial Sequence: Synthetic coding sequence
atggccctgagcgccgagaccgagagccacatctaccgggccctgcggaccgcctcgggggccgcagcccatctcgttgctctcgggtttaccattttcgtggccgtattggctcgccccgggtcctctttattctcgtggcaccccgtgctaatgtccctggctttctctttcctaatgactgaggcacttctggtattttcccccgagagtagcctcctgcacagcctcagccgaaaaggtagggctcgttgtcattgggtcctacagctattggctcttctttgcgccctactgggcctgggccttgtgatcctacataaagaacaactcggcaaggcccatctagttactaggcatgggcaggcaggtctgctagcagtgctgtgggcaggtcttcaatgtagcggtggggtcggccttctgtaccctaaactgctccctcggtggcccttggcaaaacttaagttgtatcacgccacctccggcctggtggggtatcttctggggagcgctagcctactgctggggatgtgtagcctatggtttactgcatccgtgaccggcgctgcttggtacctggctgtgctttgcccggtgctaacaagtctggttataatgaatcaggtgtccaacgcatacctgtatcggaaaaggatccagccctag

SEQ ID NO: 184388 - DNA, 669 bp, Artificial Sequence
  Description of Artificial Sequence: Synthetic coding sequence
atggccctgagcgccgagaccgagagccacatctaccgggccctgcgcactgctagcggcgccgcggcacacttagtcgcccttgggtttaccatctttgtggccgtactcgcacgaccggggagcagcttgttctcctggcacccagttctgatgagcctggccttctccttcctgatgacagaagccctcctagtgtttagtccagaatccagtcttctgcatagcttgagccgaaaggggagagcccgatgccactgggtccttcaactcctcgccctgttatgcgcacttcttggcctgggcttggtaattctgcacaaagagcagctaggcaaggcccacctggttaccaggcatgggcaggccggattgctggcagtgctttgggccggattacagtgctcaggcggtgttgggctcctctatcccaagctacttccaaggtggccgctggctaagcttaaactctatcacgccacatccgggctcgttggatacttgttgggctctgcttctctcctgcttgggatgtgctcgctttggtttaccgccagcgtgactggagctgcttggtacctggccgttctgtgtcccgtgctcacatccctggttataatgaatcaggttagcaatgcctacctctatagaaagcgcatccaaccatag

SEQ ID NO: 184389 - DNA, 696 bp, Artificial Sequence
  Description of Artificial Sequence: Synthetic coding sequence
atgggcggcctgtggcggcccggctggcggtgcgtgcccttctgcggttggcgctggatccacccaggttcacccacaagggccgccgaacgcgtcgaaccgtttctgcggcccgagtggtctggaacaggaggagctgaacgcggactccgatggttgggtacctggaagagatgcagtctgagggctagacaccctgcactgcagccaccaaggagacctaagagttctaaccccttcacaagagcccaggaggaggagaggcggaggcagaataagactactctcacatatgtggccgcagtggctgttggaatgctgggggcctcgtacgccgccgtcccattatatcgcttatattgtcaaaccaccggactgggaggcagcgccgtagccggacacgcctcggataaaatcgaaaatatggtccctgtgaaagaccggattattaagatctctttcaacgccgacgttcacgcgtcattgcagtggaacttccggccccagcaaaccgagatatacgttgtccccggtgaaaccgccctggccttctaccgagccaaaaatccaaccgataagccagtcatagggatttctacctataacatagtcccctttgaagccgggcagtattttaacaaaatacaggcatccaaactccatcgcgtgtacgtgctggagtcttggcacctgtag

SEQ ID NO: 184390 - DNA, 510 bp, Artificial Sequence
  Description of Artificial Sequence: Synthetic coding sequence
atgctggccacccgggtgttcagcctggtgggcaagcgggccatcagtacaagcgtgtgcgtgagggcccatgagtctgtggtcaaaagcgaagacttttcgctccccgcttatatggatcgccgcgaccatcctctgccagaagtggcccacgttaagcatctttctgcctcgcaaaaggccctgaaggaaaaggagaaggcatcctggtcaagtctttctatggatgaaaaagtagagttgtataggataaaatttaaagaaagcttcgccgagatgaatcgtggatccaatgagtggaaaactgtcgttggcggtgctatgttttttattggattcactgcccttgtgattatgtggcagaaacattacgtttatggccccctcccccaatcattcgacaaagagtgggttgctaaacagaccaagaggatgttagacatgaaagtcaacccaatccaaggactggcaagtaaatgggactatgaaaaaaatgagtggaagaaatag

SEQ ID NO: 184391 - DNA, 516 bp, Artificial Sequence
  Description of Artificial Sequence: Synthetic coding sequence
atgctgccccgggccgcctggagcctggtgctgcggaagggcggcgggggacgtaggggtatgcactctagcgaggggacaacccgcggcggtggtaagatgagcccttatactaactgttacgcccaaagatattacccaatgcccgaggaaccgttctgcactgaactgaacgcagaagagcaggcgctgaaagagaaagagaagggcagctggacgcagttgacccacgccgagaaggtagccctctatcgcttgcaattcaacgagacattcgcggagatgaatcgacggagcaacgaatggaaaaccgtgatgggctgcgtgttcttttttattggatttgcagcccttgtcatctggtggcagcgcgtgtatgtgttcccccccaaaccaattacgctgaccgatgagaggaaggcacagcagcttcagagaatgctggatatgaaggtcaacccagtccagggcctggcctctcgctgggactacgagaagaaacagtggaagaagtag

SEQ ID NO: 184392 - DNA, 390 bp, Artificial Sequence
  Description of Artificial Sequence: Synthetic coding sequence
atggccagccggctgctgcggggcgccggcaccctggccgcccaggctctgcgtgcacgggggccttctggtgccgccgccatgagaagtatggcctccggcgggggtgtgcccactgacgaagagcaagctaccgggctcgagcgtgaaataatgctggctgcgaaaaaaggtctcgatccttataacgtcctcgcccctaaaggagccagcggcacacgcgaggaccctaacttagtaccatcaatatccaacaagcggattgtgggatgcatctgcgaggaggataacacatccgtcgtgtggttctggctgcacaagggggaagcccagagatgtccaaggtgcggtgcgcactataagctcgtgccgcagcagctggcgcactag

SEQ ID NO: 184393 - DNA, 606 bp, Artificial Sequence
  Description of Artificial Sequence: Synthetic coding sequence
atggcccgggactacgaccacctgttcaagctgctgatcatcggcgattctggagtgggaaaaagcagcttgcttctgcggtttgccgacaacacattttctgggtcgtacataaccacaatcggggtcgatttcaagattcgcacagtggaaatcaacggggagaaggttaagcttcagatttgggacacagctggtcaggaacggttcagaaccatcacttcaacttactacagaggtacccacggagttatcgttgtctatgatgttaccagcgccgagagtttcgtcaatgtgaagcgatggttgcacgagatcaatcagaactgcgatgatgtgtgccggattctcgtcggaaataagaatgatgaccctgagcgaaaggtcgttgagactgaggacgcttacaagtttgcgggccagatgggtatccagcttttcgagacgagtgccaaggagaatgtaaatgtggaggagatgttcaactgcatcaccgagttggttctgcgagcaaagaaggataatctggctaagcagcaacagcaacagcaaaacgacgtggtcaagctgaccaaaaacagcaagaggaagaaaagatgttgttag

SEQ ID NO: 184394 - DNA, 261 bp, Artificial Sequence
  Description of Artificial Sequence: Synthetic coding sequence
atggccgaggacatggagaccaagatcaagaactacaagaccgcccctttcgactcccggtttcccaaccagaatcaaacacgcaactgttggcagaattatttggatttccatagatgtcagaaggccatgaccgccaaggggggagatatttccgtgtgcgagtggtaccaaagagtctatcagtctctttgtcccacatcttgggtgacagactgggacgagcagcgtgccgaaggtactttccccggtaaaatctag

SEQ ID NO: 184395 - DNA, 312 bp, Artificial Sequence
  Description of Artificial Sequence: Synthetic coding sequence
atgcacccccacccccagatccccggccgggacctggccggcttcagtactatggcagaagatatggaaaccaagatcaagaactataagactgcgcccttcgactcacgcttccccaaccagaaccagactaggaactgctggcagaactatctggattttcacagatgtcagaaggctatgacggctaaaggaggtgatatctccgtatgcgagtggtatcagcgggtgtaccagtcgctctgtccaaccagctgggtgaccgattgggacgaacagcgggcagaaggcacctttccagggaaaatttag

SEQ ID NO: 184396 - DNA, 228 bp, Artificial Sequence
  Description of Artificial Sequence: Synthetic coding sequence
atggcccccgaggtgctgcccaagccccggatgcggggcctgctggcccgccggctgagaaaccatatggcggtggcatttgtgctgtccctaggcgtggcagccctgtacaaatttagggtggctgatcagcgcaagaaagcgtatgctgacttctacaggaactacgacgttatgaaggacttcgaggagatgaggaaagccggcatcttccagtccgttaagtag

SEQ ID NO: 184397 - DNA, 228 bp, Artificial Sequence
  Description of Artificial Sequence: Synthetic coding sequence
atggcccccgaggtgctgcccaagccccggatgcggggcctgctggcccgccggcttagaaaccacatggccgtggcgtttgtcttaagcctgggcgtagcagcgttgtacaaattcagggtggccgaccaacggaagaaggcttatgcggatttctatagaaattacgatgtcatgaaagactttgaagagatgcgaaaggccggcatttttcagtctgtaaagtag

SEQ ID NO: 184398 - DNA, 228 bp, Artificial Sequence
  Description of Artificial Sequence: Synthetic coding sequence
atggcccccgaggtgctgcccaagccccggatgcggggcctgctggcaagacgattgcgcaatcacatggccgtggcatttgtgctctcgcttggcgtggccgccttgtacaaatttagagttgcggatcagaggaagaaggcctacgccgatttttataggaactatgacgtgatgaaggatttcgaagagatgcggaaagccgggatcttccagtcagttaagtag

SEQ ID NO: 184399 - DNA, 228 bp, Artificial Sequence
  Description of Artificial Sequence: Synthetic coding sequence
atggcccccgaggtgctgcccaagccccggatgcggggcctgctggcccggcgactccgcaatcacatggccgttgcttttgtcctcagcctcggcgttgccgcgctctacaaatttagagttgctgatcaaaggaaaaaagcttatgcggacttttacagaaattacgatgtgatgaaggattttgaagaaatgcgcaaagctggcatcttccagtccgttaagtag

SEQ ID NO: 184400 - DNA, 228 bp, Artificial Sequence
  Description of Artificial Sequence: Synthetic coding sequence
atggcccccgaggtgctgcccaagccccggatgcggggcctgctggcgcgaaggctgagaaatcacatggccgtggccttcgtattgagcttaggcgtggcagcgctctacaagttcagagttgctgaccagagaaagaaagcttatgctgatttctatcggaactacgatgtcatgaaagattttgaagagatgcgcaaggccggaatctttcagagcgttaaatag

SEQ ID NO: 184401 - DNA, 228 bp, Artificial Sequence
  Description of Artificial Sequence: Synthetic coding sequence
atggcccccgaggtgctgcccaagccccggatgcggggcctgctggccagaaggctgcgcaatcacatggccgttgcttttgtgctgtctctgggagtggccgctttgtataaatttagggtggcagaccagcgcaagaaagcctatgctgacttttatcgcaattatgatgtgatgaaggacttcgaggaaatgagaaaagctggtatcttccagtctgtaaagtag

SEQ ID NO: 184402 - DNA, 228 bp, Artificial Sequence
  Description of Artificial Sequence: Synthetic coding sequence
atggcccccgaggtgctgcccaagccccggatgcggggcctgctggcgaggcggcttcgcaatcatatggctgttgcattcgtgctctccctcggcgtcgccgcactctataagtttagagtggcagatcaacggaagaaagcctatgccgatttttaccgtaactatgatgtgatgaaggatttcgaggagatgcgcaaggcaggcatcttccaaagcgtgaagtag

SEQ ID NO: 184403 - DNA, 228 bp, Artificial Sequence
  Description of Artificial Sequence: Synthetic coding sequence
atggcccccgaggtgctgcccaagccccggatgcggggcctgctggccagacgcctgcgaaaccacatggcggtggccttcgtgttatcactcggggttgcagccttgtacaaattccgggtagcagatcagcgcaaaaaagcctatgctgacttttatcgaaactatgatgtcatgaaagacttcgaagagatgagaaaagctggtatcttccaaagtgtcaaatag

SEQ ID NO: 184404 - DNA, 228 bp, Artificial Sequence
  Description of Artificial Sequence: Synthetic coding sequence
atggcccccgaggtgctgcccaagccccggatgcggggcctgctggcacgacggctgaggaatcacatggcggttgcgttcgtccttagtctgggagtggcggctctgtacaagttccgcgtcgccgaccagagaaaaaaggcgtacgccgacttctatcgaaattacgacgttatgaaagatttcgaagagatgagaaaagctggtatttttcagtcagtgaagtag

SEQ ID NO: 184405 - DNA, 228 bp, Artificial Sequence
  Description of Artificial Sequence: Synthetic coding sequence
atggcccccgaggtgctgcccaagccccggatgcggggcctgctggcccggcgactgagaaaccatatggccgtagccttcgtcctttctctcggtgtggctgccctttataagttccgcgtagccgaccagcgcaaaaaagcctatgctgacttctacaggaactacgatgtgatgaaagactttgaagagatgagaaaggctggaatattccagtcagtgaagtag

SEQ ID NO: 184406 - DNA, 240 bp, Artificial Sequence
  Description of Artificial Sequence: Synthetic coding sequence
atgcaggccctgcgggtgagccaggccctgatccggagcttcagcagcactgcccggaatagattccagaatcgagttagagagaagcagaagctctttcaggaggataatgacatccccttatacctgaaagggggcattgtggacaatattctgtaccgagttacaatgacgttatgtttaggcggcacagtttattctttgtatagcctcgggtgggcctcttttcctagaaattag

SEQ ID NO: 184407 - DNA, 330 bp, Artificial Sequence
  Description of Artificial Sequence: Synthetic coding sequence
tgaagcttctgggtgctgagcctgcccggccccagccggcagcccggacacccacaagctcgtcttcagggcgaaagtcctcccaaccctgcgggttcatcgagagtgtcccaggccctcatacgcagcttcagctctaccgctcgcaatcgcttccagaacagggtccgcgagaagcagaaactgtttcaggaagacaatgacattccactctatctgaagggagggatagtagacaacatcttatatcgtgttacaatgacactttgcctcggagggacagtgtacagcctatactcccttgggtgggctagttttcctcggaactag

SEQ ID NO: 184408 - DNA, 2775 bp, Artificial Sequence
  Description of Artificial Sequence: Synthetic coding sequence
atgagccggagccggcagccccccctggtgaccggcatcagccccaacgagggcatcccatggaccaaggtgaccattcgaggggaaaacctgggtacggggcccaccgacttgatcgggctcacgatatgcgggcacaattgcctgttaaccgctgagtggatgagcgcttccaagatcgtgtgtcgcgtcggccaggccaagaatgataaaggcgatatcatcgttaccaccaaatcaggaggacgtggcaccagcacagtaagctttaagctgctcaagcccgagaagataggcatcctcgatcagtctgccgtgtgggtggacgagatgaattattacgacatgcggaccgacaggaataaaggaatcccgcctctgtctctgcggccagctaacccactcgggattgagattgaaaaaagtaagttttcccagaaagacctcgagatgttatttcacgggatgtctgcagatttcactagcgagaatttttccgccgcatggtacctaatcgaaaatcactctaatacatctttcgagcaactgaaaatggccgtgaccaacctaaaaaggcaggccaataagaaatcagagggatccctggcgtacgttaagggaggtctgtcgacttttttcgaggcccaggacgcactgtctgctatacatcaaaaattagaagccgacggcaccgagaaggtggagggttctatgacacaaaaactggaaaatgtgctcaaccgtgcatcgaacacagcggatactctgtttcaggaggtgctgggacgtaaagataaggctgactcaacacgcaatgccttgaatgttctacagcgcttcaaattcctttttaacctcccgttgaatatcgagagaaacattcaaaaaggcgactatgatgttgtgattaatgattatgagaaggctaagtctcttttcgggaagaccgaggtccaggtttttaaaaagtactatgccgaggttgagacccggatcgaagctctccgtgaactgctgttagacaaactcttggagaccccctctaccttgcacgatcagaagaggtatatcagatacttgtctgacttgcatgcaagcggcgatccagcgtggcagtgtattggagcacagcacaagtggatcctccaactaatgcatagttgtaaggaggggtacgtgaaagatcttaaagggaacccgggacttcactccccaatgctggatctcgataatgacacccggccgtccgtgttggggcatctgagccaaaccgcctctctgaaacgcgggagtagctttcagagcggaagggacgacacctggaggtataaaacgccacatagggtagcctttgtcgagaagctcactaagcttgttctgagccaactacccaatttctggaaactctggatctcctatgtaaacggaagcctgttctctgaaacagctgagaagagcggccaaattgaaagaagtaaaaacgtgcggcagaggcagaacgacttcaagaagatgatccaggaagtgatgcatagcttagtgaaactgacgcggggcgctctgctgcccctgtccatacgagacggcgaagcaaagcaatacggcggctgggaggtcaagtgtgagctgtctggccagtggctggcccacgcaatacagacggtgcgcctaactcacgagtccctaacggcccttgagatacccaatgacttgctgcagaccatccaggatcttattctcgatctgagggtgaggtgcgtcatggccactctgcagcacactgcggaagagataaagagactggccgagaaggaagactggattgttgataatgagggcctaacctccttgccttgtcagtttgagcagtgtatcgtatgtagccttcaaagccttaagggagttctggagtgtaaaccaggcgaggcgtccgtgttccagcagccaaagacccaggaagaagtgtgtcagctgagtatcaacattatgcaggtcttcatttactgtctcgaacagctgtccactaagcctgatgctgacattgatactacccacctatcggttgacgtttctagcccagaccttttcggttctatacacgaagatttcagcttgacctccgaacagcgactcctgattgtgctcagcaactgctgctacctcgagaggcatacttttttaaatatagcagaacactttgagaaacacaactttcagggcatcgagaaaattactcaggtatccatggcgagcctgaaggaactggaccagcgcctgttcgagaactacatcgaactcaaagctgaccccattgtaggcagtcttgagccagggatttatgccggttatttcgactggaaagattgcctgcctcccaccggggtccgcaactacttgaaagaagcactcgtgaatattattgctgtgcacgccgaggtcttcaccattagcaaagagttagtccctcgagttttgagcaaggtgattgaggcagtgtccgaagagctgtcgaggctcatgcaatgcgttagctctttcagcaaaaatggggccctacaggctcgcctcgaaatctgcgctttacgggacaccgtcgcggtgtacctgactcctgaatccaagagctctttcaaacaggccctggaggccctgccacagctgagttccggggccgacaagaaacttctggaagaactgcttaataagttcaagtcttcaatgcatttacaattaacttgttttcaggcagcctcatctacgatgatgaaaacttag

SEQ ID NO: 184409 - DNA, 348 bp, Artificial Sequence
  Description of Artificial Sequence: Synthetic coding sequence
atgcacacccaggacagcgaggtggtgcccgtgcccgcctggccctttagtttggttgttttctcttgtggaggatgttggtccgtgacagcaaaaatgctcagaaatctcctggcgctccggcagattggacaacgaaccatttccacagcgtcaaggcgacacttcaagaataaagtgcccgaaaagcagaagctgttccaggaagacgatgaaatacccctgtacctgaagggcggagtggctgacgcgctgctatatcgtgctactatgattcttactgtgggtggaaccgcatacgcaatctacgaactagctgtggccagctttccgaagaagcaggaatag

SEQ ID NO: 184410 - DNA, 348 bp, Artificial Sequence
  Description of Artificial Sequence: Synthetic coding sequence
atgcacacccaggacagcgaggtggtgcccgtgcccgcctggcccttttccttggtagtttttagttgtggcggatgttggtcagtgactgctaagatgctcaggaatctgctggccttgagacagatcgggcagcgaactatttcaaccgccagccggcgacactttaagaacaaagttcctgagaaacagaaactattccaggaagatgacgaaatacccttgtatttgaaggggggggtcgccgatgctctgttgtatagagccacaatgatcctgaccgtgggtggaaccgcatacgcaatttacgagctcgccgtggcctcgtttccaaaaaaacaggagtag

SEQ ID NO: 184411 - DNA, 1734 bp, Artificial Sequence
  Description of Artificial Sequence: Synthetic coding sequence
atgagcaagcccgagctgaaggaggacaagatgctggaggtgcacttcgtgggggacgacgatgtcctaaatcacatcctcgacagagaggggggagccaaacttaagaaggagcgtgctcagctgctggtgaaccccaagaagatcattaaaaaacctgagtacgaccttgaagaagatgaccaagaggttttgaaggatcagaactatgtggaaattatggggcgcgatgttcaagaatcactgaagaacggtagcgccaccggcggtggcaataaggtgtatagcttccagaatcggaaacacagcgaaaagatggccaaactggcttctgaactggccaaaaccccacaaaagagcgtgtcatttagcttgaaaaacgaccctgagatcaccattaatgtcccacagagtagcaaagggcacagtgcctccgacaaggttcaaccgaagaataatgacaagtccgagttcctctctactgctcctcggtcattgcgtaagaggttgattgtgccccgaagccacagtgacagcgaaagcgagtacagcgcctccaacagcgaggacgatgagggtgttgcccaggaacatgaggaggataccaacgccgtaatcttctcacagaaaatccaggcacagaatagagtcgtaagcgccccagtagggaaggagactccatccaaaaggatgaagagagacaagacatccgatctggtggaggaatacttcgaagcccactcctccagtaaggttttgaccagtgacagaaccttgcagaagttaaagcgcgctaagttagatcaacaaaccttacggaatttactgtccaaagtttcgccatctttttcagctgagttaaagcagctaaatcaacaatacgaaaaactttttcataagtggatgctccaacttcatctgggattcaacatagtgttgtacgggcttggctcaaaaagagacctactcgaaagattccggaccactatgctacaggatagcatacacgtggtgatcaatgggttcttcccaggcataagtgtcaagtcagtgctgaacagcatcaccgaagaagtccttgatcatatgggcacttttcgcagcattctggatcaactggactggatcgtgaataaattcaaggaagatagctccttggagctgttcctgctgattcacaaccttgacagtcagatgttaagaggagagaagtcccagcaaataatagggcagttgtccagtttacataatatatatttaatcgcatcaattgaccatctaaacgcccccctcatgtgggatcatgcaaagcagtccctattcaactggttatggtacgaaacaaccacgtattccccatacaccgaggaaacatcttatgagaattccctgctggtgaagcagagtggcagtttgccactgtcttcgttaacccacgtcctccgatcgctgacgccgaatgcccggggcatcttccggttgctgatcaaataccagttggataaccaggacaatccttcgtatattgggttgagcttccaggatttctaccagcagtgtcgcgaagcgtttcttgttaattcagacctgacattacgggcgcaactcaccgagttcagagatcataagctgattaggaccaaaaaagggacggacggtgtagagtatctgctcattcctgtggataacgggaccctaacagactttctcgagaaagaggaagaggaagcctag

SEQ ID NO: 184412 - DNA, 345 bp, Artificial Sequence
  Description of Artificial Sequence: Synthetic coding sequence
atgtactacaagttcagcggcttcacccagaagctggccggcgcctgggcctccgaggcctactccccccagggacttaagccagttgtatccacggaggcacccccaatcatctttgccactcctacaaagctcacgtccgattctacagtctacgactatgccggaaagaataaagtgccagagctgcagaaattctttcagaaagcagatggtgtgcctgtttacttgaaaagggggcttcctgaccagatgctttacaggactacgatggccttaacagtgggtggcaccatatactgcctaattgctctgtatatggcctcccaacctaaaaacaagtag

SEQ ID NO: 184413 - DNA, 246 bp, Artificial Sequence
  Description of Artificial Sequence: Synthetic coding sequence
atgatgttccccctggcccggaacgccctgagcagcctgaagatccaatccatcctgcagagcatggctagacacagccacgtcaaacattcccccgactttcatgacaagtacggaaatgctgttttggcctctggaactgccttctgcgttgcgacatgggtgttcactgcaacacaaatcggtatagagtggaacttgtcccccgttggtagggtcacacctaaggagtggaaacaccagtag

SEQ ID NO: 184414 - DNA, 246 bp, Artificial Sequence
  Description of Artificial Sequence: Synthetic coding sequence
atgatgttccccctggcccggaacgccctgagcagcctgaagatccagagcattctgcaaagcatggcccgtcattctcacgtaaagcacagtccagactttcacgacaagtacggcaacgccgttctggcttccggcacagccttctgcgtggctacatgggtatttacagctactcagatcggaatcgaatggaatctgtctccagtcgggagggtgacccccaaagaatggaaacaccagtag

SEQ ID NO: 184415 - DNA, 246 bp, Artificial Sequence
  Description of Artificial Sequence: Synthetic coding sequence
atgatgttccccctggcccggaacgccctgagcagcctgaagatccagtctattctgcaatccatggctaggcattcacatgtaaagcattcccccgacttccacgataaatacggcaacgcagtattagccagcggcaccgcattctgcgtagccacctgggtgttcaccgccactcagattgggattgaatggaatctgtcccccgtgggaagagttacaccaaaggaatggaagcaccagtag

SEQ ID NO: 184416 - DNA, 99 bp, Artificial Sequence
  Description of Artificial Sequence: Synthetic coding sequence
atgatgttccccctggcccggaacgccctgagcagcctgaagatccagtccatcctccagagcatggcccgtcacagtcacgtaaagcactctccgtag

SEQ ID NO: 184417 - DNA, 243 bp, Artificial Sequence
  Description of Artificial Sequence: Synthetic coding sequence
atgttccccctggcccggaacgccctgagcagcctgaagatccagtctatcttgcaatctatggccaggcactcccacgtgaaacacagtcccgactttcacgataagtatgggaacgctgtgctcgcctctggcacagcattctgtgtggctacttgggtattcacagcaacacaaattggaatcgagtggaacctttcccctgtcggacgggtgactccaaaagaatggaagcaccagtag

SEQ ID NO: 184418 - DNA, 192 bp, Artificial Sequence
  Description of Artificial Sequence: Synthetic coding sequence
atgctgggccagagcatccggcggttcaccaccagcgtggtgcggcggtcacactatgaggagggaccggggaaaaatctgccctttagtgtagagaacaagtggagcctgttagccaaaatgtgtctttatttcggctcagcttttgctaccccgtttctcgtagtgaggcaccaactgctgaagacgtag

SEQ ID NO: 184419 - DNA, 192 bp, Artificial Sequence
  Description of Artificial Sequence: Synthetic coding sequence
atgctgggccagagcatccggcggttcaccaccagcgtggtgcggcgctctcattacgaggagggtcccggcaaaaacttgcctttctctgttgagaacaaatggagtctgctcgcgaaaatgtgcttgtatttcggaagtgcgttcgccacaccttttctggtcgtacgccaccagctgttaaaaacgtag

SEQ ID NO: 184420 - DNA, 978 bp, Artificial Sequence
  Description of Artificial Sequence: Synthetic coding sequence
atggccgccgccgccgccagcctgcggggcgtggtgctgggccccagaggtgccgggttgccaggtgcgcgagcacggggactgctctgctccgcacgtcccgggcagttacctctgaggacaccccaggccgtcgctttatcctctaaatcggggttgagtcgagggagaaaggtaatgttgtcagctctgggtatgctggctgctggtggggccggtctggccatggccctccactctgctgtctcagcaagcgacttggagctccatccacctagctacccttggagccataggggtttgttatcatcgctcgaccatacttcaattcgccgagggttccaggtgtataagcaagtatgcgcctcatgccattccatggatttcgtcgcttaccggcatcttgtaggggtgtgttataccgaggatgaagcgaaagaactagcggctgaggtggaagtacaggacggccccaacgaggacggagaaatgttcatgagaccaggtaaacttttcgactatttccccaagccttatccaaactccgaggccgctcgcgctgcaaataacggcgcactgccacccgacttgtcctacatagtgcgcgcccgccacggaggcgaggactacgtcttcagcctccttactggatactgtgagccccccacgggcgtatcattacgagagggactttacttcaatccctatttccctggccaggccatcgctatggccccgccaatctacactgatgttttggagttcgatgatggcacccctgccactatgtctcagattgccaaggatgtctgcacctttttgaggtgggcaagtgaaccagaacatgaccatcggaagaggatggggctgaaaatgttgatgatgatggccctgctggtccccctagtttacaccatcaaaagacacaagtggagtgtactcaaatccaggaagctggcatatcgaccccctaagtag

SEQ ID NO: 184421 - DNA, 252 bp, Artificial Sequence
  Description of Artificial Sequence: Synthetic coding sequence
atggagcccttcgtggtgctggtgctgtgcctgagcttcatgctgctatttagcctgtggcgccagagttgcagaagaagaaaattgccaccaggtcctactccactgccgatcatcggcaacatgctgcagatcgacgtcaaggacatctgtaagtcatttacaaatgtatctctgccatatgtaccacctgccaactgtaagggaagtcagaaatccatggtgctctgctcgccctgcatcctcgcttag

SEQ ID NO: 184422 - DNA, 219 bp, Artificial Sequence
  Description of Artificial Sequence: Synthetic coding sequence
atggagcccttcgtggtgctggtgctgtgcctgagcttcatgctgctcttcagcctttggaggcagtcctgtcgccgcagaaagctcccgcccggtcccacccccttacccattatcgggaacatgctgcagatcgacgttaaggatatttgcaaatcttttactaacgtgtcattgccatatgtcccgcctgcgaattgcaaaggcgttttgctttag

SEQ ID NO: 184423 - DNA, 423 bp, Artificial Sequence
  Description of Artificial Sequence: Synthetic coding sequence
atggacctgatccccaacctggccgtggagacctggctgctgctggccgttagtctcgtgctgttgtacctgtatggaacacgtacccatgggctctttaaacggctagggattcccgggcccacccctctccctttgctcggcaatgttctgagctatcggcaagggctgtggaaattcgatacggagtgttataagaagtatggcaagatgtgggggacttatgagggacagttgccagtcctggctatcaccgaccccgatgtcattagaaccgtgttagtgaaagagtgttattccgtcttcaccaatcgaagaatctgcgcaactactagtacaatcaaaatgcagacacattctgtcaccatgtggctacccccagctgttttgcaatcccagcatggcgtttgcttgttcctgtag

SEQ ID NO: 184424 - DNA, 1563 bp, Artificial Sequence
  Description of Artificial Sequence: Synthetic coding sequence
atgccccagctgagcctgagcagcctgggcctgtggcccatggccgcaagtccatggctattgctcctgctggtgggcgcaagttggctgctggccaggattctggcatggacttatactttttacgacaattgctgccgcctgcgctgctttccacagcctccaaaacggaactggttcttagggcacttggggctggtgacccctacagagcagggaatgcgagtactcacacaactggtggctacctatccccagggattcaaagtatggatgggcccaattttcccggttatccggttctgccatccaaacattatccgaagtgtgatcaacgcctccgctgcaattgtgcccaaggataaggtgttttatagtttcctcaaaccctggctgggagacggtttgctgctgtccgcaggggagaagtggtccaggcatcgccggatgcttaccccagcctttcattttaatattctcaaaccttatatgaaaatcttcaatgaatctgtcaatatcatgcacgccaaatggcaattgctggcatctgagggatcagcccgactggatatgttcgagcacatcagcttgatgaccctggatagtctgcagaaatgcgtgttcagcttcgacagccattgtcaggaaaaaccgtcagagtacattgccgcaatcctcgagctgtcagccctggtgacgaagcggcatcagcagatcctcctgtacattgacttcctttactacctcacaccggacggacagaggtttagacgcgcctgtaggttagtgcacgacttcacagacgcagtaatccaggagagacgcaggaccttacctagccagggggtggatgattttcttcaggctaaagctaagtccaagacgttagattttatagacgtgttactgctttcaaaagacgaagatggtaagaaactgtccgacgaggatatccgcgccgaagcagatacattcatgtttgaaggccacgatacgaccgcatccggactgtcctgggtcttgtatcacttggctaaacaccctgagtaccaggaaagatgcagacaggaggtgcaggagcttctgaaggaccgagagcccaaggaaattgagtgggacgatctcgctcaactcccctttctcactatgtgtatcaaggaatcattaaggctccatccacccgtacccgccgtcagcagatgctgcacccaggatatcgtgctgcctgacgggagggtgatccctaagggtattatctgcctgatttctgtgtttggcactcaccacaacccagccgtttggcccgatcctgaagtctatgatcccttccgcttcgaccccaagaacattaaagaacgctctcctttggcgttcataccctttagcgcggggcctcggaactgcattggccaggcctttgcaatggccgagatgaaggtggtgcttggtctgaccctgctccggttcagagtactgccggaccacaccgaacctcgtagaaaaccagagctagtgcttcgcgctgagggcggtctgtggttgcgtgtggagcctctcagttag

SEQ ID NO: 184425 - DNA, 1455 bp, Artificial Sequence
  Description of Artificial Sequence: Synthetic coding sequence
atgctgttccccatcagcatgagcgccaccgagttcctgctggcctctgtcattttctgccttgtcttttgggttattagagcctccagacctcaagtgccaaaaggcctgaagaaccctccaggcccatggggctggccattgatcggccacatgcttacgttgggaaaaaatcctcacctcgctctctctcggatgtcccagcaatatggagacgtactgcaaatccggataggatccacccccgtggtagtgctgtcggggctagacaccattagacaggccctcgttcgacagggggacgatttcaaaggcaggccagatctgtacaccttcacgttaatttctaacggtcagtcaatgtcctttagtccagattccggccctgtctgggctgcgagacgtagactggcgcagaacggattgaagagtttctccattgcctcagatcccgcatcctcaacatcatgttatcttgaggaacatgtgtctaaggaggccgaggtgctcatttctaccctccaagaactcatggctggtccaggacacttcaacccttacagatacgtagttgtatctgtgaccaatgtgatctgtgcaatatgtttcggacgccggtacgatcacaatcaccaggagttgctgtccttggtcaacctgaacgcctttaaagacttgaacgaaaagttttactcttttatgcaaaaaatggtgaaagaacattataagaccttcgaaaagggccacatccgcgatatcaccgatagcctgatcgagcattgtcaggagaagcagctcgatgaaaatgcaaatgttcaactgtccgacgagaagattattaatatcgttctcgacctgttcggtgcagggttcgacaccgtgacaactgcaatttcatggtcattaatgtatctggtcatgaatccccgagtccaacgtaaaattcaggaagagctggacactgtgatcggacgctcccggcgtccacggttgtccgatagaagtcaccttccgtacatggaggctttcattttggaaaccttccgccactcttcctttgtccccttcaccatccctcattcgacaacacgcgatacttctttgaaagggttttacattcccaagggtcgttgtgtgtttgtcaaccagtggcagatcaaccatgatcaaaagctttgggtaaaccctagcgagttccttccggaacgatttcttacacccgatggagctatagataaggtgctatctgagaaagtaatcatctttggaatgggcaagagaaaatgcataggtgaaacaattgcacgatgggaggtatttctgtttcttgccatcctgttacagcgggtggagttttctgttccactcggtgtcaaggtggatatgacgcctatttatggcctgacaatgaagcatgcttgttgtgaacactttcaaatgcagctgaggtcatag

SEQ ID NO: 184426 - DNA, 1539 bp, Artificial Sequence
  Description of Artificial Sequence: Synthetic coding sequence
atgctgttccccatcagcatgagcgccaccgagttcctgctggcctccgtaatattctgcctggtcttctgggtgatccgtgctagccgaccacaggttcccaagggactgaagaatcctcccgggccatggggctggcccctgatcgggcatatgctgacacttggcaaaaacccccacctggccttatcccggatgagccagcagtacggcgatgttcttcagattcgcatagggagcacacccgttgtagtgttatctggcctggatacgatccgccaggcactcgttaggcagggagacgacttcaaagggagacccgatctctatactttcaccttaattagcaacggccagagcatgtcattctccccagacagcggacctgtctgggctgccagaaggcggctggcacagaacggacttaaatcttttagcattgcctcggatcccgccagctctacctcatgctatctggaagaacacgtgtctaaagaggcggaggtactgatctctacgttacaggagcttatggctggacctggccattttaacccgtacaggtacgtggtggtgagcgtcactaatgttatctgtgccatctgttttggtagaagatacgatcacaaccatcaagaattgttgtcccttgttaatctcaacaacaacttcggcgaggtcgtcggatcaggcaacccagcggatttcataccaatactgaggtacctgcccaaccccagtctgaacgcgttcaaggatctgaatgagaagttctacagtttcatgcaaaagatggtgaaggagcattataaaaccttcgaaaagggtcacatccgggatatcaccgacagcctgatcgaacactgccaagaaaagcagctggacgagaatgcaaatgtacaactaagcgatgagaagattatcaacattgtgctcgatctgttcggcgcagggtttgatactgtgacaacagccatcagctggagcctgatgtatctggttatgaatccgagggtccagcgcaagattcaagaagagttagataccgtcatcggccgaagcaggcgcccccggctaagcgataggtctcacctcccatacatggaggcttttatcctcgagacattcaggcactcttctttcgtgccatttactatcccccattcgactaccagggacaccagcctcaaagggttctacattccgaaaggccgatgtgtgtttgtgaatcagtggcaaatcaatcacgaccaaaagctgtgggtcaatcctagcgagtttcttccagagaggtttttgacaccagacggtgcgattgataaagtgctgtctgagaaggtgattatcttcgggatgggaaaaagaaaatgtattggggagaccatcgctcgctgggaagtgttcctgttcttagctatcctgctgcaacgcgttgaattctcagtgcctctaggcgtgaaagtagatatgactcctatctatgggttgacaatgaaacacgcatgctgtgaacactttcaaatgcagcttagatcttag

SEQ ID NO: 184427 - DNA, 1539 bp, Artificial Sequence
  Description of Artificial Sequence: Synthetic coding sequence
atgctgttccccatcagcatgagcgccaccgagttcctgctggcctcagtcattttctgcctcgtgttttgggtgatacgggcctcccgccctcaggtccccaaggggcttaaaaacccaccggggccctggggttggcccctgattggccatatgctgaccctgggaaaaaatcctcaccttgctctcagtcgcatgtcacagcaatatggcgatgtcttgcagattcgcatcggatcgacccccgtcgtggtgctatctggactggacactatacggcaggcgcttgtgaggcagggcgacgactttaaaggtcgtcctgacctctatacattcacactgatctcaaatggccagtccatgtcattttcacccgacagcggccccgtttgggctgcccggcgccgtttagcgcaaaatggccttaagagcttcagcattgctagcgaccccgcaagttctactagttgttacctggaggagcacgtgagcaaggaggcagaagttcttatttcaaccctgcaagaactaatggccggcccagggcacttcaatccttaccgctacgtggtggtgtccgttacaaacgtaatctgtgccatttgcttcgggcggcgttatgatcacaaccatcaggagttgttgtccctcgtgaatctgaacaacaatttcggggaggtggtcggctcaggaaacccagccgattttatcccaatcctgcgctacttaccaaacccttccctgaatgctttcaaagatctcaatgaaaaattttacagtttcatgcagaagatggtgaaggagcactataaaacttttgagaagggtcatatccgtgatatcaccgactccctgattgagcattgccaggagaagcagcttgacgagaacgctaacgtgcaactgagcgatgaaaagatcatcaacatagttttggatttattcggggctggatttgacacggtgacgaccgccatctcttggtcactgatgtatctcgtgatgaatccccgagtacagagaaaaatccaggaagagctggacactgtcattggcagatccagacggcccaggttgagtgatcgatcccatcttccatacatggaggcgttcatcctggagacctttaggcattcttccttcgtgcctttcaccatcccacattctactacgagagacacatcgttaaaaggtttctatattcccaaagggaggtgtgtttttgttaatcagtggcaaatcaaccacgaccagaaattgtgggtgaatccttccgagttcctcccagagagattcctgacacctgacggggctatcgataaggtgctcagcgagaaggtgatcatcttcggtatggggaagagaaagtgcattggggaaaccattgcaagatgggaggtcttcttatttcttgcaatcttgctgcagagggttgaatttagcgtaccgctcggtgtcaaggtggatatgactcccatttatggcttgacaatgaaacacgcctgctgcgagcacttccaaatgcaattgcgaagttag

SEQ ID NO: 184428 - DNA, 1452 bp, Artificial Sequence
  Description of Artificial Sequence: Synthetic coding sequence
atgctgttccccatcagcatgagcgccaccgagttcctgctggccagtgtgatcttctgtctggtgttctgggtgatccgggcctcccgacctcaagtccccaaaggactcaaaaaccctcctggcccctggggctggcccttaattggacatatgctgacactcggcaagaacccccacctagccctttcccgcatgagccagcagtacggtgacgtcctgcagatccgaataggtagtacacctgtggtcgtgctgtctgggctagacaccattcgccaggccctcgttcggcagggggatgattttaagggacgaccagacctctatacgttcaccctcataagtaatggccaatcaatgtctttctcccccgactctggtccagtatgggccgctagaagacgcctggctcagaacgggctgaagtccttctcaatcgccagcgatcccgcatccagcacatcctgttacctggaagaacatgtatccaaagaggccgaagtactgatatccaccctgcaggaactgatggctgggcctgggcacttcaacccttataggtacgtggtagtatctgtgactaatgtgatttgcgctatatgctttggaaggcgttatgatcataaccatcaagaactgctgagtctggtgaacctcaacaacaactttggcgaggtggtggggagtggcaacccggcagattttatcccaattcttcggtacttgcctaatccatctcttaacgcattcaaggacctgaacgagaaattctacagtttcatgcaaaaaatggtgaaagaacactacaaaactttcgagaaaggacacatccgagatatcaccgattccttgatagagcactgtcaagaaaaacagctggacgaaaacgctaatgtgcagttgagcgatgagaagatcatcaacattgtgctggacctgttcggcgccgggttcgacacagtcacaactgcaatttcgtggtcccttatgtatttggtcatgaacccacgcgtacaaaggaaaatccaggaagaactggacacagtcattggtcggtctcgccggcccagactgtcagatagatcacatctgccctacatggaggcctttatactcgaaaccttcaggcacagctcctttgtcccctttaccattccgcatagaaaattgtgggtaaatccctccgagtttctgcctgagcgatttttaacaccagatggcgcgatagacaaggtgctctccgaaaaagtgattatcttcggtatggggaagagaaagtgcattggcgagacgatcgccaggtgggaggtcttcctgttcctcgcaattttactccagcgcgtcgagtttagtgtacccttaggtgtaaaagtagacatgacaccaatctatggcttgaccatgaagcacgcctgctgcgaacacttccaaatgcaactgagatcatag

SEQ ID NO: 184429 - DNA, 1551 bp, Artificial Sequence
  Description of Artificial Sequence: Synthetic coding sequence
atggccctgagccagagcgtgcccttcagcgccaccgagctgctgcttgcctctgctatcttctgccttgtgttttgggtgctgaagggactcagacctcgggtacccaagggcctaaagtcccctcccgagccatggggttggcctctgctcggccacgtattgacactcggtaaaaatccccaccttgcgttatcccggatgtcacagaggtacggtgacgttcttcagatacgcattggctctactccggttcttgtcctctccagacttgacacgatccggcaggcgctcgtccgacaaggcgatgactttaagggccggcctgacctttatacctcaaccctcatcactgacggtcagtctctgacctttagcaccgattccggtcctgtttgggctgctcgccgacgcctggcacaaaacgcccttaacaccttctcaatcgcaagtgaccctgcctcaagttcgtcttgctacctcgaggagcacgtttcaaaggaggccaaggctctgatcagcagactccaagagcttatggccggacccggacactttgatccctacaatcaggtggtggtctcggtggccaacgtgatcggagccatgtgttttggccagcattttcctgagagtagtgatgaaatgctttctctcgtgaagaatacacacgagttcgtagaaaccgcctcctctggcaacccattagactttttccctatcctgagatacctcccaaatccggctcttcagaggttcaaagcgttcaaccagaggttcttgtggtttctgcagaaaaccgtgcaggagcattatcaagatttcgataaaaattctgtgcgggacatcactggggcgctgttcaagcactccaagaaggggcctcgagcatctggtaacctgatcccgcaggagaaaatcgtaaatcttgtcaacgatatctttggtgctggcttcgacaccgtgacaacagccatttcatggagcctcatgtatttagtaacaaaacctgaaatccagagaaaaatacaaaaagaactggatactgttatcggacgagagagaaggccacgtctgtccgatcgcccccaactgccatatctggaggctttcatattggaaacttttagacactccagtttcttaccatttactatccctcatagcacgacacgagacactacgcttaacggattctacatacccaagaaatgttgcgtgtttgtgaaccagtggcaggtgaaccacgacccagaactgtgggaggatccaagcgagtttcgacctgaaagatttctgacagcggatggcacagccattaataaacctttgtcggaaaagatgatgctcttcgggatgggaaagaggcgatgtataggagaagtgctcgctaagtgggaaatctttctctttctcgcaatcttgcttcagcagctggagttctccgttcctccaggggtgaaggtagacttaactcccatatatggcttaacgatgaaacatgccagatgtgaacacgtgcaggccaggttgcggttcagtatcaactag

SEQ ID NO: 184430 - DNA, 1512 bp, Artificial Sequence
  Description of Artificial Sequence: Synthetic coding sequence
atggccctgcgggccaaggccgaggtgtgcatggccgtgccctggctgtcccttcagcgagctcaagccctcggcacccgggcagcacgggtgccccgtacagtcctgcccttcgaggctatgccaagacgtcccggcaatagatggctgaggctcctacagatttggagggagcaaggttacgaagatttgcatctcgaggtgcatcagaccttccaggaactcgggcctattttccgctatgatctggggggggccgggatggtctgcgtcatgttaccggaggatgtggaaaagttgcagcaggtggacagcctgcacccacaccggatgtcgctcgaaccttgggtggcatacagacagcaccggggtcacaaatgcggtgtgttccttcttaacggacccgaatggagatttaatcggctgaggttgaaccctgaagtgttgtctccaaacgccgtccagaggttcctgcctatggtcgacgccgtggcacgagatttttcgcaagccctgaaaaagaaagtgcttcagaatgcccgcggttccctcactctcgatgtccaaccctcgatcttccactataccattgaggcaagtaacctggccctcttcggggagagactgggccttgtcggccattctccaagttccgcctcactgaatttcctgcatgctctcgaagtgatgttcaagagcaccgtgcagctcatgttcatgcctaggtccctctcacgatggactagccccaaggtgtggaaggagcactttgaggcttgggattgcatctttcagtacggcgataactgcatacagaaaatttaccaagagctcgccttttcccgccctcaacagtacacctccatcgtggctgagctgttgctgaatgcggagctgtctcccgatgcgatcaaggccaacagtatggagttaacggcaggctctgtcgatacgactgtgttcccactgctaatgacattatttgaactggctcgtaacccaaatgttcagcaagccctcagacaggaaagcctggccgccgcagcctccatctcagagcatcctcagaaggccaccacagaactccctctcttaagggccgccctgaaagagactctcaggctgtaccccgttggtctattcctggaacgggtggcatcatctgacctggttctccagaattatcacatcccggcaggcacactggtgagagtttttttgtatagcctcggtaggaaccccgcgctttttcccagacctgaaaggtacaaccctcagcgctggctcgacatccgcggatcagggcgaaatttctaccatgtcccattcggctttgggatgcggcaatgtctagggcgtagactggctgaggctgagatgctgctactcttacaccacgttctgaagcacctgcaggtggagactctgacacaggaagacattaagatggtgtactcctttatactgcggccttccatgtttcctctgctgactttcagggccattaactag

SEQ ID NO: 184431 - DNA, 1314 bp, Artificial Sequence
  Description of Artificial Sequence: Synthetic coding sequence
atggccctgcgggccaaggccgaggtgtgcatggccgtgccctggctgtcactgcaacgagcacaagccctcggtacgagagcagcgagagtgcctcgcacagtgctccccttcgaagccatgccaaggagacccgggaaccgctggctgcgcctgctccaaatttggcgggaacaggggtacgaagacctacatctcgaggtgcaccagacatttcaagaacttggacccatttttcgttacgatctgggaggcgctggcatggtctgtgtcatgcttcctgaagatgtggagaagttacaacaggttgacagcctgcaccctcatcggatgagccttgagccatgggttgcttatagacagcaccgcggccacaagtgcggagtctttctcctcaacggccctgaatggcgattcaatagactgagacttaacccggaagtgctctcccctaatgccgtccagcggtttctacctatggtagacgccgtagcaagagattttagccaggcgctgaagaagaaggtgcttcagaatgcgcggggaagccttactctggacgtccaaccaagtatcttccactacacgattgaggctagcaacttagccctctttggcgaacggttaggcctagtcggccacagccccagctcagcgagcctaaatttcctgcacgccctggaggtcatgttcaagagcacagttcagcttatgttcatgccccgttccctttctcggtggacatccccgaaggtctggaaggaacacttcgaagcatgggactgcattttccagtatggcgacaattgcattcagaagatctatcaggagctggcctttagtcggccccagcagtacacgagtattgtggccgagctgttgctgaatgctgaactgtcacctgatgccatcaaagcgaactctatggaattgactgccggtagcgtggatacaaccgtttttccactgctgatgaccctcttcgagcttgcccggaaccccaatgtgcaacaggctttgcggcaagagtccttggccgcagccgccagcatcagcgagcacccacagaaggccacaactgagctccccctgcttcgagcagcgctgaaagagactctcagactatatcctgttggcttatttttagagcgggttgcctccagtgacctggtgctacagaattatcacattcctgcaggcgtgctcaagcacctgcaggtggaaacactcacgcaagaagacatcaagatggtgtatagctttatccttagaccatcaatgttccccctgctgacttttcgagcaatcaactag

SEQ ID NO: 184432 - DNA, 1512 bp, Artificial Sequence
  Description of Artificial Sequence: Synthetic coding sequence
atggccctgcgggccaaggccgaggtgtgcgtggccgccccctggctgagcctccagcgcgctagggctctgggcacaagagctgccagggcccccagaaccgtgctcccgttcgaggcgatgccacaacaccccggaaacagatggctgcgtctgcttcagatctggagagaacaaggatatgagcacctacatctcgaaatgcatcagacattccaggaactgggcccgatcttcagatacaatctgggcggaccccgcatggtgtgtgtgatgctaccagaggacgtcgagaagctacaacaggtcgatagcctgcatccttgtaggatgatcctggagccttgggtggcctaccggcagcaccgtggccacaaatgtggtgtctttttgcttaatggcccagaatggcgttttaatcgcctcaggttgaatcccgacgtattgtctccgaaagccgttcagcgctttttacccatggttgatgcagtagcccgcgattttagccaggcgcttaagaagaaggtcctccagaatgctcgaggctctctcactctggacgttcaaccttccattttccactatactatcgaagcgtccaacctggccctgtttggcgaacgactggggcttgtcggacattctcctagttctgcttcactgaattttcttcatgcattagaggtgatgtttaaatccaccgtgcagttgatgttcatgcccagatctctgagccggtggatctccccgaaagtctggaaggagcactttgaggcctgggactgcatctttcagtatggcgacaattgtattcagaagatataccaagagctcgcatttaaccgaccgcagcactacacaggtatcgttgctgagcttctgctcaaagccgagctcagcctggaagctataaaggcaaactcaatggagcttacagcggggtccgtcgataccacggctttccccttgctcatgacactgttcgagttagcccgtaaccccgatgtgcagcagatcctaaggcaggaaagtcttgcagccgctgcatcaatttccgagcacccacagaaagctacaaccgagctgcccctgttacgggccgcattgaaagaaaccttgaggttgtaccctgtaggcctatttttggagcgagtcgtcagcagtgacttggtactgcagaattatcatatccccgctgggactctcgtgcaagtctttctctattctcttggtaggaatgctgccctgttccccagaccagagagatacaatccccaaaggtggctcgatattcgcggttcagggagaaattttcatcacgtccctttcggattcgggatgcgtcagtgtctcggacgacgcttggcagaagccgaaatgttgctcctgctgcatcatgtgcttaagcatttcctagttgagactctcacgcaggaagatattaaaatggtgtattctttcatccttcggccaggtacaagtcctttgctgacctttagggccatcaactag

SEQ ID NO: 184433 - DNA, 1527 bp, Artificial Sequence
  Description of Artificial Sequence: Synthetic coding sequence
atgtgggagctggtggccctgctgctgctgaccctggcctacctgttttggcctaaaaggagatgccccggcgcaaaatatccgaaaagcctgcttagcctccccctcgtgggatcactgccctttcttcctcgacacgggcatatgcacaacaatttctttaaactccagaaaaagtatggtccaatctacagcgttagaatgggcaccaagacgaccgtgatagtgggacaccaccagctggccaaggaggtgctgattaagaaagggaaagacttctccggccgcccccaaatggccactctggacatcgccagtaacaatcgcaagggcattgcattcgctgactctggcgcgcactggcagttgcacaggagactggctatggctacatttgccctctttaaagatggagatcagaaactcgaaaagatcatctgtcaggagatctctactctgtgtgatatgctggccactcataatggacagtcaattgatatctcctttcccgtctttgtcgccgtgaccaatgtgatttccctcatatgcttcaacacttcctataaaaatggcgacccagagctcaatgtgatacagaactacaacgagggaatcatagataatttgagcaaggactcattggtggacctggtcccttggcttaaaatctttcccaacaagacattagaaaaacttaagagccacgtcaagatcagaaacgacctgcttaacaaaatcctcgagaactacaaagagaagtttcgatcagattccatcactaacatgttggacactttgatgcaggcgaagatgaattccgataacggtaacgccggaccagatcaggattcagagctgctgagtgacaaccacattctcacaactattggtgacatctttggtgctggggttgaaaccacaacatccgtggtgaagtggactctggcctttctcctccataaccctcaggtcaaaaagaaactctacgaagaaatcgaccaaaatgtcggcttttcccggacacccaccatctctgacaggaatagactcttgctgctggaggctactattcgtgaggtgttgcgactgcggcccgtggccccaatgctcatcccccataaggcaaatgtcgacagttcaattggagaatttgctgtcgataaagggaccgaggtgattatcaatttgtgggccttgcaccataatgagaaagagtggcatcagcctgaccagttcatgccggagcggttcctgaaccccgccggcacacaactgatctccccctcagtgtcttatctgcccttcggcgccgggccccgtagttgcattggcgagatcttggcccggcaggaactattcctcatcatggcctggctgcttcagaggttcgacctggaagtcccagatgacggccagctaccttcactcgaaggcattcccaaggtcgtttttctgatagatagcttcaaggtcaaaattaaggtaaggcaggcctggagggaagcccaagccgagggctcgacgtag

SEQ ID NO: 184434 - DNA, 1512 bp, Artificial Sequence
  Description of Artificial Sequence: Synthetic coding sequence
atggtgctggagatgctgaaccccatccactacaacatcaccagcattgtgccagaggcaatgcctgcagctactatgccagtactgctgctcaccggcctgttcctgctggtctggaactacgaaggcactagttccatccctgggccagggtactgcatgggtatcggccccctgatcagccacgggaggttcctctggatgggcatagggtccgcatgtaactattataatcgcgtctacggcgagttcatgagagtctggatcagcggggaagagactctaataatcagcaaatcttcttcaatgtttcacattatgaaacacaaccattatagtagcagattcggcagtaaactgggcctgcaatgtatcgggatgcatgagaagggaataatctttaacaataacccagagctctggaaaaccaccaggcccttctttatgaaggcactttccgggccaggattggtaaggatggttacagtttgtgctgaatcacttaagacacatctcgacaggctggaggaggtgaccaacgagagcggatatgtggatgtgctgacactacttcggcgcgttatgctagacacatcaaacactctgtttctgcgaatccccctggacgagtccgccatcgttgtcaaaattcagggctattttgacgcctggcaagcactgcttatcaaacccgatattttctttaagatctcctggctttacaagaagtacgagaaatctgtgaaggaccttaaggatgccatcgaagttcttattgctgagaaaagacgaagaatctctaccgaagagaaactggaggagtgcatggatttcgctaccgagttaattttagccgaaaaacgtggagatctaacacgggagaacgtcaaccagtgcatcttagaaatgcttatagccgctcccgatacgatgagcgtctccttattttttatgctcttcctgatcgcaaaacaccctaacgttgaggaagccattattaaagagattcagacggtgatcggagaacgcgacatcaagatcgatgacatacagaagctgaaggttatggagaatttcatctatgagagtatgcggtatcagcccgtggttgatctcgtaatgcgtaaagcactggaagacgacgttatcgacggctatccagttaaaaaaggcacgaatatcatcctgaacatcggacgtatgcacagactcgagtttttccccaagcctaacgagtttacgttggagaattttgctaagaatgtgccctacagatatttccagccctttgggttcggaccccgtggatgcgcaggtaagtatatcgcaatggttatgatgaaagctatccttgtaacactgttgagacgctttcacgtgaaaactcttcaggggcaatgcgttgagtctatccaaaaaatccacgacctatctttgcatcccgacgagaccaagaacatgctcgagatgatatttacccctcgcaattcagaccgctgtttagagcactag

SEQ ID NO: 184435 - DNA, 1512 bp, Artificial Sequence
  Description of Artificial Sequence: Synthetic coding sequence
atggtgctggagatgctgaaccccatccactacaacatcaccagcattgtgcctgaggctatgccagctgcgacgatgcccgttctgctactcaccggcctgtttctgctcgtgtggaactatgagggcaccagctcgatccccggacccggctattgcatggggattggacccttgatatcccatggaagatttctctggatggggatcggctctgcctgcaactattacaacagagtgtacggggagttcatgagggtctggataagcggggaagaaacactgattatttcaaaatcttctagcatgtttcatattatgaagcacaatcactatagctcacgtttcggaagcaagcttggattgcaatgcattggaatgcacgagaaaggtattatttttaacaacaatcctgagctgtggaagactacaaggcccttctttatgaaggccctttccgggcccggactcgtacgcatggtgacggtctgtgccgaatcgttaaagactcatctggaccggctagaagaagtcacaaatgaaagcggctatgtcgacgttcttactctactccgacgggtgatgctcgacacaagtaacactctgtttctgcgcattcccctggatgaatccgccattgtagtcaagatccaaggttacttcgatgcttggcaggctctcttgattaaaccagatattttctttaagatcagctggctgtacaagaagtacgaaaaatccgtgaaagatctcaaggacgcgatcgaggtgctgatagccgagaagcgccgtaggatatcaaccgaggagaagcttgaggagtgtatggacttcgctacagagctaatcttagccgagaagagaggggatctgactcgagaaaatgtaaaccaatgcatactggagatgttaatagcggctcccgataccatgtcggtctccctgtttttcatgcttttccttattgccaaacaccccaacgtcgaggaggctattataaaggagattcagactgtgattggtgagcgtgatataaaaattgacgatatccagaagttgaaggtaatggaaaattttatctatgaatcgatgcggtaccaaccggtcgtggatctagtcatgagaaaggcactggaggacgatgtaatcgacggctaccccgtaaagaaaggtaccaatatcattcttaacataggtcgtatgcatcgactggagttcttcccaaagccgaacgagttcacactggaaaatttcgctaagaatgtgccataccgttattttcaaccgttcgggtttggtccgcgcggatgcgctggtaagtatatcgcgatggtgatgatgaaggccatcctcgttacgctgttgagacggttccatgtgaaaaccctgcaggggcagtgcgtggagtccatccagaaaatccatgatctgtctcttcaccccgacgagactaagaacatgcttgagatgattttcactccccgtaattcggatcgctgcctggagcactag

SEQ ID NO: 184436 - DNA, 1512 bp, Artificial Sequence
  Description of Artificial Sequence: Synthetic coding sequence
atggtgctggagatgctgaaccccatccactacaacatcaccagcatcgtgccggaggcaatgccggcggccactatgcccgttttgctgctcaccggactatttctgctggtctggaactacgagggcaccagttccatacccggtcctggatattgcatgggaattggacctcttattagccacggccgcttcctctggatgggaatcggcagcgcgtgtaattactacaaccgggtctacggcgagttcatgagggtgtggattagcggcgaagagacactgatcatatctaagagctccagcatgtttcatatcatgaagcacaaccattatagctctaggttcggttctaaattggggcttcagtgcatcggaatgcacgaaaagggtattattttcaacaataacccagagctgtggaagacgacccggccttttttcatgaaagctctcagcggacctgggcttgttcggatggtgacggtctgtgccgaatccctgaagacgcatctggaccgcctggaagaggtaactaacgagagtggttatgtggatgtgctcaccctactgaggagagttatgctagacacctccaatactctatttctgcgtatccctttggacgagagcgcaattgtagtgaaaatccaaggctactttgacgcatggcaggccctgctcatcaagccagatatcttctttaaaatctcgtggttgtacaagaagtacgagaagagtgtaaaggacctcaaagatgccattgaggtgctgattgctgagaaacgtaggcggatctccactgaggagaagctggaggaatgcatggattttgcaactgagctgatcctggccgagaagcgcggagacttgactcgcgagaatgtcaatcagtgtatcctggaaatgctgattgctgcccctgacacgatgtctgtgagcctgttttttatgctttttctgatcgctaagcacccgaacgtcgaggaggccattatcaaagaaattcagactgtaattggcgaacgtgatataaagatcgatgatatccaaaaactcaaagtgatggaaaacttcatctacgagtccatgagataccaacctgtcgttgatctggtcatgcggaaggctctggaggacgatgtgatcgatgggtaccccgtgaagaagggaaccaatataattttaaacataggcaggatgcaccgtctggaatttttcccaaaacctaacgaatttacactggagaatttcgcaaaaaacgtgccatacaggtattttcagcccttcggatttggccctagaggatgcgcaggcaagtatattgcaatggttatgatgaaggctattttagtgaccctcctgcggagatttcacgtcaagactcttcaggggcagtgcgtcgaaagcatccagaaaatccacgacctcagtctgcatccggacgagacgaaaaatatgttggagatgatctttaccccacggaattcggatcgctgtcttgaacactag

SEQ ID NO: 184437 - DNA, 501 bp, Artificial Sequence
  Description of Artificial Sequence: Synthetic coding sequence
atggtgctggagatgctgaaccccatccactacaacatcaccagcatcgtgccggaagcaatgccagccgcaacgatgcctgttttattgcttactggactgttcctgctggtctggaactatgaagggacgtctagcatcccaggacctggttactgtatgggcatagggcctcttatcagtcacggacgcttcctctggatgggaatcggaagcgcttgtaactactacaatagggtgtacggtgaatttatgcgggtgtggatctctggggaggaaacactaattatcagtaagtcgtcaagtatgtttcacataatgaaacacaatcattattctagcagattcgggagcaaactgggtctacagtgtatagggatgcatgaaaaaggcatcatatttaataacaatcccgagctctggaagacaacaagaccgttctttatgaaagctctgagcggtcccggcttggtgcgaatggtgaccgtgtgcgcagagtag

SEQ ID NO: 184438 - DNA, 657 bp, Artificial Sequence
  Description of Artificial Sequence: Synthetic coding sequence
atggtgctggagatgctgaaccccatccactacaacatcaccagcatagtgcccgaggcgatgcccgctgcgacaatgccagttctgctcctaacaggcctcttcctgctagtgtggaattacgaagggacgagcagtatcccaggacctggctattgtatggggatcgggccactgatttctcacggccggttcctttggatggggattggctcagcttgcaactattacaatagggtttacggggagtttatgcgcgtctggatctccggcgaagaaactctcataatcagcaagagcagtagcatgtttcacatcatgaagcacaaccactattcctctagattcggctcgaaactcggtctccagtgcattgggatgcacgaaaaaggaatcatctttaacaataaccctgaactctggaagacgacaaggccctttttcatgaaagccctgagcgggccaggtttggtcagaatggtcacagtctgcgccgagagcttgaagacgcacctggatcggctcgaggaagtgactaatgaatccgggtatgtggatgtgctgacattgttacgcagggttatgctcgacacatccaacaccttatttctaaggattcccctggatggaaccgagatcttcacattgacaagttag

SEQ ID NO: 184439 - DNA, 1080 bp, Artificial Sequence
  Description of Artificial Sequence: Synthetic coding sequence
atggtgctggagatgctgaaccccatccactacaacatcaccagcatcgtgcccgaagcaatgcctgctgcaactatgcccgttttgttactgaccggtctgtttctgctggtgtggaactacgagggcacttcttctataccaggccccggttactgcatgggtataggccccctgattagtcacgggcgattcctgtggatgggcatcgggtccgcatgcaactattacaacagggtttatggagaattcatgcgcgtgtggatctccggtgaggagacgctgattattagcaaatcttcctccatgttccacatcatgaagcacaatcattattcttctcgattcggttctaaactgggactccagtgtatcgggatgcacgagaagggaatcatttttaacaataatccagagctgtggaaaacaacccgcccctttttcatgaaggccctttctggccccggattggtgaggatggtgactgtctgcgccgagtctctgaaaacccacttggacaggctggaagaggtaactaatgagtctggttatgtagatgtcctgacactgctgagaagggtcatgctggacaccagcaataccctgttcctccgcatcccgctcgatgagagcgctatagtcgtgaagatccagggttactttgatgcctggcaagctttgctgatcaaaccagatattttcttcaagatcagctggctgtacaagaaatacgagaagtccgtcaaggatctgaaagacgccattgaggtcctgatagctgagaagagaagacgcatctctaccgaagaaaaactcgaggaatgcatggattttgcgactgaactaatattggcagagaagagaggggatcttacacgggagaacgtgaaccaatgcattttggagatgcttatcgctgcaccagatactatgagcgtatccctgttctttatgttattcctaatcgccaagcaccccaatgttgaggaagctatcatcaaggagatccagaccgtgattggtgagagggacattaagatcgacgatatacaaaaactgaaaaagcatgacgctaagtag

SEQ ID NO: 184440 - DNA, 1059 bp, Artificial Sequence
  Description of Artificial Sequence: Synthetic coding sequence
atggtgctggagatgctgaaccccatccactacaacatcaccagcatcgtgcccgaggccatgccagctgctaccatgcccgtgctcctgctgacagggctatttcttctggtgtggaactacgagggcacatcttcaatccctggccccggctattgcatgggaattggccctctcatcagtcacggacggttcctatggatgggcatcggcagcgcctgtaattactacaatagggtgtacggagagtttatgcgggtgtggatcagcggcgaagaaacattgattatctccaaaagcagctccatgttccacatcatgaagcacaaccattattcctctcgtttcggctctaaactgggactgcagtgtatcggcatgcatgaaaagggtatcatctttaacaacaatcccgagctgtggaagactacacgccctttcttcatgaaagccctctcaggaccagggttagtgagaatggtgactgtgtgcgcggagtcgctaaagactcacctcgaccgcctcgaagaggtgacaaatgagagcggctatgttgacgtactgaccctcctgaggagggtgatgctggacacatctaacacactttttttgagaatacctctcgatgagtccgccattgtggttaaaatccaggggtattttgacgcctggcaggcactattaattaaacctgacattttcttcaagataagctggctgtataagaaatatgagaaatcggtcaaagatttgaaagatgcaatagaagtgcttatcgctgagaagcgcagaagaatctcaactgaggagaagttggaagaatgtatggatttcgcaactgaattgatcctggcagagaaacgtggggacctcacccgggagaatgtcaatcagtgcattctcgagatgctcatagctgctccggacacgatgtcagtatccctctttttcatgctgttcctcattgccaagcaccctaatgtggaggaagctattatcaaggagatccagactgtcatcggggaaagggacatcaagattgatgacatccagaaatag

SEQ ID NO: 184441 - DNA, 729 bp, Artificial Sequence
  Description of Artificial Sequence: Synthetic coding sequence
atggtgctggagatgctgaaccccatccactacaacatcaccagcatcgtacccgaggccatgccagccgcgacaatgccagtcctgctgctgaccggactgttcctgctagtctggaactatgagggcacaagttccatccccgggcccggttactgcatgggaatcggacccctgatctcccacggccgattcttgtggatgggtatcgggagcgcatgcaactattacaatcgggtctacggggagttcatgcgcgtttggataagtggagaggagacacttatcatttccaagagctccagcatgttccatatcatgaagcacaatcattactcaagcaggtttggctccaaactggggctccagtgcatcggcatgcatgagaaggggatcatttttaacaataatcccgagttatggaaaactacaaggccattctttatgaaggccctgagtggcccaggcctggtgcggatggtgaccgtatgtgcagagtccctgaaaacacacctggatagactggaagaagtgacgaatgaaagcggatacgtggatgtccttaccttactgcgtagggtgatgctcgatacttctaatactctgttcctgagaatcccattggacgagagtgccattgtggtcaagatccagggttacttcgacgcctggcaagctttgctgatcaaacctgacatcttctttaagataagttggctctataaatag

SEQ ID NO: 184442 - DNA, 546 bp, Artificial Sequence
  Description of Artificial Sequence: Synthetic coding sequence
atggtgctggagatgctgaaccccatccactacaacatcaccagcattgttcctgaggctatgccggcagcgaccatgcccgtgcttcttctgacggggctgttcctcttggtctggaattacgagggcacatcttctataccaggcccgggctattgcatgggaattggccccctaatttcccacggccgtttcctatggatggggattggctctgcctgtaattactacaacagggtgtatggagagtttatgagagtgtggatctcgggggaggagaccctgattattagcaagtcttctagcatgttccatataatgaaacataaccactacagttcccggttcggaagtaaactggggttgcaatgcatcggcatgcacgaaaagggtattatcttcaataacaaccccgagctgtggaagaccaccagaccctttttcatgaaggcactgtcaggccctggattggtacggatggtcaccgtttgcgcggaatctcttaagacccatcttctgttgtttacgcccgcttccgtgaactag

SEQ ID NO: 184443 - DNA, 657 bp, Artificial Sequence
  Description of Artificial Sequence: Synthetic coding sequence
atggtgctggagatgctgaaccccatccactacaacatcaccagcatcgttccagaagcaatgccagccgccacaatgcccgtgctgcttctcacaggactgtttctgctggtgtggaactacgaggggacttcctccattccaggccctggctattgcatgggcataggacctctgattagccatgggagattcctgtggatgggtattgggtctgcctgtaactactataatcgagtctacggtgaatttatgcgcgtgtggatctcgggggaggaaacgctgatcatatctaagtctagctccatgtttcacatcatgaagcacaatcactatagctcccgcttcggaagcaaactcggtctccagtgtatcggaatgcatgagaaggggatcatctttaacaacaaccctgagctgtggaaaaccacacgcccgtttttcatgaaggcactaagtggtcctgggcttgtaagaatggttaccgtgtgtgcggagagcctgaagactcatttagaccgactggaggaagtcactaatgagtcaggctacgtggacgtgctcactctgctacgacgtgttatgctcgatactagcaacactctgttcctgcgcattcccttagacggcacagaaatattcaccttgactagctag

SEQ ID NO: 184444 - DNA, 1059 bp, Artificial Sequence
  Description of Artificial Sequence: Synthetic coding sequence
atggtgctggagatgctgaaccccatccactacaacatcaccagcatcgtcccagaagctatgcccgccgcaaccatgccggtgctcttgttgactggactgttcctgttggtctggaattatgagggcaccagcagcatccccggacctggctactgcatggggatcggccctttaatcagtcatggacgctttctctggatgggaataggcagcgcctgtaattactacaaccgggtttatggagaattcatgcgcgtgtggatttcgggagaggagacgctcattatttctaaatcgagcagcatgttccacatcatgaaacataatcactactcatctcgatttggctcaaagctcggacttcagtgcatagggatgcacgagaaaggcatcattttcaataataatcctgagctgtggaagaccactcggccgttcttcatgaaggcactgagcggccctgggttggtgcggatggttaccgtgtgtgccgagtccctgaaaacccacctggaccgcctggaagaggtgaccaacgagtccgggtacgtcgacgtcctgacattactccgcagagtgatgctcgacacctcaaataccctattcctccgcattccactggacgaatccgccatagttgtcaagattcaagggtatttcgacgcctggcaagccctcttgatcaagccagatatattttttaagatatcctggctatacaaaaaatatgaaaaaagcgtgaaggacctcaaagacgcaattgaagtgctcatcgctgagaagaggcggcggatcagcaccgaggagaagttggaagagtgtatggactttgccactgaactcatactggcggaaaaacgaggcgatcttactagagaaaatgttaaccagtgtattctcgaaatgttaattgcagcccccgatacaatgtctgtctccctgttctttatgctctttctcattgcaaagcatccgaacgtcgaagaagccattatcaaggagatccaaactgtcatcggagagcgagatatcaagatcgacgatattcagaagtag

SEQ ID NO: 184445 - DNA, 852 bp, Artificial Sequence
  Description of Artificial Sequence: Synthetic coding sequence
atggtgctggagatgctgaaccccatccactacaacatcaccagcatagtgccggaggccatgcctgccgctacaatgcccgttctgctgctcactggtctcttcctgctggtgtggaattacgaaggcacgagttcaatccctgggccaggttactgtatgggaattgggcctctaatctcccacggcaggtttctctggatgggtatcgggtcagcctgtaattactataacagggtctacggggaatttatgcgtgtgtggattagcggtgaggaaactctcatcattagtaagagttcctccatgttccatataatgaagcacaaccattatagctcacgatttgggagcaagctaggacttcaatgcattgggatgcacgaaaagggcattatttttaataacaatcccgaattatggaagacaacgagaccattttttatgaaggctttgtcaggccctggcctggtccgcatggttaccgtgtgcgcagaatctcttaaaacacaccttgatcggctggaagaagtgacaaacgaatcggggtatgtggacgtgttgaccttgttgagacgggtgatgctcgataccagcaacacactattcttgagaataccactcgacgagtctgctatcgtggttaaaatccaaggctattttgacgcatggcaagccctcctcattaaaccggatatcttctttaagatttcgtggctctataagaagtacgaaaaaagcgtgaaagatctcaaggacgctatcgaagtgctgatcgcagaaaagcgcaggcgaatatccaccgaagagaaattagaggagtgcatggactttgctaccgaacttatctag

SEQ ID NO: 184446 - DNA, 498 bp, Artificial Sequence
  Description of Artificial Sequence: Synthetic coding sequence
atggtgctggagatgctgaaccccatccactacaacatcaccagcattgtgccagaagccatgcctgccgctaccatgcccgtgctgctactgaccggcctttttcttctcgtttggaactacgaagggacatctagtattcctggaccggggtactgtatgggcattgggccactgatatctcacggccggtttttatggatggggattggcagcgcatgcaattactataacagggtgtatggagagttcatgagagtttggatttctggcgaggagaccctgatcatctccaagagttcttccatgtttcacatcatgaagcataaccactacagttcaagattcggttctaagttaggtttacagtgcatcgggatgcacgaaaagggaatcattttcaacaataaccccgagttatggaagacaacccgtccgtttttcatgaaggcactgtcagggcctggcctggtgagaatggtgaccgtttgcgcctag

SEQ ID NO: 184447 - DNA, 1512 bp, Artificial Sequence
  Description of Artificial Sequence: Synthetic coding sequence
atggtgctggagatgctgaaccccatccactacaacatcaccagcattgtgcccgaggccatgccggcagctacaatgcctgtgctgctcctcacaggtcttttcctgctggtttggaactacgaggggacctctagcatacctggtcctggttactgtatggggataggacccctcatctcccatgggcggttcctctggatggggattggatccgcttgtaattactataatcgggtgtacggcgagttcatgagggtgtggatctccggagaggagacactgatcatctctaagtcatccagtatgtttcatattatgaagcacaatcattacagtagccgattcggcagtaagctgggcctgcagtgtatcgggatgcatgaaaaggggatcatcttcaacaataatcccgagctttggaagacaactcgtcccttttttatgaaagccttgagcggaccaggattggtccgcatggttaccgtgtgtgcggaatccttaaaaactcacctggaccgtctggaggaggtgacgaatgaaagtgggtatgtcgacgtcctgactttgctgcggagagttatgctggatacttctaacacactattccttcggattcctttggatgaatcagcaatcgtcgtgaagatacagggctacttcgatgcctggcaggcactgttgatcaagcccgacattttttttaaaatcagttggctgtataagaagtatgagaaatctgtgaaggatttaaaggacgcaatcgaggtcctcatcgctgaaaagagaaggcgtatctccactgaggagaaactcgaagagtgcatggatttcgctaccgaactgatactcgcagagaagaggggcgacctgacccgggaaaacgtgaatcaatgtattctggagatgctgatcgctgcccccgacactatgagtgttagtctgtttttcatgctttttctgattgcaaaacacccaaatgtggaagaagcaatcataaaggaaatccagacagttatcggcgaaagagacatcaaaatagacgacattcagaagttgaaagtgatggagaactttatctatgaaagcatgaggtatcagcccgtggtcgacttagtcatgaggaaagcactggaagatgatgtcatcgatgggtaccccgtgaaaaaaggtacaaacataattctcaatatcggccggatgcacagactggagttcttccccaagccgaacgaattcacactggagaatttcgctaaaaatgtcccctaccggtacttccagccattcggattcgggccccggggctgtgcgggtaaatacattgcgatggttatgatgaaagccatcctggtaactctacttaggaggtttcacgtcaaaactctgcaaggtcagtgcgtggagtcgatccagaagatccacgatctctctctgcaccccgatgagaccaagaatatgttggaaatgatcttcaccccaaggaactccgaccgctgtctcgagcactag

SEQ ID NO: 184448 - DNA, 519 bp, Artificial Sequence
  Description of Artificial Sequence: Synthetic coding sequence
atggtgctggagatgctgaaccccatccactacaacatcaccagcattgtgcccgaagccatgccggccgctaccatgcccgtcctgctattgaccggtcttttcctcctggtctggaattacgagggcaccagcagtatcccggggccaggctactgtatgggcatcggcccccttatcagtcacggaaggttcctgtggatgggtatcggttccgcctgtaattattataatcgcgtgtatggagaatttatgcgggtttggatcagcggcgaggaaactttaatcatttctaaatcctcttccatgttccatattatgaagcacaaccattactcatcaagattcggctcaaaactagggctgcagtgcattggaatgcatgaaaagggaatcatcttcaataataatcctgaactttggaagacaacacgaccttttttcatgaaggccttgtctggcccggggttagttcggatggtcactgtgtgcgctgagagtctgaaaactcacctatag

SEQ ID NO: 184449 - DNA, 735 bp, Artificial Sequence
  Description of Artificial Sequence: Synthetic coding sequence
atggtgctggagatgctgaaccccatccactacaacatcaccagcattgtacctgaagccatgccagcggccactatgcctgtcctcctgctgacagggctgtttctgctcgtctggaactatgaggggacatcttccattcctggtccgggctattgtatgggaatcggaccgctaatctctcacggaagattcctgtggatggggatcggatcagcttgcaattactacaatcgcgtctatggcgaatttatgcgggtatggatctctggagaagagacactgattatttctaaatccagttctatgtttcatattatgaagcacaatcattacagctctagattcgggtcaaaacttgggctacaatgtatcggaatgcatgaaaaaggaataattttcaacaataatccagagctttggaagaccacccgacctttttttatgaaagaatcagcaatagtcgtcaaaatacagggatactttgacgcctggcaggctttgctgataaaaccagatatctttttcaagatttcatggctctataagaagtacgaaaagtccgtgaaagacttgaaagacgccatcgaggttctgattgctgagaagcggcgccgaatatctaccgaagaaaagctggaagagtgtatggactttgctacagagttgatactggccgaaaagcggggcgatctcacccgagagaatgttaaccagtgcatcttggagatgtag

SEQ ID NO: 184450 - DNA, 1485 bp, Artificial Sequence
  Description of Artificial Sequence: Synthetic coding sequence
atgctggccagcggcctgctgctggtgaccctgctggcctgcctgacagtgatggtacttatgtccgtgtggcggcagagaaagagtagaggcaagttaccccctggcccaacccctctgccatttataggaaattatttacagctgaataccgaacagatgtataacagcttaatgaagatctctgaacggtacggccctgtgtttaccatacatctgggacctagaagagtcgtggttctgtgtggccacgatgcagttaaggaggcactggtggatcaggctgaggagttctctgggcggggggagcaggctacttttgactggctctttaagggatacggtgttgcattttccaatggcgaaagggcaaagcagctgagacgcttctcaattgccacacttcgcggatttggggtggggaagagagggattgaggagaggatccaggaggaggctggattcctgatcgacgccctgcgcggaacccatggagccaatattgatccgaccttctttctgtccaggacagtctctaatgtgatttcatccatcgtgttcggcgatagatttgattacgaggacaaagagttcctcagtttgctgcggatgatgctgggtagttttcagttcactgcaacttcgacaggccagctctacgaaatgtttagctcagtaatgaagcatctccccggccctcagcagcaggctttcaaggagctgcagggcttagaggactttattgccaagaaagttgagcacaatcagcggaccctggatcccaactcccctagggactttattgatagttttctcataagaatgcaggaagaggagaaaaatccgaataccgagttttacctgaagaatcttgttatgaccaccttgaacctatttttcgcggggactgagactgtttccaccactctgcgatacggattcctgctcctgatgaagcacccagaggtcgaggcaaaggtccatgaggaaatcgatcgcgtgatcggaaaaaacagacagccaaaatttgaggaccgggctaagatgccatacactgaggcggtgatccacgaaatacaaagatttggcgacatgctgcctatgggcctggcacatagagtaaacaaggacacaaaatttcgtgattttttcctgccaaaggggactgaggtgttccctatgcttggaagcgtgttgagagatccgagattcttctcgaacccacgagacttcaaccctcagcacttccttgacaagaaggggcagtttaaaaaatccgacgcatttgtgccgttttcgatcggaaagagatattgcttcggggaggggctggctcgaatggaattgtttttgttcttcacaactatcatgcagaacttcaggtttaagagccctcaatctcctaaggacatagacgtgagcccaaagcacgtgggcttcgctaccattccacgaaattacaccatgagctttcttccacggtag

SEQ ID NO: 184451 - DNA, 1485 bp, Artificial Sequence
  Description of Artificial Sequence: Synthetic coding sequence
atgctggccagcggcatgctgctggtggccctgctggtgtgcctgacagtaatggtactcatgtctgtctggcagcagcgcaagagtaaaggaaaactccctcctgggcccacaccgctgccatttatcggaaactatctccagctgaacaccgagcagatgtataacagcttgatgaagataagtgaacgatacgggcctgtgttcacaattcatcttgggcctagacgcgttgtggtcttgtgtggccatgacgcagtgagggaggcccttgtagatcaggccgaggagttctcgggccggggcgagcaggctacattcgattgggtgtttaaggggtacggtgttgtctttagtaatggtgaacgcgctaagcagcttagaaggttctctattgccaccttacgcgactttggagtgggcaagagaggaatcgaggagcgcatacaggaagaagccggtttcctcattgatgcactgcgcgggaccggcggtgctaatattgaccccacattcttcctgagcaggactgtgtcgaacgtgatctcatcaatagttttcggagatcggttcgactacaaggacaaggagtttttaagcttattgcggatgatgctggggatctttcaattcacaagcacatcaaccgggcagctgtatgaaatgttttccagtgttatgaaacatttgcccgggcctcagcagcaagccttccaactgttacagggtctggaagattttatcgctaagaaagtggaacacaatcagagaacccttgatcctaacagcccccgcgactttatagactccttcctgatcagaatgcaggaggaagaaaaaaacccaaacactgagttttatctaaagaatctggtgatgacgacattgaacctgttcattgggggaactgaaaccgtaagcaccacccttcggtacggctttcttttgttgatgaagcaccccgaggtggaagccaaggtgcacgaagaaatcgaccgcgtgattggaaagaacagacagccaaaatttgaagaccgcgcgaaaatgccctacatggaagctgtgatccatgagatccagaggttcggcgacgtgatccctatgagcctggcgaggagagtgaagaaagacacgaagtttagagattttttccttcctaaggggacagaagtgtttcccatgttgggttcagttcttagagatccatcgttcttttccaatccccaggactttaaccctcagcattttctgaacgagaaaggccagtttaagaaaagcgatgccttcgtccctttcagtattggaaagcgcaattgttttggcgaggggctggcaaggatggagttgttcctgttttttaccaccgtgatgcagaactttcggctaaagtctagtcaatcacctaaggacatagatgtgtctcctaagcacgtgggattcgcaactatccctagaaattacacaatgtctttcctgcctagatag

SEQ ID NO: 184452 - DNA, 1332 bp, Artificial Sequence
  Description of Artificial Sequence: Synthetic coding sequence
atgctggccagcggcctgctgctggtggccctgctggcctgcctgactgtaatggtgctgatgagcgtgtggcagcaacgcaaatctcgcggcaaattgccgcccggcccaacacctctgccctttattggcaactacctgcagctgaatactgagcacatctgtgatagcatcatgaaagtatctcaaggagtggcattcagcaacggcgagagagcaaaacagctcctgcgatttgccatcgctacattaagggacttcggagtgggtaagcggggaattgaagagaggattcaagaggaaagcgggtttttaattgaggcaatcagatctacacatggggccaatattgatcccacattcttcctgtcccgaactgtctctaatgtgatctcttccatagtgttcggagacaggttcgactatgaggacaaggaatttttgtccctcctatccatgatgctgggaatttttcagttcacttctaccagtacaggccaactctacgagatgttcagctcagttatgaagcacttgccaggccctcaacagcaagcctttaagctattgcaggggctggaggacttcatagccaaaaaggtggagcataatcagcggaccctggatcccaatagcccccaagacttcatcgactcttttctcatccacatgcaagaggaggaaaaaaatcctaataccgagttctatttaaaaaatctgatgatgagcacactcaacctctttattgctggaaccgagacagtgtcgacaactctaaggtatgggtttctcctgttgatgaaacacccggaggtggaggcaaaggtgcacgaagaaatcgaccgtgtaatcggaaaaaacagacaacccaagttcgaggatcgaactaagatgccatacatggaagccgtgatacacgaaatacagagatttggcgacgttataccaatgtcgcttgctaggagggtgaaaaaagacacaaagttccgggactttttcctaccgaaaggcacagaggtgttccccatgctgggatccgtgttaagggatccatcattcttctctaatccgcaagacttcaatccacaacacttccttgatgacaaggggcagttcaagaaatctgatgcctttgtcccgttctctatcggtaagagaaattgttttggggaggggcttgcgcggatggaacttttcctgtttttcacaaccgtgatgcagaacttccgattgaagtcttctcagtcccccaaggacatcgacgtgtcccccaagcatgtggtattcgccacaatccctcgaaattatacaatgagcttccttcccagatag

SEQ ID NO: 184453 - DNA, 1485 bp, Artificial Sequence
  Description of Artificial Sequence: Synthetic coding sequence
atgctggccagcggcctgctgctggtggccctgctggcctgcctgaccgttatggtgctaatgtcagtgtggcagcagagaaagtcccgaggtaagctccctcctggccccacccccctcccttttatcggtaattatctgcagctgaacacagaacacatatgcgactcaattatgaagttcagcgagtgttacggacctgtcttcacaatccacctaggccctaggcgggtcgttgttctctgcggacatgacgctgtgagggaagcattggtggatcaagctgaagaattctctggccggggggaacaggcaacattcgactgggtgttcaagggctacggggttgccttttccaacggagaacgcgctaagcagttgttaaggtttgccatcgctacacttcgggatttcggcgtgggcaaaaggggtattgaagaacgcatccaggaagaatccggctttctgattgaggctattcggtcgactcatggcgccaatatagatccgacgtttttcttatcgagaaccgtttccaatgtgatctcctctattgtctttggggatagattcgactacgaagataaggagttcctgtccttgcttagtatgatgctaggcattttccagtttacatcgaccagcacagggcagctctacgaaatgttttcgagtgtgatgaagcacttgcccggcccgcaacagcaagcctttaaactcttgcaagggctggaggatttcattgcaaagaaggtggagcacaaccagcggacgctggaccccaactccccacaggatttcatagacagttttctgatccacatgcaagaggaagagaagaatcctaacactgaattttacctgaaaaatttaatgatgtctaccctgaatctgttcatagccgggacagaaactgtgtctactaccttaaggtatggcttcctgctgctgatgaaacatcctgaagtggaagcaaaggtccatgaggagatcgatcgtgtgatcggcaagaacagacaaccaaaattcgaggacaggaccaagatgccgtacatggaagcggtgattcatgagattcagaggtttggcgatgtcattccaatgagcttggcccgaagggttaaaaaggatactaagttccgggactttttcctcccaaagggcacagaggttttccccatgcttggatcagtgctgagggacccgtcattttttagtaacccacaggatttcaatccacaacatttcctggacgacaagggccagtttaagaagtctgatgcctttgtacctttttccatcggcaagcgtaattgtttcggagaggggctcgctcgtatggagctttttttattttttaccacagtgatgcagaactttaggttgaagtctagccaatcacctaaggatatagatgtctctcccaaacatgtcgtctttgccaccatcccacgcaattacacaatgtcctttcttcccagatag

SEQ ID NO: 184454 - DNA, 1476 bp, Artificial Sequence
  Description of Artificial Sequence: Synthetic coding sequence
atggagctgagcgtgctgctgttcctggccctgctgaccggcctgctgctgctgttagtacagaggcaccccaacacgcacgaccggttgcctccaggaccacgtcccctgcccttgttgggtaacctgctgcaaatggatcgccgcggcctcctaaagtcgttcctgcgcttccgagagaaatacggagacgtgttcactgtccatctaggaccacgccccgtcgtgatgctttgtggagtcgaagcgatccgggaagcccttgtggataaggccgaagcgttttcaggccgaggaaagattgcaatggtggacccatttttccgcggttatggcgtcatctttgcaaacgggaaccgctggaaagttctgcggcgattttctgttactaccatgagggatttcggtatgggaaaacgatccgtggaagagagaattcaggaggaggcgcaatgtctgattgaagagcttcgcaagagcaaaggagccttaatggatccaacatttctgtttcagtccatcaccgcgaacataatctgttccatcgtcttcgggaaaagattccattaccaggaccaagagtttctaaaaatgcttaatctgttttatcagacattttccttgatatcctctgtctttggccaactgttcgaactgttttccggatttctcaagtactttcctggggcgcacaggcaggtgtacaagaatctgcaggagattaatgcctacattggccatagtgtggaaaaacacagagagacgttggaccccagtgcgccgaaggatctgattgatacatacctcctgcatatggaaaaagagaaatcgaatgctcactccgaattttcccaccagaacttgaatctgaacaccttgagcctgttcttcgcaggcaccgaaaccacgtctaccactcttcgctacggcttcctgctaatgctcaaatacccgcatgttgccgagcgagtttatagggagatcgaacaggtgatcggaccccacagacccccggagctccatgatcgggcgaaaatgccgtatacagaggctgtaatatatgagatccaacggttcagcgaccttttgccaatgggggttcctcacattgtcacacagcatacctccttccgcggctatattatccctaaggatacagaggtatttctaatcttgtcgactgcacttcatgatccccactactttgaaaaacctgatgcattcaatccagaccacttcttagatgccaatggcgccttgaagaagactgaggctttcattcccttctctctggggaagcgcatatgcctgggagagggtattgcgcgagcagaactgtttctgttcttcacaacgatcctacagaacttcagcatggcttcccccgtcgcaccagaggatatcgacctgacccctcaggagtgcggcgttggaaaaatacctccaacatatcagatcagattcctgcctcgctag

SEQ ID NO: 184455 - DNA, 876 bp, Artificial Sequence
  Description of Artificial Sequence: Synthetic coding sequence
atgcggtgcatgctgaccaacagccacccctggtgcggctgcgactggcaatttcgtgagaagtacggagacgttttcacggtccacctcgggccccgccccgtggtaatgctgtgtggcgtcgaagccattagagaggctctcgtcgacaaggctgaagcattttccggtagaggaaaaatcgctatggtcgaccccttttttcggggatatggcgttattttcgccaatggcaatagatggaaagttctgcgaaggttcagcgttactactatgagggacttcggtatgggaaagaggtccgttgaggaaagaatccaggaggaggcccagtgcctgatcgaagagctgcggaagtctaaggagcgagtttacagagaaatagagcaggtgatcgggccccataggcctccagaactgcacgatcgggccaagatgccatataccgaggccgtaatctacgaaatccagcgttttagtgacctactgcctatgggtgttccgcacatcgtaacccagcacacctcattccgaggttatatcatccccaaggacactgaagtgttcctgatcctaagcacagctctgcacgatcctcactatttcgagaaacccgacgcattcaacccggaccactttttggacgccaacggggctttaaaaaagaccgaggctttcataccgttttctctcggaaaaagaatatgtcttggcgaaggaatcgcacgcgctgaactgtttctgttttttaccaccatccttcagaatttcagcatggcgtcccccgtggctcctgaggatatcgatcttaccccccaagagtgcggggtcggcaagatcccccctacctaccagatccggtttttgcccaggtag

SEQ ID NO: 184456 - DNA, 1473 bp, Artificial Sequence
  Description of Artificial Sequence: Synthetic coding sequence
atggaccccttcgtggtgctggtgctgtgcctgagctgcctgctgctgcttagcatctggcgtcagagcagcggtcgcggaaagctgccacccggacccaccccattgccagtgataggcaacattcttcaaatcgacatcaaggacgtttccaaatccctgacaaacctgtccaagatctacggccctgtatttaccctatacttcggactggaaaggatggtggtgcttcacgggtacgaagtggttaaggaggctttaattgacctgggcgaagagtttagcggccgcgggcattttcctctcgccgagagggctaatagaggcttcggtatcgtctttagcaacggaaagcgctggaaggagataagacgcttctccctcatgacactccggaacttcgggatgggcaagagatccattgaggacagagtgcaggaagaagcccgatgcttggtggaggaactgcgcaagaccaaagctagcccatgcgatccaacttttattctgggatgtgcgccctgcaatgtgatctgctctattattttccaaaaacggttcgattacaaggatcagcagtttttgaatctcatggaaaagctgaatgagaacattcgcatcgtgtccaccccttggatccagatctgcaataatttccctaccataatcgattacttcccaggaacacacaacaaactgctcaaaaacctggctttcatggagtccgacatattggagaaggtgaaggaacatcaggaatcaatggacataaacaacccgcgggatttcatagattgttttctgatcaaaatggagaaagaaaagcagaatcagcagagcgaattcacaatagaaaacctggttatcacagccgcagacctcctgggggctggtacggagaccacaagtactactctgcgctatgccttattgctgctgctgaagcaccccgaggtgaccgctaaggtgcaagaagagatagaacgcgtggtagggcgtaaccgttctccatgcatgcaggatcgaggccatatgccctatacagacgccgtcgtgcatgaggtgcagcgctatatagacctgattccaacaagtcttccccacgccgtaacttgcgatgttaaattccgaaattatttgattcccaagggcaccaccatcttgacttccctaacttcagtgttacacgacaacaaggagttccccaatcctgagatgtttgatcccaggcacttcttggatgaaggtgggaattttaaaaaatccaattactttatgccttttagtgccgggaagaggatttgcgtcggggaggggttggctagaatggaactctttctgttccttaccttcattcttcagaacttcaacctcaaaagcctcatcgaccctaaagaccttgacaccacaccagtcgtgaatgggtttgcctccgtgccccccttctatcagctttgttttatcccagtttag

SEQ ID NO: 184457 - DNA, 1473 bp, Artificial Sequence
  Description of Artificial Sequence: Synthetic coding sequence
atggagcccttcgtggtgctggtgctgtgcctgagcttcatgctgcttttcagcctctggcggcaaagctgccgcagaaggaagttgcccccaggacctacccctctacctatcatcggtaacatgcttcagattgacgtaaaagacatttgcaagtccttcactaatttctctaaagtttacggccccgtgtttaccgtctatttcggaatgaacccaattgtggtatttcatggatatgaggctgtcaaagaagccttgatagataacggcgaagaattcagcggccggggcaactcacccatcagtcagagaatcactaagggactgggcattatatccagcaacggaaaaagatggaaagaaatccgaagattcagtttgacaaccctgaggaatttcgggatgggaaagcgctccattgaagaccgagtgcaggaggaggctcactgccttgtggaggaacttagaaagaccaaagccagcccttgtgatccaacctttatacttggctgtgccccatgtaacgtaatttgctctgttgtttttcagaagcgcttcgattacaaggaccagaattttttgaccctgatgaagagatttaatgaaaacttccgaatactcaattccccctggatccaggtgtgcaacaattttccgctgttaatagactgtttccctgggactcacaataaggtgctgaaaaatgtggcgctcactaggagttacatccgggagaaagtgaaagaacatcaagccagcttggatgtgaacaacccaagagactttatcgattgcttcctgatcaagatggaacaggaaaaggacaatcagaagagcgaattcaacatcgagaatttagtagggacagtggctgacttgttcgtcgccgggacagaaaccacaagcaccactctacgctacggactgttgcttctgttgaagcatccagaagtcactgctaaagtgcaggaagaaattgaccacgtgattggcagacatcgttctccctgcatgcaggatcggagtcacatgccctacacggatgcggtcgttcacgaaattcaacggtattccgatcttgtacctacaggcgttccccatgctgtaaccaccgatacaaaatttcggaactacctgatccctaagggaactaccattatggccctcctcacctccgtccttcatgatgacaaggagtttccaaaccccaacatcttcgatcccggacatttccttgacaagaacggaaacttcaagaagagtgactatttcatgccgttctcagccgggaagaggatttgtgccggagagggattggcacgcatggaattattcctcttcttaacgaccatccttcaaaactttaatctgaagtctgtggatgatttgaaaaacctaaacacaacggccgtgactaaaggtattgtgagcctacctccttcataccagatttgttttattcccgtctag

SEQ ID NO: 184458 - DNA, 1374 bp, Artificial Sequence
  Description of Artificial Sequence: Synthetic coding sequence
atggagcggagcttcctggaggaggccatcccccagtacctgaaggagctgttaaaggacctggtgggcgcacatatctcagtttctgcactcgtaacgggagtgagaggaatggagaatagggccctgaaaagtttttccgctgagctaagcttgagtgcatggctgcctagcgttgccgctctgtctagcctggctgttaattcaccaagtttttgccccttctttctcggaatcatcagctctaatggtaaaagatggaaagaaatccgccgctttagtctcaccacattacgaaactttggtatggggaaaagatcgatcgaagatagggttcaggaagaggctcactgcctggtcgaagagctcagaaaaacgaaggcttcgccttgcgaccctacttttatcctcggatgtgccccttgcaacgtgatatgctccgtggtcttccagaaacggttcgactacaaggatcagaattttctcactcttatgaagcgatttaatgagaacttccgcattctaaactccccttggatccaggtgtgcaacaattttcctctgctaatcgactgcttccccggaacccacaacaaggtgctgaaaaacgtagccctgacccggtcgtacatccgagaaaaagtcaaggagcaccaggcttccctggacgttaataacccgcgcgactttatagattgttttcttattaagatggagcaagaaaaggataatcagaagagcgaattcaatattgagaacctcgtggggacagtggcagatctcttcgtagccggtaccgagactaccagcaccacacttcggtatggcctattgctcctgctgaaacatcccgaggtaaccgccaaagtccaggaagagatagaccacgttatcgggagacaccgcagcccctgcatgcaggatcgatctcacatgccgtatactgacgccgtggtccacgagattcagcgttattctgacttggtccccaccggagtgccacatgctgtcacgaccgatactaagtttcgcaactatctgatccctaaaggcacaaccattatggcactgttgacttcagtactccacgacgataaggagtttccaaatcccaatattttcgaccctggccactttctggataagaatggaaatttcaaaaaatctgactatttcatgccattctcggcgggcaagaggatatgtgcaggtgaagggctggcgcgcatggagctctttctgttcctgacaactatcttgcagaactttaatttgaagagtgtggacgacctcaaaaatctcaacaccacagccgtgaccaaaggaatcgtgtctttgccaccttcttatcagatttgtttcattcctgtgtag

SEQ ID NO: 184459 - DNA, 1167 bp, Artificial Sequence
  Description of Artificial Sequence: Synthetic coding sequence
atgttcctgcagcccatcgccaagggcatcatcagcagcaacggcaaacgttggaaagaaatccgcaggtttagcttaacaaccctgcgcaactttggcatgggaaaacggagtatagaagatcgggttcaggaggaggcccattgcctggtagaagaattgcgaaagacaaaagcatcgccttgtgatcccaccttcattttggggtgcgccccgtgcaatgtcatctgtagcgttgtattccagaagcggttcgactacaaggaccagaatttcttgaccctcatgaagcggtttaacgagaatttccgcatactaaactccccgtggattcaggtttgtaacaacttccccttactgatcgattgttttccaggaacccacaataaggtgctgaagaacgttgccctgactcgttcatacatccgggagaaagttaaggaacaccaagcctctcttgacgtcaacaacccgcgggattttattgattgtttcctgatcaagatggagcaggagaaagataaccagaagtccgagtttaacatcgagaatcttgtgggaaccgtcgctgatctgttcgttgctggcactgaaacaacctctaccacactgcgctatggactgttactgctgctgaagcatcccgaagtcactgctaaagtccaggaagagatagaccacgttattggacgacacaggagcccgtgtatgcaggacaggagccatatgccgtacaccgatgcggtcgtgcatgaaattcagaggtactcggatctagtgcctactggtgtccctcatgctgtgacaactgacaccaaatttcgcaattacctcatccccaagggcactacaataatggcccttctgacttctgtgctgcacgacgacaaggagttccctaacccaaacatcttcgaccctgggcattttctggataaaaacggaaatttcaaaaaaagcgattatttcatgccattcagtgcgggtaaacgtatctgcgccggcgaaggtctggcaaggatggaattattcctgttcctgaccacaatcctacagaacttcaatctaaagtctgtcgatgacctgaagaacctcaatactaccgcagtcacaaaagggattgtttccctacccccctcataccaaatatgcttcattcctgtatag

SEQ ID NO: 184460 - DNA, 924 bp, Artificial Sequence
  Description of Artificial Sequence: Synthetic coding sequence
atggccgccaagtgctgcagcaccttcttcctgggctgcgagttctctcagttcctgccactgttccttttgggaataatctctagcaatggcaagaggtggaaagaaatccgtcggttttccttgactacactccgcaacttcgggatgggcaaaagatctattgaagatagggttcaagaggaagctcattgtctggttgaggagctgcgcaagaccaaggccagcccttgcgatcccactttcatccttggctgcgcaccatgcaacgtgatttgctccgtggttttccagaaacgctttgactataaagatcagaactttctgacgctcatgaagaggttcaacgagaatttccgcatcctgaattcaccttggatccaggtttgtaataatttccccttgctcatcgactgctttccgggtacccataataaggtgctgaaaaatgtagctctgacacgttcctacatcagggagaaggtgaaggagcatcaagcatctcttgacgtcaataatccccgcgactttatagactgcttccttataaaaatggaacaggagaaggataatcagaagtccgagttcaatatagagaacttagtcggaactgtggctgacctttttgtggcgggcacagagacaactagtaccacactgcggtatggcttgctcctcctcctgaagcaccctgaagttactgccaaagttcaggaggaaatcgaccatgtcattgggcgacacaggtcgccctgtatgcaggatcgcagccacatgccctacaccgatgcagttgtacatgaaatacagcgttactctgaccttgttcctaccggcgtcccccacgccgtgaccacggataccaaattccgaaattaccttatcccgaagtccttcgacaacaaaatcatgctggccgcctag

SEQ ID NO: 184461 - DNA, 1473 bp, Artificial Sequence
  Description of Artificial Sequence: Synthetic coding sequence
atggacagcctggtggtgctggtgctgtgcctgagctgcctgctgctgctgtctttatggcgtcagagttccgggcgaggaaaactccccccagggcccacaccgcttcctgtcatcggaaacatccttcaaatcggtataaaagacatttctaagagcctgacgaacctgagcaaagtgtacggaccggtgtttacgctgtattttggcctcaagcccatcgtagtacttcacgggtacgaggctgtgaaggaggccctgattgacctgggagaggagttctctggaaggggaatcttcccactggcagagagagctaatcggggattcggcatagttttttccaacggcaaaaaatggaaggaaattaggcgattcagtcttatgacacttcggaatttcggcatgggcaagcgaagcattgaggatagagttcaggaagaggcacgctgcctcgtggaggagcttaggaagaccaaggcttctccctgcgatccaacatttatactcggttgcgctccctgcaatgtaatctgtagcataatctttcataagcggttcgattacaaggaccagcagtttctcaaccttatggaaaagttaaatgaaaatatcaagattctctccagcccctggatacagatttgtaacaacttctccccaattatcgactattttcctggcacccataataaactcctaaaaaatgtggcctttatgaagtcctatatcttggagaaggtaaaggaacatcaggagtcaatggatatgaataacccccaagatttcatcgactgctttttgatgaaaatggagaaagagaagcataaccagccttctgagtttacaatcgagtcgctcgagaataccgctgttgacctgttcggtgccggaaccgagaccaccagcaccactttacggtacgcgctgctgttattactcaagcatcctgaggtcaccgccaaggtgcaggaagaaatcgagcgcgtgattgggagaaatcgctcaccatgtatgcaggatcggtctcatatgccttacacagatgcagtcgtgcacgaggttcagcgctatatcgacctgcttcctacctctcttcctcacgctgtcacttgtgacattaagtttagaaactatctaatcccaaagggaacaacaatcctcatctctctgacaagtgtgttacatgacaataaggagttcccaaaccctgaaatgttcgacccccatcatttcttggatgaaggaggcaacttcaaaaaaagtaaatactttatgccgtttagcgccgggaagcggatttgtgtgggcgaagctcttgccgggatggaactctttttgttcttaactagcattctgcagaactttaaccttaagagccttgttgatccaaagaacctggacaccacacccgtggtgaatggtttcgcttcagtgcctcccttctaccaactgtgtttcattccagtgtag

SEQ ID NO: 184462 - DNA, 1362 bp, Artificial Sequence
  Description of Artificial Sequence: Synthetic coding sequence
atggacagcctggtggtgctggtgctgtgcctgagctgcctgctgctgttgagtctttggagacagtcaagcgggcggggcaaattgccccctggacctactccactccccgtgataggcaatattcttcagatcgggatcaaggatatatccaagtccctcacaaatctgtcgaaagtatatgggccagtattcactctttacttcggactaaagcctattgttgtgttgcatggctacgaggccgtgaaagaggctctaatcgacctgggagaagaattttccgggcgcgggatttttcccttagctgaaagggctaacagaggattcggcattgtcttctctaacggcaaaaaatggaaagagatccgcagattttcccttatgacactgagaaatttcggaatgggcaaacgcagtattgaggaccgcgtccaagaggaagcaaggtgtctggtggaggagctaaggaagactaaggcgtccccctgcgacccaaccttcattctggggtgtgccccttgtaatgtcatttgctcaataatttttcataagcgattcgattataaagatcaacagttcctgaacctgatggaaaagctcaatgagaatatcaagatcctctcaagtccttggatacagatctgtaacaacttcagtccgatcattgactacttcccaggcacacataataagctgctcaaaaacgtcgctttcatgaagtcttatattcttgagaaagtgaaggagcaccaagaatctatggacatgaacaacccccaggatttcattgactgtttccttatgaaaatggagaaggaaaaacacaatcagccctcggagttcactatagaatccctggaaaataccgccgtggatctgttcggggctggtactgaaaccacatctacgaccctccgctacgccctgctgcttttacttaagcaccccgaggtcaccgcgaaggtgcaggaagaaattgaacgcgtgataggacgaaatcgatcgccatgtatgcaggacaggtctcacatgccttatactgatgccgtggtgcatgaagtacagagatatatcgatctgctgcctactagtctcccccacgctgtcacatgcgacattaagttcaggaactacctgatcccgaagggcaccaccattctcattagcctaacaagtgttctgcacgataataaggagtttccaaacccagaaatgtttgatccacaccattttctagatgagggtggaaactttaaaaaaagtaagtacttcatgttggttcttaagatgatccggaccgagcgaactaagcgtaagcgtgtaggcaagctgttttgggttagtgtgagagtcacctag

SEQ ID NO: 184463 - DNA, 1341 bp, Artificial Sequence
  Description of Artificial Sequence: Synthetic coding sequence
atgggcctggaggccctggtgcccctggccgtgatcgtggccatcttcttgctgctagtggacctgatgcacagaaggcagcgatgggctgcccggtatcccccaggacctctgcctctcccaggcctaggaaacctcctgcatgttgatttccaaaatacaccttactgcttcgaccagttacgcagaagatttggcgacgtgtttagcctccagctcgcgtggaccccagtggtggtgctgaatggactcgcagccgtgagggaggccctcgttactcacggcgaggacacagccgatcggcctcctgtcccaattacccagatcttaggcttcggtccaaggagccaggggaggccgtttcgcccaaatggtttgctcgataaggccgtaagcaacgtcatcgcaagtctaacatgcggccgccggttcgagtatgatgacccgaggtttctgcgcctgttggacctggctcaggagggattgaaggaagagagcggtttcttgcgtgaggtcctgaacgccgtgcctgtgctgctgcacatccctgcgctggccggtaaagtgctaaggtttcaaaaagcctttttaacccaactagacgaactactgaccgaacaccggatgacctgggatcctgctcagccccctcgggacctaactgaagccttcctggctgagatggagaaggccaaaggcaatcctgaatcttcttttaatgatgaaaacctctgtatcgtggtcgccgatctctttagcgcggggatggttaccactagtacaacactcgcttggggactgttgttgatgatccttcatccagatgtccagcggagggtacagcaggaaatcgacgatgtcattggccaagttaggcgccccgagatgggagaccaggctcacatgccgtataccaccgccgtgatccatgaagtgcagcgctttggggacatagtgcctctaggggttacacatatgacatcaagggacatcgaggtgcagggcttccgcattcctaagggtacgacactcatcactaatttaagctcagtgctcaaggatgaggccgtctgggaaaagccatttaggttccatcccgaacactttttagatgcacaaggccattttgtgaaaccagaggcattcctccccttttctgctggaaggcgcgcttgtttgggcgagcctctcgctagaatggaacttttcctgtttttcacgtctctgctacagcatttttcgttttctgtacccacaggccagccacgaccatcgcatcacggcgtcttcgcatttttagtcacaccctcaccgtatgagctctgcgcggttcccagatag

SEQ ID NO: 184464 - DNA, 1494 bp, Artificial Sequence
  Description of Artificial Sequence: Synthetic coding sequence
atgggcctggaggccctggtgcccctggccgtgatcgtggccatctttctgctattggtcgacctcatgcaccggcggcagaggtgggccgcccgttacccgccagggcccctaccactgccggggttagggaacttgctacacgttgacttccagaacactccgtactgttttgatcaactgcggcggaggtttggagatgtatttagcttgcaattggcctggactccagtcgtggtgctgaacggacttgctgctgtgcgcgaggccctggtgacccatggggaagataccgccgaccgcccccctgtcccgataacccaaatcctgggtttcggaccacgcagccagggggtcttcttggccaggtatggacctgcctggagggaacaacgcagatttagcgtgagcacacttaggaacctcggactaggcaaaaaatccttggagcagtgggtgaccgaagaagctgcatgtttatgtgcagcattcgccaaccactctgggcgacccttccgacccaacgggctgctagataaggctgtgagtaatgttatcgcctcccttacgtgcggaaggcgatttgagtatgacgatcctcgattcctgaggctgcttgacctggctcaagagggactgaaggaggagtcaggctttctccgcgaggtcctgaatgccgtcccagtgcttctgcacattccggccttggcaggcaaagtactccggtttcagaaagcctttctaacccagttagacgagttgcttaccgaacatagaatgacctgggaccctgcacagccccccagggatctgacagaggctttcctggccgagatggagaaagccaaggggaacccggaatccagcttcaacgacgagaatttgtgtatcgtggttgctgatctgttctccgctggtatggtgacgacatcaacaacgttggcatggggtctccttctgatgattttgcatcctgacgtccagcgtagagttcagcaggaaattgatgacgttattggacaggtcagacggcctgagatgggagatcaggcccacatgccgtacactaccgctgtaatccacgaagttcagcggtttggcgatatcgtcccgctgggcgttactcacatgacttcccgtgatatcgaagtacaggggttcagaatccctaagggtaccacactgattacgaatctttccagtgtgctgaaggacgaggctgtctgggagaaaccctttcgttttcaccccgaacacttcctggatgctcaggggcatttcgtcaagccagaggcctttttacctttttcggcaggcaggcgtgcttgcctgggagagccccttgcgcggatggagctgtttctgtttttcacaagccttctacagcacttttcctttagtgtgcctactggtcaacctcgaccaagtcaccacggtgtgttcgcatttctggtcacgccaagtccgtatgagctgtgcgccgtcccccgatag

SEQ ID NO: 184465 - DNA, 1494 bp, Artificial Sequence
  Description of Artificial Sequence: Synthetic coding sequence
atgggcctggaggccctggtgcccctggccgtgatcgtggccatcttcttacttttagtcgacctgatgcacagacgacaaagatgggcggctaggtatccgccaggccccctgcccctgcctgggctaggcaatttgctccatgtggattttcagaacacaccttattgcttcgatcagctgagaaggcggttcggagatgtgttctccctccaattagcctggactccggttgtcgttctgaatgggctcgcagctgttcgcgaggctttagtgacccatggcgaggatactgccgaccgcccgcccgtgcccattacccaaattcttgggttcggccctagaggacagggggtgtttcttgcaagatatgggccagcctggcgcgaacagaggagattcagcgtttcgactcttcgtaacctgggcctgggaaaaaagagtctcgaacagtgggttaccgaagaagctgcgtgcctctgtgccgcttttgcgaaccacagtgggcggccctttcgtccgaacggcctgctggataaggctgtttctaatgtgattgcaagcctgacatgtggcagaagatttgaatatgacgaccctagatttctcagactgcttgacttagcacaagagggcctaaaggaggagagtgggttccttagagaagtgctgaacgctgtgcccgtgctgctccatatccccgccctggcaggaaaagtgctcaggtttcaaaaagccttcctgactcagctggacgagctcctgaccgaacatagaatgacctgggaccctgcacagccaccgagggacctgaccgaggccttcctggccgagatggagaaggccaaaggcaatccagagagctccttcaatgacgagaatctttgcattgtcgtggcagacctgttctctgccggcatggtcacaacctctactacactcgcctggggtctgctcctaatgatccttcacccagacgtgcagcgaagagtacagcaagagatcgacgacgtaattggccaggttcgtcggccagagatgggcgatcaagcgcacatgccatatacgacggctgtgatccacgaagtccagcggtttggggacatcgtacctctgggggtgacacacatgacctcccgggatatcgaagtgcagggtttccgcatcccaaaaggtaccacattaatcaccaacctgtcatccgtgctgaaggacgaagctgtctgggagaagcctttcagattccaccctgagcacttcctggatgcccaaggccatttcgttaagcctgaggccttcttgcccttctctgccggccgacgggcgtgcctgggggagcccctcgcacgtatggaactgttcttgttctttacatccctgctgcagcacttttccttctcggtgccaacagggcagccacgacccagccatcacggcgtcttcgcattccttgttactccatccccttatgaattgtgcgcggttccccggtag

SEQ ID NO: 184466 - DNA, 1332 bp, Artificial Sequence
  Description of Artificial Sequence: Synthetic coding sequence
caggaggccctgaccctgcccctgcagctgcggcggcggttcggcgacgtcttctctttgcagctcgcttggacccccgtcgttgtgctcaacgggctggcagccgtgagggaagcacttgtgacacatggagaggacacagcagaccgtcctcccgtccccatcacccaaattctgggatttggacctcgggggcagggagtatttctcgccaggtacggacctgcctggagagagcaacgaagattctccgtgagcactctccggaacctggggctgggcaaaaaaagtctggaacagtgggtgacagaagaggcagcctgtctatgcgccgcgtttgctaatcacgatgccccattcgccccaaccgtgagctggactaaaccaaacgtaatagcctctctaacctgcggaagacggttcgagtacgacgaccctagattcctccgactgctggatcttgcacaagaaggtctcaaagaggaatcgggcttcctacgagaggtcctgaacgcagtgccagtgcttctccatattcctgccctcgcagggaaggtgctacgcttccagaaggctttcctcacacagttagatgagctgctcaccgaacatcgtatgacctgggatccagctcaacctcctcgagacctgacagaggcgtttttggcagagatggagaaggcaaaaggtaatccagagagctctttcaacgacgagaatttatgtattgtagtggcagatctattttctgcggggatggttacgaccagcacgaccctcgcatgggggttgctgctgatgatcctgcaccccgatgttcaaaggagggtccagcaggaaatcgatgatgtgattggtcaagtgcggcgacctgaaatgggtgaccaggcacacatgccatacacgactgccgttatccacgaagtgcagagattcggagacattgtgccactgggtgttacccacatgacatcccgagacatcgaagtacagggtttccgcattccgaaaggtacaaccctgattactaatcttagctcagtactaaaggatgaggctgtttgggaaaagcccttccggttccatcctgaacactttctggacgcccaggggcactttgttaaaccggaggcgtttctcccattcagcgccggtcgtcgcgcttgcctgggcgagccgctcgctcggatggaattattcctcttctttacctcattactgcagcatttttcgtttagtgtgccgaccggccaaccaaggccttctcatcacggggtgtttgcttttctggttactcctagcccctatgaactctgtgccgtccctaggtag

SEQ ID NO: 184467 - DNA, 1341 bp, Artificial Sequence
  Description of Artificial Sequence: Synthetic coding sequence
atgggcctggaggccctggtgcccctggccatgatcgtggccatcttccttctactagtcgatctgatgcaccgacgacagaggtgggcggcaagatatcctcccggccccttacctctgcccggcttaggcaatctcttacatgttgacttccagaacaccccctactgctttgaccagctgaggagacggttcggggacgtattttctctgcagctggcatggacgcccgtggtcgtcttgaatgggctcgcagccgtgagagaggcactggtgacccacggagaggacacagctgacagaccccccgtgccgattacccaaatcttgggattcgggcccaggtcccagggccggcccttccggcccaacgggctgctcgataaggccgtctcgaatgtgatcgcttcactcacatgtgggcgacgatttgaatatgacgatcccagattcttacgactgttggatctagctcaggagggcctcaaggaagagtccggctttcttagggaggtactgaacgctgttccggtcttactccacatccccgctctggccggtaaggtgctgcgctttcagaaagccttcttaacacagttagacgaactgcttacagaacacagaatgacctgggatccagcacaacctcctcgcgacctgacggaggctttcctggctgagatggaaaaggccaaagggaaccctgagagtagtttcaatgatgagaatttatgcattgtggttgccgatcttttctctgccggcatggtaacaacctctacaacattagcgtggggcctccttctcatgatcttgcaccctgatgtccaacggcgcgtacaacaagagatcgatgacgtgataggacaggtgcgccgccccgagatgggggatcaagctcacatgccatacaccacggccgtgatacacgaggttcaacgcttcggcgatatagtgcctttgggggttacacacatgactagccgcgatatagaggttcaaggatttcgaattcccaaggggactaccctcataacaaacctttcttctgtgctcaaggacgaagccgtctgggagaaaccatttcggttccaccctgaacacttcctggacgcccaggggcatttcgtgaaaccagaggctttcttgccttttagcgctggccgaagagcctgtttgggggaacctttggcccgaatggagttatttctcttttttacctctctcctccagcatttctctttctctgttccaactggacagccccgcccctctcaccatggggtgttcgcatttttggtgacaccctctccgtatgaactatgcgcagtgccgcgctag

SEQ ID NO: 184468 - DNA, 1482 bp, Artificial Sequence
  Description of Artificial Sequence: Synthetic coding sequence
atgagcgccctgggcgtgaccgtggccctgctggtgtgggccgccttcctcttgctggtttcgatgtggcgtcaggtgcattcttcatggaaccttccccctggacctttcccgctgccgataatcgggaatttgttccagcttgaattgaaaaacattcccaagtccttcacgaggttggcacagagatttggcccagtgtttactctgtatgtcggctcccagagaatggttgtcatgcatggttacaaagcggtcaaggaagccctgttggattacaaagacgaattctctggacgaggagacctgccagccttccatgcccatagagatcggggcatcatatttaataatggacccacctggaaagacattcgtcggttttcattgacgacactcagaaactatggtatgggaaagcagggcaacgaaagcagaattcagagagaagcacattttttgttggaggcactgaggaaaactcaagggcagccctttgacccaactttcttaatagggtgcgcaccttgcaatgtgatcgccgacatcttgtttcgaaaacacttcgattataacgatgagaagttcttaaggctgatgtatctatttaacgagaacttccatttactgtctaccccctggctccagctgtacaacaattttccctcgttcttacactacctgcccggatcgcacagaaaggtgattaaaaacgtcgctgaagtaaaagagtacgtgagtgagagggttaaagagcaccaccagtcactcgatcccaattgccctagagatctgaccgactgcctactggtggagatggaaaaggaaaaacattccgcagagagactctacactatggatggaatcaccgttacagtggcggatttgttttttgctggcaccgaaacgacctctacgactctgcgctatggtttgctaatcttgatgaagtacccagagatcgaagaaaagctgcacgaagaaatcgatagagttattggccctagtcgaattccagccataaaggacaggcaggagatgccatacatggatgcagtcgtgcacgaaatccagagattcatcaccctggtgccctcaaacctgccacacgaagctactagggatactatatttaggggctatttaatcccaaaaggcaccgtggtggtgccaacactagactcagtactgtatgacaaccaggaattcccagatcccgaaaagtttaagcccgagcattttctgaatgaaaacgggaagttcaaatattcagattacttcaagcccttctctaccggtaagagagtttgcgcaggtgaggggctggcccgcatggagctcttcctgctgttgtgcgcaattcttcagcactttaacttgaagcctctcgtggatcctaaagatatcgatctctctcccattcatatcggttttgggtgcatcccaccccggtataagctgtgtgtgataccccgcagttag

SEQ ID NO: 184469 - DNA, 1482 bp, Artificial Sequence
  Description of Artificial Sequence: Synthetic coding sequence
atgagcgccctgggcgtgaccgtggccctgctggtgtgggccgcctttctgctgcttgtgtcaatgtggcgacaagtacattcttcttggaatctgccccccgggccattccctctgcctatcattggcaatctcttccagctcgagctgaaaaacattcctaaatcctttactagactggctcagcggtttggaccagttttcaccctgtatgtgggaagtcagcggatggtcgtcatgcatggttataaagccgttaaggaggcactgctggactacaaagacgagttttctggacggggggacctccctgcgttccacgcccatcgtgaccgtgggatcatctttaacaacggacccacctggaaggatatcagacgttttagcttgaccacactgcggaactatgggatgggaaaacaaggcaacgagtcccgcatccaaagagaggcccatttcctcctagaggcactccgcaagactcaggggcagccctttgatcccacttttcttatcggatgcgctccttgtaatgtgatcgcagacattctcttccggaagcatttcgattataacgatgaaaaatttctgcgcctaatgtacctgttcaacgagaactttcatctgttaagtaccccatggcttcagttatacaataattttccatcatttctgcactatttgcccggaagccaccggaaagtgataaagaacgtggctgaggttaaagaatatgtgtcggagcgcgtaaaggaacaccatcaaagcctcgaccctaattgtccacgggacttaaccgattgtctgttggtggaaatggaaaaggagaagcactctgccgaaaggctttacacaatggacggaataacggtcactgtcgctgatttgttcttcgccggcacggaaacaacgtcaactaccctcaggtacgggctgctaattcttatgaagtaccctgagattgaggagaaacttcacgaggaaatagaccgagttatcgggcctagtaggattcccgcaataaaggatcgccaggaaatgccctatatggacgcagtcgtacatgaaattcaaaggtttattaccctggtgccttccaacctgccccatgaggcgacgagggatactatctttcgcggctatttgatccccaagggaacagtggttgtgccaactctcgactctgtcctctacgataatcaggaattccctgaccctgagaaatttaagccagaacacttccttaatgagaacgggaagttcaaatactctgattacttcaaaccgttttcaactggcaagcgggtctgtgcaggggaggggttggcgcggatggagctgttcctgctactgtgcgccattctacagcattttaacctcaaacccctcgttgaccccaaagacattgatctgtcccccatccatattggtttcggctgtatcccacctcgctacaaattgtgcgtgatcccaagatcctag

SEQ ID NO: 184470 - DNA, 261 bp, Artificial Sequence
  Description of Artificial Sequence: Synthetic coding sequence
atgagcgccctgggcgtgaccgtggccctgctggtgtgggccgcctttcttctcttggtcagcatgtggagacaggtccatagctcctggaacctaccccccggtcctttcccgcttcccatcatcgggaacctcttccaactggaactgaaaaatattcctaaatcttttacacgcttggcccaacgatttggacctgtgtttaccctgtacgttggctcccaaaggatggtggtgatgcacggatacaaagccgtttag

SEQ ID NO: 184471 - DNA, 1476 bp, Artificial Sequence
  Description of Artificial Sequence: Synthetic coding sequence
atggacagcatcagcaccgccatcctgctgctgctgctggccctggtgtgtctgctcttgaccttgtcaagccgtgataagggaaagctccccccgggccctagaccgttgagcatcctgggcaatcttttgttgctttgtagtcaggacatgctgactagtctgacgaaattgagcaaggagtatggcagcatgtacaccgtgcatctgggtccacgtagagtcgtggttctcagcggttatcaagctgtcaaggaagccctcgtggaccagggtgaagaattctccggcagaggagactacccagccttctttaacttcacaaagggaaacggtatcgcattttcaagcggcgaccggtggaaagtgctgcgccaattctctatccagattctgagaaattttggcatggggaaacgctccatcgaagagcgtatactggaggagggatcctttctgctggcggaactgcgcaagaccgaaggagagccttttgatcctacgtttgtgctatctcgctctgtgagcaatatcatatgtagtgtcttgtttggctcacgcttcgattatgatgacgaaaggctgctcacaatcatccggctcattaatgataatttccaaattatgagctcaccttggggagagctctacgacatttttccatcactcttagactgggttcccggtccccatcagcgtatcttccaaaacttcaaatgtctgcgcgatcttattgcccatagtgtgcacgaccaccaagcttctctcgaccctagatccccgagggacttcattcaatgctttttaacgaagatggccgaggaaaaagaggatcctctgtctcatttccatatggatacactattgatgacaacacacaatcttctttttggaggcacaaagacggtcagtaccaccttacaccatgcattcttggctctgatgaagtatcctaaggtacaagcgcgcgtgcaagaagagatagacctggtggtgggacgggctcggcttcccgctctgaaggaccgagccgccatgccgtatacagacgccgtcatccacgaggtgcagcgcttcgctgatataattccaatgaacctccctcacagggtcacgcgcgataccgcgttccggggttttttaattccaaaggggacagatgtcataaccctactcaacaccgtacactacgaccctagtcaatttctgacgcctcaggaatttaatcccgaacattttcttgacgcaaatcagtcctttaagaagtcccccgcattcatgccatttagcgcgggccgccggctttgcctgggggagagcctagcccgcatggaacttttcctctatctcacagcaatattacaatccttctctctgcaacccctaggagctcctgaagatatagacctcacccctctttcatccgggttgggcaatctgccccgccctttccagctctgtctgagacctaggtag

SEQ ID NO: 184472 - DNA, 1509 bp, Artificial Sequence
  Description of Artificial Sequence: Synthetic coding sequence
atgctggccgccatgggcagcctggccgccgccctgtgggccgtggtacacccaaggactctgctgctgggcactgttgctttcctcctggctgccgatttccttaagagacgccgtccgaaaaattacccacccggtccatggagactgccgttcctcggcaacttttttctggtcgatttcgaacagtcccatctcgaagtgcagctttttgttaaaaagtacgggaatctcttttcccttgaactcggcgacattagcgctgtgctgataacaggactccccttaatcaaggaagcgttgattcacatggaccaaaacttcggaaaccggccggttacaccaatgcgggaacacatcttcaaaaaaaatggtctcatcatgtcctctggtcaggcgtggaaggagcagaggaggttcacactgaccgcgctgcggaacttcggcctgggaaaaaagagcttagaggagcgaatccaggaggaggcacaacacctgactgaagcaatcaaagaggagaatggccaaccattcgatccccacttcaagatcaacaatgccgtgagcaacataatctgcagcatcacattcggagaacgttttgagtaccaggactcttggtttcagcagcttcttaaattattggatgaagtaacttacttggaggcgagcaaaacctgccaactctataacgtatttccctggatcatgaagtttttgcctgggccacaccagacgctcttttcgaactggaaaaaactcaagcttttcgtgtcacacatgatagacaagcataggaaggactggaatcctgccgagaccagagattttatagatgcttacttgaaagagatgagtaagcacacaggaaacccgacctcctcttttcacgaggaaaacctgatctgcagcactctggacttattctttgcaggcaccgaaacaactagtacaaccctccgatgggccctcctgtatatggccctttaccccgagatccaagagaaagtgcaggcggaaatcgatagagttattggccagggccagcagcccagcacagcggcccgcgagtctatgccatacaccaacgcggtgattcatgaagtgcagcgaatgggaaacattatacctctcaacgtgccccgcgaagtcaccgtcgataccacgctcgctgggtatcatctgcctaagggtaccatgatcctgacgaacctgactgctctccatagagacccaacagaatgggccacaccagacactttcaaccccgaccattttctggaaaatggtcagtttaagaagcgcgaggccttcatgccatttagcataggtaagagggcctgcctgggtgaacaactcgccaggacagagttatttatttttttcacatctcttatgcagaagttcactttccgcccccctaataatgagaagctgagccttaaatttagaatggggatcactatctcccctgtgagtcatcggctgtgcgcagtgccccaggtgtag

SEQ ID NO: 184473 - DNA, 1506 bp, Artificial Sequence
  Description of Artificial Sequence: Synthetic coding sequence
atgtggaagctgtggcgggccgaggagggcgccgccgccctgggcggtgcgctttttctgctgttattcgccctgggggtacggcaattgttgaaacagcggaggcctatgggcttccccccaggcccacccggactcccatttattggcaatatctattctttggccgcatccagtgagctccctcacgtgtatatgaggaaacagagccaagtctacggcgaaatctttagtttagatctgggtggcattagcaccgttgtgctcaatggatacgatgtggtcaaagaatgcctggtgcaccagagcgagatttttgcagatagaccttgcctacccctatttatgaaaatgaccaagatgggaggtctgcttaacagccggtacggacggggatgggtagaccacagaaggctcgctgtgaatagttttaggtatttcggatatggtcaaaaatcttttgaatctaaaatcctggaggaaaccaagtttttcaatgatgccattgagacctataaaggtcggccctttgattttaagcagctgataacgaacgccgtaagtaacattaccaacctgatcatctttggagaacgctttacttatgaggacactgatttccaacacatgattgagttgttcagcgagaatgtggagcttgccgcatccgcgtccgtctttctgtataatgcattcccttggattggcattttacctttcgggaagcaccagcagctgttcagaaatgccgccgttgtctatgacttcttgtctagactgatagagaaagccagcgtgaatcggaagcctcagcttccgcaacacttcgttgatgcctatttagatgagatggatcagggcaagaacgacccgtcatctaccttttctaaggagaatctcattttttctgtcggtgaattaattatagctggaaccgaaacaacaactaatgtgctgagatgggccatattgttcatggcactctaccccaacatccaggggcaggtgcagaaagagatcgaccttatcatgggaccaaatggaaaaccatcctgggatgacaagtgcaaaatgccatacaccgaagcagtgctccatgaagtcctgcggttttgcaatattgtcccgctgggcatcttccacgctaccagcgaggatgctgtggttaggggctactccattcctaagggaacgacggtgatcacaaatctctacagtgtgcatttcgatgaaaagtactggcgtgatcctgaagttttccatccagaacgctttcttgactctagcggatactttgccaaaaaagaggccttggtcccattctctctcggccgtagacactgtcttggggaacaccttgccagaatggagatgttcctgttctttactgcccttctgcagaggttccatctgcactttccacatgaactggtgcccgatcttaaaccccggcttgggatgactctccagccccagccctacctgatttgtgccgagcgtagatag

SEQ ID NO: 184474 - DNA, 1695 bp, Artificial Sequence
  Description of Artificial Sequence: Synthetic coding sequence
atggaggccaccggcacctgggccctgctgctggccctggccctgctcctcctcttgacgttagctctcagcggtacgagggcccgcggccatcttccccctgggccgacaccattgccactgctcggcaatcttctgcaattgaggcctggcgctttgtatagcgggctaatgcgcctgagcaaaaaatacggccctgttttcaccatctatctgggcccatggcgccccgttgtcgtactggtggggcaggaagccgtacgcgaagccctgggtggacaggccgaggagttcagtgggcggggaacagtggccatgctggagggcacgttcgatgggcacggcgtgtttttctccaatggggagcggtggcgccagctgcggaaattcacgatgttggcacttcgggatctcggtatgggaaagcgcgagggggaggagttgattcaggcagaggccagatgcctagtggaaacctttcagggcaccgagggacgaccattcgacccatcgttattgctggctcaggccacttctaatgtagtgtgctccctcctgttcggtctgcgattcagctacgaggacaaagagttccaggccgtggtgagagcagcaggaggcacccttctgggtgtcagtagccaaggagggcagacatacgaaatgtttagctggttcctgcgccccttgcccggaccccataaacaactgctgcaccatgtgagcacactcgctgcctttaccgttcgccaggttcagcagcaccagggtaatcttgatgcctctggccctgcacgggacctcgttgatgcctttcttctcaaaatggcccaggaagaacagaatcctggcacagagttcactaataagaatatgttaatgacagtgatatacctgctcttcgcgggcacgatgactgtttccaccaccgttggctataccttgcttctactgatgaagtatccacacgtgcagaagtgggtgagagaggaactcaacagggagctcggggctggccaggcccccagcctgggggatcggactcgcctaccttatacggacgcagtgctccacgaggcccagaggctactggctttggtcccgatgggcatacccagaacactcatgcggacaacaagattccgcggctataccttgccccagggtactgaagtatttcctctgctcgggtctatcctgcacgatccaaacatcttcaaacaccctgaagaattcaatcccgaccgattcctggacgcggacggacgatttcgtaagcacgaggcctttctgccgttttcgcttggtaaaagggtgtgtttgggtgagggactggccaaagccgagcttttcctcttttttactactatcctgcaggctttcagcctcgagtccccgtgcccacccgatacattgagcctcaaacccacagtgagcgggttgttcaacatcccaccagcatctactgtcgggatggatagggtaaatgtatctcgtgtctacaccgcaggcagccatatatatacgccagccgtggtgtttcggtccctgtcccatgggccacatgcacacctgacccatgcggcgaaaatgcataatcggacacctatccacaactataaggggcacaaagctaccgctggcctcgctttccacaggcacaagtactcccctagcgcgattacttccacgtag

SEQ ID NO: 184475 - DNA, 1515 bp, Artificial Sequence
  Description of Artificial Sequence: Synthetic coding sequence
atggaggccaccggcacctgggccctgctgctggccctggccctgctgctcctcctaacccttgcactgagtggcacccgagctagaggtcatctgcctccaggcccgacaccacttccccttctgggcaacctgcttcagctgcgccctggagctctgtattccggcctcatgcgcctcagcaagaagtacggccctgtctttacaatctatctgggaccttggcggcctgtggtggtgctggtcggccaggaagcagtgcgagaagccctggggggacaagcagaggaattcagtggtagaggtactgtggctatgctagaaggcacttttgacggtcacggagtatttttctccaacggcgaaagatggcggcagctgcggaagttcactatgttggcgctccgtgatctgggaatgggtaagagggagggggaggaattaattcaggcggaagcacggtgtctggttgagacatttcaaggcactgaagggcgccccttcgatccttcgttactgctggcacaggccacctctaatgtcgtgtgcagtctcctgtttggccttaggttcagctatgaagacaaggaatttcaggcagtggttagggctgccggggggaccttgcttggggtatcttcacagggaggacagacatatgaaatgttctcttggtttctgcgccctcttccaggaccccataagcaactgctccatcatgtttcaaccctcgccgcctttactgttcgtcaagtccagcagcaccagggtaacctggatgcctcaggccccgcgagagatctggtcgacgctttcctgctcaagatggcacaggaggaacagaatcctgggaccgaattcactaataagaacatgctgatgaccgtgatatacctgctgttcgccggaactatgaccgtatcaacgactgtgggctatactctcttgctcctcatgaaatatccccacgtccagaagtgggttcgggaagaactcaaccgcgaactcggagccggccaagccccctcattgggggaccggacccggctgccctatacagacgccgtgctccatgaggcccagcggctgctcgccctggtgcccatgggcattcctaggaccctgatgcgaaccactcgctttcgtggatacacgctgccacagggcactgaagtattcccccttcttggctccatactccatgaccctaacatcttcaagcatcccgaggaatttaatcccgacagatttctagatgcggatgggcgttttagaaagcacgaagccttcctgccatttagtctgggaaagagggtctgtttgggcgagggcctagcaaaagccgaactgttcctctttttcacaacaatcttacaggcgtttagccttgaaagcccatgcccacccgacacacttagcttgaagccaacagtgagcggactgttcaatatccctcccgcctttcagctgcaagtgcgccctacagatctccattctaccacgcagacacgctag

SEQ ID NO: 184476 - DNA, 690 bp, Artificial Sequence
  Description of Artificial Sequence: Synthetic coding sequence
atggccatggaggagcagaaccccggcaccgagttcaccaacaagaatatgctcatgactgtgatatacctattgttcgccggcactatgacagtgtcaactaccgtgggatacacccttctcttacttatgaaataccctcacgtccagaagtgggttcgggaggagctaaaccgggaactgggcgcaggccaggccccttctctgggggacaggacgcgtctgccttacaccgacgctgttttacacgaagctcagcggctactggcactcgtccctatggggatccccaggactctgatgagaaccactcgcttccgagggtatactcttcctcagggcaccgaggtgtttccactgctgggatcaattcttcacgaccccaatatcttcaagcaccccgaggaattcaaccccgacaggttcctggatgctgacggtcgctttcggaagcacgaggctttcctccctttttccctggggaagagggtgtgcctgggggaggggctagccaaagcagagctcttcctgttctttacgactatcctccaggcattcagcctggaatctccctgccctcctgacactctctctttgaagcctacagtgtctgggctcttcaatattccccccgcttttcagctgcaggttcggccaactgatctgcacagtacaacccagactaggtag

SEQ ID NO: 184477 - DNA, 1635 bp, Artificial Sequence
  Description of Artificial Sequence: Synthetic coding sequence
atgagcagccccggccccagccagccccccgccgaggaccccccctggcctgcccggctgctgagggccccactcgggctcctccgtctggatccatccgggggcgcactcttgctctgtgggctggttgctcttctggggtggtcctggctgagaagacgtagagctcggggcatccctccaggcccaaccccttggcccctcgttggcaatttcggacatgtcttgctccccccttttctccggagaaggagttggctgagcagtcgaactcgggccgcgggcattgatccatctgttatcggtcctcaggtcctgctagctcacctggcaagagtatatgggagtattttttcatttttcattggccattatctggttgtggttctgagtgattttcactctgtgcgagaagcattggtgcagcaggcggaggttttttccgaccggccacgagttcccctgattagcattgtaaccaaggagaagggtgttgtatttgcccactatggaccggtttggcggcaacaaagaaagttcagccactcaacacttcgccacttcgggctcgggaagctttctctcgagcccaaaatcatcgaagagttcaaatatgtcaaggcggaaatgcagaagcacggcgaggatccattctgtcccttctcaattattagcaacgccgttagcaacattatctgctcactttgttttggccagagattcgactacaccaacagtgaatttaagaagatgctcggcttcatgagcagggggctggaaatctgtctgaacagccaggtattgctggtgaacatctgtccgtggctgtactacttaccattcgggccatttaaggagctgcgacagatcgaaaaggacatcacgtcattcttgaagaagataataaaagatcaccaggagtcactggaccgcgaaaacccccaggatttcatcgatatgtatttgctacacatggaagaagaacgaaagaacaacagcaactcaagcttcgacgaggaatatctcttttacatcattggggatctcttcattgcggggaccgataccactacgaatagccttttatggtgtctgttgtatatgagcctcaaccccgatgttcaagagaaagtacacgaagagattgagcgggttatcggggctaatcgtgcccccagccttaccgacaaggcccagatgccatacacagaagcgacgatcatggaagtgcagcggctgactgtcgtggtaccccttgctatcccacacatgacctctgaaaatacggttctgcagggatacaccatcccaaaggggactctaatcctgcctaatctctggagcgtccatcgagatcccgccatatgggaaaaacctgaggacttctatccaaatcggttcttggacgaccagggacagctgatcaagaaggaaacgttcattccgtttggtatagggaagcgcgtgtgtatgggcgaacaattagcaaagatggagttattcctgatgtttgtctccctcatgcagtcattcgcttttgcgttaccagaagactcaaagaagcccctgctgactgggcgtttcggcctgacccttgcccctcaccctttcaacattaccatctccagaagatag

SEQ ID NO: 184478 - DNA, 1506 bp, Artificial Sequence
  Description of Artificial Sequence: Synthetic coding sequence
atgagcagccccggccccagccagccccccgccgaggaccccccctggccagctcgcctgctcagggccccgctcgtggggaatttcgggcacgtgctcctgccccccttcctccggcgacggtcgtggctttcttctcgcacccgggctgcggggattgatcctagcgtcataggcccccaggtgctgctggcgcatttggccagggtttatggaagcatcttttcctttttcattggacactatctggtggtggtgctatcagacttccactcagtcagggaagctctcgtgcaacaggctgaggtcttctccgataggcctagagttccattaattagcatcgtgacgaaagaaaagggggttgtgttcgcgcactacggcccagtgtggcggcaacagcgcaagtttagccactccacccttcgtcattttggcctgggtaagctgtctctggaaccaaaaatcatcgaagaatttaagtacgtgaaggcggaaatgcagaaacacggagaagaccctttctgcccttttagcatcatttctaacgctgtttctaacatcatctgcagcctctgtttcggacagaggttcgattatactaatagtgaatttaagaaaatgttgggattcatgtccagaggattagagatctgtcttaattcccaggtcctcctggtgaacatctgtccctggctttattatttgcccttcggaccttttaaggagctgagacaaattgaaaaggacataacatcgtttctgaaaaagatcatcaaagaccatcaggagagcctagacagagaaaatcctcaggattttatagatatgtatctactgcatatggaagaagagcggaaaaataatagcaactccagcttcgatgaagagtatctcttctacattattggggatttgtttatagccggaactgatacgaccacgaattccctgctctggtgcttactatacatgtcgcttaatccggatgtccaagagaaagtacacgaggaaatcgaacgcgtcattggagcgaaccgggctcccagcctgacagacaaggcgcagatgccctatacagaagctactattatggaggtgcagaggctcacggtggttgtccctctagcaatcccacacatgacctctgaaaacacagtccttcaaggatacactattcccaagggcactctgatactgccgaacttgtggagtgtgcaccgggaccctgccatctgggagaagccagaagatttctaccccaataggttcctggatgaccagggccagttgattaagaaagagacattcatcccgtttggcatagggaaacgagtgtgcatgggggagcagttagccaagatggagctgttcctaatgttcgtgtcactaatgcagtccttcgcctttgcactccccgaggactcaaagaagccactcctcaccggcaggttcggcttgacactggccccgcaccccttcaatattacaatttcccgtcggtag

SEQ ID NO: 184479 - DNA, 1398 bp, Artificial Sequence
  Description of Artificial Sequence: Synthetic coding sequence
atgctgctgctgggcctgctgctgctgctgcccctgctggccggcgccagacttctgtggaattggtggaagttacggtccctgcatctgccgccgttagcccctggctttttacatctcctgcagcctgacttaccaatttatcttttaggtctcacccagaaattcggtcctatttatcgcctgcacctgggtctgcaagataaactcgtcagtagaaattatcccgacctgtctctgggcgactactccctcctgtggaaggctcacaagaagctgacccggtctgccttattgttgggaataagagactccatggagcccgtcgttgaacagctgacccaggaattttgtgagagaatgagagctcaaccagggaccccagtcgcgattgaggaggaattttccctcctcacttgctctattatttgttaccttaccttcggcgacaagatcaaggacgataacctgatgcccgcctactacaagtgcatccaggaggtcctgaagacatggagccattggagcattcagatagttgatgtaatcccctttctgaggttctttcctaatccagggctgcggaggctgaaacaggccatcgaaaagagggatcacattgtagaaatgcaactgcgccagcacaaggaatctcttgttgccggccagtggcgcgacatgatggactacatgttgcaaggagtcgcacagccctcaatggaggaaggtagcggccagctgctcgaagggcacgtacatatggcagccgtcgatttgctgataggtgggacagagaccacagccaacaccctctcgtgggctgtcgtcttcttgttgcatcaccccgaaatacagcaacgactccaggaagagctcgatcacgaactcggtccaggcgccagctcatctcgagtgccatataaagaccgcgcccgactccccctgctcaatgccaccattgcagaggtgctgcgactccgtccggtggtgccgctggccctccctcatagaacaacgaggccgtcatctatttctggttatgatattcctgaagggacggtgattattcccaacctgcaaggcgcccacctggatgagaccgtttgggagagacctcatgagttttggcccgacaggtttcttgagccaggtaaaaacagtcgagctctcgctttcggctgtggggctagagtgtgtctaggggaaccactagcccgactggagctcttcgtggttctgaccaggcttctccaagcgttcaccctactgccaagcggagacgcattgccctctctccagcctctccctcactgtagtgttatcctcaaaatgcaaccttttcaggtgcggcttcagcctcggggaatgggtgcccattctcccgggcagtcccagtag

SEQ ID NO: 184480 - DNA, 1488 bp, Artificial Sequence
  Description of Artificial Sequence: Synthetic coding sequence
atgctgctgctgggcctgctgctgctgctgcccctgctggccggcgcacggctgctgtggaactggtggaagctgcgaagccttcacctaccgcccttggcaccagggtttttgcatctactacagccggacctgccaatctatctcctcggactaacacagaaatttggtccaatatacagattgcatctagggctgcaagatgttgtggtgttaaactctaagagaaccatcgaggaggccatggtgaagaagtgggccgactttgccggacgcccggaacccctgacatacaagctggtttcccgaaactatcccgatctcagcctcggagactatagcctcctttggaaggcccacaaaaagctgaccagatctgctttactactaggcatcagggatagcatggagccagtcgttgagcagctgactcaagagttttgtgagaggatgagggcccagcccggaaccccggtagccatagaagaagaattctctttattgacctgcagtattatttgctatctaacattcggggataaaatcaaggatgataacttaatgccagcctattacaaatgtatccaggaggtcctcaaaacctggagccactggagtattcagattgttgatgtcattccatttctgcggttcttccctaacccaggcttaagacgcttaaaacaggctattgaaaaaagggaccatatcgtggaaatgcaattgagacaacataaagaatccctggtggcaggacagtggcgcgatatgatggattacatgctacagggtgtggctcagccatctatggaggagggatccgggcaactcttggaagggcacgtgcatatggccgctgttgaccttttgatcggtggcaccgagactacagctaatactctttcatgggccgtcgtattcctcttacaccatccggagattcagcagcggctgcaggaggagcttgaccacgaactcggccccggtgcaagttctagccgcgtgccttataaggaccgcgcgcggttgcccctcttgaatgctactatcgccgaagtactgcgccttaggcctgtggtacctttggccctgccccaccgcactacccggccaagttcaatttccgggtatgacatccccgaaggcacagtgatcattccaaacctccagggcgcacacctggacgaaactgtgtgggaacgccctcatgagttttggccagaccgtttcctagagcccggcaagaattctcgagcacttgccttcggatgcggggctagagtgtgtcttggcgaacctctggctcggctcgagttgtttgtggtactaacaaggttactgcaagcctttacgctgctcccttccggggacgctttgccttcactgcagccactcccccactgtagcgtgattctgaaaatgcagcccttccaggtgcggctgcagcctcggggtatgggcgcccatagtccagggcagtctcagtag

SEQ ID NO: 184481 - DNA, 1488 bp, Artificial Sequence
  Description of Artificial Sequence: Synthetic coding sequence
atgctgctgctgggcctgctgctgctgctgcccctgctggccggcgctaggctcctgtggaattggtggaagctgcgctctttgcacctcccgcccctagctcctgggttcctgcatctgttgcagcccgacctccctatctacttactaggcttgacacagaaattcgggccgatctaccgactccacctcgggctgcaggacgtggtggtcctcaactccaaacgcaccatagaagaggctatggtgaaaaaatgggcagatttcgcaggtcggcccgagcctcttacttataagttagtgtcgcgaaactaccccgacctctccctcggcgattacagtctcctgtggaaggcccacaaaaaacttacaaggagtgcccttctcttgggaatcagggattcaatggagccagtagtagaacagctcactcaggaattttgcgagagaatgcgggcccagcccggtacccctgtggcgattgaggaagagttcagcctcctgacttgtagcattatttgctacctaacttttggtgataagatcaaagacgataacctgatgccagcatactataaatgtatccaggaggtcctgaagacatggtcccactggtcaatccagatcgtggatgtgatccccttcttaagattcttccctaaccctggcttacggaggttaaagcaagccatagagaaacgcgatcacatcgtggagatgcagctcagacagcacaaagagtctctcgtggcaggccagtggagggacatgatggactatatgctgcagggggttgctcagccttcaatggaagagggcagcggacaactgctggaggggcacgtccacatggccgctgtcgatctactaataggtggcaccgagacaaccgccaacaccctcagctgggccgtggtgtttcttctgcaccaccctgagattcaacaacggctgcaggaggaactggatcatgagctggggcctggcgcatcaagttcacgagtcccttacaaggaccgcgccaggttgcccctgctcaacgctaccatcgctgaggtcctgcgactgcgaccagtcgttcccctcgccctcccgcaccggacaactagacctagttcgattagcggatatgacataccagaagggacggttatcattcccaaccttcagggcgcccatttggatgaaactgtgtgggagaggccacatgaattctggcccgaccgttttctggaacctggcaagaatagccgtgcacttgcattcggctgtggggcacgggtgtgcttgggagaaccccttgcaagactcgaactgtttgtggttcttacacgactgctgcaagcattcacactccttcccagcggagacgcgctaccgtcactccaaccacttccgcactgtagtgtgattctgaaaatgcaaccctttcaagttcgactgcagcccaggggcatgggcgctcactctcccgggcagagccagtag

SEQ ID NO: 184482 - DNA, 1398 bp, Artificial Sequence
  Description of Artificial Sequence: Synthetic coding sequence
atgctgctgctgggcctgctgctgctgctgcccctgctggccggcgccagacttttgtggaattggtggaagttacgatccttgcatctcccccccttggctcctggatttcttcatcttctgcagccagacctgccgatatacctcctaggcctgacgcaaaagttcggtcctatttataggttgcacctgggcttacaggacaaactggtgtctaggaattaccccgacctgagtctgggagattactcattgctttggaaggcccacaaaaagctgaccaggagcgccctgctgctgggaattcgagatagcatggagcctgttgtggagcaactaacccaagaattctgcgaaaggatgagagctcagcccggcactccagttgcaatcgaggaggaatttagcctgctcacctgctccattatttgctacttgacctttggcgataagattaaggacgacaatctgatgcccgcctattacaaatgcatccaggaagtcttaaagacatggtctcattggagcatccaaatcgtcgacgtgattcctttcctccggtttttccccaaccccggcctgaggcgtctgaagcaggccatagaaaaacgggatcacattgtagagatgcagctgcgccagcacaaagagagcctcgtcgccggtcagtggagagatatgatggattatatgctccagggggtcgctcagcccagcatggaagagggatctggacagctgcttgaaggccacgtgcatatggccgctgtcgatctgctgattggggggactgagactacggcaaacaccttgtcatgggcagtggtgtttctccttcatcaccccgaaatccagcagcgactgcaggaagaattggatcatgaattgggacccggcgcctcctcctccagagtgccttacaaagatcgggcccgattaccactactgaatgcaaccatagctgaggttttgaggctgcgacctgtggtgccactggccctgcctcacagaacaacacgaccaagctctatatctgggtacgacatccccgagggaaccgtcatcattccaaatctgcagggagcccatttagacgaaactgtgtgggagcggccacatgagttttggccggatcggtttctggaaccgggcaagaatagcagggctttagctttcggttgcggggcaagagtttgcctgggtgaaccgctggctcggctcgagttgttcgttgtgctcacccgcctgctgcaagctttcacccttctgccttccggtgacgcactgccgtctctacaacctctgccccattgtagcgttatcctgaaaatgcagccatttcaggtccggttgcaacctcgcggcatgggcgcgcatagtccggggcaatcccagtag

SEQ ID NO: 184483 - DNA, 1398 bp, Artificial Sequence
  Description of Artificial Sequence: Synthetic coding sequence
atgctgctgctgggcctgctgctgctgctgcccctgctggccggcgctcgactcttgtggaattggtggaaactgcggtccttgcatctgccgccgctggcccccggtttcctccacctgctgcagccagatctgcccatatatcttcttggcctgacacagaagttcggcccgatttaccgtctgcacctcgggttgcaggacaaattggtctcccgcaattacccggatctttctcttggggactactcactcctttggaaagcccataaaaaactaactcgttccgcccttctgctgggtattagagattcaatggagcccgttgttgagcaactgactcaggagttttgtgaacgcatgcgggcgcagcctgggacccctgtggccatagaagaggaattctcactgttgacctgctctatcatttgctatctcaccttcggtgataaaatcaaggacgataaccttatgccagcctattacaaatgtattcaagaagtgttgaaaacttggagtcactggtccatccaaattgtggacgttattccatttctgaggttctttcccaacccggggctgcgtagacttaagcaggctatcgaaaagcgcgaccatatcgttgaaatgcagctgcgccagcataaagagtccctggtggctgggcaatggcgcgatatgatggattatatgctccagggcgtcgcccaaccaagcatggaggaaggatcaggccagctgctggaaggccatgtccatatggccgccgtcgatttactcatcggtggtacggaaacgactgccaatactctgtcctgggctgtggtatttctgctgcatcaccctgaaatacagcagaggctccaagaagagctggaccatgagctgggaccaggcgcctccagttcacgcgttccatataaagatcgagctcgactcccattactgaatgcaacaatcgccgaagttctaagactcagaccagttgtgccattggctttgccgcaccgcaccactaggccaagcagtatctccggatacgatatacccgaaggtacagttattatccctaatctccaaggagcacacctggatgagacggtttgggagcggccccacgaattttggccagaccggtttttagaacctggcaaaaatagcagagccctcgctttcgggtgcggagccagggtgtgtctgggtgaaccgctggctcgactggaactgtttgttgttctgacaaggctattacaggccttcacccttctgccgagcggggatgctctgcctagtctgcaacccctgccccattgctccgtaatattaaagatgcagccgtttcaagtccgcttacagcctcgcgggatgggcgcacatagtcccggacagtcccagtag

SEQ ID NO: 184484 - DNA, 1485 bp, Artificial Sequence
  Description of Artificial Sequence: Synthetic coding sequence
atgctgctgctgggcctgctgctgctgcccctgctggccggcgcccggcttctttggaactggtggaagcttcggagcctccacctgcctcctctagctcctggtttcctacacctgctgcaacccgatctgccaatttacttactgggacttactcagaagtttggacctatttaccgattgcacctaggactgcaggatgtggtggtgttaaactctaagagaacgatcgaagaggccatggtcaagaagtgggcggacttcgccggtaggccagagcctctgacttataagctggtgtcgaagaattatcccgaccttagcctgggggactactccttgctctggaaagcccataaaaagttaactcgctctgcccttttactcggtatacgagactctatggagcctgtcgtggaacagctgacccaggaattctgcgaaagaatgagggcgcagccgggtaccccggttgcaatcgaggaggagttctctttactgacatgcagcatcatatgctatttgacattcggcgacaaaatcaaagatgataatctcatgccggcttactataaatgcatccaagaggtgttaaaaacttggagccactggagtattcagatagtagatgtcatccctttcctgcgcttctttccaaatccagggctgagaaggcttaaacaggcaattgaaaaacgtgaccacatcgtcgaaatgcagctgagacagcacaaggaatcactcgtcgcaggtcagtggcgggatatgatggactacatgttgcagggggtggcacaacccagcatggaagagggcagcggtcagctcttggagggccacgtgcatatggcagctgtcgaccttctgattggaggaacggaaacgactgccaatactttgagctgggctgtggttttcctcctgcaccaccctgagatccagcagagacttcaggaggaactcgaccacgagcttggacctggagcctcttccagtagagtaccttacaaggaccgcgccagactgcccctgctcaatgccaccatcgctgaggtccttcgtctccggcccgtagtgcccctcgccttgcctcatcgcacaacccgcccctccagcataagtggctatgacatcccggagggcacagtgatcataccaaatctgcaaggcgcccatctagacgaaacagtgtgggagcgaccacacgaattctggcctgaccgattcctcgagccaggcaagaactcccgggccttagcttttgggtgcggagctagggtgtgcttgggcgagccactcgctcgtctggagttgttcgtggtgttgacgagactgttgcaggcctttacattgcttccatcaggggatgcgcttccctccctccagcctcttccccattgctccgtcatactgaaaatgcagccatttcaggtgcgccttcagcctagaggcatgggggctcactcccctggtcagaatcagtag

SEQ ID NO: 184485 - DNA, 1485 bp, Artificial Sequence
  Description of Artificial Sequence: Synthetic coding sequence
atgctgctgctgggcctgctgctgctgcccctgctggccggcgccagacttctgtggaattggtggaaactgcgatctctacatcttccaccactggcacctggctttcttcacctccttcagcccgacctgcccatctatctcctcggcctgacccaaaagttcgggccgatttatcggctgcacctgggcctccaggatgtggtcgtgttgaatagcaaaagaacaatcgaagaggcaatggttaagaaatgggctgacttcgctggtaggcccgaacctctgacatataagctagtgtccaagaattatcccgatttaagcctgggtgactactcccttctgtggaaagcacacaagaagctgacaaggtcggccctactgctgggcatccgcgacagtatggaaccagtcgtggagcagctgactcaggaattttgtgagcgcatgcgggcgcagcctggaaccccagtggccatcgaggaggaattttcactcctgacatgctcaatcatatgttatcttacgtttggcgataagattaaggacgacaatctcatgcctgcctactacaagtgcattcaggaggtgcttaagacctggtctcactggagcatacaaattgtggatgttatccccttcctcaggtttttccccaatccaggactccggcggctgaagcaggcaatcgaaaagagggaccacatcgttgagatgcaacttcgtcagcacaaggagagtttggtcgcaggacagtggcgggacatgatggactacatgcttcagggagtagcccaaccatcaatggaggaggggagcggccagctgctggagggccacgttcacatggcggccgtggacctcctaattggagggactgagaccaccgccaatacactcagctgggcagtagtttttctgttgcaccacccggaaatccagcaacgccttcaggaagagctggatcacgagctggggccaggcgcctccagcagcagggttccatacaaagacagggcccgactgccgttactgaatgctactatcgccgaggtgctgagattacggcctgtcgtgcccttggctctgccacataggactacacgacccagctccatctccggctatgacattcctgagggcacagtcatcattccaaacttacagggcgcccatctggatgagactgtttgggaaaggccacacgagttttggcctgatcgttttctggagcccggaaaaaactctcgggcactggcctttggttgcggcgcccgcgtgtgcctcggtgaacccctcgctagactcgagctgtttgttgtgctgactcggctgctgcaggcttttacactcctgccaagcggggacgctctcccttccctgcagcccctgcctcactgctctgtgatcctcaaaatgcagccatttcaggttcggcttcagcctcgaggcatgggagcacattcccctggtcagaaccagtag

SEQ ID NO: 184486 - DNA, 1488 bp, Artificial Sequence
  Description of Artificial Sequence: Synthetic coding sequence
atgctgctgctgggcctgctgctgctgctgcccctgctggccggcgccagattgctgtggaattggtggaaactcaggtctctccacctccctccgctggcaccgggattccttcaccttttacagccggacctgcctatttacctgctgggcctgactcagaagtttgggcccatctaccggctgcacctggggctgcaagatgttgtggtactcaactccaagagaaccatcgaagaagccatggttaaaaagtgggccgatttcgcaggaaggcccgagcctctcacatacaagctcgtttccaggaattaccccgacctttccctgggcgactattctctgctatggaaagctcataaaaaacttacaaggtccgctttgctgctcggcatacgcgacagcatggagccagtagttgaacagttaacccaggagttttgtgagaggatgcgggcacagccgggcacacctgtggccatcgaggaagaatttagcctgcttacctgtagcattatttgctacctgaccttcggcgacaaaattaaggacgataatctaatgccagcttattataagtgcatacaagaggttctgaagacctggtcacattggagtattcagatcgtggacgtaataccttttctgcgcttcttccctaaccctggtctccgccggctcaagcaggccattgaaaaacgcgatcacatcgtcgagatgcagctgagacagcacaaggagtctctggtcgccggacagtggcgcgacatgatggattacatgctccagggtgttgcacagccgtccatggaagaggggtctggccagctgttggagggtcacgtacatatggcagccgtggacctgttaataggcggtaccgaaactacagccaacaccctgtcatgggctgttgtttttctcctgcatcacccggagattcagcagcggctccaagaggagctggaccatgaacttgggcctggagcctcctcaagccgcgtcccctataaggatcgagcgcgcttgccgctgttgaatgcaacaattgcagaagtcctgagactgcggcccgtagtgccactagcgctccctcaccgcacaactcggccgagcagcatttccggctatgatattcccgaaggaacagtcatcattcccaacctccagggcgctcatctagatgaaactgtgtgggaacgtcctcacgagttctggcctgaccgctttctggaacctgggaagaattcacgcgccctggcattcgggtgtggcgcccgggtatgcctgggcgagccactggcacgtctggagcttttcgtggtgctgacgaggttgttgcaagcattcactcttttaccctctggcgacgccctgcccagcctccagccgttgcctcattgctcagtgattctgaagatgcaaccctttcaggttcggctgcagccaaggggaatgggtgcacactcccctggacagagccagtag

SEQ ID NO: 184487 - DNA, 1395 bp, Artificial Sequence
  Description of Artificial Sequence: Synthetic coding sequence
atgctgctgctgggcctgctgctgctgcccctgctggccggcgcccgtctgctctggaactggtggaagctgcggtccttgcatctgccccctctcgcccccggtttcttgcatctcttgcagcctgacttacctatttatttgctaggcttaacgcagaaattcggtcccatttacagactccacctgggcctgcaagataaattggtcagtaagaactaccccgacctctctttgggcgactactctctgctgtggaaagcccacaagaaattgactcgatcagccctgcttctggggatcagggactccatggagcctgtcgtcgaacaactcactcaagagttctgcgagcggatgagggctcaacctggcaccccggttgcaattgaagaggaatttagcctccttacgtgcagcattatatgttacctcactttcggggacaagattaaggacgacaatctcatgccagcatactacaagtgtattcaggaagtcctgaagacctggtctcactggtctattcaaatcgttgatgtcatcccctttctgagattcttccccaaccccgggcttaggagactcaagcaagcaattgagaagagagaccacattgtggaaatgcagctccggcagcataaagaatcactggtggcgggccagtggagagacatgatggactacatgttgcagggagttgcgcagccatctatggaagaaggaagcggccagctcttggagggacacgtacacatggcggccgtggacttgctcattggaggaaccgaaaccacggctaacacactgtcgtgggccgtggtttttttgctgcaccaccctgaaatacagcagcgcctccaagaagaacttgatcacgagctcggccctggagcctctagcagccgcgttccctacaaggacagagctagactgcccctgctgaatgctacaatcgccgaagtactgcgcctgcggccagtggttcctctcgcactcccccacagaacaacgcgaccgagttctatctccggttatgacattccagaggggacggtcatcatacccaacctgcagggcgcacatctagacgaaacagtgtgggaacgcccgcatgaattttggccggatcggtttcttgagcctggcaaaaatagccgtgcactagcgtttgggtgtggagcacgcgtgtgccttggcgagccccttgcaaggctggaactgtttgttgtgctaacaaggctgctgcaggctttcactctgctcccctccggggacgctctgcctagtctgcagccgctgccgcattgtagtgtcatcctcaaaatgcagcccttccaggtccggcttcagcctcgcggcatgggggctcatagtcccggtcaaaaccaatag

SEQ ID NO: 184488 - DNA, 1398 bp, Artificial Sequence
  Description of Artificial Sequence: Synthetic coding sequence
atgctgctgctgggcctgctgctgctgctgcccctgctggccggcgcccgtctgctgtggaactggtggaaacttcgctctctgcatttacccccgttggctccaggctttctgcatctgttacagcccgatcttcccatttatctcctggggctcacccagaaattcggaccaatctataggctccacctcggcctgcaggataaactggtgagtcgcaattatcccgatcttagcctgggggattacagcctcctgtggaaggcccataagaagttgacccggtcagcacttttgttaggaatacgcgattctatggagccagtggtggagcagcttacccaggagttctgcgaaaggatgagagcacagcctggcactcccgtcgcaattgaagaggagtttagtctcctcacttgctctatcatttgttatcttacctttggcgataagatcaaggacgacaatttgatgccagcatactataagtgcattcaggaggtactgaaaacatggtcccattggtctattcagatcgtggatgtcatccctttcctgcggttcttccctaatccagggctgagacggttgaagcaggccattgagaagagagaccatatagtcgaaatgcagctcagacaacacaaagagtcactggtagctgggcagtggcgggacatgatggattatatgttacagggcgttgcccagccgagtatggaagagggaagtgggcagcttctggaggggcatgtgcatatggctgctgtggacctgctgatcgggggcaccgaaacaacagcgaacacgctttcgtgggccgttgtcttccttcttcaccacccagagattcagcagaggcttcaggaggagttggaccatgagctgggtcccggagcatccagctccagagtcccttataaagaccgggccagactccctttgttaaacgcaaccatcgccgaggtgctcagattaagacctgtcgtgcctctcgcactgccgcacaggaccacccgcccctcatctatttcgggttatgatattccagaagggacagtcatcattcctaacttgcaaggcgcacacttagatgaaacagtatgggagcgaccccatgaattctggcccgacagattcctggaaccagggaagaatagtcgggcacttgcctttggttgcggcgccagagtgtgcctgggagagcctctcgcgcgccttgaactgtttgtggtactgactaggcttctgcaggcctttactctgcttccaagcggtgatgcgctgccatccttacagcccctacctcattgctccgttatcctgaagatgcagccgtttcaggtgaggcttcagcctaggggcatgggggctcacagccctggccaatctcagtag

SEQ ID NO: 184489 - DNA, 1395 bp, Artificial Sequence
  Description of Artificial Sequence: Synthetic coding sequence
atgctgctgctgggcctgctgctgctgcccctgctggccggcgccaggttactctggaattggtggaagctgcgctccctgcaccttcctcctctagcccccggttttctgcacctcctacagcctgacctgcctatttacctgctcggcctcacgcagaaatttggtcccatatatagattacaccttgggctgcaggacaagcttgttagtaaaaactatcctgacctgagcctaggggactatagtctgctgtggaaagcacacaaaaagctcacaagatcagctttactgctgggtattcgggacagcatggagcccgtggttgagcagctaacgcaagaattttgcgaaaggatgagggctcagccagggacccctgtcgccatagaggaagagttttcgttactcacttgttctatcatttgttacctgactttcggagacaagattaaggatgacaacctaatgcccgcctactataagtgtattcaggaggttcttaagacctggagccattggtcgattcaaatagtggatgtgatcccttttttgaggttttttccaaatccagggctccgtcgactgaagcaggctatcgaaaagcgagatcatattgtggagatgcagttacgccaacacaaggagtccctggtggccggtcagtggcgcgacatgatggattacatgctccagggtgtagcccagcccagcatggaagaggggagtggccaactgctggagggccatgtgcatatggccgcagtggacctattaatagggggaacagagaccaccgcgaacactttgtcctgggccgtggtgttcctgctgcatcatccagaaatccagcagaggctccaggaggaacttgaccatgaacttggaccaggagcatcttcaagtcgtgtgccgtacaaggacagagcaagattaccccttctgaatgccaccatcgctgaggttctgaggctgagacccgtggtgcccctcgctcttccacaccggactacaaggccttctagcataagtggatatgacatccccgagggcaccgttattatcccaaacctccagggggcacacctggacgagacagtctgggaacgccctcatgagttttggcctgatcggttcctggaacctggaaaaaacagccgggcactcgcctttggatgtggcgcacgggtctgtttgggcgagcccttagccaggctggagctctttgtggtgctgaccaggcttctacaggctttcacactactcccctcaggagatgcactcccttctctgcagccacttccacactgcagcgtgatactcaaaatgcagcctttccaggtgcgtcttcagccacgaggaatgggagcacatagtcctggtcagaatcagtag

SEQ ID NO: 184490 - DNA, 1488 bp, Artificial Sequence
  Description of Artificial Sequence: Synthetic coding sequence
atgctgctgctgggcctgctgctgctgctgcccctgctggccggcgcccgcttactatggaattggtggaaactgcgctccttgcatctgcttcctcttgcacccgggttcttgcatctactgcaacctgacctcccaatctatctgctgggcctgacccagaaattcgggcccatctataggttgcacctgggcctccaggatgtggtcgtgttgaattctaaaagaacaattgaagaggctatggtcaagaaatgggcggacttcgcaggacgaccagaaccccttacatacaaacttgtgtccaagaactaccctgacctctccctgggggactatagcctgctgtggaaagctcacaaaaaactcacaagaagcgcacttctcctgggcatcagagactctatggaacccgttgtagagcaactgactcaggaattttgtgagagaatgcgggcccaaccaggtacccctgtggccattgaagaggaattttccctgctgacctgttccattatttgttacctgaccttcggagacaagatcaaggatgataacctgatgcccgcatattacaagtgcatccaggaagtactcaagacttggagccactggagtatccagattgtggatgtgattcctttcctaagatttttcccaaatccgggcctgaggaggctgaagcaggctatagagaagcgcgaccatatcgtggagatgcagttaaggcagcataaagagtctttggtggctggacagtggcgggacatgatggattacatgctgcagggggtggcccagcccagtatggaggaaggcagcgggcaactgctcgaagggcatgttcatatggctgcagtggatctgctgatcggagggacagagaccactgctaacaccttatcttgggcggtggtgttcctactgcatcacccagagatccagcaaaggctgcaagaggagctcgaccatgagctgggacccggggcttcatcctcgagggtcccttataaagaccgggcccggctgcctcttctgaatgcaactattgccgaagtccttaggctacggcctgtggtgccactggccctaccacatagaacaacgcgcccatcatcgatctctggttacgatatccctgagggaaccgtgattattcctaacctccagggcgcacacctcgacgaaaccgtgtgggaacggccccacgagttttggcctgataggtttctggagccagggaaaaattctagggccttagcatttggctgtggtgctcgagtgtgtctgggcgaacctctggcccgcctcgagctctttgttgtgctcacgcggttactgcaggcctttacccttcttcctagcggagatgctttaccttccctccagcctctcccgcattgcagcgtcatcttgaagatgcagccctttcaggtccgcctccagccccggggaatgggagcacattctcctggacagaaccagtag

SEQ ID NO: 184491 - DNA, 1488 bp, Artificial Sequence
  Description of Artificial Sequence: Synthetic coding sequence
atgctgctgctgggcctgctgctgctgctgcccctgctggccggcgcccgattgctgtggaattggtggaaacttcggagccttcatcttccacctctggcccctgggttcctgcacctgctgcagcccgacttgcccatatatttactgggcctaactcaaaagtttggacccatctaccgactgcatcttggactgcaggatgtcgtggtgttaaacagcaaacgaacgatcgaagaggccatggtgaagaagtgggctgattttgctggccggcctgagccccttacttacaagcttgtaagtaagaattatccagacttgagtctgggtgactactcgctcttgtggaaggcccacaagaagctgaccagatcggccttacttcttggtattagagactcgatggagccagtcgtggagcagttgactcaggaattctgtgagcggatgagggcccaacccgggacacccgtggccatcgaggaggaattttccttgctgacgtgttcaataatctgctacctcacgtttggggataagataaaggatgataacctgatgccggcctattataagtgtattcaagaagtgctaaagacatggtctcattggtcaattcagattgtggacgtcatccccttcttgagattctttccaaaccctggtctgcgccgacttaaacaggccattgagaaacgggaccatattgtcgagatgcaactgcgccaacataaggagagcctggtggcgggccaatggagggacatgatggactatatgctccaaggcgtggcccagccgagcatggaagaaggctcgggccagctgctggaggggcatgttcacatggcagccgtggatctccttatcgggggaaccgaaaccaccgcgaatactctctcatgggcagttgtgtttctgctgcaccatcctgagatccagcaacgacttcaggaagagttagaccacgagctcggacccggcgcttcttcttcacgggttccatacaaagaccgggcccgcctgcctctcctgaacgccacaatcgcagaggtattgaggctgaggccagtggtcccgctcgccttgcctcacagaactactcgtccgtccagtatttctggatacgatatacctgagggcacagtgatcatccctaacctgcagggcgcacatttggatgagacagtatgggagaggccacacgagttctggcccgacagattcttggagcctggaaagaactctagagctctcgcatttgggtgcggggccagggtttgcctgggggagcctttggctagactcgagctctttgtggtgttgacgagactcttgcaggcatttaccctgctccccagcggtgatgctcttcccagcttgcaaccactccctcactgctcagtgatccttaagatgcagccattccaggtcaggctccaaccacggggcatgggggcccacagtccagggcagaaccaatag

SEQ ID NO: 184492 - DNA, 1398 bp, Artificial Sequence
  Description of Artificial Sequence: Synthetic coding sequence
atgctgctgctgggcctgctgctgctgctgcccctgctggccggcgcacggctgttatggaactggtggaagttgcgctctctgcaccttctgccgctggcgccagggtttctacacctcctgcagccagacctcccaatatacctactcgggctgactcagaaattcggacccatttaccggctccatctcggacttcaagacaaactggtttcaaaaaactaccctgacttatcactgggagactattctttgctgtggaaagcccataagaaattgacccgctcggcactgctcctgggcatcagggattctatggaaccggttgtcgagcagttgacccaagagttctgtgagagaatgagggcgcagcctgggactcccgtcgccatagaagaagagttcagccttctgacttgctccattatctgttacctcacctttggcgataagatcaaggacgataacctgatgcctgcgtattataagtgtatccaggaggtactgaaaacgtggtctcactggagcattcagatcgtggatgtgattcctttcttaaggttctttccgaatccaggcctccgaaggttgaaacaggccatcgagaagagagaccacatcgtggaaatgcagcttagacagcataaggagtctctggttgccggtcagtggagagatatgatggactatatgctgcaaggcgtggctcagccaagcatggaggaaggcagtggccaactgctggaagggcatgtgcacatggctgcagtcgatctcctaatcggcggtactgaaaccacggccaatacattgtcgtgggcagtggtgtttttactgcatcaccccgagatacagcagcgcctgcaggaagagctcgaccacgagctagggcccggggcttctagctcaagagtcccctataaagatcgggctcggttgccccttctaaatgccacaattgccgaggtgctgaggttgagacctgtcgtgcctctggccttgcctcatcgcacaacgcgcccttcctctatttccggctatgacatcccggagggtaccgtgattatcccaaacctccagggagctcacctggacgagactgtttgggaaagacctcacgaattttggccagatcgcttcctcgaacccgggaagaacagcagagctctcgcattcggatgcggagctcgagtgtgtttgggagagccactcgccaggctggaattattcgtggtcctgactaggctgctgcaggcctttaccttattaccctcgggcgacgcgctgccctctcttcagccgctgccccactgctccgtgattcttaagatgcagcctttccaggtgcgtctacaacctagagggatgggcgcccattcaccaggacagaatcagtag

SEQ ID NO: 184493 - DNA, 1704 bp, Artificial Sequence
  Description of Artificial Sequence: Synthetic coding sequence
atgcacggccggctgaaggtgaagaccagcgaggagcaggccgaggccaaacgactggagagggaacagaaactgaaactataccagtctgccacgcaggccgtcttccagaagagacaggcaggagagctggacgagtccgttttagagctgacaagccagatactcggcgccaatcccgactttgccaccctgtggaactgtcgcagagaggtcctgcagcagctggagacccagaaaagccctgaggagctcgcagcacttgtcaaggccgaactggggttcttggagtcttgtctccgcgtgaaccccaaatcatatgggacttggcatcacaggtgttggttgctgggaaggctgccggagcccaattggacaagggagctcgaactgtgcgctcgttttctggaggtagatgagagaaattttcattgctgggattaccgccgcttcgttgctacccaggctgcagtgccgcctgccgaggagttggcgttcacagattcacttatcactcgaaatttttccaactatagtagctggcactaccggagctgcctactcccccagctacatccgcagccagactcgggaccacaaggtcgccttccagaggatgttctcttgaaagagttggaactggttcaaaacgcattcttcaccgatccaaacgaccagtctgcctggttctatcaccgttggttactaggacgggctgatccacaggacgcactacggtgtcttcacgtatctagagacgaggcatgcttaaccgtttctttttcaagacctttgctcgtgggctcacgcatggagatcctactccttatggtggacgatagcccactcatagttgaatggaggaccccagatggtaggaaccgtccgtcacacgtttggctctgtgatctcccagctgcttctctgaacgatcagctcccgcagcataccttccgggtgatatggacagctggggacgtgcagaaggaatgcgtgcttctaaaaggaagacaggaaggctggtgtcgtgacagcaccacagatgaacagctatttaggtgcgagctctcagtggagaagtctaccgttctgcagtctgaactggagtcttgcaaggagttgcaggaacttgagcccgagaataagtggtgtctgctgaccatcatcttgcttatgcgggccctggacccgctgctctatgaaaaagaaacactgcaatattttcagacactgaaggccgtggaccccatgcgggcaacttacctggatgatctgaggtccaagttcctgctcgagaatagcgtgctgaagatggagtatgctgaagttcgggtcctgcatctggcacacaaggatctaacagtactttgccacttggagcagctgttgttagttacacatctggatctatcccataataggctgcggacacttccccccgcactggctgcgttgaggtgcctcgaggtactgcaggcaagcgacaacgctatagagtctctggacggcgtaacaaacctcccgagactgcaggaactgctgctatgtaataaccgtttgcagcagccagccgtactgcagccacttgcatcctgccctcgcttagttttgctgaaccttcagggtaatcctctgtgccaggctgtgggcattctcgagcaactcgctgagctcctcccgagtgtgtcctcagtgctaacgtag

SEQ ID NO: 184494 - DNA, 1347 bp, Artificial Sequence
  Description of Artificial Sequence: Synthetic coding sequence
atgagcagccccatcagcaagagccggagcctggccgccttcctgcaacagctccgatctccgcggcagcccccacggcttgtcacgtccacagcatatacaagtcctcaaccgcgagaggtaccagtgtgtcctctcactgcaggcggagagacccaaaacgctgctgccctcccaggcccaacatcatggcctctgcttggctctttgctccaaatcctctggaagggaggcctgaaaaagcagcatgacaccttggtggaatatcacaagaaatatggcaagatcttcaggatgaagttagggagtttcgaatcggtccacctgggatcgccttgtctgctggaggcattgtatagaacagagagcgcctacccacagcggttagaaatcaagccttggaaagcataccgcgattaccgcaaggaaggatacggcttgctgatactcgagggggaggactggcagcgcgtccgcagtgccttccagaagaagctaatgaagcccggcgaggtcatgaaactggacaacaagatcaatgaggtgttagccgacttcatgggccggatcgacgagctgtgtgacgaaaggggacatgtggaagatctgtatagtgaattgaacaaatggtccttcgagtcaatctgcttagttctgtatgagaagcggtttgggctcttgcaaaagaacgctggcgatgaggccgtgaacttcatcatggctataaagactatgatgagtactttcgggcgcatgatggtgacacctgtggagctgcacaagagtctgaatacaaaagtgtggcaagatcacactttggcctgggatactattttcaaaagcgtgaaggcttgcattgataacagactggagaagtactcccagcaacctagcgccgattttctttgtgatatctaccatcagaatcgcctatccaagaaggaactgtacgccgccgttaccgagttgcagctggctgctgtggaaacgaccgcaaattccctgatgtggatcctgtacaatcttagccggaacccgcaggtgcagcagaagctgctaaaagagattcaaagtgtcctgccggagaaccaggttccccgtgccgaagaccttagaaatatgccatacttaaaggcttgcctgaaagaatctatgcgattaaccccctcagtgccctttacaaccaggaccttagacaaggctaccgttctcggggaatacgccctccccaaggggattgtccgaaaatacgacattcaggccaccgataatgagcccgtggagatgctccatagtggaaccttggtgccaagtcgggaactacctatcgccttttgtcagcggtag

SEQ ID NO: 184495 - DNA, 1371 bp, Artificial Sequence
  Description of Artificial Sequence: Synthetic coding sequence
atggacaagctgaacaagatcaccgtgcccgccagccagaagctgcgccagctgcaaaaaatggtccacgacatcaaaaataatgagggcggtattatgaataagatcaaaaaactaaaagtcaaggctcccccaagtgtgccacgccgcgactatgcctcagaatctccagctgatgaggaggaacagtggtccgacgatttcgactcagattacgaaaatcccgatgaacatagcgattctgaaatgtacgtgatgccggctgaagagaatgctgacgactcatacgaacccccgcctgtggaacaggagaccagacctgtgcatcctgcccttccattcgcccggggtgagtatattgacaatcgctcttcgcagcgccatagtccccccttctccaaaactctgccatccaagcctagctggccgtcggaaaaggctcggcttacaagcacacttccggctctgaccgccctccagaagccgcaagtgccgcctaagcctaaggggctcttagaagacgaggccgattacgtggtgcctgtggaagataacgatgagaactacattcatccaacggaatccagttccccccctccggagaaagccccaatggtgaacagaagtacaaaacctaatagcagcacacctgcgtcgccacccggcacggccagcggaaggaatagtggggcctgggagaccaaatccccacctcctgctgcaccctctccccttccaagggcgggaaagaaacccaccacccccctaaagactactcccgtcgcatcccagcagaatgcgtccagtgtatgcgaggaaaaacctattcccgcagagaggcaccggggttcctcacacaggcaggaggccgtgcagtccccagtgttcccccctgcccaaaaacagatacaccaaaagccgataccactgcccagattcaccgagggcgggaaccccactgttgatggacccctgccaagcttttcctctaacagcaccataagtgaacaggaggctggagtactctgcaagccatggtatgcaggggcttgcgataggaagtcggccgaggaagctctccatcggtcaaacaaagacgggtcattcctgatccgcaaaagcagtgggcacgattccaaacagccatacaccctcgtagtctttttcaacaaaagggtctacaatattccggtcagattcatcgaggccaccaagcagtacgcgcttggaaggaagaagaatggggaagagtacttcggctctgtagccgagatcatccggaatcaccagcactctcccttagtcctgatcgatagtcagaacaatacgaaggactcaaccagattgaaatacgccgtgaaagttagttag

SEQ ID NO: 184496 - DNA, 1287 bp, Artificial Sequence
  Description of Artificial Sequence: Synthetic coding sequence
atgaagcggcggaagtacggcttcatctacaagacccacctgttcggccgccccactgtgcgcgtgatgggcgctgataacgtccgcagaatattgctgggcgaacaccgacttgtctctgtccactggccagccagcgtgagaaccatcttaggctccggctgcctgagcaacctacatgatagtagccataagcaacgcaagaaagtgataatgcgggctttcagccgtgaggctctcgagtgctatgtacccgtgatcacagaagaggtgggaagttctttggagcaatggctttcctgcggggagaggggcctccttgtgtatcctgaggttaaaaggctgatgtttagaatcgctatgcgcatccttttaggctgtgaaccacaactcgccggcgacggggacagcgagcagcagctcgttgaagcttttgaggaaatgaccagaaacttattttccctccctattgatgtcccgttctctggcctgtaccgaggaatgaaggctagaaacctcatacacgcacgaattgaacaaaatatccgggcgaagatttgtggtctacgggcaagtgaggcaggtcagggatgtaaggatgcgctccagctgctgatcgaacattcctgggagagaggggaacgcctggatatgcaggccctcaaacagagtagcacagagctgctgtttggggggcatgagacaacagcttcagctgctacctccttgatcacatatttaggactgtaccctcatgtactccagaaggttcgggaagagttaaagtcaaaagggttgctctgtaagtccaatcaggataataagctggacatggagatcctggagcagctgaagtacatcggctgcgtgataaaagaaacattacggttgaatcctcctgtcccaggcgggtttcgggtcgccctcaagacattcgagctgaatgggtaccagatcccaaagggctggaacgttatatacagcatctgcgacacccacgatgtggctgaaatcttcactaataaagaggagtttaaccccgatcgttttatgctgccacaccccgaggacgcttcccggttttctttcatcccatttggggggggccttagaagctgtgtgggaaaagagtttgccaagatactcctgaagatttttacagtggaattagctcgacactgcgactggcaactgctgaatggaccccctacaatgaaaactagcccgactgtgtatccagtggataacctaccggcacgatttacgcatttccatggcgagatctag

SEQ ID NO: 184497 - DNA, 1287 bp, Artificial Sequence
  Description of Artificial Sequence: Synthetic coding sequence
atgaagcggcggaagtacggcttcatctacaagacccacctgttcggccgaccaactgtgcgggttatgggggcagacaacgtcagacgtattctattaggtgagcacagactcgtttccgtccactggcctgctagcgtgaggactattcttgggtcagggtgtcttagtaatctgcatgacagcagccacaagcaacgcaaaaaggttatcatgcgcgctttcagtcgggaagccctggagtgctatgttcctgttatcacggaggaggttggctcgtctctcgagcagtggctgtcttgcggtgagaggggcctactggtttacccagaagtgaagagactgatgttcaggatcgcgatgaggatcctgctgggctgcgagcctcagcttgccggtgatggagatagcgaacaacaactcgtggaggcatttgaggagatgacaaggaatctcttctccctgcctatagatgtgccgttttccggcttgtatcgtggtatgaaggctaggaatctcattcatgcccgcatcgagcagaatataagggctaaaatctgtgggctacgtgcttctgaggcgggccagggctgcaaggatgcactccagttgcttatcgaacacagctgggagaggggagaacgcctggatatgcaggccctcaaacagtcgtccactgagttactttttggcggacacgaaactaccgcctcagccgccacttccctcatcacctacttgggactctacccacacgtgctgcagaaggttcgggaagaactaaaaagcaagggcctcctttgtaaaagtaaccaggacaataaacttgatatggaaattctagagcagctgaaatacattggatgcgttataaaagaaacactgcggctcaatccacccgttcccggcggtttcagagtggctctcaaaacttttgagttgaatggctaccagatccctaagggctggaatgttatatactccatttgtgatacccacgacgtcgccgaaatttttaccaataaagaggagtttaaccctgaccgattcatgctgcctcaccccgaggatgcctcccgattttcatttatcccctttgggggtgggctacggtcttgtgttgggaaagaattcgcaaaaattctattgaagatatttacagtcgagttggcccggcactgcgattggcagctcttaaatgggccgcccactatgaagacatcccctaccgtctatcccgtcgacaatctgcctgcccgcttcacccattttcatggtgagatttag

SEQ ID NO: 184498 - DNA, 1569 bp, Artificial Sequence
  Description of Artificial Sequence: Synthetic coding sequence
atgttcccctggggcctgagctgcctgagcgtgctgggcgccgccggaactgcactgctgtgtgccgggctgctcctgtccctggctcaacatctgtggacgttgagatggatgctttccagggatcgggccagtaccttaccgctgcccaagggcagtatggggtggcccttcttcggcgaaacgctgcattggctggtgcaggggtcccgcttccatagcagtagaagggaaagatatgggaccgtgtttaaaacccacctgctgggcaggcctgtgattcgcgttagcggtgccgaaaatgtgagaacaattttgctcggtgaacatcgcctggtgagatctcagtggcctcagtcggcgcacatcctgttgggaagccacacgctactgggggctgtaggtgaaccgcataggagacgcagaaaggttttggcccgggtgttttcacgggctgcgttggagcgctacgttccccggctgcagggtgccctacggcacgaggtgcggtcctggtgcgccgcgggtggtccggtctccgtttatgacgcgtctaaagccttgactttcaggatggccgctcgcatcctgctgggcttacgcctggacgaagcccagtgcgctacgttggctagaacatttgagcagctggtggagaacctcttctctttacctttagatgtgcctttttctggactgcgtaaaggcattcgcgctagggatcagctgcatagacacttggaaggagccatttccgaaaaacttcacgaagacaaggcagcggagcccggcgacgctctggacctgattatacattcggcccgtgaattgggccatgagccatctatgcaggagctgaaggaatctgctgtggaactccttttcgctgcatttttcacaaccgcaagcgcgagcactagcttagttttgctgctgcttcagcacccggcggcaatcgccaaaatccgggaagaacttgtggctcagggcctgggacgcgcctgcggctgcgcacccggtgctgctggaggcagtgaggggccccctccagattgtggctgcgaacccgatctgtcattggccgccctgggccggttaaggtatgtagactgtgtagttaaggaggtgcttagactgctccctcccgttagtggcgggtataggactgccctgcgaaccttcgagctggacggttatcagattccgaaaggttggtctgtgatgtattccatcagagatacgcacgagaccgcagccgtctatagatcaccacccgaaggatttgacccagaaaggttcggagcggcgcgcgaagactcacggggcgcttccagcagattccattacatacccttcggcggtggggcacggtcatgcctaggccaggaattggcgcaggcagtccttcaactgctcgcggtggaactggtaaggactgcccggtgggaattggctactcccgcctttcccgccatgcagactgtgcctattgtgcacccagtggacggattgcggctcttcttccacccactgacaccgtcggtggcagggaatgggttgtgtctatag

SEQ ID NO: 184499 - DNA, 1596 bp, Artificial Sequence
  Description of Artificial Sequence: Synthetic coding sequence
atggccgccctgggctgcgcccggctgcggtgggccctgcggggcgcaggccgcggcctttgtccccatggagctagggccaaagctgctattccagctgcccttccaagtgacaaggccacaggcgcacccggcgccggtcctggagtcagacggagacaacgctcccttgaagagattccccgcttgggccaattgcgatttttcttccagcttttcgttcaagggtacgcgttacaacttcaccaactccaagtgctgtacaaggccaagtacggacctatgtggatgtcttatctgggaccacagatgcacgtaaatctagcgagcgcacccctactggaacaggtgatgaggcaagagggtaagtaccctgtaagaaatgacatggaactatggaaggagcaccgtgaccagcacgatcttacttacggaccatttactactgaaggacatcactggtatcagctcaggcaggccctaaatcagaggttgctcaaaccagctgaggcggccctgtatacggacgcattcaacgaagtcatcgacgatttcatgaccagattagatcaactcagagcagagtccgcctctggaaaccaggtgtctgatatggcccaattgttttactattttgcgcttgaagccatctgttatatactgtttgagaagaggatagggtgcctgcagagatccatccccgaggatacagtcacgttcgttagaagtataggtttgatgtttcaaaattcactctacgccaccttcctgcctaagtggacccggcccgtgctgcctttctggaaacggtacctggatggctggaatgccattttctcgttcggtaagaaactaatcgatgaaaagctcgaggatatggaggctcagctgcaagctgcaggaccggatggcattcaagtgtctgggtatttgcattttctgttggctagcggccagctgtccccacgggaggcaatgggttcccttcccgagttactgatggccggggtagatacaacgagcaacaccctgacatgggccctgtaccacctctccaaagacccggagattcaggaagcactgcatgaggaagtggtaggggtagtccctgctggacaggtgccgcagcataaagactttgctcacatgcctctcctaaaagcagtgttgaaagaaactctgcgcctgtacccagtggtccctactaattccaggattatagaaaaggaaattgaggttgatggcttcctgtttcccaaaaatactcagttcgtgttctgccactacgtggtgagtcgagatccaacggccttctccgaaccagagagcttccagccacaccggtggctgaggaattcgcagcctgccacgcctagaattcaacacccatttggatcagttccgttcggctacggagtgagagcatgcctaggacgtcggattgccgaactggaaatgcagctgcttctggccaggcttattcaaaagtataaggtcgtgttagcgcccgagactggagagctcaagtccgtggcaaggatcgtgctggtgcctaacaagaaggtggggctgcaattcctgcagcggcagtgttag

SEQ ID NO: 184500 - DNA, 1572 bp, Artificial Sequence
  Description of Artificial Sequence: Synthetic coding sequence
atgagcttccacaaggaggacggcgtgaacagcctgtgccagaaggccctgcacatagttaccgagctgtgttttgctggccaggttgaatgggaaaagtgtagtggtatcttcccaagagaccgaggcagtcagggaggatcttctacagatattagcgtgagtctcctcgcggttgttgtttccttttgcggcctggccctgctggtggtatccctctttgtcttctggaagctgtgctggccatgttggaaaagtaagcctgtgacttcaaatatcacaacactgcctcaaagtatctcctcagccccaacagaggtgttcgagacggaagaaaaaaaggagattaaggagaatgaaaagcccgcagtgaaagccattgaacctgccatcaaaatttcccacaccagccctgatattccagctgaagtgcagaccgcactaaaggaacacctaataaagcacgcccgggtgcagcgacaaatcacagagccaacaagttccactaggcatagtagcttccggaggcaccttccccggcaaatgcaggtatctagtgtggatttttccatggggaccgaacctgtgctccagagaggcgaaacgacaacttcaatagggcgcattaaaccagagctgtataagcagaaatcagtggatagcgaagggaaccaaaacgaggatgtgaaaatttgtggtaagctaaacttcacattacagtacgattatgaaaacgaactgctggtggtcaaaattataaaggcgctggacctgccagcaaaggacttcactggcacatcagacccctacgtgaagatgtatttgctcccagaccggaaaaaaaaatttcagactagagtacatagaaagacacttaacccgctatttgatgaaacctttcaattcccggttgcctacgatcagctgtcaaatcgtaagctgcactttagtgtgtacgatttcgacagattcagccgccacgatatgatcggcgaagtgatcctggacaatctctttgaggtatctgacctgagcagggaggccacagtgtggaaagatattcactgtgcaaccacagaatccattgaccttggggagattatgttctcgctttgttacctccccaccgctggtaggatgactcttaccgtcatcaaatgccggaatttgaaggctatggacataaccggcagttctgatccctatgtgaaggtgagcctcatgtgtgaaggaaggcgcctgaagaagcggaaaactaccaccaaaaagaacactcttaatccagtctacaacgaagccataatctttgatattcccccagagaacgtggatcaggtgagcctctctattgctgtaatggactacgatcgagtggggcacaacgaggtcatcggcgtgtgcagaacgggtctggacgcagaaggcctgggcagggaccattggaacgagatgctggcctatcacaggaagcctatcactcattggcatcctctgttggagctaccaggccgcgctacctcatttgattcgcaggggtcctgtccttctcccaagccgccgtctaccccctag

SEQ ID NO: 184501 - DNA, 1512 bp, Artificial Sequence
  Description of Artificial Sequence: Synthetic coding sequence
atggccctgatccccgacctggccatggagacctggctgctgctggccgtttctcttgtgctcctgtacctttacggaactcactcccacggccttttcaaaaaattggggattcccggcccgacccccttacccttcctgggtaatatccttagctaccacaagggtttctgtatgtttgacatggaatgtcataaaaagtatgggaaggtgtggggcttttacgacggtcagcaaccggtcctagccatcacagaccctgacatgatcaagaccgtgctggtgaaagagtgttactctgtcttcactaatagacgcccattcggtcccgtcgggttcatgaagtcagccatttccatcgcagaggatgaagagtggaaaagattacgatcgttactaagtcctacatttacaagcggcaaactgaaagagatggtcccaatcattgcgcaatatggggacgtgctggtaaggaatctgcgaagggaagctgaaaccggaaaaccagtgactctcaaagacgtattcggcgcttacagcatggatgttattacatctaccagtttcggcgtcaacatagattcgctgaacaacccgcaggatccgttcgttgagaataccaagaaactgttgaggttcgattttctggatccattctttctgagcatcacagtgttccccttcctaattcccattctggaagtactaaacatctgcgtgtttcccagagaggtgaccaacttcttgaggaaatctgtcaagagaatgaaggagtccaggctggaagacacgcaaaaacatagagtagacttcctccaactgatgattgatagccaaaactcaaaagagaccgagagccacaaggcactttcggacttagagctggtcgcccagagcatcatcttcatatttgcagggtacgaaaccaccagctctgtgctgagctttatcatgtacgaactggccacgcaccccgacgttcagcaaaagctgcaggaagagatcgatgctgtcttgccaaataaagccccacccacctatgacaccgttctgcagatggagtacctagatatggtagtgaacgagaccttacgcctgttcccaatcgcaatgagactcgagagagtgtgtaagaaggatgtggagatcaacggtatgtttattcctaaaggagtagtggtgatgattccctcctacgctctgcatcgggatccaaagtactggaccgagcccgagaagtttctccccgagcgttttagtaaaaaaaacaaggataatatcgacccctatatctacacacccttcggatctggccctcggaactgcattggaatgaggttcgcactcatgaacatgaagctggctttgatcagggttctccagaacttctccttcaaaccttgcaaggagactcagatccctcttaaattgagcctgggtggcctgctacagcccgagaagcctgttgtcttgaaggtggagagcagagacggcactgtctcaggcgcatag

SEQ ID NO: 184502 - DNA, 1062 bp, Artificial Sequence
  Description of Artificial Sequence: Synthetic coding sequence
atggccctgatccccgacctggccatggagacctggctgctgctggccgtgtctctcgtactgctgtatctggtcttcggagcatactctatggatgtgatcacaagtactagctttggcgtgaatatagattcactcaacaatcctcaagatccttttgttgagaatacaaagaagcttttaagatttgatttcctggatcccttctttctgtcaatcactgtcttcccatttcttattcctatactggaagttcttaatatctgcgtgtttccacgggaagttactaactttcttagaaaatcagttaagcggatgaaggagtcccggttggaagatacacagaagcatcgcgtcgacttcctgcagctgatgattgactctcaaaactctaaggaaactgaatctcacaaggcactatctgatctcgaactcgtggcacagagcattatattcatttttgcaggctatgaaaccactagcagcgtgctctccttcatcatgtatgagctcgcgacacaccctgacgtgcaacaaaaactgcaagaagagattgatgcagtgttaccaaacaaggctccccccacctacgacactgtgctgcagatggaatacctagacatggtggttaatgagactctccgactgttccccattgctatgcgcctagagcgggtctgtaagaaggatgtggagattaatggcatgttcattcccaaaggcgtggtcgttatgattccttcatatgccttacatcgcgatccaaaatactggaccgagccagagaagttcctgcctgagcgtttctccaaaaaaaacaaagacaatatcgacccgtacatatacacaccatttggaagtggcccacggaactgcatcggcatgcgcttcgccttgatgaacatgaaactggccctcatacgcgtcctgcaaaacttttccttcaagccgtgcaaagagacccagatccccctgaaactctcgctcggcggcctgctgcagcccgagaaaccagtggttctcaaagttgaatcccgtgatggaacagtgtccggagcctag

SEQ ID NO: 184503 - DNA, 240 bp, Artificial Sequence
  Description of Artificial Sequence: Synthetic coding sequence
atggtgcccatcatcgcccagtacggcgacgtgctggtgcggaacttaagacgtgaagccgaaactggcaaacccgtcactctgaaggacgtgttcggtgcttacagcatggatgtcatcactagcacaagtttcggggtcaacatcgactccttgaacaaccctcaagaccccttcgtggagaacacaaaaaaacttcttcggtttgatttcctagatcctttctttttgtcaatctag

SEQ ID NO: 184504 - DNA, 1068 bp, Artificial Sequence
  Description of Artificial Sequence: Synthetic coding sequence
atggccaagctgatcgccctgaccctgctgggcatgggcctggccctattcaggaaccaccaatctagctaccagacgcgcctcaacgctttgagagaggtgcagcctgtcgagcttcccaactgtaacttggtaaaaggcattgagaccgggtccgaagatttggaaatcctgcctaacggcctggctttcatttcctcaggcctgaaatatccggggattaagtctttcaaccccaactctcccggaaaaatactgctgatggacctgaacgaagaggatccaacagtcctggaactgggtattacaggatccaaatttgatgtatcttccttcaacccgcatgggattagcaccttcaccgacgaggacaatgcgatgtacctgctggtcgtgaaccatcctgatgctaagtctacagtggaactctttaagtttcaggaagaggagaaatcccttttacacctgaagaccatccgacataagctgctgcccaatttgaacgatatcgtggccgtgggcccagagcatttctacgggacaaacgaccactatttcctagacccctatttgcagtcctgggaaatgtatttggggctggcttggagctatgtcgtttattattccccatctgaggtacgcgtcgtcgccgaaggcttcgattttgcaaacgggatcaatatctctccagacggcaagtatgtctacatcgccgagttgttggcccataaaattcacgtctacgaaaaacacgctaactggactttaaccccattgaagagcctcgattttaacactctcgtggacaacatcagtgttgatccagagaccggagacctgtgggtcggctgccatcccaacggcatgaagattttcttttacgactcagagaatccacctgcaagcgaggtgctgcgaattcaaaatattctgactgaggagccaaaagttacccaggtctacgcggaaaatggcacagtacttcaggggtcaaccgtcgctagcgtgtataaggggaaactgctgatagggactgtatttcacaaggctctgtattgtgaactgtag

SEQ ID NO: 184505 - DNA, 1263 bp, Artificial Sequence
  Description of Artificial Sequence: Synthetic coding sequence
atggacctgatccccaacttcgccatggagacctgggtgctggtggctaccagcctcgtgctactgtatatttacgggactcatagccacaaattgtttaagaagctgggcatcccaggcccaactccactgcccttccttggcacgattctgttttatctccgggggttgtggaatttcgaccgtgagtgtaacgaaaagtatggggaaatgtggggcctgtacgagggacagcagcctatgctggtgattatggaccccgacatgatcaagaccgtcctggtgaaagagtgttactctgtgtttactaatcaaatgcccttaggaccaatgggcttcttaaagtcagctctctcctttgctgaggacgaggaatggaagagaattcgtactctgttgtcgccagccttcacttcagtgaagttcaaagagatggtacctattatttctcagtgcggcgacatgttggtccggagtctgagacaggaggcagaaaattccaagtctatcaacctgaaagatttcttcggggcatatactatggacgtcatcacagggacactgttcggggtgaatctggactcattgaacaacccgcaggatccgttcctgaagaacatgaaaaaactgctgaagcttgatttcctggacccctttctgctgctcattagcctgttcccatttttaacacccgtgtttgaggccctgaatatcggcttgtttcccaaagatgtaacccatttcctgaagaactccattgaacggatgaaagagtctcgtctgaaagataagcagaagcacagagtggactttttccagcagatgattgattcacagaatagtaaggagaccaagtcacataaggctttatccgacctggagctcgttgcccagagcattataatcattttcgccgcttacgataccacaagtacgacattgcccttcatcatgtacgagctagcaacccatccggacgtgcagcagaaactgcaagaggaaatagatgccgttctgcctaataaggctccggtcacctatgacgccctggtgcaaatggaatatctggatatggtggtgaacgagaccttgaggttgtttccagtggtaagtagagtgacccgcgtatgtaaaaaagacatcgaaataaacggggtgttcatcccaaaaggcctagccgtcatggtgcccatctacgccttacaccatgacccaaaatattggaccgagcccgaaaagttctgtcccgagagaagccactag

SEQ ID NO: 184506 - DNA, 843 bp, Artificial Sequence
  Description of Artificial Sequence: Synthetic coding sequence
atgaacctggagaccggcaacggcccccaccacttccccatgtggcggtatgtcggcgagaaacccgaagcgggctcccgtgaacagcaagtgcatcaactggagagatttctgtgggggctccaccacgggtgtaaccattggcatatcatttggtccgagctggggttctctcagcagagtacccggtcacttagcgagaaatacgaagaagcgttcaaaattggcttcttcggaagtctgtttactctgaacatacaatcactggccgtgctgcccaggcctgagtgtatggttaggagcggtctgactgagacctccacaagttgggtacgggtgatcctacttccgcagccaccagaggagctgggactgcaacatcgcgtggactttttccagcagatgattgatagtcaaaatagtaaagagaccaagagtcataaggccttgagcgacctggagctcgttgcccagagtattattatcattttcgctgcctatgacactacaagcaccactttacccttcatcatgtacgagctagccacccatccagacgttcagcagaagttacaggaggagatcgatgcagtcctgcccaataaagctccagttacctacgacgccctggttcagatggagtacttggacatggtggtaaatgaaactctccgcctcttcccggtggtgtccagagtcacacgagtgtgtaagaaggacatagaaatcaatggggttttcatccccaagggcctagccgtcatggtcccgatctatgcactgcaccatgatcctaagtactggacagaacctgagaagttttgcccagagcgtagtcactag

SEQ ID NO: 184507 - DNA, 1512 bp, Artificial Sequence
  Description of Artificial Sequence: Synthetic coding sequence
atggacctgatccccaacttcgccatggagacctgggtgctggtggctacctcgctggttctgctgtatatttacggaacccattcacacaagctgttcaaaaaactcgggatcccaggcccaacccctctgccattcttaggaaccattcttttttatctgaggggattgtggaactttgaccgcgagtgtaatgagaaatacggagaaatgtggggcctgtacgagggacagcagccaatgttagttatcatggaccccgatatgatcaaaaccgtcttggtaaaagagtgttattctgtattcacgaaccagatgccgctcgggccaatggggtttctgaagtccgcccttagctttgccgaggacgaggaatggaagcgtatcagaaccctcctgtcaccagcgttcaccagtgtcaagttcaaagaaatggttcctattatatcacagtgtggggacatgctcgtacgctctctgcggcaggaggccgagaattctaagtcgataaatctgaaagactttttcggcgcctacaccatggacgtaatcacaggaacgctgtttggtgtcaacttggattctttaaacaatccacaggaccccttcctaaagaatatgaagaaattgctgaagttagattttttggacccgtttctcctgctcatctctttgttcccttttctaacaccagtattcgaggcccttaacatcggtcttttcccaaaagatgtgacccacttcctgaaaaatagtattgaacgtatgaaggagtccaggctgaaggataaacagaagcatagagtggatttctttcagcaaatgattgacagccagaattcgaaggaaaccaaatctcataaagcactttccgacctcgaacttgtggcccagagcattatcatcatctttgcagcatacgataccacatcaacaactctaccttttatcatgtacgagctggcaacgcatcctgacgtacagcaaaagctccaggaagaaatagatgccgtgctacctaataaggccccggtgacgtacgatgcccttgtgcagatggaatatttagatatggtagtgaacgagacccttaggctgtttccagtcgtgagcagggtgacccgcgtgtgcaaaaaggacatcgaaatcaatggcgtgtttatccctaaagggttggctgttatggtgcctatatatgcattgcatcatgaccctaagtattggaccgagccagaaaaattttgtccagagcgcttctccaagaagaacaaggatagtatcgatctgtataggtacatcccgtttggcgctggcccccggaattgtataggaatgagatttgcgctcacaaatatcaaacttgccgtcattcgtgcacttcaaaatttttcgttcaaaccgtgtaaagagacccagatcccattaaaattggacaacctccccatactccagccggagaagccaattgtgctgaaggttcatttgcgggacgggattacatctggaccttag

SEQ ID NO: 184508 - DNA, 381 bp, Artificial Sequence
  Description of Artificial Sequence: Synthetic coding sequence
atggacctgatccccaacttcgccatggagacctgggtgctggtggcaacttccctggtgttgctctacatctacgggacccattcacataaacttttcaagaagctgggaatccctgggccaacccctctgcccttcctcgggacaatcctgttttatctgcgcggtctctggaattttgatcgagaatgcaatgagaaatttctgtgggggctgcatcatggatgtaaccactggcacatcatctggtccgaattgggctttagtcagcaaagtactcgctcattatcagagaagtacgaggaggccttcaagatcggattctttggaagccttttcacattgaacatcacattgtcaatctcttacccttctttctag

SEQ ID NO: 184509 - DNA, 225 bp, Artificial Sequence
  Description of Artificial Sequence: Synthetic coding sequence
atggacctgatccccaacttcgccatggagacctgggtgctggtggccacaagcctggtgctgttatacatatacggaacacattcccacaaactcttcaagaagctggggataccaggtcccacgcccctgcctttcttgggaacgatactgttttatcttcgaggtctatggaatttcgaccgcgagtgtaatgaaaagtacggggaaatgtggggaccttag

SEQ ID NO: 184510 - DNA, 435 bp, Artificial Sequence
  Description of Artificial Sequence: Synthetic coding sequence
atgcccaaggtgaagcggagccggaaggccccccccgacggctgggaactcatcgagccgactctagatgaactcgatcagaagatgcgggaagctgagacggagccgcacgaaggtaaacggaaagtggagtcactttggccaattttcagaatccaccatcagaaaacaaggtatatattcgatctgttctataaacggaaggctatctcgcgagagttatacgaatattgtattaaagaagggtacgccgacaagaacctgatcgccaagtggaaaaagcaggggtatgaaaacttgtgctgcttgaggtgcatccagacccgtgacactaactttggtacaaactgcatctgccgggtgccgaagtcaaaactagaggtggggcgcataatcgaatgcacgcactgtggatgtcgcgggtgttccggctag

SEQ ID NO: 184511 - DNA, 120 bp, Artificial Sequence
  Description of Artificial Sequence: Synthetic coding sequence
atggacctgatccccaacctggccgtggagacctggctgctgctggcagtgtcactcgttttgctgtatctcatgcgggtgccgaaaagcgccaagtctccactgacaaaacagacctag

SEQ ID NO: 184512 - DNA, 1479 bp, Artificial Sequence
  Description of Artificial Sequence: Synthetic coding sequence
atgcagctgctgatgctggagctgctgctgctgttcatcgtgtacggaacacgtacccacggcctgtttaagcggcttgggatcccaggcccgacaccattgccccttctcggcaatgtcctaagttacagacagggactctggaagtttgataccgaatgttacaaaaagtatggtaagatgtggggaacttatgaagggcagttaccagtactcgcaattaccgatccagacgtgattcggacggtgcttgtgaaggaatgctattccgtctttactaaccgacggagccttgggcccgtcggctttatgaaatccgccatttccttggccgaagatgaagaatggaagcgcattcgctctttactatcccctacgttcacatcaggaaagctgaaagagatgttccctatcatagcccagtatggggatgtactggtcagaaatctgcggcgggaggcagaaaaggggaaacccgtaaccctgaaggacattttcggcgcatattccatggatgtgatcaccggaactagtttcggtgttaacatcgacagtctgaacaatccacaggatcccttcgtggaatcgactaaaaaattcctgaaatttggcttcctggatccactcttcctgtccataatcctgtttccgtttctcactcccgtctttgaagcactcaacgttagtttattccctaaagacactattaatttcctgagcaagtccgtcaacagaatgaagaagagccggctcaacgacaagcagaaacacagactggattttttacagctcatgatcgatagccaaaactccaaagaaaccgagtcacataaggccctgagtgatctggagctggccgcccagtccattatttttatcttcgccggctacgaaactacatcatcagtcctcagctttaccctctacgagctggccacacacccagatgtgcagcagaagctgcagaaggagattgatgctgtcctgcctaacaaagctcctcctacgtacgacgccgtggtccaaatggaatacctggatatggtagtgaacgagaccctgagactgttccccgtcgcgatcaggctggagagaacttgcaaaaaagatgtcgagatcaatggcgtctttatcccaaaaggcagtatggtggtcatcccaacttatgccctgcaccatgatccgaagtattggacagagccagaggagttcagacccgagagattttctaagaagaaggattccatagatccttatatctacacaccatttggtacaggcccgcggaattgtatagggatgcgatttgcactcatgaatatgaaacttgctttaatcagagtcctacagaatttcagcttcaagccgtgtaaggaaacgcaaattccactcaaactcgacacccaaggcctccttcaaccagaaaaacctatcgtcctcaaggtcgactccagggacggaacactgtccggcgagtag

SEQ ID NO: 184513 - DNA, 1602 bp, Artificial Sequence
  Description of Artificial Sequence: Synthetic coding sequence
atggacctgatccccaacctggccgtggagacctggctgctgctggccgtttctctgattttgctctacctttacggcacaaggacacatggcctcttcaagaaacttggaatacctgggccaacgcccctccccttcctcgggaatgccctgagtttccggaagggttactggacttttgatatggagtgctacaaaaaatacagaaaagtctgggggatttacgattgccagcagcccatgctcgcaataaccgatcccgacatgattaagaccgtcctggtaaaggagtgttattctgtgttcacgaatcgaagaccatttgggcctgtggggttcatgaagaacgccatctctattgccgaggacgaagagtggaagcgcatacgctctttgctcagtccaactttcacctctggaaaactgaaagagatggtcccgattatagcccaatatggagacgtgctggtcaggaacctgcgaagggaagccgagacgggcaaacccgtcacactaaagcatgtcttcggagcttacagtatggacgtgatcacctcaacgtcattcggggtcagcatcgattctctgaacaatcctcaagatccttttgtcgaaaacactaaaaaactgctgcgcttcaatcctttggaccctttcgtgcttagcattaaggttttccccttcctgacaccaattctagaggcgcttaatatcacggtcttccctcgcaaagtcatctcgttcctcactaaatcggtgaagcagatcaaagaaggccgcttgaaagagacccagaagcatagggtggacttcctgcagttaatgatcgatagccagaatagtaaagattccgagactcataaagctctcagtgatctggagcttatggcacaaagcataattttcatttttgctggctacgaaaccacctcctcagtgctctcctttatcatttacgagctggcgacgcaccccgatgtgcagcaaaaggtgcagaaggagatcgacacggtgcttcctaataaagcacccccaacctacgataccgtgctgcagcttgagtacctggacatggtggtgaacgagaccctgcgcctttttcccgtggcgatgcgcctcgagcgggtgtgcaagaaggacgtggagattaatgggatgttcatccccaaaggcgtggtagttatgatccccagttatgtgttacatcatgacccgaaatactggcgggaaccggaaaagttcctgcctgagcggttttctaaaaaaaataaagacaacattgacccctatatttacaccccatttggctcaggacctaggaactgtattggcatgcggttcgctctggtgaatatgaaactcgctctagtccgcgtcctccagaatttcagtttcaagccatgcaaagagacacagataccactgaaactacggtttggggggcttctactcactgagaaacctatcgtactaaaggcagagtcgagagacgagaccttcgtcgatatggaacctattcacatggacttccttcgatcactcgcattccagggaccacatttgtgctttttctgggagctgctgtgccccacaattcggtag

SEQ ID NO: 184514 - DNA, 1512 bp, Artificial Sequence
  Description of Artificial Sequence: Synthetic coding sequence
atggacctgatccccaacctggccgtggagacctggctgctgctggcagtcagtcttatcctgctgtatctttacggaacccgcactcatggattgttcaagaagcttggtatcccgggtcctacccccctgcccttcctgggcaatgcgctgtcttttaggaaaggctactggacatttgatatggaatgttacaagaaataccgtaaggtgtggggcatatacgactgccagcaaccaatgctggcgattaccgatccagacatgattaaaaccgtcctggtcaaggagtgctatagcgtgtttactaaccggagacccttcggcccagttggtttcatgaaaaatgccattagcatagctgaagatgaagaatggaaaagaatccgctcactcttgtctccaacctttacatctggaaagcttaaggagatggtccctatcatcgcacagtacggcgacgtgttggttaggaacttgaggagagaagctgaaacagggaagcccgtcactctcaaacacgtgttcggagcctattctatggatgttatcacctccacatctttcggcgtgtcaatcgactcattgaacaacccccaggatccattcgtggagaacaccaaaaaactcctccgctttaaccccttagacccattcgtgctctcaattaaggtgttccccttcctcaccccaattttagaagcgcttaacattactgtcttccctcgtaaggtcatttcctttctcacaaagtccgtcaaacaaattaaggagggtaggctgaaggagacacagaaacatagagttgattttctccagctgatgatcgatagccagaactccaaagattcggaaacacacaaagccctgtcggacttagaactgatggcccagagtatcatctttatcttcgcaggctacgaaaccaccagctctgtgctcagttttatcatttatgagctggccacccaccccgacgtccagcaaaaggttcaaaaggagattgataccgtgcttccaaacaaggccccgcccacctacgataccgttctgcagctcgagtacctggacatggtggtgaacgagaccttgcgcctgttccccgtcgccatgaggttggagagggtatgtaaaaaggacgtcgagatcaatgggatgtttattcccaaaggtgttgtggtgatgattccgtcttatgtcctgcaccatgaccctaagtactggagagaaccagaaaagttcctgccagagcggttttcgaaaaagaataaggataacatcgacccatatatctatacgcctttcggttctggtcctcgtaattgcatcggaatgaggttcgcattggtgaatatgaagttggccctcgttagagtcctccagaattttagcttcaagccttgcaaagagacccagatcccacttaagctgaggttcggcggcttgctcctgaccgagaagcccattgtactgaaagcagagtctagggacgagacggtgtcaggagcctag

SEQ ID NO: 184515 - DNA, 1410 bp, Artificial Sequence
  Description of Artificial Sequence: Synthetic coding sequence
atggagctgatcagccccaccgtgatcatcatcctgggctgcctggcactattccttctgttgcagagaaaaaatctgcggcgtcccccatgtatcaagggctggattccctggatcggcgtgggtttcgaattcgggaaggcccccctggaattcatcgaaaaggcacgaatcaaatacggtccaatcttcaccgtgtttgccatgggcaatagaatgacattcgtgacagaggaagagggaattaacgtgttcctgaagagcaagaaggtggactttgagctcgctgttcagaatattgtctatcggactgccagcattccaaaaaatgttttcctggccctccatgaaaagctgtacattatgctcaaaggcaagatggggaccgtcaatctgcatcagttcaccggacagttgactgaggaacttcatgagcaactggagaatctgggcacacatggcacaatggatttgaataatctcgtcaggcacctcttgtatccagttaccgtgaacatgttgttcaacaaatccctgtttagcacaaacaaaaagaaaatcaaagagttccaccagtactttcaggtttacgacgaggattttgaatatgggtcccagctccccgagtgtctgttgcgcaactggtcaaagtctaagaagtggttccttgaactgtttgaaaagaatattcctgatattaaagcatgcaaaagcgctaaggataactctatgaccttgttacaggccactctggatattgtggagaccgaaacgtccaaggagaacagcccaaactacggcctcctgctcctgtgggcttctctttccaacgccgtcccagtggccttctggactctggcctacgtgctgtcccatccggacattcacaaggccatcatggaaggaatatcatccgtgttcggcaaggcaggtaaggataagattaaggtgtccgaggacgacctggagaatctactgctgattaagtggtgcgtgttggagacaattcgcctgaaagcaccgggggtgatcactcgtaaggtcgtcaagcctgtggaaattttaaactatataattcccagcggggatctgctaatgctgtcccccttctggcttcatcgcaaccctaagtactttccggagccagaactgtttaaacctgaaaggtggaagaaggccaatctggaaaagcacagcttcctcgactgtttcatggcttttgggagtgggaagttccaatgtcctgccagatggtttgctctgctcgaggtgcagatgtgtatcatcctaatcttgtacaaatacgattgttctctgctggaccctctgcctaagcagagttacttgcatctggttggggtcccacagcccgaaggccaatgtcgaatcgaatataagcagagaatttag

SEQ ID NO: 184516 - DNA, 1560 bp, Artificial Sequence
  Description of Artificial Sequence: Synthetic coding sequence
atgagcgtgagcgtgctgagccccagccggctgctgggcgacgtgagtggtatacttcaggcagcttcactgctcattctgttactcctgttaatcaaagcagtgcagctgtatctccacaggcagtggctgctgaaagcgctgcagcaattcccttgcccaccatcacactggctgttcgggcacatccaggagctccagcaggatcaggagctgcagagaattcagaagtgggtcgagacttttccctcagcatgccctcactggctctggggtggaaaggtgcgtgttcaactctacgacccagactacatgaaagtaattcttggccgctctgaccccaaatcacacggctcatatcggttcctcgccccctggataggatatggtttgctgctgttaaatggccaaacgtggtttcaacatcgacggatgcttacaccagctttccactatgacatcctaaagccctatgtggggctgatggccgactcagttagagttatgctggataagtgggaagaactgctgggccaagattcaccgctggaggtattccagcatgtcagcctgatgacgctggacacgatcatgaagtgcgccttctctcaccagggcagtattcaggtggacagaaacagtcaatcttacatacaagccatctccgatctgaataacctggtgttttctagagtccgaaacgccttccatcagaatgacacaatttattccttgacctccgccggacgttggactcatcgggcatgtcagctcgcccaccaacatacagatcaggtaattcaattacgaaaagctcaactgcagaaagagggggaactggagaagatcaaacggaaacggcacctggattttttagacattctgctgctggctaagatggagaacggctccatcctgagcgacaaggatctccgagctgaggtggataccttcatgttcgagggacacgataccaccgcaagcggcatctcctggatcctatatgccctggcaacgcatcctaaacatcaagagcgttgcagggaagaaattcattctttactcggagatggcgcgtcgattacctggaatcatctggatcagatgccttacacaaccatgtgtatcaaggaggcccttaggttatacccacccgtcccaggcattggcagggagctcagcacccccgtcacttttccagatgggcgatctttaccaaaaggaatcatggttctgctcagcatttacgggctccatcataaccccaaggtgtggcctaatcctgaagtatttgacccattccgattcgctccaggatcggcacagcacagtcacgctttcttgccgttttcagggggatccagaaactgcatcgggaaacagttcgcaatgaacgaattaaaggtggcaacagctctgacattgttgcgcttcgagctgctccctgatccaacaagaatacctatcccgatcgcccgcctcgtactgaaatcgaaaaacgggattcacctgagattaagaaggcttcctaacccatgtgaagacaaagaccagctatag

SEQ ID NO: 184517 - DNA, 1563 bp, Artificial Sequence
  Description of Artificial Sequence: Synthetic coding sequence
atgagcgtgagcgtgctgagccccagccggctgctgggcgacgtgtccggaatcctgcaggcagctagtttactgatactgctgttgctcctgattaaggccgttcagctctacctgcaccgtcagtggttgctaaaggcccttcagcagtttccttgccctccttcacattggcttttcgggcacatccaggaattgcagcaggaccaggagctccagaggatccagaaatgggttgagaccttccctagcgcctgccctcattggctctggggaggcaaggttagggttcaactttacgaccctgattacatgaaggtcattctgggcaggagtgaccctaagtcccacggcagctaccgctttcttgctccatggattgggtacggccttttgctactgaacggtcaaacctggtttcagcatcggcggatgcttactcccgcattccactacgatattctcaaaccttacgtggggctgatggctgattctgtgagagtcatgctggacaagtgggaggagcttttaggtcaggatagccccctggaagtctttcagcacgtttccctgatgacattggatactattatgaagtgcgcgttcagccatcagggctccattcaagtcgacagaaactctcaatcatacattcaggcgatctctgatctgaataacctggtgttcagccgggtgaggaatgcctttcatcagaacgatactatatatagccttacatctgcaggacgctggactcatagggcttgccagctcgcccatcagcataccggtgaccaggttatccaactgaggaaagcccagctgcagaaggaaggagaactcgagaagattaagcggaaaagacatctggatttcctggatattctcctgctggccaagatggaaaatggctctattctttccgacaaagaccttagggctgaagtcgacacttttatgttcgaaggccacgataccacagccagcggcatctcatggattctctacgcccttgctacccaccctaagcaccaagaacgctgtcgcgaagagatacattctcttctgggagatggtgcaagtataacctggaatcatcttgatcaaatgccgtataccactatgtgcataaaagaggccctgcgcctttatcctccagtgcccggtattggacgtgaactaagtactcctgtaacctttcccgatgggcggagtctgccaaaaggcattatggtactcctcagtatctatggtctacatcataatcctaaggtatggcctaatcctgaagtgtttgacccttttagattcgcccctggctccgcccagcattctcatgccttcctgcctttcagcggtgggtctcgtaactgcatcggcaaacagtttgccatgaatgagctcaaggtggcaaccgcactcaccctcctgcgcttcgaactacttcctgaccccacgcgtatcccaattccgatagcgagactggtgcttaagagcaaaaatggcattcatctgcgcttgcggagactgcctaatccctgtgaggacaaggaccagctttag

SEQ ID NO: 184518 - DNA, 1368 bp, Artificial Sequence
  Description of Artificial Sequence: Synthetic coding sequence
atgagcgtgagcgtgctgagccccagccggctgctgggcgacgtgtctggaatccttcaggccgctagcctgttgatcctgctgctgttgctgatcaaggccgtgcagctgtacctccacaggcaatggctgctgaaggctctgcagcaatttccctgcccgccatctcactggctcttcggccatattcaggaactgcaacaggaccaagagttgcagcgaatccagaagtgggtagagaccttccctagcgcatgtcctcattggctctgggggggtaaagtgcgcgtacagttgtacgaccctgactatatgaaggtcatcctgggcagatccgatccaaagagtcacggcagctacagatttttagccccgtggatcgggtatggattgttgcttctaaatggccagacatggttccagcataggagaatgctgacacccgcatttcactacgacatattgaagccctacgttggtctgatggccgactccgtacgcgtgatgctggataaatgggaggaactgctcggacaggattcaccacttgaagtgtttcagcatgtaagcctgatgacgctggacaccatcatgaagtgcgctttctcccatcagggctctatacaggttgacaggaacagtcaaagctacattcaagcaattagtgacctgaataatcttgtgttctctcgggtcagaaatgcttttcatcagaatgacaccatttattcattaacgtctgctggcaggtggacccaccgcgcctgtcaattggcccaccagcacaccgatcaagtgattcaactgaggaaggcacaactacagaaagaaggcgaactggaaaagatcaaacgtaaacgtcacctggactttctagatatcctacttttggctaaaatggaaaatggctccatcctgagtgacaaggaccttagggctgaggtcgatactttcatgttcgagggtcacgataccaccgcctcaggcattagttggatcctgtacgcactggctacccaccctaaacatcaggaacgctgccgcgaagagatccatagtctgctcggcgatggagcatccatcacctggaaccacctagatcagatgccctacaccaccatgtgcatcaaggaagcactacgcctgtatccccctgtccccggcataggccgcgagctctcaacacccgtgactttcccagatgggcgttcactgcccaagggaatcatggtactgctgagcatctacgggttgcatcacaatcctaaggtctggcccaacccagaggtgtttgatccatttcgctttgccccagggtccgcgcagcattcacatgcttttctcccatttagcgggggctcccggtag

SEQ ID NO: 184519 - DNA, 474 bp, Artificial Sequence
  Description of Artificial Sequence: Synthetic coding sequence
atgaaggtgatcctgggccggagcgaccccaagagccacggcagctatcggttcctggctccttggattgggtacggtcttcttctgctcaatggccagacttggttccagcaccgaaggatgctgacacctgcctttcattacgacatcttgaagccctacgtcggcctaatggcagactccgtacgagtgatgctggataaatgggaggagctgttaggtcaagactccccgctggaagtctttcagcacgtgtcactaatgacacttgacactatcatgaagtgcgcgttcagtcatcagggatccattcaggtggacagaccgtccgaccctaccgaagaggggagtaccactgagggcggtggggcgggagaagatcaggaagaggaggcgtttggcttcagtggctatccaccactgggtcagaatggcgagtgggaacatttagtcaggcagggcccgccctgctag

SEQ ID NO: 184520 - DNA, 1575 bp, Artificial Sequence
  Description of Artificial Sequence: Synthetic coding sequence
atgccccagctgagcctgagctggctgggcctgggccccgtggccgcgagtccatggctcctgttgcttctggtgggtggatcttggctgctggcacgcgtgctagcttggacatacactttttacgacaactgcagaaggctccagtgcttcccccagccaccaaaacagaactggttttggggacatcagggcttagtgacccctacagaggaaggcatgaaaaccctcacacagctggttacaacataccctcagggctttaagctttggctgggtcctacctttcccctgttaatcctgtgtcatcctgacataatccgacctattacttcagcaagcgccgctgtggcacctaaagacatgatattttacggcttcctgaaaccctggttaggggacgggttgctcctgtcaggaggcgacaagtggagtcgccaccggcgcatgctgaccccggcatttcacttcaacatcctcaaaccgtacatgaaaattttcaacaagagtgtaaacatcatgcacgataaatggcagagacttgcttctgaggggagcgcacgcttagatatgttcgaacacatcagcctgatgacactggacagcctgcagaagtgcgtcttttcttttgagagtaactgtcaagagaagccatctgagtacatcgccgccatccttgagctgagcgctttcgtagaaaagcggaatcagcagatcctgctgcatactgattttctctactacctcactcctgatggacagagatttagaagagcatgtcacctggtacacgattttactgatgctgtaattcaggagagaagatgtacgttgcccacacagggtatagatgacttcctgaagaataaagccaagtccaaaacacttgacttcattgacgtcttactactgtccaaggacgaggacggaaaggagctgtcagatgaggacatccgagccgaagcagacacatttatgttcgaagggcacgataccactgcctccggcctgtcttgggtcctctaccacctcgctaaacatccagaataccaggaacagtgtagacaggaagttcaagagctgctcaaggaccgcgaaccaattgaaatcgagtgggacgatctcgctcagctacctttcctcaccatgtgcatcaaggagtcccttcggctgcaccctccagttcctgtgataagcaggtgctgcacacaggattttgttttacctgatgggagagtgatcccaaaagggattgtgtgccttatcaacatcattggcattcattacaaccctacagtgtggcctgacccggaggtctacgatcctttcaggtttgatcaggagaacatcaaggagcggagcccgttggcctttatccctttctccgccgggcctcgcaactgtatcggtcaggctttcgcaatggctgaaatgaaggtcgtacttgccctgaccttgctgcacttccgtatcttaccaactcacactgagccccggagaaaacctgaattgatcctgcgcgcagagggcgggctgtggctgagagttgaaccactgggtgccaactcgcaatag

SEQ ID NO: 184521 - DNA, 1365 bp, Artificial Sequence
  Description of Artificial Sequence: Synthetic coding sequence
atgccccagctgagcctgagctggctgggcctgggccccgtggccgcctccccctggctgctcttgctgctcgtgggcggcagttggcttctcgcccgcgtgctcgcttggacatataccttctacgacaactgtcggcggcttcagtgctttccacagcctccaaaacaaaattggttctggggccaccagggtttagtgactcctaccgaagaggggatgaaaaccttaacgcaactggttaccacataccctcaggggttcaaactgtggctgggccctacctttccgctcctaattctgtgccacccggacatcattagacctattacttctgcctctgccgctgttgccccaaaggatatgattttctacggatttctgaaaccatggctcggcgatggtctcctgctttccggaggagacaagtggtcacgccaccgcagaatgctcaccccagcttttcattttaacattctgaaaccgtatatgaaaatttttaacaagtctgtgaatattatgcacgacaagtggcagcggttagcgtccgaaggctccgcaagattagatatgtttgagcatatctccctaatgactctggactccctccaaaaatgtgtgttcagctttgaaagcaactgccaagagaaaccttctgaatatattgcagcaatcttggaattgtccgccttcgtggagaagagaaaccaacagatcctgttacatactgacttcctgtactatttgacaccggacggtcagagatttagaagggcctgtcacctggttcacgatttcacggatgccgtgatccaggaacggcgttgtacacttcctacccagggcattgacgacttcctgaagaacaaggctaaaagtaaaaccttggacttcatcgatgtcctgctgctaagtaaagatgaggatgggaaagaactctccgacgaggatatcagagctgaggccgatacctttatgtttgaaggccatgacaccactgctagtgggctgtcctgggtcctgtaccacttggcaaaacaccctgaatatcaagaacagtgcagacaggaggtccaggaactgttaaaggatcgggagcccatcgagatagagtgggatgacctggcccagctgccatttctgactatgtgcattaaagagagcctcagactgcatcccccagtacccgtgatctcccgctgttgcactcaggatttcgtgcttccagatggcagagttattccaaaaggactccggccgttaccattcaggcccagagagcaccagggtgaggtgactagtggtttctatagccttcttggtagagcccagaaacttcacagggccggggtgaggcacggatag

SEQ ID NO: 184522 - DNA, 1575 bp, Artificial Sequence
  Description of Artificial Sequence: Synthetic coding sequence
atgccccagctgagcctgagctggctgggcctgggccccgtggccgcttcaccctggttactgctgctgctagttggaggatcttggctcctcgcacgcgtgcttgcttggacgtatacattttatgacaactgtaggcgactgcaatgttttccccagccgcctaagcaaaactggttttggggccaccagggtctcgtgactcctactgaagaaggtatgaaaactctgacacagctcgtcactacctaccctcaagggttcaaactatggcttggcccgacatttcccctgctgatcctatgccatcccgatattattcgccctattacctctgcaagcgctgcggtagcccccaaggacatgatcttttacgggttcctgaagccctggttgggtgacgggcttctgttgagcggcggcgacaagtggagcaggcacagaaggatgttaacccccgcgtttcacttcaatattctgaagccatacatgaagatctttaacaagtctgtgaatattatgcacgacaaatggcaaaggttggcaagcgaaggtagtgccagactcgatatgttcgagcatatttccttgatgacgctagactccctgcagaagtgtgttttctccttcgagagcaactgccaggaaaaaccctcagagtatatagctgccatccttgagctttcagcctttgttgagaaacggaaccaacagatactcctgcacacagactttctctattacctgacccccgacggccagaggtttagacgggcctgccatctagttcacgatttcacagatgcagtgatccaggagcgaagatgtacccttcctacgcagggaatcgacgactttttgaagaacaaggcaaagtccaaaacacttgattttatagacgtcttactgctgtcgaaggatgaagacggaaaagaactgtctgatgaagatattcgggcggaggctgataccttcatgtttgagggccacgataccaccgctagcggactgtcatgggtactgtaccacctggcaaagcatcccgaatatcaagaacagtgtcgacaagaggtccaagagcttttgaaagaccgagagcctattgaaatcgaatgggacgatctcgcgcagcttccgtttctgactatgtgtataaaagaaagcttgcggcttcacccaccagtacccgtaatcagtcgctgttgtacccaagatttcgttctcccagatggccgtgtaattcccaagggcatagtttgcctgatcaacatcatcggtatacactataatccgacagtctggcctgaccctgaggtgtatgatccctttcgctttgaccaggagaatataaaagagagatcccctctagccttcattcccttttctgccggtcctcgaaactgtatcggccaggcctttgcaatggccgaaatgaaagtagtactcgccctgacccttctccacttcagaatactgcctacacacacggagcccaggaggaagccggaactaatccttagggccgagggtggattgtggcttagagtggagccattgggggccaattcacagtag

SEQ ID NO: 184523 - DNA, 1575 bp, Artificial Sequence
  Description of Artificial Sequence: Synthetic coding sequence
atgagcctgctgagcctgccctggctgggcctgcggcccgtggccacctctccttggctgctccttttgctcgttgttgggagctggctgctagccagaatcctcgcttggacatatgctttctacaacaactgtagaaggctgcaatgttttccacaaccccctaaacggaactggttttggggccatctaggcttaatcacccccacagaggaaggcctcaagaactctactcaaatgagtgccacgtattcccagggattcacaatatggctcggcccaattattccatttattgtgctatgccaccccgacaccattaggagtattactaatgcgtctgcggcaattgcccccaaggacaatcttttcattcgttttctgaagccatggctgggtgagggcatactgctgtccggtggagacaaatggagccgtcaccgacgaatgttaacaccagcctttcattttaatatccttaagtcttacattactattttcaacaagtccgcaaatattatgcttgacaagtggcagcatctagcctctgaaggctcctcctgccttgatatgtttgagcatatctccttgatgacgctggacagtctccagaaatgtatcttctccttcgactcccattgtcaggagaggccatccgaatacatcgctaccatactggaactgtcagcactggtagaaaagagaagtcaacacatcctgcagcatatggattttttgtactacttaagtcacgacggtcgcagattccaccgcgcgtgtagacttgtgcacgactttacagacgccgtgatacgagagaggcgccggactctgcctacacagggaatcgacgactttttcaaagataaggccaagtcaaagaccctggactttatcgacgtgctattactgagcaaagatgaggacggcaaggcgctatccgacgaggacattcgcgccgaggccgatacatttatgtttggcggccacgacaccactgcctctggtctgtcttgggtgttgtataacctggccagacaccccgagtatcaggagagatgtcggcaggaagtccaggagctgctcaaggaccgggatcctaaagaaatagagtgggatgatctggctcaactgcctttcctcaccatgtgcgtgaaagaaagcttgcgcctgcacccccctgccccatttatctcccggtgttgcacgcaggacatagtgctgccagacggcagagtgatccccaaagggataacctgtctgatcgatattattggggtgcaccataatcctaccgtgtggcctgatccggaagtctacgatccattccgattcgatccggaaaattctaaaggccgtagtcccctggcattcatacccttttctgctgggcccaggaactgcattgggcaggcctttgccatggccgagatgaaggttgtattagcacttatgctccttcacttcaggttcttgcccgaccacacagagccccggagaaagctggagctgatcatgcgtgccgagggcggactgtggttgcgcgttgagccccttaatgtgtccctccagtag

SEQ ID NO: 184524 - DNA, 1575 bp, Artificial Sequence
  Description of Artificial Sequence: Synthetic coding sequence
atgagcctgctgagcctgccctggctgggcctgcggcccgtggccactagtccatggttgctgctccttcttgtagttgggagttggctcctggctagaattctagcctggacttacgctttttacaataattgtagacgtttacagtgcttcccgcagccccctaaaagaaactggttctgggggcacctaggtctgatcacacccactgaggaagggttgaaaaactcaacccagatgagtgctacctactcacaaggatttacaatttggctaggccccattatccctttcatcgtgctatgtcacccagacaccatcagatcaatcactaacgcctccgcagcaattgccccaaaggataatctttttatccgcttcttaaagccctggttgggcgaaggaatactcttgtccgggggagacaagtggagtaggcatcgcaggatgcttaccccagcctttcactttaacatcctcaagtcatatattacaatcttcaataaaagcgccaacatcatgttagacaagtggcaacacttggcctcagagggctcaagctgcctggacatgttcgaacacatcagcctgatgacacttgacagtctgcaaaagtgtatattttccttcgatagccattgccaggaaaggccaagcgaatatatagcaacaatccttgagctttcagccctggtggagaaaaggtcgcagcacatccttcagcatatggacttcctgtactatttatctcacgacggccgccggtttcaccgggcatgccgcctggtacacgacttcaccgatgccgttattcgtgagcggagacgcaccctgccaacccaaggaattgatgatttctttaaggacaaggctaagtccaaaaccttggactttatcgatgtgctccttctgagcaaagacgaagatggaaaggccctctccgatgaggacattcgggcagaagcggacaccttcatgttcggtggccacgacaccacggcttctgggctgagttgggtgctgtataacttagcacggcatcccgaatatcaagagagatgtcgccaggaggtgcaggaactcctgaaagatcgcgatcccaaagaaattgaatgggatgacctggcgcagttaccatttctgaccatgtgcgttaaagaatcccttcgactgcatccccctgcgccatttattagcaggtgctgtacacaagacattgtacttccagatggaagggtgatccctaaaggcattacttgcttgattgacataattggagtgcaccacaatcctaccgtgtggcccgaccccgaagtctacgacccatttcgattcgatcccgagaatagcaaaggaagaagtcctctggcctttattcctttttcagctgggcccaggaattgcatcggccaagcgttcgccatggcggaaatgaaagtggtgctggcactgatgttgctccactttcgcttcttgccggaccataccgagccccgtcgaaagctcgagctaatcatgagggctgagggggggctgtggctgcgggtggaaccattgaacgttagcctgcagtag

SEQ ID NO: 184525 - DNA, 1596 bp, Artificial Sequence
  Description of Artificial Sequence: Synthetic coding sequence
atgctgcccatcaccgaccggctgctgcacctgctgggcctggagaaaaccgcattcagaatttatgccgtgagtaccctgttactatttctcctcttttttctcttccgccttttgttacggttccttaggttgtgcaggtcgttctatattacatgccggcgactgcggtgcttcccccaaccgcctcgccggaactggcttctggggcacttgggaatgtacctgcccaatgaagccggcctgcaggatgagaaaaaggttctggacaatatgcatcatgtgctgctcgtgtggatgggacctgtcctgcccctgctcgtgctggtgcatcccgattatatcaagccccttctgggagcaagcgcggccatcgcacccaaggacgatctattctacggctttctaaagccatggcttggggatgggcttctcttatcaaagggcgacaagtggagcagacataggcggttgctcacgccagcattccacttcgacattcttaagccttatatgaaaattttcaatcagagtgccgatattatgcatgccaaatggcgccatttggccgagggatccgccgtctctctggacatgtttgaacatatctctttgatgaccctggactcactgcagaaatgtgtgttttcttacaatagcaattgtcaggagaagatgtccgattatatttctgctatcattgagctgagtgccctctctgtgagaagacagtaccgattgcatcactatcttgacttcatttattaccggagtgccgatggcaggagattccgccaggcgtgtgacatggtgcatcactttactaccgaggttatccaggaacggcggcgggctctccgccagcaaggggctgaggcctggctgaaggccaaacaggggaaaacattggactttattgatgttctccttctggctcgcgatgaagacggtaaagagttatccgacgaagatatcagggcggaggcagacactttcatgttcgaaggacatgatacaacctcctcgggaatttcatggatgctgtttaacctggctaagtatcccgagtatcaggaaaagtgcagagaggaaatacaggaagtgatgaagggcagagaacttgaggaactggaatgggatgatctcacacagctgcccttcacaacgatgtgcataaaggagagcctccggcagtacccacccgtcactctggtgagccggcaatgtactgaggacataaaattgcccgacggacggataattccaaaaggcataatttgcttggtgtctatttacggaactcaccataaccctacagtgtggccagacagcaaggtgtataatccctatcggttcgatcccgataaccctcagcagcggagccctcttgcttatgtcccgttttctgctggccctcgaaactgcatagggcaaagctttgcaatggctgagctgcgagtggtggtggcactgactctgctacgctttcggctttcagtggatcgcactaggaaggtgaggagaaaacctgaattgattttgagaactgaaaacggcctgtggttaaaagtagagcccctccccccacgagcttag

SEQ ID NO: 184526 - DNA, 1782 bp, Artificial Sequence
  Description of Artificial Sequence: Synthetic coding sequence
atggcccccagcggcctgaaggccgtggtgggcgagaagatcctgtctggcgtgattaggtccgttaaaaaggacggggagtggaaggttctaatcatggatcacccatccatgcgcatcctctccagctgctgtaagatgtccgacattctcgctgagggaatcactattgtagaagacattaacaaaaggcgagagccaatacctagtctagaggcgatctatcttctgtctccaacagagaaaagtgtccaggcactcataaaagatttccagggtacacctaccttcacatacaaggctgcacatatattctttacggatacatgtcctgaacccttatttagcgaattaggacgtagcagactggcaaaggtggtcaaaacgttgaaggagatccacctggcctttttgccttatgaggctcaggtgtttagccttgatgcaccccatagcacttataatctgtattgcccatttcgggctgaggaaagaacacgtcagctagaagtgctcgctcagcagattgccacactctgtgccactctgcaagagtaccccgcaattagatatcgcaaaggacccgaagatacagcacagctcgcccacgcagtcctggccaaactgaatgcattcaaggcggacactcctagcttaggcgagggaccagaaaagacccgaagccaacttttgatcatggaccgggctgccgaccccgtgtcgccattactgcacgagctgactttccaagctatggcctacgacttgttagatatcgaacaggacacctaccggtacgaaacaaccggtctgagcgaagcccgtgagaaggctgtgttactggacgaggacgatgatctttgggttgaactgcgccatatgcacatcgccgatgtctctaagaaggtgacggagttgctcaggacgttttgcgagagtaagcgtctcaccaccgacaaggctaacattaaggatctgtcacagatcctgaagaagatgccccagtatcagaaggagctgaacaaatatagcacccacctgcatctggccgacgattgcatgaaacatttcaagggtagcgttgagaaattatgcagcgtcgagcaggacctcgcaatgggctccgacgccgagggggagaagatcaaagacagcatgaagttgattgtgcccgtgcttctggacgccgctgtaccagcttacgacaagatcagggtgctgctgctgtacatcctcctccgaaacggggtatctgaagaaaatcttgccaagttaattcaacacgcaaatgtgcaggctcattcctctcttatcaggaatctggagcagctgggcggaacagtaaccaacccaggcgggagcggaacctccagcaggctcgaaccccgggagagaatggaaccaacataccaactgagtcgatggaccccagtcattaaggacgtaatggaggatgctgtcgaggatcgattggataggaacctatggccatttgtgtccgacccggctcctaccgcatcaagccaagcagccgtcagcgcaagattcgggcattggcacaagaacaaggccggaatcgaagccagagcaggccctaggctgatagtctacgttatgggcggcgtggctatgagcgagatgcgcgccgcctacgaggtaactagagctaccgaggggaagtgggaggtgctgattggcagctcccacatcctgactcccaccaggttcttagatgatctcaaagcgctggacaagaaactggaggacattgccctgccatag

SEQ ID NO: 184527 - DNA, 1344 bp, Artificial Sequence
  Description of Artificial Sequence: Synthetic coding sequence
atgcgggtgctgacccagctggtggccacctacccccagggcttcaaggtttggatggggcccatctttccggtgattaggttttgccacccaaacataataaggagcgtaatcaatgcctcagcagccatcgtgccaaaagataaagtgttttactccttccttaaaccctggctgggcgacggcttgctgctgagcgcgggggaaaaatggagtagacatcgacgaatgctgactccagccttccatttcaacattttgaaaccttacatgaagatttttaacgaatctgtgaatattatgcatgctaaatggcagctgctggccagcgaaggctctgcgcgtctggatatgtttgagcatatctcactaatgaccctcgacagtttgcaaaagtgtgtcttctcctttgactctcattgccaagagaagccatcagaatatatagcagccatattggagttgtccgcgctggttacaaaaagacatcagcagatcctgttgtacatagactttctctactacctaacgccagatgggcaaaggttcaggagggcttgcaggctagtgcacgatttcaccgacgccgtcatccaggagcggaggcgcactcttccatcccagggcgttgacgatttcctccaggccaaagcgaaaagcaaaacattagactttatcgacgtgctcctgttgagcaaggatgaggatgggaagaagctatccgatgaagacatccgggccgaagctgacaccttcatgtttgagggccacgataccacagcctccgggttgtcttgggtgctatatcatcttgccaaacatccagaatatcaggagagatgccgacaagaagtccaggagttactaaaggacagggagcctaaagagattgaatgggacgacctcgctcaattaccattcctaactatgtgtattaaagaatcactgcggctgcacccacccgtgcccgccgtatccaggtgctgtacccaggatatcgttctgcctgatggtagggtgattccaaaaggtatcatttgcctcatttctgttttcgggacccaccacaatccggcagtgtggccagatcctgaggtgtacgacccgttccgcttcgacccaaagaacataaaggagcggtcaccactagcgtttattcctttcagtgccgggccccggaactgtattgggcaggcgtttgcgatggccgagatgaaagttgtcctgggcttaaccctgctgcgattccgagtcctccccgatcatacagaacccagaaggaagcccgagcttgtcctgcgagcggaaggcggcctgtggttacgagtggaacccctgtcatag

SEQ ID NO: 184528 - DNA, 999 bp, Artificial Sequence
  Description of Artificial Sequence: Synthetic coding sequence
atgcccagcatcaccaccgccgccgccagcggcgtgagccggagcccaggcaaccggacaggcagctgggtgacgtgggcatggaaaccctccgaatacattaccgccattatggagctctccgctctggtggtgaagcgcaataatcagttctttcggtataaggactttttgtatttccttactccttgcggccggcggtttcatcgcgcctgccgactggtccacgacttcacagacgccgtgattcaggaacgacgcaggaccctgacttctcagggcgtggacgactttctccaagccaaagcaaagtctaagaccttggactttatcgatgtcctgctgctaagcgaggacaaaaatggcaaagagctgagcgatgaggatatacgtgcggaagcagatacttttatgttcggcggccacgacaccactgcatctggcttatcctgggtgctgtacaacctagctagacatcccgaataccaggagcggtgtaggcaggaggtgcaggagctgttgaaagaccgcgagcccaaagagatcgagtgggatgatctagcccagctccccttcctgactatgtgtcttaaggaatctcttcgcctacaccctcccattcccacgtttgcccgcggttgcactcaggacgtcgtcctccccgactctagggtgataccaaaagggaacgtgtgtaatatcaatattttcgccatccaccacaaccctagtgtgtggcctgatccagaggtctatgatccattccgctttgaccctgagaatgcgcagaaacgctcacccatggccttcatcccctttagtgccgggccccgtaattgtataggacaaaagttcgccatggccgagatgaaagttgtcctcgcacttaccttgcttagatttcggatactccctgatcaccgggagccccggaggactcccgagatcgtgctgagggcagaagacgggctttggctcagggtggagcctttgggatag

SEQ ID NO: 184529 - DNA, 1560 bp, Artificial Sequence
  Description of Artificial Sequence: Synthetic coding sequence
atgagcctgctgagcctgagctggctgggcctgcggcccgtggccgcaagtccatggctgctgctgctggtcgtcggcgcttcatggttgttggcccgcatattagcctggacatacgccttctaccacaatgggagaagactgcgctgctttccacagcctagaaagcagaactggttcctcggccatctcgggctcgtgactcctaccgaggaagggcttagggtgcttactcagctggtcgctacgtacccccaggggttcgtgcgatggctcggccctattacacccatcattaatctgtgtcatcctgacattgttcgctcggtcatcaacacaagcgatgccatcactgataaggacattgtgttctacaagacattaaagccctggcttggggacgggcttctgttaagtgtcggggataaatggaggcatcatcgacgcctgacccctgctttccacttcaatatcttaaagccctacatcaagatctttagcaaaagcgctaatataatgcacgctaagtggcaacggctggccatggaaggcagtacttgcctggacgtcttcgagcatattagtctgatgaccttggacagccttcaaaagtgtattttttcttttgactcaaattgtcaagagaagccctcagaatacattacagcaattatggaactttcagccctggtagttaaacgtaacaaccagttttttcgctataaggatttcctgtatttcctcactccctgcggacgccgttttcaccgagcttgccgtctggtccacgacttcacagatgcggtgatccaagaacggcgccgtaccctgacctcacagggggtagatgacttcttgcaagcaaaggcaaagagtaaaacgttggacttcatcgacgtgctgttgttgagcgaggataaaaacggtaaggagctgagtgatgaagatataagagcagaggccgatacctttatgtttggcggccacgacactacggcatccgggctgagctgggtgctgtacaacctggccagacaccccgaataccaggagagatgccgacaggaagtgcaggagttgttaaaagacagagaacctaaggagatcgaatgggatgatctggcacagctccccttcctgaccatgtgcttgaaagaatctctgcgactgcatccccccatcccgacattcgcccgcggttgcacacaagatgttgtgctcccggactctcgcgtcatccccaagggaaatgtgtgcaacattaacattttcgccattcatcataacccctctgtgtggcccgatccagaggtgtacgacccttttcggttcgacccagagaacgcccagaagaggtctcccatggccttcattcccttctccgctggcccacgaaactgtattggccagaagttcgctatggccgaaatgaaggtcgttctcgcgttgaccttgttacggtttcggattctccccgaccaccgggagcctaggcgaacaccggagattgtgctcagagctgaggacggcctctggctgcgcgtggagccgctaggttag

SEQ ID NO: 184530 - DNA, 804 bp, Artificial Sequence
  Description of Artificial Sequence: Synthetic coding sequence
acccccgccttccacttcaacatcctgaagccctacatcaagatcttctccaaaagtgcgaacatcatgcatgcgaagtggcagaggctggcaatggagggctctacgtgcctagacgtctttgagcacatatctctgatgacactggacagcctccaaaagtgtattttttctttcgattctaactgccaggagaaaccaagtgagtacattaccgcaatcatggagctgagcgcactggtcgtcaaacgcaacaatcaattctttcgatataaggatttcctctatttcttaactccttgcggtcgaaggtttcacagagcgtgtagactagtacacgatttcacagatgcagtgattcaggagcgccgaagaaccttaacaagccaaggagtcgatgatttcttacaagcaaaggcaaagagcaaaacacttgacttcattgatgtgctactgctgtccgaagacaaaaatggaaaagaactgagtgacgaagacattcgagcggaggcagacacctttatgttcggcggacatgacaccaccgcgagcgggctgtcctgggtactctataatctagcacggcaccccgagtaccaggagagatgcaggcaagaggttcaggaactgttgaaggatcgagaacccaaagagatcgaatgggacgacctggcccagctgccgtttcttaccatgtgcctgaaggagagcttgcgcctccatccccccattccgactttcgccaggggctgtacccaggatgtcgtgctacccgacagtcgggtgatacctaagggcctctag

SEQ ID NO: 184531 - DNA, 1512 bp, Artificial Sequence
  Description of Artificial Sequence: Synthetic coding sequence
atggccggcctgtggctgggcctggtgtggcagaagctgctgctgtggggcgcagcttccgcactcagcctggcaggagcctcgctcgtattatcattgctgcagcgagtggccagttatgctctactgatgaagcctgatgggagggagttcttccaacaaatcattgaatacactgaggagtaccgccatatgcctctgctcaaattgtgggtggggcccgttcccatggtggctctgtacaacgccgaaaatgtggaggttatcctgacatcatccaagcagatcgataaatcctcaatgtataaatttcttgaaccctggctgggtttaggcctgcttacctccacaggaaacaagtggcggtcgcgcaggaagatgttaacccccacatttcacttcactattctcgaggacttcctagatattatgaacgagcaggctaatatcctggtaaaaaagctggaaaagcatattaatcaggaggcattcaattgttttttttatatcacactgtgtgctctggatattatctgcgagaccgccatgggcaagaacattggagcccagagcaatgatgacagtgaatacgtgagggcggtctaccggatgtctgagatgatttttcggcgcattaaaatgccatggttatggctggacctgtggtatctcatgttcaaggaagggtgggaacataagaaatctctccaaattctgcacacatttactaattcagtcatcgctgagagggcaaatgagatgaatgccaacgaggattgtcgcggcgatggccgtggatcagcaccaagtaagaacaagcggcgggcgttcctcgacttgctgctgagtgttacagacgacgagggaaatagactctcccacgaggatatcagagaggaagtggatacctttatgtttgagggccacgacaccacagccgccgctatcaattggtccctttacctgttaggttctaatcccgaagtgcaaaagaaggtcgatcacgagctggacgatgtgttcggtaaatctgatcgaccagccaccgtcgaagacctcaagaagctcagatacctggagtgcgtgatcaaagaaacacttaggctgttcccttcagttccattgttcgctcggagcgtgtctgaggactgcgaggtggcgggataccgcgttttgaaaggaactgaagccgtgatcatcccttatgcgttacacagagatccacgctactttcctaacccagaagagttccagccagaaagattcttccccgaaaatgcacaagggcgccatccttatgcatatgtgccattctcagccggcccccgaaattgtatcggccagaaatttgctgtgatggaggagaaaacgattctttcttgcattctgcgccacttttggattgagtccaatcagaaacgcgaggagttagggctggaggggcagcttatcctgcgtccttcgaatggcatctggataaaactgaagcggcgcaatgccgacgagcgatag

SEQ ID NO: 184532 - DNA, 1578 bp, Artificial Sequence
  Description of Artificial Sequence: Synthetic coding sequence
atggccggcctgtggctgggcctggtgtggcagaagctgctgctgtggggagccgctagtgccctgtcactagctggggcttccttggttctgagcttgcttcagagagtcgcttcatatgcgaggaagtggcagcagatgagaccgatacctaccgtggcaagagcttacccgttggtaggccatgccttactcatgaaaccagacggcagagaattctttcagcagattatcgaatacacggaagaataccggcatatgcctctactgaaactgtgggtgggcccagtgcccatggtggcactgtacaatgcagagaatgttgaggtgatactgacgagtagtaagcagatagacaagagctctatgtataaatttcttgaaccttggcttggactgggcttgctgacatccaccggaaataagtggcggtcaaggcgaaaaatgctgacccccacttttcacttcaccatactggaggacttcctcgacatcatgaacgagcaggccaatattctcgtcaaaaagctagagaaacatatcaaccaggaagcatttaactgttttttttatattactctgtgcgctctggacattatctgcgagactgctatgggcaaaaatattggagcacagagtaatgatgacagtgaatacgtcagagccgtgtatcgaatgtccgaaatgatcttccggcggattaaaatgccgtggttgtggctagacctgtggtatctaatgttcaaggagggctgggaacataaaaaatccctgcagatactgcataccttcactaatagcgtcatagctgagagagccaatgaaatgaacgctaacgaagactgtcgcggcgacggtcgcggaagcgctcccagcaaaaataagcgtcgcgcattcttggatctgctcctgtctgtgaccgacgacgaggggaataggctatcccatgaagacatcagggaagaagtggacacttttatgtttgaggggcatgatacaaccgctgccgcaattaattggagcctgtacctcttgggttccaatccagaggtgcagaagaaagtcgaccatgaactggatgatgtattcggcaagtctgatcgacccgccaccgtggaagatctgaagaaattgcgctacctggagtgcgtgattaaggaaacgttaaggctgttcccgagcgtgcccctgttcgcacgctccgtgagcgaggattgtgaggtcgctgggtatcgggtcttgaaggggactgaggctgtgatcatcccctacgctttgcacagagaccctcgctacttcccaaatcctgaagagtttcaaccggagcgattcttccctgagaatgcacagggacgccatccctatgcctatgttcctttcagcgccggccccagaaactgtatcggtcagaagtttgccgtcatggaagaaaaaacaatcttgagctgtatactgagacatttttggatcgaaagtaaccaaaagagagaagaactcggattggaagggcagctcatcctgagaccctcaaatggaatttggatcaagttaaaacgccgcaatgcagatgagcggtag

SEQ ID NO: 184533 - DNA, 1503 bp, Artificial Sequence
  Description of Artificial Sequence: Synthetic coding sequence
atgagccccggcctgctgctgctgggcagcgccgtgctgctggccttcggcctgtgctgtacctttgtgcaccgcgccaggtctaggtatgaacatatcccagggccgccgagaccgtcctttctgctagggcacctcccctgtttctggaagaaggacgaggtgggggggagggttcttcaggacgtgtttctggattgggccaaaaagtatggaccggttgtcagggttaacgtctttcataaaacatccgtgatcgtgacatcacccgagtccgttaagaagtttttgatgagtaccaaatataacaaggattccaaaatgtacagagcactccagactgtgttcggagagaggctatttggccagggtctcgtgagtgaatgtaattacgagaggtggcacaaacagcggagagtgattgacctagcttttagtaggtcctctctggtgtccctgatggagacctttaatgagaaggccgaacagttggtggaaattctggaggccaaagctgacgggcagacccccgtaagcatgcaggatatgctgacgtataccgcaatggatatcttagcaaaagctgccttcgggatggagacttccatgcttctaggggctcagaagccactttcgcaggctgtgaagctgatgcttgaggggatcacagcctcacgtaacaccctggctaagttcttgcctggcaaacgcaagcagttaagagaagtaagggaaagtatcaggttcttaagacaagttggcagagattgggtccaaaggcggagagaggccctgaagcgtggggaggaggtgcctgccgatatactcactcaaattctcaaggctgaagagggagcccaagacgacgaagggctcctagataattttgtaactttctttatagccggtcacgaaacctcggccaaccaccttgcatttaccgtgatggaactgtctaggcagcctgaaatcgtggcaagattgcaagctgaagtggatgaggtgattggcagtaagaggtacctcgatttcgaagacttggggcgtcttcaatacctgtctcaagtactgaaagaaagcctaagattatacccacctgcttggggtaccttcagactcctcgaggaggagactctcatcgacggagtgcgtgtcccggggaataccccactcctcttctccacctacgtaatgggccgaatggatacgtactttgaggatcctctgacctttaacccggataggttcggcccgggggcaccaaaaccgcggttcacatactttcccttttccctcggccaccgctcctgtatcggacagcagttcgcccagatggaagtaaaagtagtgatggccaaactgttacaaaggttagagtttcgcctcgtccctggccagcggttcggtttgcaggaacaagcgacactaaagcctctggaccctgtgctttgcactttgaggcctaggggctggcagccagcaccacctccccctccttgttag

SEQ ID NO: 184534 - DNA, 1212 bp, Artificial Sequence
  Description of Artificial Sequence: Synthetic coding sequence
atgagcaccaagtacaacaaggacagcaagatgtaccgggccctgcagacagtattcggagaacgcttattcggccagggccttgtttcagaatgtaactatgaacgctggcacaagcagaggcgggtcatcgatcttgctttcagtagaagctccctcgtcagccttatggagaccttcaatgaaaaggcggaacagctagttgaaatcctggaggcgaaggccgatggccaaactccagtgtctatgcaggacatgctaacatataccgccatggacatattggcaaaagccgcctttgggatggagacctcgatgctgctgggcgcccagaaacctctgtcccaagccgtcaaactcatgcttgagggaataacggccagccgcaacaccctggcgaagtttctcccaggaaaacgtaagcagctgcgtgaggtgagggaaagcatccgatttttgcgacaagttgggagagattgggtgcagaggagaagggaagcactgaagcggggcgaagaggtgccagccgacatactgactcagatccttaaagccgaggaaggagctcaggatgacgaggggcttctggataatttcgtcacattttttatcgcgggacacgagacttctgccaatcatctggctttcaccgtcatggagctcagcagacagcccgagatcgtggcccggcttcaggcagaagtcgatgaggtgatcggctctaagagatacctggatttcgaggacttaggccggttgcagtacctgtctcaggtccttaaagaaagtcttaggctatacccccccgcctgggggaccttccggttattagaggaggaaaccctgattgacggcgtcagggtgccaggtaataccccactgcttttctccacttatgtgatgggcagaatggatacatatttcgaggatcccctcacctttaaccctgaccgcttcgggccaggggcacccaaaccacggttcacctattttccattttccctgggacaccggagttgcatagggcagcagtttgctcaaatggaggtgaaagttgtaatggcaaagctgctgcagcgtctggaattcagactggtccccgggcagaggttcggcctgcaagaacaggccactctgaagccactggatccagtcctgtgtacactccggccccgaggctggcagccagcccctcccccgccaccatgctag

SEQ ID NO: 184535 - DNA, 1530 bp, Artificial Sequence
  Description of Artificial Sequence: Synthetic coding sequence
atggccgccgccgccggcatgctgctgctgggcctgctgcaggccggtggatcagttctgggccaggccatggagaaggtcacaggaggcaatctgttaagcatgttactgatcgcctgcgcatttacactgtccctggtataccttattcggctggctgctggtcacttggttcagcttcccgcaggcgtgaagagccctccttacatcttctctcctatcccgtttctggggcacgcaattgccttcggcaaaagtcctatcgaatttctcgagaacgcttacgagaagtatggtcccgtcttcagctttactatggtgggaaaaacttttacctatctgcttggcagcgatgccgccgctctcctgtttaattctaaaaatgaagatctcaacgccgaagatgtttatagtcgattaacaaccccagtttttggaaagggcgtcgcttacgatgtccctaatcctgtgtttctggaacagaaaaaaatgttgaagtctggcctcaatattgcccattttaagcaacacgtgtctattatcgagaaggaaactaaagaatactttgagtcctggggggaaagcggagagaaaaatgtctttgaagcgcttagcgagctaatcattttgacagcctctcactgcctccatgggaaggagattcgctctcaattaaacgagaaagtggcccaactttatgctgacctggacggggggttctcacacgccgcttggctgttacctggatggttacctctgccaagcttcagacgccgcgatcgggcccacagggaaatcaaggacatattttataaggccatccagaagcgacggcagtcccaggagaaaattgatgacatactccagactctgctggatgctacttataaggacggccgcccgctgacagacgatgaggtggcaggcatgttaattggactgttgctggccgggcagcacaccagcagcacaacttctgcctggatggggttctttctggctcgagataagaccctccagaaaaagtgctacctcgagcagaaaacagtttgcggggagaaccttccccccctcacctatgaccagctaaaagacctcaatctgctcgacaggtgcataaaggaaaccctccgcctgcggccacccattatgattatgatgagaatggctaggactccacagactgtcgcaggctatacaataccccctgggcatcaggtatgcgtgtctccgaccgtgaaccaacgcctgaaagactcgtgggtcgagcgtctggacttcaatcctgaccgctatctgcaagataaccccgcctccggtgagaagtttgcctacgtcccatttggcgcaggccggcatcgttgtattggggaaaattttgcctacgtgcaaatcaaaacaatttggtcaacaatgttgcgactgtacgagtttgacttgatagacggatatttccccactgttaattataccacgatgatccatactcctgaaaacccagtcatccgctacaagcgacgctcaaagtag

SEQ ID NO: 184536 - DNA, 1215 bp, Artificial Sequence
  Description of Artificial Sequence: Synthetic coding sequence
atggtgggcaagaccttcacctacctgctgggcagcgacgccgccgcactgctgttcaattctaagaatgaggatctgaatgccgaagatgtgtattccagactgactacacccgtgtttggcaaaggggttgcatacgacgtgcctaacccagtattcctggaacaaaagaagatgctgaagtcgggcctgaatatcgcacatttcaagcagcacgtgtctattatcgaaaaagagacaaaggagtatttcgagtcatggggtgagtctggcgagaaaaacgtctttgaggcactctcggaactgatcattctgaccgctagtcactgtcttcacgggaaggaaatccgttcacagttgaatgaaaaagttgcacaattgtacgcagatctcgacggtggtttcagtcacgctgcttggctgctgcccggctggctcccactcccaagctttcgccgccgggatagagcccaccgagaaattaaagatattttttataaagctatccagaagcgcaggcagtcgcaagagaagatcgacgacattctgcaaacccttcttgacgctacctacaaggacggtaggccccttactgacgacgaggtagccggaatgctgataggtctcttgctggccggccaacacaccagctcgacaaccagtgcttggatgggattctttctggccagagataaaaccctccagaaaaagtgctatctggagcagaagacagtatgcggtgagaatctgccccccttgacttacgatcaactgaaggatttgaatctccttgatagatgtatcaaggagacgctgaggttgcgaccaccaataatgattatgatgaggatggctcgcacccctcagacagtggccgggtacactattccaccaggtcatcaagtgtgcgtctctccaactgtcaatcagcgcctgaaggattcttgggtggagcgcctggatttcaaccccgacagatacctacaagacaaccctgccagcggcgaaaaattcgcgtacgttcctttcggagccggcaggcacaggtgtatcggcgaaaatttcgcttacgtccagattaagactatttggtccacaatgctgcgtttgtacgagttcgatttgatagatggctacttccctacggtgaactataccacaatgatacacaccccagaaaatcccgtgattaggtacaaacgcaggtctaagtag

SEQ ID NO: 184537 - DNA, 1350 bp, Artificial Sequence
  Description of Artificial Sequence: Synthetic coding sequence
atgaagcacgagaagagccccccctacatcttcagccccatccccttcctcggccatgctattgccttcgggaaaagccccatagaatttttggaaaacgcatatgaaaagtacggaccggttttttcgtttactatggtcggcaagacctttacatacctattgggtagcgacgctgctgctctgttgttcaattctaagaatgaggatctaaatgctgaggatgtctacagtagactcaccacccctgtgtttggaaagggtgtagcctacgacgtcccaaatccagtattcttggagcagaaaaagatgctgaaatcaggtcttaatatcgcacactttaaacagcatgtgtccattatcgaaaaagaaaccaaggagtattttgagtcttggggagagagcggcgagaagaatgtatttgaggcgctgtctgagctgataattctgaccgcatctcattgtctccatggcaaagagattcggtcccagctgaacgaaaaggtcgcccagctatatgccgacctggacgggggcttctctcatgcagcatggctccttcctgggtggttgccattgcccagctttaggagaagggaccgggcccatagagagattaaagatatattctataaggcaatccagaaaagaaggcagagccaggaaaaaatcgacgacattctgcaaacacttctcgatgccacctataaagatgggagacccctgaccgatgatgaggtagccgggatgctcatcggactgctcttggctggacagcatacgtctagcacaacttcggcgtggatggggttctttctggctagagacaagactttgcagaaaaaatgttacctggagcagaagaccgtctgcggtgagaacctcccgcccctcacttatgatcagctaaaagacttgaacctgctggatagatgcataaaagaaacgctcagactgaggccacctattatgatcatgatgaggatggcgcggacccctcagactgttgcaggttatactattccaccaggacaccaggtgtgcgtctctccaaccgtgaaccagagacttaaagatagttgggtggaaaggcttgacttcaatccagacaggtatctgcaggacaaccctgcctctggcgagaagttcgcctatgttccttttggcgccgggcgtcaccgctgcatcggagagaacttcgcttacgtgcagataaagactatttggtctactatgctgaggttatacgagtttgacctaattgatgggtatttccccaccgtcaactataccacaatgattcatacccctgaaaaccctgtcattaggtataagagaaggagtaaatag

SEQ ID NO: 184538 - DNA, 1515 bp, Artificial Sequence
  Description of Artificial Sequence: Synthetic coding sequence
atgatgaccaccagcctgatctggggcatcgccatcgccgcctgctgttgcttgtggttaatccttggcattcggcgccgccagactggcgagcctcccctggagaatgggcttattccgtatttgggttgtgccctgcagttcggtgctaaccctctcgagtttctgagggcgaaccagagaaagcatggccatgtttttacatgcaagctgatggggaagtacgttcacttcattaccaatcccctgagttaccacaaagttttgtgtcatgggaagtatttcgattggaagaaatttcattttgccacttctgcaaaagcattcggccatcgcagcattgaccctatggacgggaatacgaccgagaacatcaatgatactttcataaagaccctacagggccacgctctgaactccttaacagagagcatgatggaaaaccttcagcgcataatgcggccccctgtgtcgtctaacagcaaaaccgccgcatgggtgacggagggtatgtacagcttttgctatcgcgtaatgttcgaagccggctatctcactatctttggcagagacctgacacggcgtgatacgcaaaaggcacacatactgaacaatctggacaatttcaaacagttcgacaaagtgtttcctgctctggtagctggcctgcccatccacatgtttcggacagcccataacgcgagagaaaaactggcagaaagcctgcgccacgagaatcttcagaagagggagtcgattagcgaacttatcagccttagaatgttccttaacgatactctcagcacctttgatgacctcgaaaaggccaaaacgcatctggtagttttgtgggcttctcaggcaaatactatccccgccacgttctggtcccttttccagatgatcagaaatcctgaggccatgaaggctgccactgaagaggtgaagagaactcttgaaaatgcaggccagaaagtgagcctggaagggaaccctatttgcctgtcccaggccgaactgaacgatctgcctgttctcgattccatcattaaagaatcgctgaggttgtcctcagccagcctcaacatacgcacagccaaagaggactttacattacacttagaagacggctcatataacatccgcaaggacgatatcatcgccctttacccacaacttatgcacctagatcctgaaatctaccccgatcctcttactttcaaatacgataggtacctcgatgagaacgggaaaacaaagacaaccttctactgtaacggtcttaagctgaagtattactatatgccgttcggaagtggcgccacaatttgtccgggccggttatttgctatccatgagatcaaacagttccttatcttaatgttgtcatacttcgaactcgaattaattgagggacaagctaagtgtcctccgctggaccaatcccgggctggactaggcatcctgcccccactgaatgacatcgagttcaagtacaaatttaagcatttatag

SEQ ID NO: 184539 - DNA, 1521 bp, Artificial Sequence
  Description of Artificial Sequence: Synthetic coding sequence
atggccggcgaggtgagcgccgccaccggccggttcagcctggagcgtctcggattgccagggcttgctctcgccgcagcccttctgctgctggcattatgtctcctggtacgcaggaccaggagacccggagagcccccactgattaaggggtggctaccctatttgggcgtggttctcaacttgcgcaaagatcctctacgttttatgaagactctgcaaaagcagcacggcgacaccttcacagttctcctcggtggtaagtacattaccttcattctcgaccctttccagtatcagctagttatcaaaaatcataagcagctgagtttccgcgtcttcagtaataagctcctggagaaagctttttcaatttctcaactgcagaagaaccatgacatgaacgacgagttgcatctgtgctatcagtttttgcaggggaagtccctggatatattactggagtccatgatgcagaatttgaagcaagtgtttgagccccagctgctcaaaactacgagttgggatacagcagagctatatccgttctgctcgagtataatcttcgagataacttttaccacaatctacggaaaagtcatcgtttgtgataataacaagtttataagtgagttacgggatgattttctgaaatttgacgacaaattcgcgtatctggtgtccaacattcccatagagctgttgggaaacgtgaagtcgattcgcgagaagataattaagtgcttttccagcgagaagcttgccaagatgcagggctggtccgaagtgtttcaaagtcgccaggacgtgctcgagaagtactatgtgcacgaggacctcgagattggcgctcatcatctcggctttttatgggcttctgtcgcgaatacgatccctactatgttctgggccatgtattacctgcttaggcatccagaagctatggcggctgtgcgggatgagatagataggttgctgcagtctacaggccaaaagaaagggtctggtttccccattcacctgaccagggagcagttggactctttgatatgtctggagtccagcattttcgaagcactcaggctgtctagctattccacaacaattcggtttgtggaagaggatctaactctgagttctgagactggggattattgcgtgcggaagggggacctggtcgccatcttcccaccggtcctgcacggagaccctgagatcttcgaggctcctgaggagttcagatacgatcgttttatagaggatggcaaaaagaagacaaccttctttaaaagaggaaagaagctgaaatgctatcttatgccgtttggcactggcacatccaaatgtcctgggcgattctttgccctaatggaaattaaacagctgctggtcattcttttgacatacttcgatttggaaatcatcgacgacaaacctattggcctgaactattcacgtttgctattcggtatccaatacccagattccgacgtgctctttcggtacaaagtcaaatcatag

SEQ ID NO: 184540 - DNA, 1506 bp, Artificial Sequence
  Description of Artificial Sequence: Synthetic coding sequence
atggtgctgtggggccccgtgctgggcgccctgctggtggtgatcgcaggctatttatgcctacccggtatgctgaggcagcggcggccttgggagcctccgttagataaaggaacagtgccctggctaggccacgcgatggcatttagaaaaaacatgttcgaattccttaaaagaatgcgtaccaaacatggcgatgtcttcaccgtgcaactgggaggacagtatttcacgtttgtaatggatcctctgagtttcggcagcatcttaaaagacacacagcggaaactagacttcggccagtacgcaaaaaaacttgtcctaaaagtattcgggtaccgatcagtgcaaggggaccatgaaatgatacatagtgcctctactaaacatttgcggggcgacggcttaaaagacctcaacgagacaatgctagactctttatcgttcgtgatgcttacatccaaagggtggagtctcgacgcctcctgttggcacgaggatagccttttccgtttttgctattatatactgttcaccgccggctatttaagtcttttcggttacaccaaggataaggagcaggacttattacaagccggcgaactctttatggagtttagaaaatttgacctgctgttccccagattcgtttactctctactgtggcctcgcgagtggctcgaagtcggcaggctgcagagattattccacaaaatgttgtctgtctcacatagtcaggagaaggaaggaatctcgaactggctggggaatatgctgcaatttctgcgggagcagggcgtaccgtctgccatgcaggacaagttcaactttatgatgctgtgggcaagccagggaaacacggggcctaccagcttttgggctcttctgtatctactgaagcaccctgaagccatcagggccgtgcgggaagaggcaacacaggtgcttggagaagctcgcctagagactaaacaaagttttgcctttaagctgggtgcattacagcacactcctgttctggacagtgtggtagaggaaactctgcgcctgagagccgcccccaccctgttaaggcttgtgcatgaggactacaccctgaaaatgtcctctggacaagagtacctgtttaggcatggcgacattctggccttattcccatatctgagcgtgcacatggatcccgatatccacccggaacctactgtttttaaatatgaccgttttttgaatccaaacggtagcagaaaagtcgacttctttaaaacaggcaaaaaaatccatcactacaccatgccttggggatctggagtgagcatttgtcccggtagatttttcgctctgtccgaagtcaaactgttcatcctcttgatggtcacccactttgatctcgagctagtcgaccccgatacacctctgccccacgtcgaccctcaacgctggggtttcggaaccatgcaaccctcccatgatgttcgctttaggtataggttacatcccacagagtag

SEQ ID NO: 184541 - DNA, 573 bp, Artificial Sequence
  Description of Artificial Sequence: Synthetic coding sequence
atggagaaggtgcccggcgagatggagatcgagcggcgggagcggagcgaagagctgagtgaagcagaacgtaaggccgtgcaggccatgtgggccagactctatgccaactgcgaagacgtaggagtggccattctcgtgaggtttttcgtgaattttccctctgctaaacagtacttttcccagttcaaacacatggaggatcccctggaaatggagcggagtccacaacttaggaagcacgcatgtcgcgtaatgggggcactgaatactgtggtggaaaatttgcacgaccccgacaaagtgtcatcggtactggctctggtcggaaaggcccatgcccttaaacacaaggtcgaaccagtgtactttaagatcctcagcggagtcatattggaggtggtagcagaggaatttgcctccgattttccccctgagacgcagcgggcctgggcaaagctaagaggcctgatctatagtcatgtaaccgcggcatataaagaggtgggatgggttcagcaggttccaaatgctaccacgcctcccgccaccttgcccagctccgggccctag

SEQ ID NO: 184542 - DNA, 1194 bp, Artificial Sequence
  Description of Artificial Sequence: Synthetic coding sequence
atggaggaggacgacagctacgtgcccagcgacctgaccgccgaggaaaggcaggaactggagaatattcgccgcaggaagcaagagctgctcgctgacattcaacggctcaaggacgagattgcagaagtggcgaacgagatcgagaatctgggtagcacagaagagcggaagaacatgcagaggaataagcaggttgcaatgggtagaaagaaattcaatatggatcccaagaaaggaatacagttcctaatcgaaaacgacctgctgaagaacacctgcgaggacatcgcccagttcctgtacaagggagagggactgaacaagaccgcaattggtgactacctcggtgagagagacgaatttaacattcaggtgctccacgcttttgtggagctccatgagtttaccgacctgaacctggtgcaggccctgagacagtttctctggtcttttagattaccaggggaagctcagaagatcgaccgcatgatggaggccttcgcacagaggtactgccaatgcaacaacggtgtgtttcaatctactgacacttgctacgtgcttagtttcgccatcatcatgctaaacacttccttgcacaaccccaacgttaaggacaaaccaacagttgagcggtttattgctatgaaccgcggaatcaacgacgggggcgatttacctgaggaattgctgcgtaacctgtatgaatcaattaaaaacgagcctttcaagataccggaggatgatggtaacgaccttacccatactttctttaatcctgatcgggaaggttggctgcttaagctgggcgggcgagtgaagacctggaaacggcgctggtttatccttaccgacaactgcttgtattacttcgagtacaccactgacaaggagcccagaggcatcataccccttgagaacctaagtatcagggaggtagaagattcaaaaaagcctaattgttttgaactgtacattccagataacaaggaccaagtgattaaggcttgtaagactgaggcagatggccgggtggtcgaggggaaccacactgtgtatcgaattagtgcccccacccctgaagaaaaagaggagtggatcaagtgcattaaagcggccatctcacgcgatcctttctacgaaatgctggccgcaagaaaaaaaaaagtttccagcacaaagcgccactag

SEQ ID NO: 184543 - DNA, 1197 bp, Artificial Sequence
  Description of Artificial Sequence: Synthetic coding sequence
atggaggaggacgacagctacgtgcccagcgacctgaccgccgaggagcgccaggaattagagaatattaggcggagaaagcaagagctgctcgcggatatacagcgattgaaagacgagatagccgaggtagctaacgaaatcgagaatcttgggtctacagaagaacgcaaaaacatgcagagaaataagcaggtggccatggggaggaaaaagttcaacatggatccaaagaagggtatccagtttctgatcgaaaatgacctcctgaaaaatacatgtgaagacattgcccagtttttgtacaagggcgaggggctgaataaaacagcaatcggtgattatctcggggagagggatgagtttaacatccaggtcttgcatgcctttgtggagcttcatgaattcaccgatttgaacttagtgcaggccctccggcaatttttgtggtcctttaggctccctggagaagcacagaaaatcgatcggatgatggaggcctttgcccaacgctactgccagtgtaataacggagtgtttcagtccaccgacacatgctacgttttgagctttgccatcatcatgctgaacacaagtcttcataaccccaatgtgaaggacaagcctactgtggagagattcattgctatgaacaggggcatcaatgacggcggggacctcccagaagaactgctgcgtaatctgtacgaatctattaaaaatgagcccttcaaaatcccagaggatgatggcaatgacctaacacacacttttttcaatccggaccgcgaaggatggcttcttaaactggggggcggcagggtgaaaacttggaaacgtcggtggtttatcttaacagataactgcttgtattattttgagtataccaccgacaaggagccccgggggatcatcccattggagaatctttctatccgcgaggtggaagattctaagaagccaaattgtttcgagctatacatccccgataataaggaccaggtcattaaagcgtgtaagaccgaagctgacgggagggtcgtggaggggaatcatacagtgtacaggatctccgcccctacccccgaggagaaagaagagtggatcaagtgcattaaagccgccatatctagagacccattctatgagatgctggcagctcggaagaagaaggttagctctaccaaacgacactag

SEQ ID NO: 184544 - DNA, 657 bp, Artificial Sequence
  Description of Artificial Sequence: Synthetic coding sequence
atgatggaggccttcgcccagcggtactgccagtgcaacaacggcgtatttcagtccactgacacatgttatgttctgagcttcgcaataataatgcttaacaccagcctacacaatcccaatgtaaaggacaagccaacggtcgagagattcatcgcaatgaatcgcggcattaatgatggcggggatctacctgaagagttgttgcggaacctttacgaaagcattaagaatgaaccgttcaagattccagaggatgatggaaatgatcttacacataccttcttcaatcccgatagagaggggtggttgctaaaactggccggaggccgcgtgaaaacctggaagcgccggtggtttattctgacggataattgtctttactacttcgagtacaccactgataaagaaccgcgcggtatcatacctttagaaaacctgagtatcagggaggtggaggactcaaagaagccgaactgcttcgagttatatatccctgataacaaggaccaggtgataaaagcatgtaagactgaagcagacggaagagtggtagaaggaaaccatactgtctatcggatctccgcacccactccagaggagaaggaggagtggataaagtgcatcaagttccaagtctcccccggggagccctag

SEQ ID NO: 184545 - DNA, 1197 bp, Artificial Sequence
  Description of Artificial Sequence: Synthetic coding sequence
atggaggaggacgacagctacgtgcccagcgacctgaccgccgaggagagacaggagctggagaacattcgccgacgtaaacaggagctcctggccgatattcaacgcttgaaggacgaaatcgcagaagtggccaatgagatcgaaaatctcggctctacagaagaaagaaagaatatgcaacggaataagcaggtagcaatgggcaggaaaaaattcaacatggacccgaaaaagggcattcagtttctgatcgagaatgatctgctgaagaacacttgcgaggacattgcccagttcctgtataagggagaagggctcaacaagactgcgattggggactacctgggtgaacgcgacgagtttaatattcaggtccttcatgcattcgtcgaactgcatgaattcacggatttaaaccttgtgcaagcacttcggcagtttctgtggtccttccgcttaccaggcgaggctcagaagatagacagaatgatggaggccttcgcacagcgctactgtcagtgcaataacggggtgtttcaatctaccgatacatgttatgtgttatcttttgctatcatcatgctgaatacctccctgcacaaccctaacgttaaagacaaacctaccgtggagcgatttatagccatgaaccgtggcatcaatgacgggggcgacctccccgaagagctgctgagaaatctgtatgagagcattaaaaatgaacccttcaagatccccgaggacgacgggaatgatctgacgcacaccttttttaaccccgatagagagggttggctgctcaagctcgggggcgggcgggtcaaaacttggaagcgaagatggttcatccttactgataactgtctgtactattttgagtataccaccgataaagaaccccggggaattatcccactggaaaatttgtccataagggaagtggaggattccaagaagcccaattgctttgagctctacatcccagataataaagaccaagtcatcaaggcttgcaaaaccgaggcagatgggagagtcgtagaggggaaccatacggtgtaccgcattagtgcgcccacccccgaagaaaaggaagagtggatcaagtgcattaaggccgccatcagcagggaccccttttatgagatgttggctgctagaaagaagaaggtcagctcaactaaacggcattag

SEQ ID NO: 184546 - DNA, 1020 bp, Artificial Sequence
  Description of Artificial Sequence: Synthetic coding sequence
atgcagcggaacaagcaggtggccatgggccggaagaagttcaacatggacccaaaaaaaggtatccagttcctgatcgaaaatgacctactgaagaacacgtgtgaagatatcgcccaattcctgtacaaaggcgaaggactgaacaagacagccatcggggactatctgggtgagcgggacgagttcaacatacaagtccttcatgctttcgtggagttacatgagttcactgatctcaatctcgttcaggctctgaggcagtttctctggagcttccggttgccaggcgaggcccagaaaattgaccggatgatggaagccttcgcacaacgctattgtcagtgcaataacggagtctttcagtccaccgacacatgttacgtgctctccttcgctatcattatgttgaacacctcactgcacaaccctaatgtgaaagataagcctactgtggagagattcatagcaatgaacaggggcattaacgacggcggcgatcttccggaagagcttttaaggaatctgtacgagagcataaaaaacgagcccttcaaaatacccgaggatgatggaaatgacttaacacacacattctttaaccctgatcgggaaggctggcttttgaagctgggaggcgggcgggtgaagacctggaaaaggagatggtttatcttgactgataattgtctctattactttgaatacacaaccgacaaggagcccagaggaattatcccactggaaaatctttccattcgagaagttgaggattccaaaaagccaaactgcttcgaattatatatcccagacaataaagatcaggtaattaaagcttgcaagaccgaagccgacgggagggtggtcgaagggaatcacaccgtttacagaatctccgccccgacccctgaagagaaagaagaatggattaaatgcattaaagcggctatttccagggaccctttctatgaaatgcttgccgcaaggaagaaaaaagtatccagcaccaaaaggcattag

SEQ ID NO: 184547 - DNA, 1020 bp, Artificial Sequence
  Description of Artificial Sequence: Synthetic coding sequence
atgcagcggaacaagcaggtggccatgggccggaagaagttcaacatggaccccaagaagggcatccagtttctcatcgaaaatgatctcctgaaaaatacttgcgaggacatcgcccaattcctctataaaggcgagggactgaataagaccgccattggtgattatctgggtgagagggatgagttcaatatccaggtcttacacgccttcgtcgaactgcatgagtttaccgatctgaatctcgtgcaggcacttagacagtttctctggtcctttcggctgcctggcgaggcccagaaaatcgataggatgatggaagcttttgcccagcggtattgccagtgtaataatggggtgttccagagcactgatacatgttacgtcctgtcatttgccattattatgttgaacaccagtctccacaaccccaacgtgaaagataagccaacagtggaaaggttcattgcaatgaacagaggaataaacgacggcggcgacttgcctgaggagctcctgcggaatctgtacgaaagcatcaagaatgagccatttaagatccctgaggacgacggaaacgacctgacacatacgttctttaatccagatagggaaggctggttgttaaaattaggtggaggccgcgttaaaacctggaagagacgatggttcatcttaactgataactgcctgtactatttcgagtataccactgacaaagagccccgcggcattattcccttagaaaatctatccatccgagaggtagaggatagcaaaaaacccaactgctttgaactgtatatccccgataacaaggatcaggtcatcaaagcctgcaagactgaagcagatgggcgcgtagtggaaggaaaccatacagtgtataggatatccgcccctacgcctgaagagaaggaggagtggatcaagtgcatcaaggccgccatatcgcgggatcccttttatgagatgcttgccgccaggaaaaagaaggtcagttcaaccaagaggcattag

SEQ ID NO: 184548 - DNA, 1080 bp, Artificial Sequence
  Description of Artificial Sequence: Synthetic coding sequence
atgagcctgcagcggctgctgcagcacagcagcaacggcaacctggcagatttttgcgcgggcccggcctattcatcatactccaccttaacaggatccctcacaatggacgacaatcggaggatccagatgttggccgatactgtggccacgttgcctaggggcagaaaacagttggcgctgacccggagctcttcactgagtgatttttcctggagtcagagaaagctcgtaaccgtcgagaaacaggataacgaaaccttcggtttcgaaatacagtcctatagaccgcagaatcagaatgcttgctcttcagagatgttcactcttatttgcaagattcaggaggactctccagctcactgcgcaggcttgcaggccggcgatgtgttggccaacataaatggagtgtccacagaaggttttacctacaaacaggtggtggatctcattcggtcttccggcaacctcctcaccattgagacactgaatgggacaatgatactcaaacggacggagctggaggccaagctgcaggtcttgaagcagactctgaagcagaagtgggtggaatatcggtcattgcagctgcaagagcaccggctgctccacggtgatgccgcaaattgcccttcactggaaaacatggaccttgatgaactgtcactgttcgggcctctgcctgggccaggacctgctctggttgatcgcaacagactgtccagtgagtctagctgtaaaagctggcttagcagtatgacaatggattcagaagatgggtatcagacctgcgtgtcggaagactcttcgcgcggcgcattttccaggcaaacttcaactgacgacgagtgctttatacccaaagaaggcgacgactttctcaggcgctcttcctctagaagaaacaggtctatctccaataccagtagtgggtcgatgtccccactgtgggagggaaatctcagttctatgttcgggaccctccctcgaaagagccgtaagggcagcgttcggaagcagctcttgaagtttatccctggcctgcacagagcggtggaagaagaggagtcccgcttttag

SEQ ID NO: 184549 - DNA, 762 bp, Artificial Sequence
  Description of Artificial Sequence: Synthetic coding sequence
atgttcaccctgatctgcaagatccaggaggacagccccgcccactgtgccgggctgcaggcaggggacgttctggctaacatcaacggagtaagtactgagggtttcacatacaagcaagttgtggacctgattaggtcaagcggcaatctcctaactattgaaaccctgaatggaacaatgatcctgaaaagaaccgagcttgaagccaaactacaggtcttaaagcagacactgaagcagaagtgggtcgaatatcgttctctacagttgcaggagcacaggctgctgcatggcgacgctgcaaactgtccgtccctcgagaacatggaccttgacgaactgtcacttttcgggccgctgccaggccccggacctgcccttgtggataggaataggttgtcctccgagagttcctgcaagtcatggctgtcatcaatgactatggattccgaggatgggtaccagacgtgtgtgagtgaggattcttcccgcggcgccttttctcggcagacctccaccgacgatgagtgtttcatccctaaagaaggtgatgacttcttacgccgctctagtagccgcagaaaccgctctattagcaatacttcctctggttccatgagccctctctgggaaggcaacttgtcctcaatgttcgggaccttacccaggaaatcacgcaagggaagcgtacgaaaacagttgctcaaatttatcccgggcctgcatagagccgtggaggaggaagaatctagattctag

SEQ ID NO: 184550 - DNA, 1203 bp, Artificial Sequence
  Description of Artificial Sequence: Synthetic coding sequence
atggaggacggcgtgtacgagccccccgacctgacccccgaggagagaatggagttggaaaatataagacggaggaagcaagaactcctggtggagatccagcggctgagagaagagctgagcgaggccatgtcggaagtggaggggctggaagccaatgagggctcaaaaactcttcagcggaataggaaaatggcgatggggcgaaagaagttcaacatggaccctaagaaaggcatacagttcctggtagagaacgagttacttcagaacactcctgaggagatcgccagattcctgtataaaggtgaaggccttaacaagacggccatcggggactacctgggcgaacgggaggaacttaaccttgcagtgcttcatgcattcgtcgatctgcacgagttcactgatctcaacttagtacaagctctgaggcagttcctttggtcattccgtctcccaggggaggctcaaaaaattgatcgcatgatggaagcgtttgcacagcggtactgtttgtgcaatcccggggtgtttcagagcaccgacacatgctacgtcctgagttttgcggttatcatgttgaacacaagcctccataatccaaacgtaagagacaagcccggcctggaacgcttcgtagccatgaacaggggtattaatgaagggggcgatcttcccgaagagctcctgcgtaacttgtatgactctatccggaacgagcccttcaaaattcccgaggacgacgggaatgaccttactcacactttttttaatcctgatcgggaaggctggttactgaagctggctggtggtcgtgtcaagacctggaaaagacggtggtttattctcaccgataactgcttatattattttgaatataccacggataaggagccccgtggtatcataccactcgagaacttgagcataagggaagtggacgacccacgcaagcctaactgttttgagttgtacatccctaacaataagggccaactaataaaagcctgtaaaacagaagccgacggccgcgtggtcgagggcaatcatatggtgtatagaatctccgcaccgacacaggaggagaaggacgaatggattaaatctatccaagccgccgtttcagtggatcctttctatgagatgttagccgcacggaaaaaaaggattagcgtcaagaaaaagcaagagcagccttag

SEQ ID NO: 184551 - DNA, 1200 bp, Artificial Sequence
  Description of Artificial Sequence: Synthetic coding sequence
atggaggacggcgtgtacgagccccccgacctgacccccgaggagaggatggagctcgagaatatccgcagaaggaaacaggaactgctggtcgagatccagcggctgcgggaggagttaagtgaggcaatgagcgaggttgaagggctcgaagcgaacgaaggtagtaaaacattacagagaaaccgaaagatggcaatgggtaggaagaagttcaacatggaccccaaaaagggaattcagttcctcgtggagaacgagctcctgcagaacacgcctgaagaaattgcacggttcttatataagggggagggcctaaacaagactgccatcggggattacctcggtgagagggaggagctgaatttggcagttctgcatgcttttgtggatctgcacgagtttacggatctgaaccttgtccaggcgttgcggcagtttctgtggagctttagacttcccggggaagctcagaaaatcgataggatgatggaggcattcgctcaacggtattgtttatgcaacccaggggttttccaaagcactgacacgtgctacgtattgtccttcgcggtgatcatgttgaacactagcctacacaacccgaatgtgagggataaaccaggactggaacgattcgtggcaatgaaccgcgggattaacgaaggcggagacctgcccgaagagttgctgaggaatctgtatgatagtatccggaatgagcctttcaagatccctgaggacgatggaaatgacctcacccacacttttttcaacccggaccgcgaggggtggctgttaaaactcggggggcgagtcaagacgtggaagaggcgctggttcatcctgaccgataactgcctgtattactttgagtataccacagacaaagaaccacgagggatcatccccctcgagaacctctccattcgagaagtggacgatccccgaaaaccaaactgcttcgaactgtacattcctaacaacaaagggcaactgatcaaagcatgcaaaaccgaggctgatggaagggtcgtcgaggggaatcatatggtctatagaataagcgcccctacccaggaagagaaagacgagtggattaaaagcatccaagccgcagtttcagtcgatccattctacgaaatgctggcagcaagaaagaagcgtatctcagtgaagaagaaacaggagcagccctag

SEQ ID NO: 184552 - DNA, 1200 bp, Artificial Sequence
  Description of Artificial Sequence: Synthetic coding sequence
atggacgaggacggcggcggcgagggcggcggcgtgcccgaggacctctctctggaagagcgcgaggaactgttggatattcgacggaggaagaaagaactgatcgatgacattgagcgattgaagtacgagatcgccgaggttatgacagaaattgataacttgacttccgtggaggagtctaagaccacccagcgtaataaacagatcgccatgggacgcaaaaaattcaacatggacccaaagaaagggatacagttccttattgagaatgaccttctgcagagttcacccgaagatgtggctcagttcctgtataagggcgagggattgaataagacggtgatcggcgactacttaggcgaacgagacgagtttaacattaaagtcctgcaggctttcgtggagctgcatgagttcgcagaccttaacttagtgcaagctctcaggcaattcttatggtcttttcgccttcctggtgaggcacagaaaattgataggatgatggaagccttcgcctcaagatattgtctctgcaatcccggtgttttccagagcacggatacatgttacgtactgagcttcgccattatcatgctgaatacttccctgcacaatcataatgtgcgtgacaaacctaccgctgaacgctttatagccatgaaccggggcatcaacgaggggggtgatctgcccgaggaactgctgcgaaatctttatgaaagcatcaaaaacgaaccatttaaaatcccggaggatgacgggaatgaccttacgcacactttctttaatcccgatagagaggggtggctcctgaagttagggggaagagtcaagacctggaaacgcagatggttcattcttacagataattgcttgtattacttcgagtataccactgacaaggagcctagggggataattcctctcgagaatttgtctattcgcgaggtggaagatccaagaaaacccaattgtttcgaactttataaccccagccataagggccaggtcatcaaagcttgtaagactgaggccgacggacgtgtggtcgaaggcaatcacgtcgtgtataggatcagtgccccgagccctgaggaaaaagaagagtggatgaaaagcattaaggcgagtatctcgcgggaccctttctatgatatgttggccaccagaaaacgcagaatagcaaataagaagtag

SEQ ID NO: 184553 - DNA, 945 bp, Artificial Sequence
  Description of Artificial Sequence: Synthetic coding sequence
atggccctgccccagctgcagaccgccatgctggccgccttcctgtgggaccccagggatgtcgtcctcacagcccagcccggagccgagcaatgcgccgagtcatctcagcatattcgcattctccagccccagtttagacttatccggctgaggttttggaagctctatattcagaggagggtccaggcctggcagtttctgtggtcattcagactcccgggcgaggcccagaagattgacagaatgatggaagcatttgcaagtcgatactgcctgtgcaacccaggagtatttcagtctaccgatacatgctacgttttaagcttcgccatcattatgttgaacacttctttgcacaatcacaatgtgcgggacaaacctacagccgagaggtttatcgcgatgaacagagggatcaatgaaggcggggaccttccagaggagctccttaggaatttgtacgagtctatcaagaacgaaccatttaagatccccgaggacgacggcaacgacctcacccacaccttttttaaccctgaccgcgaaggctggctgctcaaattgggcgggcgcgtgaagacttggaaaagacggtggtttatattgacggacaattgcctatattactttgaatatacaaccgacaaagagccccgcggtataatcccattggagaacctatcaatccgcgaggttgaagatccacgcaagccaaattgcttcgaactgtataatccttcccacaaaggtcaggtgattaaagcttgtaaaaccgaggctgatggacgggtggtggagggcaatcacgtagtatacagaatctcagccccatctcctgaagagaaggaagagtggatgaaatccattaaagcgagtatttctcgcgaccccttttatgatatgctcgcgaccaggaaaaggcggattgcgaacaagaaatag

SEQ ID NO: 184554 - DNA, 1185 bp, Artificial Sequence
  Description of Artificial Sequence: Synthetic coding sequence
atggacctgtgccaccccgagcccgccgagctgagcagcggcgagaccgaggaattacagcggatcaaatggcacagaaagcaattgttagaagacatccagaagctgaaggatgagatcgctgacgtgttcgcccagattgactgtttcgaaagcgctgaggagagtcgcatggctcagaaggaaaaagagctctgtatcgggcggaagaaattcaatatggatccagcaaagggtattcagtattttatagagcataagctccttacgccggatgtgcaggacattgcaagatttctctacaagggcgagggtcttaataagacagcaatcggtacttacctgggggaacgggatccaatcaacttgcaggtgctgcaggccttcgtggattgccatgaattcgcgaacctcaatctggttcaggcccttagacagttcctctggagcttccgccttccaggagaggctcagaagattgaccggatgatggaagcgttcgcgacacgctattgtctttgcaatcccggcgtgtttcaatccacagatacatgctacgtattaagttttagtataataatgttaaacacaagcctgcacaacccgaatgtgagggatcgccctccgttcgagaggtttgtctcaatgaatcgtggcatcaacaacggatctgatctcccggaagaccagctgagaaacctttttgattctataaagtcagaaccattttcaattcccgaggacgatgggaatgatctgacgcacacctttttcaatcctgacagagaaggctggctgttgaaactgggagggcgcgtcaaaacctggaagcgaagatggttcatcttgactgacaactgtctgtactattttgaattcaccacagacaaggagccaagggggattatacctctggagaatcttagcgtccagaaagtagacgatccgaaaaagccattctgcttggaattatacaatccgagttgcaggggacaaaagataaaagcctgtaaaaccgacggcgacggacgagtggtcgagggtaagcatgaatcctaccgcataagcgcaacaagcgctgaggaaagagatcagtggattgagtctatccgggccagtatcacccgcgtaccattttatgatctcgtgtccacacgcaaaaagaagatcgcctcaaagcaatag

SEQ ID NO: 184555 - DNA, 474 bp, Artificial Sequence
  Description of Artificial Sequence: Synthetic coding sequence
atggacctgtgccaccccgagcccgccgagctgagcagcggcgagacggaggaactccagaggatcaaatggcaccgtaaacaactccttgaggatatccaaaaattgaaggacgaaattgcggatgtgttcgcccaaattgactgtttcgaatcagccgaggaatcccggatggcccagaaggagaaagaactatgcatcgggcggaaaaagtttaacatggaccccgccaagggaattcagtatttcattgagcacaagttactcacccccgatgttcaggacatcgcgagattcctctacaagggcgaagggctaaataagacagctattggcacatacctcggtgagcgcgaccccatcaacctacaggttttgcaagccttcgtggactgtcacgaatttgcaaatttgaacttagtacaggctttgagatttcgggagggagcgtctgacctgggctttggcgggtag

SEQ ID NO: 184556 - DNA, 876 bp, Artificial Sequence
  Description of Artificial Sequence: Synthetic coding sequence
gaccggagcaccggccacctgttcccccggggcgtgggcatggacctttgccatcctgagcctgcagaactctcttcaggagagactgaagaattacagagaattaaatggcacaggaagcagctcctcgaagatattcagaagcttaaggatgagatagcagatgtgttcgcccagattgattgttttgaatcggccgaggaatctagaatggctcagaaggagaaggagctgtgcatcggtagaaaaaagttcaatatggacccggcaaaagggatccaatatttcattgagcataaactgctgactccagatgtgcaagacatcgctcgcttcctgtacaagggagaggggttgaacaaaaccgccattggcacttatctgggcgaacgagatcctattaacctgcaagtcctgcaggccttcgtggactgccacgagttcgccaacctgaatctagtgcaggccctccgccagtttctgtggtctttcaggctgcctggagaggctcagaaaattgacagaatgatggaagcatttgcaacccgctattgcctgtgtaaccccggggtttttcaaagcacggatacctgttacgtccttagcttcagtatcatcatgctgaacacatctctccataatccaaatgtgcgggaccgtccaccttttgagcggttcgtctctatgaatcgaggcataaacaacggctccgatttgccagaagatcagctgcgggtgacctgggagtgtagccaacggaggagtcgggaaaggactttccagaaggaagaggttgcgcgaaccgaggcatgccctgactgggaacgcagaggcgttcagtgtggaagggaacccctcagacagcaccaggagtag

SEQ ID NO: 184557 - DNA, 444 bp, Artificial Sequence
  Description of Artificial Sequence: Synthetic coding sequence
tgaacccacaccagcggcagcctgagcagccgggacagccaggccggggactccgcgtcgagagccggaggcagagtgaaaacatggaagcgaaggtggttcattctgacagataattgtctgtattacttcgaattcactaccgacaaggaacctagaggaatcattccccttgaaaatctgtctgttcagaaggtggatgatcccaaaaaacccttctgcctggagctctataaccctagctgcagaggacagaagattaaagcatgcaagactgacggtgacggtcgggtggtcgagggaaagcacgagtcataccgaatctctgctaccagcgcagaagagagagaccagtggatagagtccatcagggccagtattacacgcgtccccttttacgatctagtcagtacacgtaagaaaaagatcgcatccaagcagtag

SEQ ID NO: 184558 - DNA, 354 bp, Artificial Sequence
  Description of Artificial Sequence: Synthetic coding sequence
atggacctgtgccaccccgagcccgccgagctgagcagcggcgagacagaggaactgcaaagaatcaagtggcatagaaagcagctcctcgaggacattcagaagctgaaagatgaaatcgccgatgtgtttgcacagatcgattgcttcgagtctgccgaagaatcccggatggctcagaaagagaaagagctctgcattggaaggaaaaagtttaatatggaccctgctaagggcattcaatacttcatcgagcataagctactgaccccagacgttcaggatattgctcggtttctatacaaaggagagggactcaataaaaccgcaattggtacatatctgggagagtag

SEQ ID NO: 184559 - DNA, 777 bp, Artificial Sequence
  Description of Artificial Sequence: Synthetic coding sequence
atggtgctgtgcgtgcagggcccccggcccctgctggccgtggagagaaccggacaacgtcctctctgggcccccagcctcgagttgcccaaaccagtgatgcaaccactgccagcaggcgcctttttggaagaggtggccgaggggacccctgcccagacagagtccgaacctaaggtgcttgaccccgaagaggaccttttgtgtatcgccaagacgttctcctatttacgtgagagcggctggtattggggcagcattacagccagtgaggctagacagcacctgcagaagatgccagaaggtactttccttgtgcgagattccactcacccgtcctacttattcacactgtccgtcaaaaccacacggggaccaacaaatgtccgtattgagtacgctgactctagttttcgcctcgactctaactgcttatcccgtcctcgtattctcgctttccctgacgtcgtgtccctggtacaacattacgtggcttcatgtactgctgatacaagatccgactcccccgaccctgcgccaacccctgctctccccatgccaaaagaggacgcaccttccgatccagccctccctgccccgcctcccgctaccgcagtccacttgaagctggtgcagcctttcgtacgccgttcctccgcgcggtctctccagcacctgtgtagattggtaattaaccggttagtcgctgacgtcgattgtttgccactgcccaggcgtatggcagattacctgaggcagtaccctttccagctgtag

SEQ ID NO: 184560 - DNA, 828 bp, Artificial Sequence
  Description of Artificial Sequence: Synthetic coding sequence
atgtacctggagcacaccagccactgcccccaccacgacgacgacaccgctatggatacccccttgccacgccctcggcctctcctggctgtggaacggactgggcaaaggcctttatgggcccctagcctggagctgcctaagcctgtgatgcagccccttcctgccggggctttcctggaggaggtggcagagggcactcccgctcagactgaaagtgagcccaaggtcttggatcctgaagaagatctcctctgtattgccaaaacttttagctacttgagagagtctggatggtactgggggtccatcacagcgtctgaggcccgtcagcacttacagaagatgcctgaaggcactttcctggttcgcgattctacccacccgagctacctgtttacactcagtgtgaaaacaactaggggaccaacaaacgtgaggattgagtacgccgattcttcatttcgactggattcaaactgcctaagtcgtcctcgtatactcgccttccctgatgtcgtgtccctggttcagcactatgtcgctagctgtacagcggacacacgaagcgactccccagatcctgcacccacaccggcactgcccatgccaaaagaggatgctcccagcgaccccgccttgcccgcccccccacctgcgacagccgtccatttgaaattagtccagccttttgttcgccggtcaagtgcccgttctctgcagcatttgtgccgattggtgatcaataggttagttgcggatgtcgactgtctgcctcttcccagacggatggccgactacctgcgccaatacccgtttcagttgtag

SEQ ID NO: 184561 - DNA, 1269 bp, Artificial Sequence
  Description of Artificial Sequence: Synthetic coding sequence
atgcccgccggccggcggggccccgccgcccagagcgcccggcggccaccacctctcctgcctctactgctgttgctgtgtgtacttggggccccaagggcgggcagtggggcgcacaccgcagtcatatcaccacaagatccaacgttgctgattggcagctcactgttggcaacttgctctgtgcatggcgatccacctggcgctaccgccgaaggtctgtattggacattgaacggccggaggttaccacccgaactgtcacgggtgctgaacgcatccacgctcgcactagctctggcgaatctaaatgggtccagacagaggtctggcgacaaccttgtgtgtcacgcccgtgacgggtccatcttggccggcagctgcttgtacgttggactgccacctgaaaagcccgtgaacatcagttgctggtctaagaacatgaaggatttgacgtgtcggtggacaccaggggcccacggggaaacttttctacatactaattactcccttaagtataagctgaggtggtacggacaagataatacctgcgaggagtaccacaccgtgggcccacattcgtgccacattcctaaggatctggctctgtttacaccttacgagatctgggtagaggccaccaatcggctcggaagtgcaaggagcgatgtgctgacactggacatactggatgttgtgaccaccgatccgcccccagatgtgcatgtcagcagggtcggcgggctggaagatcagctttcagtcaggtgggtcagtcctccagccctcaaggattttttattccaggccaaataccagattcggtacagggtggaggactctgtggattggaaggtagtggacgacgtgtcaaatcaaacttcctgcagacttgccgggctgaagccgggcactgtttactttgttcaggttaggtgcaaccccttcgggatttacggctctaagaaagccggcatttggtctgaatggtctcatcccaccgcggccagtactcctagaagtgagcgaccaggacctgggggcggcgcatgtgaaccgcgcggcggagagccctcgagcggacccgtgcggcgtgaacttaaacagttcttagggtggcttaaaaagcatgcctactgttccaatctctcctttcggttgtacgaccaatggcgagcttggatgcagaaatcacacaaaaccagaaatcaagatgaaggaattctccccagtgggcgtaggggaacagcacgcggtcctgcgcgctag

SEQ ID NO: 184562 - DNA, 702 bp, Artificial Sequence
  Description of Artificial Sequence: Synthetic coding sequence
atgggccggctggtgctgctgtggggcgccgccgtgttcctgctggggggctggatggcactgggacagggcggggcggccgagggagttcagatacaaataatctatttcaatcttgagacagtccaggtgacctggaatgctagtaagtactcccgcaccaatctgaccttccactaccggttcaatggagatgaagcttatgatcagtgcaccaattatttgctgcaggagggtcatactagtgggtgccttctggatgctgagcagcgggacgatattttgtacttctctatccgaaatgggactcacccagtcttcacagcctccagatggatggtatactacctcaaaccaagttcccctaaacacgtgcgcttctcctggcaccaggacgcagttaccgtcacttgttccgacctctcatatggcgacctgctttacgaggtacagtaccgctctcctttcgacacagagtggcagacacagagcaggagcgttactcaagccggtgtgcaatggtgcgatctatgccttctccagccatcaccacctagatttaagaggttctcttgtttaagcctgccctcgtcatgggactaccgccatcctccaccccgcctcgccaacttctgcattatttccagagacggagtgtcaccttgttggccaggttggtcacgcacatgtgatctccgatag

SEQ ID NO: 184563 - DNA, 771 bp, Artificial Sequence
  Description of Artificial Sequence: Synthetic coding sequence
atgggccggctggtgctgctgtggggcgccgccgtgttcctgctgggaggctggatggcactggggcagggcggcgcagccgagggcgtccagattcagatcatctactttaatcttgaaaccgtacaagtgacctggaatgcatccaagtacagccggacaaacttaacttttcactatagatttaatggcgatgaggcctatgaccagtgtactaactacctcttgcaggaaggccatacgagcggctgtcttctggatgctgaacaacgcgacgatatcctgtactttagcattcgcaacggcacacatccagtattcaccgcaagccgatggatggtgtactatctgaaaccttcatctccaaagcatgtccgcttcagctggcatcaggatgctgtcactgtgacatgtagcgacctgagttacggagatctcctttatgaggttcagtaccgctcacctttcgataccgagtggcagagtaagcaagagaatacatgtaatgtcactattgagggactggacgctgagaagtgttacagcttctgggtcagagtgaaggcaatggaggatgtgtatggtcctgacacatacccctccgattggagcgaggttacctgttggcagagaggagagatccgggatgcttgtgccgagacgcccacaccacccaaacctaagctctccaagtttattttgatcagtagtctcgcaattttactgatggtgtccctcctcctgctgagcttatggaaactgtggcggtag

SEQ ID NO: 184564 - DNA, 768 bp, Artificial Sequence
  Description of Artificial Sequence: Synthetic coding sequence
atgggccggctggtgctgctgtggggcgccgccgtgttcctgctgggcggctggatggccttgggtcagggaggggccgctgaaggtgtgcaaatccaaattatctactttaacctggagaccgtgcaagtgacttggaacgcttcgaaatacagtagaacaaatttgacatttcactatcgcttcaatggagatgaggcctacgatcagtgcaccaactatttgctccaagaggggcacactagtggctgcctgctggatgctgaacaaagagatgacatcctgtatttctctatccgaaacggaactcacccggtattcactgcaagccgctggatggtttactatctcaagccctccagcccaaagcacgtccggttctcctggcaccaagacgccgtcactgtgacttgtagtgacctatcctatggcgacctgctttatgaggtgcaataccggtcgccttttgacacagaatggcagagtaaacaggaaaatacctgcaacgtgacaatcgagggactggatgccgagaaatgctattctttctgggtgcgggtgaaggctatggaggacgtatatggacctgacacctacccgagtgactggtccgaagtgacctgctggcaaaggggggaaatcagggacgcctgcgctgagacgcctacgcctccgaaacctaagctgagtaagtttatactgattagctctctggctatcctgctgatggtgtctctcctacttttgagcctctggaaactgtggtag

SEQ ID NO: 184565 - DNA, 411 bp, Artificial Sequence
  Description of Artificial Sequence: Synthetic coding sequence
atgcggacccccggccccctgcccgtgctgctgctgctgctggccggagcgccagccgcccggcctaccccccccacgtgctactcgcggatgcgcgcgcttagccaggagataacgcgggatttcaatttgttgcaggtatcagaaccctctgagccatgcgtgcgctacctccctcgcctctacctggacatccataactactgcgtgttggataagctgagggacttcgtagccagcccgccatgctggaaagttgcacaggttgacagcttgaaggataaggccaggaagctctatacaattatgaacagcttctgccgaagagacctggtgttccttctcgacgactgtaatgccctggaatacccgattcccgtgaccactgttcttcctgatcgccagaggtag

SEQ ID NO: 184566 - DNA, 3762 bp, Artificial Sequence
  Description of Artificial Sequence: Synthetic coding sequence
atggccgcccaggtgaccctggaggacgccctgagcaacgtggacttgctggaagagcttcccctgccggatcagcagccatgtatcgagccccctccaagttcattgctgtaccagcccaactttaatactaatttcgaagacagaaatgctttcgttacaggcatcgcaaggtatattgagcaggctactgttcattcctcgatgaacgaaatgttggaggagggccaggaatatgcggtcatgctatacacgtggaggtcttgttccagggccatccctcaggtgaagtgtaacgagcagcccaatcgcgtggagatttatgagaagacggtggaggtgttggaacccgaggtcaccaagctcatgaactttatgtattttcagagaaatgcgatcgagcgcttctgcggagaggtccgccgcctgtgccacgcagagagaagaaaggacttcgtttcagaagcttatctgattactctggggaagttcattaacatgttcgccgtgttggatgagctgaagaatatgaagtgttcagtgaagaatgaccatagtgcctataagagggctgcacagttcctaagaaaaatggctgatcctcagagcatacaggaatctcagaatcttagtatgttcttggctaaccataacaagatcacccagtctctgcagcagcagcttgaggtgatctctggttacgaggagctgcttgccgacattgtcaacctctgcgttgactactatgagaacagaatgtatctgaccccttctgagaaacatatgttgcttaaagtcatgggattcggactgtacttgatggatggttcagtgagtaacatatataagttagatgccaagaaaagaataaatttgagcaagattgataagtatttcaaacaactgcaggtcgtgcctctgtttggtgacatgcaaattgagttagccaggtacatcaagacatcagcccattacgaggagaacaagtccaggtggacttgtactagtagtgggtccagccctcaatataacatttgtgaacagatgattcagattagggaggaccatatgcgattcatttcggagctggcccgctactctaattctgaggtcgttaccggctccgggagacaggaagcccagaaaacagacgctgaatacagaaagttgttcgatctagcgctccagggtctccagctgctgagtcagtggagtgcacacgttatggaagtctactcctggaaactcgtacatcctaccgataagtacagcaataaagactgtcctgactcagcggaggagtacgagcgcgcgactaggtacaattacacctccgaagagaaatttgcgctagtcgaggtgatcgccatgataaagggtctgcaggtcttgatgggaaggatggaatctgtgtttaaccacgccatccgtcatacagtgtatgcagcgctgcaggacttttctcaggtcaccttgcgcgaaccccttcgccaggcgattaagaaaaaaaaaaatgtgattcagtctgtgctgcaggccatccgaaaaacggtgtgtgactgggagactggacatgagccttttaacgaccctgcattgcggggggaaaaggacccgaaaagcggcttcgatattaaggtccctagacgcgccgtcgggccttcatctactcagctctacatggtgaggactatgctggaaagtcttatcgccgataagtccgggagtaaaaagacgctacgatcatctcttgagggccccacaatccttgatattgagaagttccatagggagtcctttttctacactcacctcattaatttttcagaaaccttgcaacagtgctgcgatttgagtcagctctggtttagggaatttttcctcgaactcacaatgggtcgcagaattcagtttccgattgagatgagcatgccatggattctgacagatcatatcctggaaactaaggaggcgtctatgatggagtacgtgctgtacagtttggacctttataatgacagcgctcactatgctctaaccaggtttaacaagcagtttctgtacgatgagatcgaggcggaagttaatctgtgcttcgatcagttcgtgtacaaactggctgatcagatctttgcatactacaaggtcatggctggaagcctgctcctggataaaaggcttcggagtgagtgcaaaaatcagggagcaactatccatttaccaccctcgaataggtacgagaccctgctgaagcaaagacacgtgcaactgttaggcaggtcaattgatttgaacagacttataacgcagcgagtctcagctgctatgtacaagagtcttgaattggcaatcgggcggtttgagagcgaggatctgacaagtatcgttgagttggatggcttgctggagattaacagaatgactcacaaactgttatcaagatatctgactttagacggcttcgacgccatgttccgcgaagccaaccataacgtgagcgcaccatacggccgcataacgctgcatgtgttctgggaattaaactatgattttctgcccaattactgctataacggctctacaaaccgcttcgtccgcaccgtcctgccctttagtcaggagttccagagagataagcagccgaacgcgcagccacagtacctccacggaagcaaggctctgaatctggcctattcttcgatctacggctcataccgcaacttcgtcgggcccccgcacttccaggttatctgccggttactcgggtatcaggggatcgccgtggtgatggaggaattacttaaggtggtgaagtcactcctgcaggggacgatactgcagtacgttaagacactcatggaggtgatgccaaaaatctgtcgattgccacggcatgaatacggatccccaggaatcctagagttctttcatcaccaacttaaagacatcgtggaatatgcggagctgaaaacagtgtgttttcagaacctcagagaggtcggcaacgctattctcttctgcttgctaattgaacagtcactgtccctggaggaggtgtgcgatctactacacgccgctccctttcaaaacatactacctagggttcacgtcaaggaaggcgagcgcctagacgccaaaatgaagaggctggaatctaaatacgctccacttcatctggtgcctctcatcgaacggctgggcaccccacaacagatcgccattgccagagaaggagacctgctcaccaaagagcggctctgctgtggcctgtctatgttcgaagtgatcctgactcggatacgcagttttctcgatgatccgatttggagaggacctctgccttcaaatggcgtgatgcatgttgatgagtgcgtcgagttccaccggctgtggtcagccatgcagtttgtgtactgtatccccgtcggtacccatgagtttactgtcgaacaatgctttggggatgggcttcactgggcaggctgtatgattattgttctcctgggtcagcagagacgcttcgccgttctggacttctgctatcatttgttaaaggtgcaaaaacatgacggtaaagacgaaataatcaagaatgttcccttaaagaagatggtcgaacgtatacgaaagttccagatcctgaacgacgagatcataacgatcctcgataagtatctgaaaagcggcgatggagaaggcactcccgtggagcatgtacgatgttttcagccacctatccaccagtcactggcttcgtcatag

SEQ ID NO: 184567 - DNA, 3768 bp, Artificial Sequence
  Description of Artificial Sequence: Synthetic coding sequence
atgggccccaagcacgtgctgcggcagcccggccccagcgagcggcaccaccctgaagtgcccgcctggacccccagggcgggaccaccgtgctggctgtgtcgccagcggtggggttggacccttcacccccctggccggggatgtcccgcgctgctgttatccgaacctaggatggcggcgcaggtgaccctggaagatgcactttcaaatgttgatctgctggaggaactgcccctgccggatcagcaaccctgcattgagcccccgccgagctctctcctgtaccaaaacgagatgttagaagagggtcaggaatacgctgttatgctgtacacctggaggagctgcagtagggctatcccacaggtcaagtgcaacgaacaacctaacagggttgagatctatgaaaagactgtggaggtgctggagcctgaagtgaccaaacttatgaacttcatgtattttcagcgcaatgcgattgagcgcttttgtggggaggtaaggcggctgtgccacgcggagcgacgtaaagattttgtttccgaggcataccttatcaccctaggtaagttcatcaatatgtttgccgtcctcgatgagctgaagaatatgaagtgttctgtcaagaatgaccactccgcttataaaagagccgctcagttccttcggaaaatggccgacccacagtccatccaggagtcacagaacttaagtatgtttcttgccaatcacaataagataacgcaatctctccaacagcagctggaggtgattagcggatacgaagagctgctcgctgatatagttaacctgtgtgttgactactatgagaaccgcatgtacctcaccccaagtgaaaagcacatgctactgaaagtgatgggatttggcttatacttgatggatgggtctgtgtcaaacatctacaagctggacgcgaaaaaacggattaacctgtccaaaattgacaagtactttaagcagcttcaagtggttccactctttggagatatgcagatcgaactagccaggtatatcaagacatccgcgcactatgaagagaataaatcacggtggacatgcacttccagtggttcttcgcctcaatacaacatatgtgagcagatgattcaaattagggaggaccatatgcgcttcatttctgaactggcccgatatagcaatagcgaggttgtgactggatcaggccgccaagaggcacagaaaacagatgcggagtaccggaagttatttgatctggccctgcagggactgcagttgctgtcccaatggagcgcccacgttatggaggtctatagctggaagctggtgcacccgaccgacaagtatagcaacaaggattgtcccgattcagctgaggaatacgaaagagctaccagatacaactatacaagcgaagaaaagttcgcactggtggaagttattgccatgatcaaggggctccaggtgcttatgggaagaatggagagtgtattcaatcatgccattcggcacacagtgtacgctgcattgcaggatttctcccaagtcaccttgagagagccattgcggcaggccatcaagaagaagaagaacgtgattcaatcggtcctgcaggcaatcaggaaaacagtctgtgattgggaaacgggccacgagccattcaacgaccccgccctgcgtggtgaaaaggaccctaagagcggattcgatatcaaagtgccccgtcgggccgtagggcccagctccacacaactctatatggtgcgcacaatgctggagtcgctcattgctgataagtcgggtagcaagaaaacacttcgttcctcactcgagggcccgaccattctcgacatcgaaaagtttcaccgtgaaagcttcttctacacccacctgatcaacttctccgagactttgcaacaatgttgtgacctcagtcagctctggttccgcgaatttttccttgagttgacaatgggccgcagaattcaatttccaatcgagatgagtatgccatggatcctgaccgaccacattctcgagactaaggaggcttccatgatggaatatgttctatactccctcgatctgtacaatgatagtgcccactatgcacttactcggtttaacaaacagttcctctacgatgagatagaggcggaggtcaacctatgttttgatcagttcgtgtataaattagctgatcagatattcgcttattacaaagttatggcaggctcactgctcctagataaaagactgcgctctgagtgtaagaaccagggcgccacaatccatttgcccccctccaaccgctacgagacactgctcaagcagcgccatgtccagctgctcggacgatcaattgacctcaaccggttgataacgcaaagagtgtctgcagcaatgtacaaatcattggagttagctatcggaaggttcgaatctgaagacttgacatctatcgtagagttggacggcttacttgagatcaacagaatgacgcacaaacttctatccagatatttaacactggatggcttcgacgccatgtttcgtgaagcaaaccacaatgtatcagcaccgtatggcagaatcacacttcacgtcttttgggagctgaactacgacttcttgcccaactattgctacaacggcagcacaaatcggttcgtacggactgtcctacccttctctcaagagttccagcgtgataaacagccgaatgctcagccacagtacttacatggctctaaggcacttaatctcgcgtactcttctatctacgggtcctataggaactttgtggggcccccacattttcaagtaatctgtcgcctgctgggttaccaaggcattgctgtcgtcatggaagagctactaaaagtggtgaaaagtcttcttcagggcactatactccagtacgtaaaaacccttatggaagtgatgcctaagatttgtcgactgccacgacacgagtacggctctcctgggattctggaattcttccatcaccagctaaaggacattgtcgaatatgctgagcttaaaaccgtgtgctttcaaaacctgcacgccgctccattccagaatattttgccccgtgtacatgtcaaggaaggtgagcggttggacgcaaaaatgaaacgcctggaaagtaaatacgcaccgcttcatctagtgccacttatcgagcggcttggtacacctcaacaaatcgccatcgcgcgagaaggcgatctgctgactaaggagaggctctgttgtggactgtctatgtttgaagtgatactgacccgaattcgctcattcctggatgacccaatttggaggggtcctctcccctcaaacggcgtaatgcacgtggatgagtgtgtcgagttccaccgcttgtggtctgcgatgcagtttgtgtactgtattcccgtggggacgcacgagttcacggtagaacaatgctttggggacggactgcattgggccggatgtatgattatcgttctattaggccaacaacgaaggtttgccgtccttgacttttgttatcacctactgaaagtccaaaaacatgatgggaaagatgagatcattaaaaatgtccctttgaagaagatggttgaaagaatcaggaaatttcagattctaaatgacgaaataatcacgatccttgacaagtaccttaaatcaggtgatggagaaggcacgcccgtggagcacgtccggtgcttccagcccccaattcaccagagtctcgcgagctcttag

SEQ ID NO: 184568 - DNA, 2469 bp, Artificial Sequence
  Description of Artificial Sequence: Synthetic coding sequence
atggccgagagcctgggcagcgccgagctgctgcggcagctgaagtctcttggcatggagcgtctgcttcacgcagtcaatactttcctccgccagagctgcacttacctacctcttctgacgttcggcgggaagacctctttcgtgagcctagacgtctacggcaccgaagctaactgcagtgcgacttcatgcagctttccgaaggcagccgcaacctggcccagaagacaagcccccggtccgttaggagaactggttagaggtccccctgatcagggtgtggcagagcagagcttttctcatgggcttttcgagtttgggatcacaaacgtcccgtgtattttctccccccctcagatgttcccttggattatccaactgtatatggtgagaactatgctcgaaagtcttatagcagacaaaagtggcagtaagaagaccttacggtcctccctggaaggccccaccatattagacatcgaaaagttccatcgggagagttttttttacacccacctgattaacttctcagagacccttcaacagtgctgcgatctttcccagctttggtttcgcgaatttttcctcgaactgacaatgggccgacggatacaatttccaatcgagatgtctatgccatggatccttacagaccatattctggaaaccaaggaagccagtatgatggaatacgtcttgtattccctagacctttacaacgactctgcccattatgccttgactcggttcaacaagcagttcctctatgacgagattgaggccgaggtgaatctgtgcttcgatcagtttgtctacaaactagctgaccagatctttgcatactacaaagtgatggcagggtcattgctgctggataagagactccgctccgagtgtaaaaatcagggggccaccattcacctcccgccatcaaaccgatacgaaaccctgctcaaacagcgccatgtgcagctcttagggcgatcgatcgacctgaacaggctgatcacccagcgcgtatcggcggctatgtataaatctctggagctcgccataggcaggttcgaatccgaggatttaacaagcattgtcgagctagatggtttacttgaaatcaacaggatgacccataaactgctgagccgttatttaactttggatgggttcgacgcgatgtttagagaagccaaccacaacgtcagcgctccctacggaaggatcaccctacatgtgttttgggagcttaattacgacttcctgccaaactattgttataacggtagcaccaataggttcgtccgtaccgtgttgcccttctcacaggaatttcaaagggataagcagcctaacgcccaaccgcaatacctgcatggatccaaggcactgaatctcgcctactcctctatctacggcagctacaggaatttcgtgggcccaccccactttcaagttatttgcagactgctcggctaccagggcatagccgttgttatggaagagcttttgaaagtcgtaaaatctttgttgcagggcaccatcctccagtatgtgaaaacactgatggaggtgatgcctaaaatttgccggttacccaggcacgagtatgggagccctggaatcctggaattcttccaccatcagctgaaagatatagtcgagtacgctgaactaaaaactgtgtgcttccagaacctgagagaggtcgggaatgcgatccttttttgtctgctgattgaacagagcctgtctctggaggaggtgtgtgacctccttcacgcagctccattccagaatattttgccccgtgttcacgtcaaggaaggagagcgcctggatgctaagatgaaaaggttggaaagcaaatatgcaccacttcacttggtccctctcatcgagaggctggggacaccacagcagatcgccatcgctcgggagggggacctgctgactaaagaacgcctctgctgtggcctctccatgtttgaggtgatactgaccagaattcggagcttccttgatgacccgatctggcggggaccacttccttccaacggcgtgatgcacgtcgatgagtgtgttgaatttcatcgcttgtggtccgcaatgcagtttgtgtattgtattccagtgggaacgcacgagttcaccgttgagcagtgctttggggatggtctgcattgggccggatgcatgatcatcgtcctgcttggccagcagcggaggttcgccgtgctagacttctgctaccacctcctgaaagtgcagaaacacgacggcaaggatgaaatcattaaaaacgtgcccctgaaaaaaatggtggagcggattcggaagttccagatcttgaacgacgaaatcataactatcctggacaaatacctgaagagcggagatggcgaggggacgccagtagagcacgtgcggtgtttccagccacccattcaccaaagcctggctagttcctag

SEQ ID NO: 184569 - DNA, 3762 bp, Artificial Sequence
  Description of Artificial Sequence: Synthetic coding sequence
atggccgcccaggtgaccctggaggacgccctgagcaacgtggacctgctggaggagttgcccctgcctgatcagcaaccgtgcattgagccgcctccttcttccctgctgtatcaaccgaatttcaacaccaacttcgaagacaggaatgcatttgttactggaatcgctagatatatcgaacaagccaccgtccacagttctatgaatgaaatgctagaggaagggcaagagtacgcagttatgctgtacacatggcgtagctgttctagggctatcccacaagtcaaatgcaatgaacagccaaatcgggtggaaatttacgagaagacggtggaggtgctggagcccgaagtgaccaaactcatgaacttcatgtactttcaaagaaacgctattgagcgcttctgtggagaggtgagaagactgtgtcacgccgaacgaagaaaggattttgtcagtgaagcctatctcatcacattaggaaaattcatcaatatgttcgccgtgttggatgaactgaagaacatgaagtgctccgtcaaaaacgatcactccgcttataaacgggctgcccaattcttaaggaaaatggctgacccgcagtccatacaagagtcacagaacctgtcaatgtttctagctaatcataacaaaattactcagtctcttcagcaacaattagaggtgatctccggctacgaggagctcttggcggatattgttaacctctgcgtcgactattacgagaatcgcatgtaccttacgcctagcgagaaacacatgcttctgaaggtgatggggttcgggctctacctgatggatggtagcgtgagcaacatatacaaactggatgccaagaaaaggatcaacctttccaaaatagataagtacttcaaacaactgcaggttgtgcccctcttcggcgacatgcaaattgaactcgctcgatacatcaaaacttcagcccactacgaagagaacaagagcaggtggacgtgtacaagctcaggcagctcaccccaatataatatttgtgagcagatgatacagatacgcgaagaccatatgcgattcatctcagagctggccagatactcgaacagcgaggtcgttacaggctccggacgccaggaggcgcagaagacagacgccgagtaccgcaagctcttcgacctcgccctccaaggactgcagctactgtcacaatggtcagcacatgtaatggaggtgtattcatggaaacttgttcaccctaccgacaaatactccaacaaggattgtcccgactcagcagaggagtatgaacgggccaccagatacaactataccagcgaggagaagtttgccttggtggaggtgattgctatgatcaaagggctgcaagtgctaatgggtcgaatggagagcgtgtttaaccacgccatacggcatacagtgtatgccgctttgcaagatttttcccaggtaacactgagggaacctctgcgccaggccatcaaaaagaaaaagaacgtcatccaatccgttctgcaggctatccgaaagaccgtctgcgactgggagaccgggcatgaaccattcaatgatccagctcttcgcggtgagaaagaccctaagtcgggctttgacattaaggtgcctagaagggcagtgggtccgtcatctacccagctgtatatggtgagaacaatgctagagagtcttatagccgacaagtctgggtctaagaaaacactccgttcatcactcgagggccccaccatcctggatattgagaaatttcaccgcgaaagcttcttttatacccacctcattaatttctcagaaacattacaacagtgttgtgatctatcacaactgtggtttcgggaatttttcctggaactgaccatggggcgccggattcaatttccaatcgagatgagcatgccatggattctgacggaccacattctcgagaccaaggaagctagcatgatggaatacgtgctctactcactagacctgtacaacgactcagctcattacgccctgaccagattcaacaaacaattcctttatgacgagatagaggccgaggtcaatctttgtttcgaccagtttgtgtacaagctggcggaccaaatctttgcctactacaaggttatggccggttcactcctgttggacaaacgtctgcggtctgagtgcaaaaaccagggtgcaaccattcaccttccacctagtaatcggtacgaaacgctcctgaagcagcgacatgtacaactgctcgggcgctccattgatctcaatcggttaatcactcaaagagtctccgcagccatgtacaagtcgctggaactggccatcgggcggttcgagtccgaggacctgacatctatcgtcgaactcgacggactgctggagatcaacagaatgacccacaaacttttgtcccgatacctgacactggacggatttgatgcaatgtttcgggaggcaaatcacaacgtgtctgccccctacggaagaataactctccatgtgttctgggaactcaattacgattttctccccaactactgttacaatggatctacgaaccggtttgtgaggacggtccttcctttctcccaggagttccaacgggataaacagcctaatgcacagccccagtatctgcatggttctaaggccctgaatctcgcttactcctcaatttacggtagttatcgcaacttcgttggccctccccattttcaggtgatatgtaggcttctcggctatcaaggtatcgccgttgttatggaggagcttctgaaagtcgtcaagtccctgctgcaggggactatcctgcagtacgtgaagactctgatggaagtaatgccgaagatttgccgcctgccaagacacgaatacggtagtcctggcatcctggagttctttcaccaccagctgaaggatattgtcgaatacgcggagctgaaaacggtgtgctttcagaacctgcgcgaggtaggaaacgcaattttattctgtctcctgatcgaacagtccctcagtttagaggaggtgtgcgacctgttgcacgctgctccctttcagaacattctgccacgcgttcacgtgaaggagggcgagcggttggacgcaaagatgaagcgacttgaaagtaagtacgctcccctccatctggtcccgttgatagagcgattgggaacaccccagcaaatcgctattgcacgggagggtgatctgttaaccaaagaaagactttgttgtggactcagcatgtttgaagtaatcctgacccgaatcaggagcttcctggatgatccaatctggcgaggccctctgcccagtaatggtgtaatgcacgtggatgaatgcgtggagttccaccgtttgtggtctgctatgcagtttgtctattgtattcctgtaggcacacacgagttcaccgtcgaacagtgtttcggggatggcttacattgggccggttgtatgattatcgttcttctgggacagcagagaaggttcgccgtgttggacttctgctatcacctgctaaaggttcagaagcatgatggaaaggacgagatcatcaagaatgtgcccctgaagaagatggtggaaaggatccgcaagttccaaattctcaatgacgagataataacaatcctcgacaagtatctgaaatccggggatggggaagggactcccgtcgagcacgtgcggtgtttccagcctcctatccatcagagtctggcatcctcatag

SEQ ID NO: 184570 - DNA, 486 bp, Artificial Sequence
  Description of Artificial Sequence: Synthetic coding sequence
atggccgcccaggtgaccctggaggacgccctgagcaacgtggaccttctcgaggaactacctctacccgaccagcagccatgcatcgagccaccgccaagctctctgctctaccaaccaaacttcaatacaaacttcgaagatcggaacgcctttgttactgggatcgccagatatatcgagcaggctaccgtccactcgtctatgaacgagatgttagaggaaggccaggaatacgctgtaatgttgtacacctggcgctcttgcagccgagccatcccccaggtgaaatgtaacgagcagcctaacagagtcgagatctatgaaaaaaccgtggaggtgctggagccggaagtaacaaagctcatgaattttatgtattttcagagaaatgccatcgaacggttttgcggagaggtgcgccgcctctgccatgctgagcgaaggaaagattttgtgagtgaggcgtatttaatcacactgtag

SEQ ID NO: 184571 - DNA, 456 bp, Artificial Sequence
  Description of Artificial Sequence: Synthetic coding sequence
atggccgcccaggtgaccctggaggacgccctgagcaacgtggacctcctagaagagctgcctctgccagaccaacagccttgcatcgagcccccaccatcttctttgttatatcagccaaacttcaacaccaattttgaggatcgcaatgccttcgtgacgggaattgctcgctacatcgagcaggccaccgtgcattcctccatgaatgaaatgctggaggaagggcaggagtacgccgtgatgttgtatacttggcgtagctgctctagagccatccctcaggtgaagtgcaatgagcagcccaatagagtcgagatttacgaaaagacggtggaggtgttggagcctgaggtgaccaaattgatgaattttatgtacttccagcggaacgcgatcgagcggttttgtggagaggtgcgcaggttatgtcatgctgaaagacgcaaggactag

SEQ ID NO: 184572 - DNA, 3837 bp, Artificial Sequence
  Description of Artificial Sequence: Synthetic coding sequence
atgaccacccacgtgaccctggaggacgccctgagcaacgtggacctgctggaggagctcccacttcccgatcagcagccatgcatcgaaccccccccatcctctattatgtatcaggcgaatttcgacactaattttgaggacagaaatgcttttgttacaggaatcgcccggtatattgaacaagccacggtccacagctcgatgaatgaaatgctggaggaaggtcatgagtacgccgtaatgctctacacttggcgctcctgctcaagagcaattcctcgggtgaaatgcaacgaacagcccaatagagtagagatttatgagaaaactgtcgaggtgctggaacccgaggtgacgaagctaatgaagttcatgtattttcagaggaaagcaatcgagaggttctgcagcgaggtgaagcggctttgccacgcggagcgccgcaaggacttcgtaagcgaagcttacctgctaaccctcggaaagttcataaacatgtttgccgtgctggacgaacttaagaacatgaaatgctctgtgaagaacgatcattcggcatacaaaagagcagcacagttcctcagaaagatggcggacccacagtctatccaagagagtcagaatctgagcatgttcctggcaaaccataatcgaatcacgcagtgtctgcatcaacagctcgaggtaatcccagggtatgaagagctcctggcagatatcgttaatatctgtgtagattactatgagaataagatgtacttgactccgagtgagaagcatatgcttctgaaagtcatgggttttggcctataccttatggatgggaacgtgagcaacatttacaagctcgatgccaaaaagcgtattaacctttcaaaaatagataagttctttaagcagctgcaagtggtgcctctgttcggggatatgcagatagagctggcaagatatatcaaaaccagcgcccattacgaggagaacaaatccaagtggacttgtactcagtccagcatttcacctcagtataacatctgcgagcagatggtccagatccgtgatgaccacatccgcttcatcagcgagctggcgcggtacagtaactccgaggtagtgaccggctccggccttgacagccagaagtccgacgaagaatacagggaactctttgatctcgcgctgcggggcctccaactactgagtaaatggagtgctcacgtcatggaggtctattcctggaaactcgttcaccctactgataaattttgcaacaaagactgtcctggcaccgcagaagaatatgagagagccacacgttacaactacaccagtgaggaaaagtttgccttcgtggaagtgattgctatgattaaagggctccaggtactgatggggagaatggagagtgtgttcaatcaggccattcgaaacactatatatgcagcacttcaggactttgcacaggtgaccctccgggagccccttaggcaagccgtaagaaaaaagaagaatgtgttgatttcagtactgcaggccatccgcaagaccatttgtgattgggagggcgggagggagccaccaaacgacccctgccttcgtggggaaaaggatcctaagggaggattcgacataaaagtgccacggagagccgttggaccaagtagtacccaggcctgtcagtggtcgcccagggccctgtttcaccctactggcgggacccaaggccgtcgtgggtgcaggagtttactgtatatggtaaggactatgctggagtccttgattgcggacaagtccggttcaaagaaaacactccgttcttctctcgacggaccaatcgtgttagccatcgaagactttcacaaacagagtttcttcttcacccatctgctcaacatcagcgaagctctccaacagtgttgtgaccttagccaactttggttcagggagttttttctcgagctcacaatgggaagacggatccagttcccaatcgaaatgtcaatgccttggatactcaccgatcacatattagaaaccaaggaaccttctatgatggaatacgtcttgtacccccttgacctctataatgatagcgcttattatgccctgacaaagtttaaaaaacagtttctgtatgacgagattgaggctgaggtaaacttgtgcttcgaccagttcgtgtataagctcgctgatcaaattttcgcgtattacaaagccatggccgggtcagtgctgctggataagaggttcagggcagagtgtaaaaactatggggtcatcattccttacccaccctcaaaccgctatgaaaccctactgaagcagcgccacgtgcagcttctaggtcgctccattgaccttaaccggctaatcacccagaggatctcagcagcaatgtacaaatcccttgaccaggccatctctaggttcgaatccgaggacttgaccagtatagtggaactcgagtggttgcttgaaattaacaggcttactcaccgcctgctgtgcaagcacatgacgctcgattcattcgatgctatgtttagagaagccaatcataatgtgtctgccccatatggccggattactctgcacgtcttctgggagctgaattttgacttcctcccaaattattgttacaatgggtcaactaaccgattcgttagaactgctatccccttcacacaagagccgcagcgggacaagcctgccaacgttcagccatactacctctacggatctaaaccacttaacatcgcatactctcatatttattcgagttatagaaatttcgtgggcccccctcacttcaaaaccatatgtagacttcttggataccaggggatcgcagtagtcatggaagaactcttgaagatcgtcaagagcctgctgcagggaacaatcctccagtatgtgaaaaccctcatcgaagtcatgccaaaaatatgcagattgcctcgacacgagtatggttcaccggggatcttggaattcttccaccatcagctgaaagatatcatcgaatatgcggagctgaagactgacgtctttcagtcactgcgcgaagtgggaaatgccatcctgttttgtttactgatcgagcaggctctaagccaggaagaggtttgtgatctactgcatgctgcaccattccagaacattcttcccagggtatatattaaagagggggagaggctggaagtgcgcatgaagaggctcgaggccaagtatgctcccctccacttggtaccccttatcgagcgactcggcacgccacagcaaatcgcaatcgctagggagggtgatttactcactaaggagcggctttgttgtggcctgagcatgtttgaggtaatcctcacccgtatccgcagctatctgcaggaccctatttggcgtggcccgcctcctactaatggcgtgatgcatgttgatgagtgtgtagagtttcacaggttgtggagtgcaatgcaatttgtctactgcataccagttggtaccaatgagttcacagctgagcaatgcttcggcgatggactgaactgggccgggtgttctatcattgtgctgctcggtcagcaacggcgatttgacctgttcgacttttgctaccaccttctgaaagtccaacgccaggatgggaaggacgagatcataaaaaatgtcccgctgaaaaagatggccgatcgcatacggaagtaccaaatcttaaataatgaggtctttgctattttgaataagtacatgaaatccgtggagacagattcgtccactgtggaacatgtgcgttgctttcaaccaccaatccaccaatccctcgcaaccacgtgctag

SEQ ID NO: 184573 - DNA, 3762 bp, Artificial Sequence
  Description of Artificial Sequence: Synthetic coding sequence
atgaccacccacgtgaccctggaggacgccctgagcaacgtggacttgctagaggagctcccactgccagaccagcagccatgtatcgagccaccaccgtccagcataatgtatcaggctaacttcgatactaacttcgaggaccgcaacgccttcgtgactggaatcgctcgctacatcgaacaggccacagtgcatagtagcatgaacgagatgctggaggaaggccacgagtacgccgtgatgttatacacatggaggagttgctctagggcaattcctaaggttaagtgtaacgaacaaccaaaccgcgtggagatctatgagaaaaccgtcgaggtccttgaacctgaagtcaccaagcttatgaagtttatgtatttccagcgaaaagccatcgagagattctgttctgaagtgaagagactttgccacgctgagagacgcaaagactttgttagtgaggcctatcttttaacactcggaaaattcatcaacatgttcgcagtgctggacgaactcaagaacatgaagtgttcggtgaaaaacgaccactctgcctacaagcgggctgcccaattccttcgtaaaatggccgaccctcagtctatacaggaaagccagaatctgagcatgtttctggctaatcataataggatcacacagtgtctgcaccaacagctggaggtcattcccggatatgaagagctgctggcggatattgtgaatatttgcgttgattactacgagaataaaatgtacctcacgccctctgagaaacatatgctcctgaaagttatgggcttcggcttgtatctcatggacgggaatgtgtccaatatttataagctggacgcaaagaaaaggattaatctgtctaagattgataaattctttaagcagctccaagtcgttcctctctttggcgacatgcaaattgagctggcccgttatattaaaacaagtgctcactacgaagagaacaaatctaagtggacttgcacccagtcctcaattagcccacagtataacatttgtgagcagatggtacaaattcgggacgaccacattagattcatcagcgagctcgcacgctatagtaattccgaggtggttaccggcagcggactcgattcccaaaaatcagatgaggaataccgggagttgttcgatttagccctgaggggactgcagctgctctctaagtggtctgctcacgtgatggaagtgtacagttggaagcttgtgcaccccacagacaaattctgtaacaaagattgcccgggaacagcagaggaatatgagcgggcaacaaggtataactacacaagcgaggagaagtttgctttcgtcgaagtgatcgctatgatcaagggactgcaggtgctgatggggcggatggagtcagtcttcaatcaggccatccgcaacacaatatatgccgcactgcaggacttcgcacaagtgacactgagggagcctctaaggcaagctgtcagaaaaaagaagaatgtcctcatttctgtcctgcaggccataagaaagacaatatgcgattgggaggggggtcgcgaaccccctaacgatccgtgcctgcgtggcgaaaaagaccctaagggggggtttgatattaaggtgcctagacgcgccgtcgggccttcctcgacccagctgtacatggtgcgaacaatgttagagagcctgatcgctgataaatctggatccaaaaagaccctgagatcctccctcgacggtcctatcgtcctggctatcgaggacttccataagcagtctttcttttttactcatctgctcaacatctcggaagctctgcagcaatgttgtgatttgtcacagctctggtttcgggagtttttcctggagctgactatggggaggagaatacagtttccaattgagatgtcgatgccatggatattaaccgatcatatcctggagactaaagagccctccatgatggagtatgtgctctatccccttgatttatacaatgactcagcttattatgccctcacaaagttcaaaaaacagtttctctacgatgagatagaagccgaagttaatttatgctttgatcagttcgtatataagctagccgatcagatattcgcctattacaaggctatggctggatccgtcttgttagacaagaggttccgtgcagagtgtaagaactatggcgtgatcattccatatccacccagcaatagatatgagactctgctcaagcagagacatgtccagctcctcggtaggagtatcgacctaaatagactgattacacagagaatatccgccgctatgtataaatcactggatcaggctattagccgttttgaatccgaggatctgacttcaattgtagaattagaatggcttctcgaaatcaacagactaacacaccgattactgtgtaaacacatgaccctggatagttttgacgcaatgttcagggaagctaaccacaacgtgagtgccccctatggcaggataaccttacatgtgttctgggagctgaactttgactttctgccgaactattgctataatggatctacaaaccgatttgtacgtacagccattccttttacacaggagccacaaagggacaaacccgccaacgtgcagccttactacctctatggatctaagccgttgaacatcgcctactcccatatctattccagttatcggaacttcgtgggtcctccacactttaagacaatatgtaggcttctgggctaccaaggaatcgctgtcgtcatggaagaacttttgaaaatcgtgaagtctctcctccaggggaccatcctgcagtacgtgaaaacattgattgaagtgatgcctaaaatttgtcgcttgcctcgacatgaatatgggagccccggtattctcgaattctttcaccaccagttgaaggacatcattgaatacgcagaactcaagaccgatgtgttccaatctctgcgggaggtggggaatgctattctgttctgtttactcatcgagcaagccctgtcacaggaagaagtgtgtgacctgctgcacgctgccccattccaaaatatactgccgcgcgtctacattaaagaaggggagagactggaagtgagaatgaaacggctggaggcgaagtacgcccccctacatctggtgcctcttattgagagactgggcaccccccaacagattgccatcgcccgcgaaggggacctgctgacgaaggaacgcttatgttgcgggctatccatgttcgaagtgatcctgactcgtatacgatcttacttacaggatcccatctggcggggacctccacccactaacggcgttatgcacgttgacgaatgcgttgagttccaccgcttgtggagcgctatgcagttcgtatactgcatccccgttggcaccaacgagttcaccgctgagcagtgcttcggagatggcctgaattgggctgggtgctcaatcatcgtgcttctgggacagcagcgtcgctttgatctgttcgacttttgttatcatctcctaaaggtgcagcgccaggacgggaaagatgaaattattaaaaacgtccctctgaagaaaatggcagaccggattcggaaataccagatcctgaacaacgaggtgttcgcaatcttgaacaagtatatgaagagcgtagagacagactcatccactgtcgaacatgtcaggtgctttcagccgcccatccaccagtccctcgctactacttgttag

SEQ ID NO: 184574 - DNA, 3762 bp, Artificial Sequence
  Description of Artificial Sequence: Synthetic coding sequence
atgaccacccacgtgaccctggaggacgccctgagcaacgtggaccttctggaggagcttcctctccccgatcagcaaccatgtatcgagcccccaccaagttccattatgtaccaggccaatttcgataccaatttcgaagatcgtaacgcttttgtgacgggcatagcccgatatatcgaacaggctaccgtacatagctccatgaatgaaatgcttgaagaaggtcatgaatatgcagttatgctgtacacgtggcggtcctgttcaagggccattcccaaagttaagtgcaacgaacagccaaatcgcgtcgagatatacgaaaagaccgtggaagtccttgagccagaagttacgaaactgatgaagttcatgtactttcagaggaaagccattgaacggttctgcagtgaagtcaagcgactctgccacgctgaaaggcgcaaggacttcgtttcggaggcttacctgctgacgctaggaaaatttattaacatgttcgccgtgctggatgagttaaagaacatgaagtgctcagtcaaaaacgatcattcagcctataagagggctgcacagtttctccgcaagatggctgatccccaatctattcaagagtcacagaaccttagcatgttcttagcgaaccacaatcggattactcaatgccttcaccagcaactggaagtgattcctggatatgaagagctgctggctgatattgttaacatatgtgtggattattacgagaacaaaatgtatcttacgcctagcgaaaagcacatgttgctaaaggttatgggctttggcctgtacctcatggacggtaatgtgtcaaacatttataagcttgatgccaagaaaagaatcaatttaagcaagatcgataagtttttcaagcaactgcaagttgtgcctctgtttggagatatgcagattgagctcgcgcgctacattaagactagcgcccattatgaggaaaacaagagcaagtggacctgtactcaatcttctatttctccccagtacaacatttgtgaacagatggtgcagatcagagacgaccatatccggtttattagtgaacttgcgcggtattccaactccgaagtagtgacaggttctggactggatagtcagaagagcgacgaggaatatagagagctgtttgacttggctctgagaggcctccagctcctgtccaagtggagcgcccacgtgatggaagtttacagctggaagctggtgcaccccactgacaaattctgcaataaagactgcccaggaacagctgaagaatacgagagagctaccagatacaattatacctccgaagagaaatttgccttcgtcgaagtgatcgctatgataaaaggattacaagtgcttatgggaaggatggaatctgttttcaaccaggctatacgaaatactatctacgctgccctccaggacttcgcacaggtgacgttacgagagcccttgcggcaagcagtgcgtaaaaaaaaaaatgtgcttatatccgtgctgcaggctatccgcaaaacaatttgtgactgggaaggcgggcgggaacctccaaacgatccctgcctgaggggagagaaggatcctaagggcggattcgacatcaaggttccacgccgggctgtgggcccctcatctacccagctgtacatggttcggaccatgttagaatccttaattgctgacaaatcgggttccaagaaaactctccgttcctcactcgatgggcctatagtattagcgatcgaggactttcataagcagtctttcttcttcactcatctcctgaatatctcagaagcgctgcagcaatgttgtgacctcagccagctttggttccgggaattcttcttagaacttaccatgggtcgtcgtatacagtttcccatcgaaatgtctatgccctggatcctgactgatcacattctcgaaacaaaagagccctctatgatggaatacgtactatatcctttggacttatacaatgatagtgcctactatgcgcttaccaaatttaagaagcagtttctttacgatgagatcgaggctgaggtgaatttgtgcttcgaccagttcgtctacaaactggcagatcaaatctttgcttattacaaggccatggctggttctgtcctgctagataagcgctttagggctgagtgcaaaaattatggagttataatcccatatcctccctctaatcgctacgagaccctgctgaaacagaggcacgtccagttgctcgggcggtccatcgacctcaataggctcatcacccagcgaatctcagctgccatgtataagtctctggaccaggcaatcagtcgatttgaaagtgaggacttgacaagcattgtcgagcttgaatggttgctagaaatcaaccgactgactcaccgcctgctgtgtaagcacatgactctggacagttttgatgccatgttcagagaggctaatcacaacgtgtcagccccgtacggacgtatcactttacatgtgttctgggaactgaatttcgactttttacctaattactgttataacggctctacgaataggtttgtgaggaccgccatccccttcacacaggaaccccagagggataaaccagcaaacgtacagccatattacctctatggatctaagcctcttaatatagcctattcccacatttattcctcttacagaaacttcgtgggcccaccccatttcaagacaatatgtaggctgttgggctatcagggcattgccgtggtgatggaagagcttcttaaaattgtcaaatccctgttacaggggacaatattgcaatatgtgaagacgctaattgaggtgatgcctaagatatgtcgactccctaggcatgaatacggttcccccggtatactggagttttttcaccatcagctgaaagatatcatagagtatgcggaacttaagacggacgtatttcagtctctgcgagaggtgggaaatgcaatcctcttttgcctcctgatcgagcaggccctaagccaggaagaggtctgcgacttattgcatgcagcaccgtttcagaatattctccctagggtctatatcaaagagggagagcggctggaagtgaggatgaaaaggttggaggcgaaatacgctccactgcacttggtgcctctgatagagagactgggcacaccccaacagatcgcaatcgcacgagagggcgaccttctgactaaggagagattgtgttgtggtctgtccatgtttgaggtgattcttacaaggatccgtagctacctgcaggaccctatctggagagggcccccacctactaacggcgttatgcacgtggatgagtgcgtggaattccatcggctctggtccgccatgcagtttgtgtattgtatccccgtcggtacgaatgagttcaccgcagaacagtgttttggggacggacttaactgggccggttgcagtatcatcgtgctgcttggtcagcagagacgcttcgatctcttcgacttctgttatcatttacttaaagttcaaaggcaggacgggaaggatgaaattattaaaaacgtaccactgaagaagatggcagatcgcataaggaaataccaaatcctgaataatgaggtgtttgcaattctgaataaatacatgaagtctgtggaaacagacagcagtaccgtagagcacgttaggtgtttccagcctcctatccaccaaagcctcgcaacgacttgttag

SEQ ID NO: 184575 - DNA, 2859 bp, Artificial Sequence
  Description of Artificial Sequence: Synthetic coding sequence
gagaagcggcggcggtggacctgcacccagagcagcatcagcccccaatacaacatctgcgagcagatggtgcagattcgggacgaccatatcagattcatctccgaactggccaggtattccaatagcgaggtggtgaccggcagcgggttagacagccagaagagcgatgaagaatatagggaactttttgacctagccctgaggggactgcagttgttatcgaaatggagtgcgcatgtaatggaagtctactcctggaagctggttcatcctacagataaattctgtaataaggattgtcccggcactgctgaagagtacgaacgagcaactaggtataactacacatctgaggagaagtttgcctttgtggaagtgattgcaatgattaaagggttgcaggttctgatgggcagaatggagtccgtcttcaaccaggctattagaaataccatctatgccgcgctccaagacttcgctcaggttacactccgggagccccttaggcaggccgtgcggaaaaagaaaaatgtgctgatcagcgtgctccaagctatacgtaaaaccatttgcgactgggagggggggcgtgaaccccctaacgacccttgtctgcgtggggaaaaagacccaaaaggcggcttcgacattaaagtccctcgccgggctgtaggcccaagctccacacaggcctgccaatggagtcctagagcgctattccatcctactggcggtacacaggggcgacgcggatgtcgctccctcctttacatggtgcgtacaatgcttgaaagcctcatcgccgataagagcggatctaagaagacactccggagcagcctggacggacctatcgttctcgcaatcgaagactttcataagcagagctttttcttcactcacttgctgaacatctccgaggcgctgcagcagtgttgcgatttatcgcagctgtggtttagagaattctttctggaattaacaatggggagacgtattcagtttcctattgaaatgagcatgccctggatcctgacggatcacatcctggaaactaaagagccctccatgatggaatacgtgttatatccactcgatttatataatgatagtgcatactacgccctgacaaagttcaaaaagcaattcctctacgatgagatcgaggcagaggtgaatctctgctttgatcagtttgtgtataagttggcggatcagatttttgcctattataaggccatggccggaagtgtgctactagacaagaggtttcgcgcagagtgcaagaattacggagttattattccctatccacccagcaacagatacgagactctactcaagcagagacatgttcagctgctagggcgcagcatagaccttaaccggcttataactcagcgcatatcggccgcaatgtacaaatcactcgatcaagccattagcagattcgaatccgaagacctgaccagtattgtggaactcgaatggttgctggaaattaacagactgactcacagactgctgtgtaaacacatgaccctggactctttcgacgccatgtttagagaggccaaccacaacgtgtcagccccctatggaagaatcacgcttcacgtattttgggaactcaactttgactttctcccgaattactgctacaacgggtcgaccaacagattcgtgagaactgcaatcccctttactcaggagccacaacgggacaaaccagcaaatgtgcagccctactacctgtatggttccaaaccactcaacattgcatactcccacatctatagttcgtatcggaacttcgtgggccctccacactttaaaactatttgtcgactcctggggtaccagggcattgccgtggtcatggaggaattgttgaagattgtgaagagtttgctgcaaggcacaatcctgcagtacgtgaagacgttaatcgaagttatgcccaaaatttgtcgtctcccccgacacgagtacggctctccggggatcctcgagtttttccaccaccagctgaaggacataatcgaatatgctgaattaaaaaccgatgtttttcagagcctgcgcgaagtcgggaatgcaatcctcttctgcctcctgatcgagcaggcattatctcaagaggaagtttgtgacttgttacatgctgcccctttccagaatatactgcccagggtttacatcaaagaaggagagcggctggaggtgcgtatgaagcgactcgaggcaaagtatgcccctctgcatttggtcccactaatcgagagacttggtacaccccaacagatagccatcgcccgcgagggtgatttgttgactaaggaacgcctttgttgcggacttagcatgtttgaagtcatccttacccggatccgctcatatttgcaagatccgatttggcgggggccaccgcctactaacggagtgatgcacgtcgatgaatgcgttgaatttcaccggctgtggtcagctatgcaattcgtttactgcatcccggttggcacaaatgagttcacggcagagcagtgcttcggggacgggctcaattgggcaggctgctcaatcattgttctgttgggacagcagagaagatttgatctgttcgacttttgttatcatttgttaaaagtccagcgccaggacgggaaggacgagatcatcaagaatgtgccattaaaaaagatggccgacagaattcgcaaatatcagatcttaaacaacgaggtgttcgccattctgaacaaatatatgaagagtgttgaaacagatagcagtactgtcgagcatgtgcgttgtttccaacctcccatacaccagagtctggccacaacgtgctag

SEQ ID NO: 184576 - DNA, 651 bp, Artificial Sequence
  Description of Artificial Sequence: Synthetic coding sequence
atggccggcagcgtgctgctggacaagcggttccgggccgagtgcaagaattatggggtgatcatcccgtacccgccttccaatcgctatgagacccttctcaaacaacgccatgtacagctcctgggccgaagcattgacctgaacagactgatcactcagcgaattagcgccgcaatgtacaaatctttggaccaagctatttcccgcttcgagtcggaggacctcaccagtatcgtggagctggaatggctgctcgaaataaaccgactgacccatagattgctttgtaaacacatgactctggacagctttgatgctatgtttcgtgaggctaaccataacgtgagcgcgccctacggcaggatcactctgcatgtgttctgggagttgaactttgatttcttacccaattactgctacaacggatctaccaaccgttttgtacgcaccgccagcttccacccgcgtaccactaccaggcaaacttgtcagagacctgccctcctgcctctatggatacaggcctcacagcactgcctgcaacctcatctccagctcctccaagagtttagaggcgctacctcttttcaggattacgctgatagctgggtgatcagagcctccttatggtcctggcgcaactgctag

SEQ ID NO: 184577 - DNA, 3537 bp, Artificial Sequence
  Description of Artificial Sequence: Synthetic coding sequence
atgaccacccacgtgaccctggaggacgccctgagcaacgtggacctgctcgaggagctaccacttccaaacgaacagcccaaccgcgtcgagatctatgagaaaactgtagaggtcctcgagccggaggtgacaaagttaatgaaattcatgtatttccaaagaaaggcgattgagagattttgttccgaagtgaaacggctgtgccacgccgagaggaggaaagatttcgtgtctgaggcctacctgctcacgctgggcaaatttatcaatatgttcgctgtcttggatgagctgaaaaacatgaaatgctccgtcaagaatgatcatagcgcctacaagcgggccgcccagttcctacgcaagatggcagaccctcagtcaatacaggagagccagaatctgtccatgtttcttgcgaaccataaccgcataacgcagtgtcttcaccagcaactggaggtcattcctggctacgaagaactactcgctgatatcgttaacatttgcgtggactactacgagaataaaatgtatctgacaccctcagagaagcatatgttactgaaggtgatggggttcggactctatctgatggatggcaatgtatccaatatatacaaactggatgctaagaagcgcattaatctgtcgaagatcgataaattcttcaagcagctccaagtggtgcccctgttcggggatatgcaaatcgagctggccagatatattaagacctccgcccactacgaagaaaacaagtcaaaatggacctgcacccagtcttctattagcccccagtataacatttgcgaacagatggtgcagattagagatgaccatattaggtttatcagcgaactcgctcgatacagtaactctgaggtggtgacggggtcaggattagactcacagaagagcgacgaggagtaccgagagctctttgacctggccctgcgaggattacaactgctcagtaaatggagcgcgcatgttatggaagtgtatagctggaaactagtgcacccaacagacaagttttgcaacaaagattgcccgggaaccgcagaagaatatgagagggccaccagatataactatacaagcgaagagaagttcgcttttgtggaagtcattgctatgattaagggactgcaggtgttgatggggcgcatggagtcagtcttcaaccaggcaatacgaaacaccatctacgcagccctgcaggattttgcgcaggtaacgctgcgcgagccactcagacaggccgtgaggaaaaaaaagaacgtcctgatctccgttctacaagcaattcgcaagaccatttgcgattgggaaggggggagagagccacctaacgatccatgtctacgaggggagaaagatccaaaaggtggcttcgatatcaaagtgcctcgcagggccgtcggtccctcctctacccagttatatatggttcgcaccatgcttgagtcactcatcgctgataaaagtgggagcaaaaagaccctgaggtcctctctggacggaccgattgtgctggctattgaagatttccataagcagagtttcttcttcacccatttgctgaatatcagcgaagcattacagcagtgttgtgatctttctcagctgtggtttcgcgagttcttccttgaactgactatgggtcggaggatccagttcccaatagaaatgtcgatgccgtggattctgaccgatcatatcctcgaaacaaaagagccctccatgatggagtatgtgctgtatccactcgatctctacaatgattctgcttattatgctctgacgaaatttaaaaaacagttcttatatgacgagattgaggccgaggtaaatctgtgctttgaccagttcgtgtataagctcgctgaccagatctttgcttattacaaagccatggctgggagcgtccttctggacaaaagattccgagccgaatgtaaaaactatggtgtgattataccctatcccccatccaatagatatgagacccttctaaagcagcgccacgtccagctgctcggcagatctatcgatttgaaccgcttgatcacacagaggatctcagctgcgatgtacaaatcactggatcaggcgataagccgctttgagtctgaagacctcactagtatagtagagcttgagtggctgctagaaattaatagactcacgcaccgcctgttatgtaagcatatgacactggacagctttgatgccatgtttagggaggccaatcacaatgtctctgctccctacggcaggataacactgcacgttttttgggaactcaatttcgattttctgcccaattactgctacaacggaagtactaacaggtttgtgagaacggccattccgttcactcaggaacctcaacgagataagcctgctaatgttcagccttactacttgtacggatccaaacctttgaacatcgcgtactctcacatctattccagttacaggaacttcgtgggccctcctcactttaaaaccatctgccggcttctaggctaccaagggatcgctgtagtaatggaggaactgctgaagattgttaagtccctattgcagggcaccatactgcagtacgttaagaccctgatcgaggtgatgcccaaaatctgccgtttaccacgacatgagtatgggtcacccgggatcctagaatttttccatcaccagctgaaagacataatagaatatgccgagttgaaaactgacgttttccagtcattgcgcgaggtgggaaacgccatcctcttttgcctgctgatcgagcaggcactgagtcaggaggaggtgtgcgacctgctccacgcagcgccttttcagaacatcctcccgcgggtgtacataaaagagggagagcggcttgaggtccgaatgaaaagactggaagccaaatatgccccccttcacctcgtgccactcatcgagcggttaggcactccacaacagattgccattgcccgagagggtgaccttctaacaaaagaacgcctctgttgcggcttgagcatgttcgaggtgatcctgacgagaatcagaagctaccttcaagaccctatatggagaggacctcctccaacaaacggggtcatgcacgtggacgagtgcgtggagtttcatcgcttatggagtgccatgcagtttgtttattgtattcctgtgggtacaaacgaattcacagccgaacagtgttttggtgacggcctaaactgggctgggtgttctatcatcgtgctcttgggccagcagaggagattcgacctatttgacttctgttatcatttgttaaaggttcaaaggcaggacggtaaggacgagattatcaagaatgtacctttgaagaagatggcagaccgcattcgtaaatatcaaatactcaacaacgaagtctttgcaatactgaataaatatatgaagagtgtcgaaacagattcatcaacagtggaacatgttagatgttttcaaccgccaatacatcagtcattagctacaacctgttag

SEQ ID NO: 184578 - DNA, 4617 bp, Artificial Sequence
  Description of Artificial Sequence: Synthetic coding sequence
atggagccccggatggagagctgcctggcccaggtgctgcagaaggatgttggaaaaagactccaggtcggacaggagttaattgactatttctcggacaaacaaaagtccgcagacctggagcacgatcaaactatgttggataaactggtggatggacttgccacatcatgggtgaattcttctaattataaagtcgttctccttggcatggatatcctgagcgccctggtgacccgactgcaagatagattcaaagcacaaatcggaactgtcctgccttccctgatcgaccgtctgggcgacgccaaagattcagtgcgagaacaggatcagacactgttgctgaagattatggatcaggctgcaaacccccagtacgtctgggatcgcatgctcggaggctttaagcacaaaaatttccgcacaagagagggtatctgtttgtgtctcattgccacgctcaacgcttccggggcccaaactcttaccctgagtaagatcgtgccccacatctgcaatctgttaggggaccccaatagccaggttcgtgacgctgctatcaacagcttggtcgagatctaccggcatgtgggcgaacgagttcgtgccgacctgtccaagaaagggctcccgcaatcacgcctgaatgtaatttttaccaaattcgacgaggtgcaaaaatccggcaatatgattcagtctgccaacgataaaaatttcgatgatgaggactctgtggacggtaacaggccctcctccgcctccagtacctcttccaaagctcccccctcttctcggcggaacgtcggaatgggtactaccagacgcttaggcagctcaaccctcggtagcaaaagcagtgctgctaaggagggggctggcgccgtggatgaagaggactttattaaggcttttgatgacgtacccgtggtgcagatttattcatctagagatcttgaggagtctatcaacaaaatccgcgaaatcttatcggacgataagcatgattgggaacaacgggtcaatgcactaaagaaaatacggagtctgctcctggccggcgccgcagagtatgacaattttttccagcatttgcggctgttggatggtgctttcaagctgtccgcaaaggacctgcggtcacaggtcgttcgggaggcatgcattacgctgggtcatcttagcagtgtgctgggaaacaaattcgatcacggagctgaagccatcatgcccacaattttcaatctcatcccaaactcagctaaaatcatggccaccagcggtgttgtcgcagtgcggctgatcatccggcacacgcatattcctcgcctgattcccgtgattacttccaactgcacgagcaagtccgtggccgtgaggaggaggtgttttgaatttctggaccttctactgcaggagtggcagacacatagtttggagcggcacatctccgtgttggcagaaacgatcaagaaaggaatacacgacgccgactccgaagctcgaattgaggctaggaagtgttactgggggtttcactctcatttttccagagaggctgagcatctctaccacacactggaatcttcttatcagaaagccctgcagagtcacctcaagaactcagatagcatcgttagcctaccccagtcagataggtcctcttcatcttcccaagagtctctgaatcgacccctgagcgccaagagatctccgaccggcagtaccacatcccgtgccagtaccgttagtaccaagtcagtttccacgacaggctccctccaacggtcccgatcggatatcgatgtgaatgccgcagcgagcgccaagtcaaaagtgtcttcttccagcggtactacacccttcagttctgccgctgcattgccacccggcagttacgcgagcttgggaaggatccgtactcggaggcagtcttcaggaagtgccaccaacgtcgctagtacccctgataatcgtggcagatctcgtgctaaggtagtttcacagagccagaggtccagatctgccaaccccgcgggggcggggtctcggagcagctctcccggcaaactgctgggctcaggctatggaggcctgacagggggttcatctcgggggcctcccgtgacacccagctcagagaaacgttcgaagatcccccgatcccagggttgtagccgcgagacttcgcctaatcggatcggcctggcaagatctagccgaatacctcgccccagcatgtcccagggatgttcaagggatactagcagggagtccagccgtgacactagccctgcaaggggattccctcctttggataggtttggcttagggcagcccgggcgcatccccgggtccgttaacgctatgagagtcctcagtacgtccaccgatttggaagccgctgtggcagatgccctgaaaaaacctgttcggaggaggtacgaaccctacggcatgtactccgacgatgatgctaactcggacgcatcaagtgtctgttctgagcgctcttatgggtcccgcaatggtggtattccccattacctccggcagaccgaggatgtggctgaagtgctgaaccactgcgcctcttccaattggtccgaaagaaaagaaggcttgttaggtctccagaacctactgaagagtcagagaactctatcccgcgtggagctgaagaggctgtgcgaaattttcacccgtatgtttgcagatccccactccaagagagtgttttccatgtttttagaaacgcttgtggactttattatcatccataaggacgacctgcaagattggctgttcgtgttgttgacacagctgcttaaaaaaatgggagctgacctcctggggagcgtccaagctaaggtacagaaggctctggatgttacccgcgattccttcccttttgaccagcagttcaacatcctcatgcgtttcattgtggatcagacccaaactcccaacctcaaggtgaaggttgccatactgaagtatatagagtccctcgcacgccagatggaccctaccgactttgtgaattctagcgaaacgcgcctggccgtgtcgagaataatcacctggacaaccgagccaaagagttccgatgtgcgcaaagccgcccagattgtgttgatttccctattcgagttgaacacaccggaattcactatgctactcggagctctgcccaaaacattccaggacggggccactaagttgctgcataatcacttgaaaaactccagtaatacctccgtcggtagtccgagtaatacaatcggtagaactccctcccgtcatacaagctccaggaccagccctctgacttcccctacgaattgctcccacgggggtctcagccctagccgcttatggggatggagcgccgacggtttggctaagcaccctcccccattctctcaacccaactctatcccaactgcgccttctcataaggcccttagacgaagctatagtccctctatgctggattatgataccgagaacctgaactcagaggaaatttactcaagccttcggggagtgaccgaagccatcgagaagttttcatttcggagccaggaggacttgaacgagcctatcaaacgggatggaaaaaaagagtgcgatatcgtctcccgcgacggaggagcggcatccccagcgacggaaggccgcgggggaagtgaagtggagggaggccggactgctctggacaataagacgtctttgctgaacactcaacctccacgagccttccctggcccacgagcccgggattacaatccatacccttattcggatgccatcaatacatacgataaaactgccctaaaggaggcggtttttgatgacgacatggagcagttaagagatgttcccattgaccacagtgatttggtagcagatcttcttaaagaacttagcaatcacaatgagcgagtagaggaacggaagggcgccctcttggaattgctgaagattactcgagaggattctctcggagtttgggaggagcacttcaagaccatcctgctcttactgcttgagaccctgggggataaagaccactctattcgagccctggcccttagggtgctaagagaaatactacggaaccagcctgcccggttcaagaattatgccgagttaacaattatgaagacactggaggcccacaaggacagccacaaggaagttgtaagggccgctgaggaggctgccagcacccttgcaagctccatccatcctgagcagtgcatcaaagtgctctgtcctatcattcaaactgccgattatcctatcaacctggcggcgatcaaaatgcagactaaggtggtggagcggatcgccaaggagtcactgctacagctgctcgtggacatcattccaggacttctgcaaggttacgacaataccgagtccagcgtaagaaaggccagcgtgttctgcctggtggcaatttactctgtgatcggcgaggacctgaagccacatctcgcccaactgacagggtccaaaatgaaactgctgaatttatacataaaaagagcccagaccaccaacagcaatagctcctcaagttccgacgtttccacacactcctag

SEQ ID NO: 184579 - DNA, 4437 bp, Artificial Sequence
  Description of Artificial Sequence: Synthetic coding sequence
atggagccccggatggagagctgcctggcccaggtgctgcagaaggacgtgggcaagagactgcaagtcgggcaggaattaattgactactttagtgacaaacagaagtcagccgatttagaacacgaccagaccatgctcgacaagttggtagatggcctggccacgagctgggttaatagttcaaattataaagtcgtcctgctgggaatggatatcctgagcgccctggtgactcgcctccaggaccgtttcaaggctcagattggaactgttttgccttctctgatcgatcgattgggtgacgccaaggacagcgttagggaacaggatcagaccttgctgttgaagataatggatcaagctgccaaccctcaatatgtgtgggatcggatgcttgggggattcaagcataaaaatttcagaacaagggagggtatttgcctctgcctgatcgccactttaaacgcatcaggagctcagaccttgactcttagtaaaatcgtgccacatatttgcaatctacttggcgaccccaattcccaggtgagggatgcagctattaacagcttggttgagatctataggcatgtcggggaacgtgtcagggccgatctgagcaagaaaggacttcctcagtcacgattaaacgttattttcacaaagtttgacgaggttcagaagagcgggaatatgatccagtctgccaatgataaaaatttcgatgatgaggatagcgtcgatggcaatagacccagcagcgcctcctccacatcttctaaggctccaccaagtagtcgtagaaacgtcggcatgggcacaactagaagactgggctcatccactctgggttctaaatcctccgccgctaaagagggcgctggggccgttgacgaggaggatttcattaaggcttttgacgacgtgcctgtggtgcaaatctatagctccagggacttggaggagagtatcaataagatccgagagattctgtccgacgacaagcacgactgggaacagagagtgaacgccttgaagaaaatccggagtctactcctggcaggcgccgcggagtacgataacttttttcagcacctgcggctcctcgacggtgcatttaaactatcagcgaaggacctgcgcagccaggtggttcgcgaggcatgcattaccctcggccatctttcgtctgtgctgggaaataagtttgaccacggggcagaggctataatgcccacaatctttaaccttatcccaaatagcgccaagatcatggcgacttccggagttgtagccgtacgtctgataattagacacacccatattccgcgcttgattcctgttattacttcaaactgtaccagcaaaagcgtcgccgtgaggcggagatgtttcgagtttttggacctgcttctgcaggaatggcaaacccactctctggagcgacatatctctgttcttgcagagacaataaaaaaaggcatccatgatgcagacagtgaggctagaattgaggctcgtaaatgctactggggctttcactcgcattttagccgcgaggccgaacacctctatcataccctggaatcatcctatcaaaaagctctgcagtcacatttgaagaattcagacagcatcgtgtccttacctcagagtgaccgttcctcctctagttcccaggaatctctcaataggccgctgtctgcaaagcggtcccccaccggctccacaacaagccgcgcctccacagtgtccacaaagtccgtgtcgacaaccggttcactccagcgttcccgcagcgacatcgacgtgaatgctgcagcttcagccaagtccaaagtatcatctagcagcggcaccacacctttctcatccgcagccgctctgccccctggtagctatgcgtccctggatggcaccaccaccaaggctgaagggaggatccgtaccaggagacagagctccgggtccgcaactaacgttgcatcaactcccgacaatagaggccggagccgagccaaagttgtgtcgcagagccaacgctcaaggagcgccaatcccgccggtgctggaagccgtagttccagccccggcaaactgcttggctccggctacggaggtttaaccggggggtcaagccgaggtcccccagtgacacctagctccgagaagcgttccaagatcccaaggtcccaggggtgttcgcgggaaacttcccccaataggataggactggaccggtttgggctaggccagcccgggcggatacctgggagtgtgaatgccatgagggttttaagcacttccaccgatttagaagccgccgtcgcagacgcactactcttaggggactcacgcagtaagaagaaacctgtgaggagacgctatgaaccatacgggatgtacagtgacgacgacgcaaacagcgacgcatccagcgtttgtagcgagcgctcctacggatcgcgtaacggtggaatcccccactatctgcggcagacagaggatgtcgcagaggtgctgaatcattgtgcttcgtcaaactggagtgagcgtaaggagggtttattaggtttacagaacctcctcaagtcccaaaggaccttgagcagagtagaactcaaacgcttgtgtgagatttttacaagaatgttcgcagatcctcacagcaaagtgttctctatgtttttggagacccttgtcgacttcatcatcatccacaaagatgacctacaggactggcttttcgtgttgctgacacaactcctgaagaaaatgggcgccgatctcctcggaagtgtgcaagctaaggtgcagaaagctctggacgtcacaagggactcttttccatttgaccaacaattcaacatcctcatgaggtttatcgtggatcaaacccaaactccaaatcttaaggtcaaggtagctatcctgaagtacatcgaatccctcgctaggcagatggacccgacagactttgtgaatagctcagagacacgacttgctgtctcccgtatcatcacttggacaacggagcctaagtcatctgacgttcggaaggccgcccaaatagtcctcatctccctgttcgagctcaacacacctgaattcaccatgctgctaggagccctgccaaaaacgttccaggacggcgctacgaagttgctgcacaaccatctgaaaaactctagcaatacctcagttggctctccatccaacaccataggacgtaccccctccaggcacacctccagcagaacttccccccttacatcccctaccaactgcagccacgggggcctgagtccatccatgctggactacgacaccgaaaacctgaactcagaggagatatacagtagtctcaggggcgtcacagaagcaatcgagaagttctcttttcggagccaggaagatctgaatgaaccaattaaaagggacgggaagaaggaatgcgatatcgttagcagggatggcggcgccgcctcgcctgcgaccgagggacggggagggagtgaggtggaaggcggccgaaccgctttggacaacaagacctctttgttgaatactcagcccccccgcgcttttcctgggcctagagcacgcgactataacccatacccatacagcgatgcgataaacacatatgacaaaacagcgctgaaggaggccgtgtttgacgacgacatggagcaattaagggacgttccaatcgatcacagcgatctggtggctgacctgttgaaagagctttcaaatcacaacgagcgggtggaggagcgcaaaggcgcgttactggagcttctgaaaatcaccagggaggatagcctgggtgtgtgggaagagcacttcaagacgatactgttactgttgctggaaacattaggtgacaaagatcacagcatacgcgctcttgcgcttcgtgtcttgagggagatcttgagaaaccaacccgccaggtttaaaaactacgctgagctcaccattatgaagactttagaggcacacaaggattctcataaggaggtggtgcgggctgccgaggaagccgcatccactctcgcaagcagcattcaccctgagcaatgtataaaagtgttatgccctataattcagacagcggattatccaataaatcttgctgctattaagatgcagaccaaggtcgttgagcgcattgctaaggaatccctgttgcaattgctggttgatataattccaggcctgcttcaaggctatgacaatacggagtcgtcagtaagaaaggcctctgtgttttgcctagtggctatctatagtgtgatcggggaggacctgaagccccatctggcacagctcactggctcgaaaatgaaactccttaacttgtatattaagcgagctcagacaactaatagcaattccagtagcagttccgatgtgtctactcattcctag

SEQ ID NO: 184580 - DNA, 4416 bp, Artificial Sequence
  Description of Artificial Sequence: Synthetic coding sequence
atggagccccggatggagagctgcctggcccaggtgctgcagaaggacgttggaaagaggttgcaggtggggcaggagctcattgactacttttctgataagcagaagagcgccgacctggagcatgatcagaccatgctggacaagcttgtggacggacttgctaccagctgggtcaactcttccaactataaggttgtgctcttggggatggacatactctctgcccttgtgacgcgtctgcaggaccggtttaaggcccaaattggtacagtgctgccatccctgatcgaccggctgggcgacgcaaaggactcggtgcgagagcaggatcagacgctcctgctgaagattatggaccaggcagcaaacccacagtatgtctgggatcgcatgctgggggggttcaagcacaagaactttcggactagggaaggaatttgtctctgcctgattgctacccttaacgcatccggcgctcaaactctaacgctatccaaaattgtacctcacatctgcaatctgctaggggacccaaactcccaggtgagagatgccgccataaacagtctcgtcgaaatctacagacatgtcggcgagcgggtgcgcgctgaccttagcaagaaaggattgcctcagagcaggctgaacgtgatcttcactaaattcgatgaggtccaaaagtcaggcaatatgattcaatccgctaatgacaagaacttcgacgatgaagatagcgtggacggcaacaggcctagttccgcatcgagtacaagctctaaagcccctccaagtagccggcggaatgtaggtatgggcacaacacgccgattagggtctagtacgctgggatctaagtcaagtgctgccaaggagggggcgggagccgtcgacgaggaagatttcattaaagcatttgacgacgtaccagtggttcagatatacagctcgagagacctggaggagtccataaacaaaattcgagaaatcctgagcgacgataagcatgactgggaacagcgcgttaatgccctgaaaaagatacgatctttactgctggctggcgcggcagagtacgataacttctttcagcatttaaggctcctggacggggccttcaagctctccgccaaggaccttaggtcgcaagttgtccgcgaagcttgtattaccctcggccatctatcgagcgttcttgggaataagtttgatcacggtgcggaagctatcatgcccacgatcttcaatctgatccccaatagtgcaaaaattatggctacctcaggcgtcgtggcggtgcgactcatcatccggcatactcacataccgcgcctcattccagtgattacaagtaactgcacgagtaaatcagtggccgttaggagaagatgtttcgaatttcttgatctcctgctacaggagtggcagacccactcacttgaaagacatatctctgtgctcgccgagaccattaaaaaaggtatccacgacgccgactccgaggcccgcatcgaggcccggaagtgctattgggggttccatagccatttttctagagaagccgagcatctctaccacactctggagtcaagctatcagaaggctctgcagtcccacctgaaaaattctgatagtatcgtgtcattgccgcagtccgatagatccagctcatcgtcccaagaaagcctgaatagacctctgagcgccaagcggagccccactggaagcacaaccagccgagcttctacggtttcaactaaaagcgtctccacaaccggttcactgcaacggtcgaggtccgacattgatgtgaacgccgccgcgagtgcgaaatccaaggtgtcatccagttccggtacgactccttttagctccgcagcagctctgccccccggctcttacgcttctttggggaggattcgcactcggcgccaaagctcaggaagtgcaactaatgtcgcttcaacaccagacaacaggggacggtctagggccaaggtagtatcccagtcacagaggagccgcagcgccaaccctgcaggggccgggtcccgatcctcttcccctggcaagctgctagggagtgggtacggcggactgactggcggttctagtcgtgggccccctgtcaccccctctagcgaaaaacgtagtaaaattccacgcagtcaaggctgttcccgcgagacttctccaaaccgcatcggcctggatcgatttgggttaggccaacctggccgaattcccggcagcgtgaatgccatgagggtcttgtcaaccagtaccgacctcgaggcagccgtagcggatgccttactgctcggcgatagccggagcaagaagaagcccgtgcggcgacggtacgaaccctatggtatgtactcagacgacgacgcaaattccgacgcctccagtgtttgctccgaacggagctacggtagcaggaacggtggcatcccacactaccttagacagacagaggacgtggctgaggtcttgaaccattgcgcctcctctaattggagcgagcgtaaggaaggtctgctggggctacaaaaccttctgaagagtcaacgaaccctgtccagagtggaactgaaacgtctctgcgagatcttcactcgaatgtttgcggacccgcattccaagcttgttttttccatgtttctcgaaactcttgtggattttatcatcattcacaaggatgacttgcaggattggctgttcgtgctgctcacacagcttctgaaaaaaatgggcgcggaccttctgggatctgtgcaggcaaaggtccagaaggccctggatgttaccagagatagttttccgtttgatcagcagtttaacatcctgatgcggttcatcgtggatcagactcaaaccccaaatctaaaagtgaaggtggcgattcttaaatatatagagtctctggctcgccagatggatcctaccgatttcgtgaactcatctgagacccgtcttgcagttagcagaattatcacctggaccactgaaccaaaaagctctgatgttagaaaagccgcccagattgtcctcatcagcctgttcgagcttaacacacctgaatttacaatgctgctgggcgccctgcctaaaacatttcaggacggagccaccaagttgctccataaccacctcaagaacagttctaacacaagtgttggaagtccaagcaacacaatcggccggaccccttctagacacacctcatccagaaccagtccgctcacaagtcccacgaactgctcccacggcgggctgagcccctcaatgctggattatgacacagagaacttgaacagcgaagagatttacagctctctgagaggcgtcaccgaagctatagagaagtttagcttccggtcacaggaagacctgaatgagccaataaagagggatggtaagaaggagtgtgacattgtctcacgagatggtggagcagcctctccggctactgaggggcgtgggggaagcgaggtggaaggaggacgtacagccctcgacaacaagacgtctcttctgaacactcaacctcctcgagcttttcctgggcccagagccagagattataacccgtatccgtattccgatgcaattaatacttacgataagaccgctctgaaagaggccgtctttgacgacgatatggaacagcttagagacgtgcctatcgaccatagtgacttggttgccgacctgctcaaggagctttctaatcacaatgagcgcgtggaagaacgtaaaggagcactactggaactcttgaaaatcacacgcgaagattcactcggagtgtgggaggagcatttcaaaactatccttttgctgttgctggaaacccttggagacaaagatcatagcattagggcactggctttacgcgtgctccgggagatactcagaaatcagccagcaaggtttaaaaactatgcagagctcacgatcatgaaaacgctggaggcccataaggactcccacaaagaagttgtcagagcagccgaggaggctgctagtacactggcctccagcatccaccctgaacagtgtataaaggtcctctgtcccatcatacaaacagcagattaccccataaatctggctgctattaagatgcagaccaaggtggtcgaaaggatcgcgaaagagtctctcctgcagttattagttgatattatcccgggcctcctgcaaggttacgataacacggaaagctcagtgaggaaggcttccgtgttttgcctagtcgccatttattccgtcattggcgaggacctgaagcctcacctcgctcagctgactggcagtaagatgaaactcctgaacctctatattaagcgagcgcagaccacaaacagcaactcatctagcagttccgacgtcagcactcactcttag

SEQ ID NO: 184581 - DNA, 2115 bp, Artificial Sequence
  Description of Artificial Sequence: Synthetic coding sequence
tgaaccaagttcgacgaggtgcagaagagcggcaacatgatccagtccgccaacgataagaacttcgacgacgaggactcggtcgacggaaatcgaccctcgtctgccagctctacgagctccaaggctcctccttcctctcgcaggaacgtgggcatgggaacgacgaggcggctcggcagcagcactttggggtctaagagttccgcagcaaaagaaggggcgggtgctgtggacgaggaagacttcatcaaggcatttgatgacgtccccgtcgtgcaaatttatagctctcgtgatctggaagaaagcatcaacaaaatcagggaaatcctgtcggacgacaaacatgattgggagcagcgagtgaatgctctcaagaagatcaggagcttgctgttagctggtgcggccgagtacgacaacttttttcagcacctgcgcctgctggatggcgcattcaaactttcagccaaggacttgcggtcccaggtggtgcgagaagcctgcatcaccctgggccatttaagctccgtacttggtaacaaatttgatcacggcgcagaggccatcatgccaacgatcttcaatctcataccaaattctgctaaaatcatggctacctccggcgtcgtggccgtgagattaatcattcggcacacacacatcccacgacttatacccgtaatcacctctaactgcacaagtaaaagtgtggccgttcggaggcgctgcttcgagttcctagatctgctcctgcaggagtggcaaacacattcccttgaacgacacatcagtgtgctcgccgaaacaatcaaaaagggtatccacgacgcggattcagaggctcgaatagaagcgagaaaatgttattggggattccattcacattttagcagggaggcggagcacctgtaccatacactggaaagttcataccaaaaagctcttcagtcgcacttgaaaaacagtgatagtattgtttccctgcctcagagtgataggagttcaagcagttctcaggaaagccttaaccgccctctgtccgcaaagaggtcgccaactgggtccacaacctcccgcgcctcaacagtttctaccaaatcagtgtctacaaccggcagtttacagaggtcccggtcagacatagacgtaaatgccgctgcaagcgctaaaagcaaagtgtcttcatcatccgggactactccattctcgtcggctgccgctttaccacctggctcatacgcatcacttggccgcatcagaacgcgacggcagagcagcggatcagcaactaatgtggcatctacaccagacaacagggggcgtagcagggccaaagtggtgagtcaatcacaacgcagccgatcggcaaacccagcaggcgcaggtagtagaagcagcagccctggaaaactcctggggagtgggtatggagggttgacaggtggctctagccggggtccacccgtgaccccctcatcggagaaaagatcgaagatccccaggagtcagggctgctcccgagagaccagtccaaataggattgggctcgacagatttggactcggacagcctggccgaataccaggctctgtcaacgcaatgcgcgtgctgagtacgtctaccgacctggaagcggctgtcgctgacgccttgctcttaggagactctcggtctaaaaagaagcctgtgcgcagacgctatgaaccctacggcatgtacagcgatgacgacgctaattccgacgcctcctcagtttgcagcgagcggtcttacggcagccgaaatggcggcattccacactacttgcgccagaccgaggacgtcgccgaggtgttgaatcactgcgccagctcaaactggagcgaacgtaaggaaggtcttctggggctgcagaacctgctgaaatcacagcgcacacttagtagggtggagctcaaaaggctgtgcgagatttttactcggatgttcgctgatccccattcaaagattgcagacagtgaggcggagtgtgaggataaagaagggaatctttttcccagcgaggtatcctgtacagtgagcttccagtacgtcttcggcgactcatgcggtttttataataacagctag

SEQ ID NO: 184582 - DNA, 4485 bp, Artificial Sequence
  Description of Artificial Sequence: Synthetic coding sequence
atggagccccggatggagagctgcctggcccaggtgctgcagaaggatgtcggaaagaggctgcaggtggggcaggagttaatcgactactttagtgataaacagaagagtgcagaccttgaacatgaccagaccatgctcgacaagcttgtagacggattagcgactagttgggttaactcgtcaaattataaggtggtgctgttaggtatggatattttatccgctttggttacacggcttcaggatcgatttaaagcccagattggcactgtactccctagccttatcgatcgcctcggtgacgcgaaggattctgttagggagcaagaccagacactcctgttaaaaattatggaccaagcggcaaacccccagtacgtgtgggacaggatgctgggtggcttcaaacacaaaaactttcgcacacgagaggggatttgcctgtgcctcatagcgactttaaatgcaagcggcgcacagacacttacactttctaaaattgtcccacacatctgtaatcttctgggggatcccaattctcaggtgcgagacgcagccatcaactccctggtggaaatctacagacacgtgggcgagagagtgcgtgcagacctatccaagaaagggctgcctcagtctcggctgaacgtaatcttcacaaaattcgatgaggtccaaaagtctggaaatatgatccaaagcgccaatgacaaaaattttgatgacgaggattctgtggacggtaaccgcccctcgtcggccagctccacctccagtaaggcgccccccagtagcaggcggaatgtcggcatgggaactacgagacggctgggttcctcaactctaggttctaaaagtagcgctgccaaagaaggcgccggcgcagtggacgaagaggatttcatcaaagccttcgacgatgttcctgttgttcagatatattcgtcgcgcgacctggaggagagcatcaacaaaatcagggagatactgagtgatgataaacatgactgggagcagcgagttaacgccctgaaaaaaatccggagcttgctgctggcaggcgctgccgaatatgacaatttctttcaacacttacggctcctggatggcgctttcaagctgtccgcgaaagaccttcggtctcaagtggtgagggaagcttgcatcactcttgggcatctgtcttccgtcctgggtaataagtttgaccacggcgcggaggcaattatgcccacgattttcaacctcatccccaattccgcaaagatcatggcaacttccggggtggtggccgtgagactaattattcggcacacacacatcccgcgcctgatcccggtgatcacgtctaattgtacgtctaaaagtgtcgccgtcaggaggcgttgctttgagttccttgatctgttgttgcaggagtggcagacccattcgctggaacgacacatctccgtccttgctgaaactattaaaaagggcatccacgatgcagatagcgaagcgcggatcgaggcaaggaaatgctattggggattccattcacatttcagcagagaagctgagcacctgtatcatactctggagagctcatatcagaaggcattgcaatctcacttgaagaacagtgatagcattgtgagtctgcctcagtcagataggtcatccagctcttcccaggaaagcctcaacaggccattgagcgccaagagaagtcccaccggctccaccacatccagagcctcaacagtcagtaccaagagcgtgagcaccactggcagccttcagcgttcaagatccgatatagatgtgaatgctgccgccagcgctaaaagcaaggtgagctcaagcagcggcaccaccccctttagttcagcagccgcgctcccaccaggcagctacgcctccctaggaagaatcagaaccaggcgtcagagcagtggaagtgcaacgaatgtggcatccacccctgacaatagaggcagaagccgggccaaggttgtttcacaatctcagaggtcacgtagtgctaaccctgctggagcaggctctaggtcgtccagtcctggtaaacttctggggagcggctacgggggccttactggaggctcgtctagagggccaccagtaactccgtccagcgaaaagaggtccaaaataccacgctcccaggggtgttcgcgggaaacgagtcccaatagaatcggactggaccgattcggactgggacagcctggtcggatcccgggatccgtgaacgctatgagagtgctgtctacctctactgaccttgaggcagccgtggctgacgcacttgtgagaggcaccagcaccggcaaaaagaaaccggtgcggcggcggtacgagccatatggaatgtacagcgacgacgacgccaactcagatgcgagttctgtatgcagcgaacggtcttacggcagtaggaatggtggcatccctcattacctcagacagacggaggacgtggcagaagtgttaaatcactgcgcgtcctctaactggagtgagagaaaggaagggttgttaggtctccaaaatttactgaaatcacagcgcacactctcccgggtggaactgaaacgactgtgtgaaatttttacacggatgtttgcagaccctcatagcaaaatcgccgatagtgaggctgagtgcgaagacaaagaaggcaacctgttcccatctgaagtctcttgtaccagggtctttagcatgttcttagaaactttggtcgacttcattataatacacaaagatgacttgcaggactggctgtttgtgcttctgacacagctgctaaaaaaaatgggtgcagatctgctcgggtccgtccaggcaaaggtgcagaaggcactggatgtgactcgagacagctttccctttgatcagcagttcaatatcctgatgaggtttattgtggatcaaactcagaccccaaacctgaaggttaaagtggccatcctgaaatatattgagagtttggcgaggcagatggatcccaccgattttgtgaattcaagcgagactaggttggccgtgagtcgcatcatcacttggactacggagcctaaatcttcagacgtgcgaaaagccgctcagattgtgttaatctccctcttcgaattgaatacgccggagttcaccatgttgctcggagccctgccaaagaccttccaggatggtgccaccaagttgttacataatcatctgaagaattcctcaaatacatcggttggctcacccagtaatactattggaaggactccgtcccggcacacctcttccagaacgtctccattaaccagtccgaccaattgctcacacggcggtctaagcccctctatgctcgactatgataccgagaatctgaattccgaagagatttacagttctctccgcggggtaaccgaggctattgaaaaattttcgtttcggtcccaggaggatcttaacgaaccaatcaagcgggacggcaagaaagaatgtgacattgtgagccgagacgggggcgccgctagcccagccaccgaaggcagaggcggctctgaagtggaagggggaagaaccgccctggataacaagaccagccttctcaatactcagccccctcgcgcctttccaggacctcgagccagagattacaacccatacccttatagtgatgctattaacacatacgataagacagcacttaaagaagccgttttcgacgacgatatggagcaattgcgggatgttccaattgatcacagtgacctggtggccgatctcttaaaggagctatctaaccacaacgaaagagttgaggaaaggaagggcgcactgcttgaattgctgaagatcactagggaagattccctgggcgtttgggaagaacattttaaaaccattcttttgctgctgctggagactcttggggataaggaccattccatccgagctttggccctgagggtcctgagggagatccttagaaaccagccggctaggtttaagaattatgccgagctaactatcatgaaaacactggaagctcacaaggatagtcacaaggaagtggtcagggctgccgaagaagccgcctcaacattggcgagttcaattcatcctgaacagtgcatcaaggtgctgtgcccaatcattcagacagcagactacccgatcaacctggccgctatcaaaatgcaaaccaaggtggtggaacgaatcgcaaaggagtccttactccagcttctcgtggacataatacccgggcttttacagggttatgacaatacagaatcaagtgtacgcaaagcgagcgtattttgcctggtcgctatctattccgtgatcggcgaggacctgaaaccacacctagcacagctgaccgggagcaagatgaaactgctgaatctgtacataaagagagcccagactaccaactctaattcttcatccagctccgacgttagcactcattcatag

SEQ ID NO: 184583 - DNA, 4434 bp, Artificial Sequence
  Description of Artificial Sequence: Synthetic coding sequence
atggagccccggatggagagctgcctggcccaggtgctgcagaaggacgtgggaaaacgcctccaggtgggccaggagctgattgactatttctcggacaagcaaaagtcagctgacctggaacatgaccagaccatgctcgacaagttagttgatgggttagccacctcctgggtgaattcctcaaactacaaggtagtcctgctgggaatggacattctgagcgcacttgtcaccaggctacaggacagattcaaggcccagatcggcaccgttttaccatctctgatcgacaggctcggggacgccaaagactctgtgcgagagcaagaccagaccttgctgctgaagattatggaccaggcggccaaccctcagtatgtctgggacaggatgctgggcggttttaaacacaagaacttcagaacacgcgaggggatctgcctgtgtctgattgctaccttaaatgcatctggggcccagacactcaccctgtcaaagatcgtaccacacatttgtaacctcctgggcgaccccaactcacaagttagagacgctgctataaattcactggtagagatatacaggcacgttggggagcgagtgcgggctgatctgagtaagaagggcctacctcagtcaagacttaacgtgatttttactaagttcgatgaggtccaaaaatccggtaacatgatacagtcggcaaatgataaaaactttgatgatgaggattctgttgacggaaacaggcccagctcagcatccagcacctcctcaaaagcaccaccatcctcccgtcgaaatgtcggtatgggcaccacccgccgattgggaagttcgacactgggttccaagtcatccgctgctaaggagggtgccggcgccgttgatgaggaggactttataaaagcatttgacgacgtcccggtcgtgcagatctactcatctcgcgacctcgaggagtcaattaataagatacgtgaaatcctttcagatgataaacatgactgggagcaacgcgtcaatgcccttaagaaaatccggagcctactactagcgggcgctgccgaatacgacaatttcttccagcacttgagattgctcgatggagcttttaaactttcagccaaagatctccggtcgcaggtagtgcgcgaagcttgcatcactctgggccacctatcaagcgtgttaggaaataaatttgatcacggagctgaggctatcatgccaactatcttcaatctaatcccaaattccgcaaaaatcatggcaacaagtggagtggtagccgtccgactgatcatcaggcacacacacatccccagactaatcccagtgatcacctccaattgtacatccaagtccgtcgctgtgcggcgtcggtgtttcgagtttctggatctgctgctgcaggagtggcagacacactccctggagagacatataagcgttctggctgaaaccatcaaaaaaggaatccacgacgcagacagcgaagccagaattgaggcccgtaagtgctactggggctttcacagtcacttttcccgtgaggcggaacatctttaccacaccctggagtccagctaccaaaaagccttgcagagccacttgaagaacagcgactctattgtaagcctcccccagagcgatcggtcctcgtctagttcccaagagtcattaaatcgccctctgagtgctaagaggtccccaacagggagtactacctctcgggcctctacagtgagcacaaagtcggtatctacaacaggctccttgcaacgatctaggagcgacatagatgtgaacgctgccgcctccgccaagagcaaggtttcctcgtcttccggaacgactcccttctccagtgccgctgccctcccacctggcagctatgctagccttgaatcccgccatatgagggaggatatggaatacatcggcctggactctggcaggatcagaacccgacggcagtcatccggaagcgcaactaatgtcgcttctacccctgataatcggggacggtcccgggctaaagtcgttagtcaatcccagcctggcagccggtccagctcacctgggaaactcctcgggtccgggtacggcgggttgaccggcggctcttccaggggcccgcctgtgacccccagttccgagaaaagatccaagattccacgctcacagggttgctccagagagacctctccaaacaggattgggctggacagattcggtctcggccagccaggcaggattccggggtccgtcaatgcgatgcgggtcctctccacctctaccgaccttgaggccgccgtggctgatgctttgctgctgggcgactctcggagcaagaagccggtaagacgaagatacgaaccctacgggatgtatagcgatgacgacgccaatagtgatgcctcatccgtgtgcagcgagaggagctacgggtcacggaacggaggcataccgcattatttgcggcagaccgaagacgtcgccgaggtgcttaaccactgtgcaagctcaaattggtccgagcggaaggaggggctgctgggattgcaaaacctgctgaagtctcagcggacattgtctcgggtagagctaaagagactctgcgagatatttaccagaatgttcgcggacccacattctaagcgcgtattctccatgtttctcgaaactctggtggattttattattatccacaaagacgatctacaggattggttgtttgtcctgttaactcagttactgaagaagatgggcgccgatctcctgggctctgtccaggcaaaggtccagaaagcactggatgtgacgagggattcattcccatttgatcagcagtttaacatcctaatgcgcttcatagttgatcaaacccaaaccccaaacttaaaggttaaggtcgccatcctcaaatacatagaaagtcttgctagacaaatggacccgaccgattttgtgaattcttcagaaactaggctagccgtgtccaggataattacatggaccacagaacccaagtccagcgatgtacgcaaagctgctcagattgtcctgatctctctctttgaactcaacacacccgaattcaccatgctgcttggagctctgcctaagaccttccaggacggagccaccaaacttctgcataatcacctgaagaacagctcgaatacctcagtggggtctcctagcaacactattggtcgaactccatccagacatacaagctcgcggacatcacccctgacatcaccgactaactgcagccacgggggactatctccgtcaatgttggactatgacaccgaaaacctgaattccgaggagatctatagtagcctccggggagtcactgaggcaatagagaaattcagctttagatcgcaggaggatttaaatgaaccaatcaagagggacggaaagaaggaatgtgacattgtgtccagggacggtggggccgctagccctgccacagagggtcggggcggaagcgaggtcgagggagggaggacggcactcgacaacaaaacctcactgttgaacactcaacccccacgcgcctttccaggaccacgcgcacgggattacaatccgtacccatacagcgacgcaataaacacatatgataaaacggccctgaaagaagctgtctttgatgacgatatggagcagctgagagatgttccaatcgatcattcggaccttgtggcagatctgctgaaggagctgagcaaccataacgagcgggtcgaggagcgcaagggtgccttgttggagctccttaagattactcgagaggatagccttggtgtgtgggaggagcacttcaagaccatcctccttctgctattggagactcttggtgacaaggatcattccataagggccctagctctgcgtgtcctgcgggagattctgcgaaaccagccagctaggttcaaaaattacgctgagctcaccattatgaagacacttgaggcacacaaggactctcataaggaggttgtgagggcagccgaagaggcggctagcactctggcgtcaagtattcaccctgagcagtgtataaaagtgctgtgtccaataatacagactgcggattatccgatcaacctggctgccataaaaatgcagaccaaagttgtcgagcgcatcgccaaggaatctttactccagctcctagtggacatcatacccggcctgttgcagggttacgataacactgaatccagcgttcgtaaagccagcgtgttctgcctggtcgcaatttacagcgtgattggggaggatctgaagccacatctcgctcagctgaccgggtccaagatgaaactcctcaatttatacatcaagagggcgcaaactactaacagcaattccagctcatctagcgatgtctctacacactcttag

SEQ ID NO: 184584 - DNA, 3768 bp, Artificial Sequence
  Description of Artificial Sequence: Synthetic coding sequence
atgctgcagaactgcagcgacaagaacttcgacgacgaggacagcgtggatggtaataggccgtcgtcagcgagttcaactagtagcaaagcgccgccttccagccgaaggaatgtgggcatgggcacaacacggagactcggctcctccaccctggggagtaaatctagtgccgccaaagagggggcgggtgcggtagacgaagaggactttatcaaggccttcgacgatgttcccgtggttcagatttactcctcgcgggacctggaagagtcgattaacaagattagggagatcttatccgacgataaacatgactgggagcagagggtaaatgctctcaaaaagattcgcagcctactgcttgctggcgcagcagaatatgataacttcttccaacacttgcgcttgttggacggggcctttaaactgagcgcaaaggatctacgcagccaagtcgtacgggaagcttgtattaccctggggcatctcagctccgtgttggggaacaaattcgaccacggcgccgaagcaattatgcccacaatctttaacctgattccaaactctgcaaagatcatggcgaccagcggggttgtggccgttaggctaatcatacgtcacacgcacattccacggctaatcccagttatcacgagcaactgcacatccaagtcggtggccgttcggcggaggtgctttgaatttctcgacttgctcctccaagaatggcagacccacagtctggagcgccacataagcgtgctcgcagagaccattaaaaaaggaatccatgatgccgactcagaggcccgaatcgaggcaaggaaatgctactggggcttccactcccatttttctcgggaagcagagcatctttatcacactctggaaagttcctaccagaaagctctccagagccacttaaagaatagcgactctattgtgtcacttcctcaaagcgacagatcgtcatcatcctcccaagagtctttgaacaggcccttgagcgctaagcggtctcctaccggcagtaccacctctcgggcttcgactgtttctaccaaaagcgtgtccaccactgggtccctgcagcgctccaggtcagacatcgacgtcaatgccgctgctagcgccaaatccaaagtgtcatcatccagcggaactacccctttctcatccgctgccgcactgccgccggggtcctatgcttccctcggtcggatccgaacaaggcggcagtcgagcggctccgccaccaacgtcgcttccacgccggacaatcgtggacgatctcgggcgaaagtggtatctcaatcccagaggtctcggtccgctaaccccgccggagccggaagcagatcctctagtccgggtaaacttctcgggtccggttacgggggcctcactggtggtagcagccgcggccctccagtaacaccaagcagtgaaaagcgctctaaaattcccaggtcccaaggctgcagtcgtgaaacatcacccaaccgaatcgggctggaccgctttggacttggtcagccaggacgtattcccggctccgtgaacgccatgagggtacttagtaccagcacggacttggaggccgcagtggcggacgcgctgaagaaaccggtgaggcgcagatacgagccatacggaatgtactctgacgatgacgctaactcagatgccagcagcgtgtgcagcgaaaggtcttatgggtccaggaatggggggattccccattacctgcggcagacagaagatgtcgcagaagtgctgaaccactgcgcatcatcaaattggtcagagcggaaagagggcctgctgggtcttcagaatttgctgaaaagtcagcgcacactaagccgggtggagctaaaacgcctctgcgaaattttcacaagaatgtttgctgacccccactctaagatcgctgattccgaggctgagtgtgaagacaaggaggggaacttattcccatccgaggtttcttgcacgcgagtgttctcgatgtttcttgaaacattggtggactttataatcatccataaggatgacctccaggattggcttttcgtgctgttgacccaacttcttaagaagatgggtgctgatttactgggatctgtccaggcaaaagtccagaaggccctcgatgtcacaagggattccttcccatttgatcagcagtttaacattctgatgagatttatcgtcgatcagactcagacaccaaatttaaaagtgaaggtggccatcctgaaatatatcgaaagcttggctcgtcagatggaccctaccgatttcgtgaattccagtgagacgcggttggccgtgagccgaatcatcacttggaccaccgaacccaagtctagtgacgttcgcaaggcagcccagattgtcctgatttccctgtttgagctgaacacccctgagttcacaatgctgctgggagcacttcctaagacctttcaagacggcgccacaaaactcctgcacaatcacctgaaaaatagctcaaatacctccgtgggttcaccctcaaacactataggccggactccgtcaagacacacttcatccaggaccagccctttgacctccccgactaattgctcacatggaggtctgtccccatccatgctcgactatgatactgaaaacctgaacagtgaggagatctattccagtcttcgcggggtgacagaagcaattgagaaattttccttcaggtcccaagaggatcttaatgaacccattaagagagatggcaagaaggagtgtgacattgtgagtcgagatggaggggcagcctcccctgcgacagaggggcgcggtggaagcgaggttgaaggaggccggactgctctcgacaacaagacatcactccttaatacgcaaccacctcgggcttttcctgggcctagagcccgagactataatccgtacccgtactccgacgctatcaacacttatgataaaaccgccctgaaagaggcagtcttcgacgatgacatggagcagctgagggacgtgcccattgatcacagtgacttagtggccgatcttcttaaagaactgagcaaccacaacgagagagtggaggaacggaagggtgccctgctggagctgctaaaaattactcgagaggacagcctgggcgtgtgggaggagcactttaagaccatcctgctgttgcttcttgagacgcttggtgataaggatcattccatccgggcacttgcactgagagtgttgcgtgagatactgaggaatcagcctgctcgtttcaaaaactacgcggagttgacaattatgaagaccctggaggctcacaaagattctcacaaagaggttgtgagggccgctgaggaagcagccagtaccctcgccagttctatccatcccgagcagtgtatcaaagtcctttgtcctatcatccagaccgcagactatccgataaacctggccgcaataaaaatgcagaccaaggtggtcgaacgcatcgccaaggaaagcctcctccaacttttagttgatattattccagggctgctccaagggtatgacaatacagaatcttcagtcagaaaagccagcgtgttttgtctagttgcaatttatagcgtgatcggtgaggacctgaagccacacctagctcaactgaccggatcaaaaatgaagctgctaaatttatatatcaaaagagcccagactacaaattcaaatagctcctcttctagcgacgtctcaacccattcctag

SEQ ID NO: 184585 - DNA, 3738 bp, Artificial Sequence
  Description of Artificial Sequence: Synthetic coding sequence
atgaccaccggcaaggacaagaacttcgacgacgaggacagcgtggacgggaacaggccctcttccgccagctccacatcttccaaggcgccccccagttcacgacggaatgtggggatgggtaccacccggcggttagggtccagtactctggggagtaaatcttcagctgcaaaggagggggcgggcgcggttgatgaagaagattttatcaaagcatttgacgacgtgcctgtggtgcagatatacagctcccgagacctggaggaaagtatcaacaaaatccgtgagattctgagcgatgacaagcacgattgggaacagcgggtgaatgctctgaagaagattcggtccctgctgcttgccggcgccgccgagtatgacaacttcttccaacacctccggctgttggacggcgccttcaaactgtctgccaaggacctgcgctcacaggtggtaagagaggcttgtatcactctgggccacctctcgtcagtgctggggaataagtttgatcacggcgccgaggccatcatgcccacaattttcaatctgattccgaattctgcgaagatcatggctacaagcggtgtggtagctgtgaggctgataattcgccacacacacatccctcgattaattcctgttatcactagcaactgtacatccaagagcgtcgctgtgcgtcgaaggtgcttcgaatttcttgatttgcttcttcaggaatggcagacacatagcctggagagacacattagtgtgctggccgagactattaagaaggggatccacgatgctgattctgaagctcgaatcgaggctagaaagtgttattgggggttccactctcatttttcccgagaagccgagcacctgtaccacaccctggaatcgagctatcagaaagcactacaatcccacctgaagaattctgacagcatcgtgtctctgcctcagtcagacagatcttcaagctcaagccaggagtccctgaaccgaccactgagcgcgaaacggagcccaacagggtcaaccaccagccgagccagcaccgtttcaactaaatctgtttcgaccacaggctcactgcaacgctcacgaagtgacatcgacgtcaatgccgcagcttcagccaagagcaaagtgtcatcctcctccggcactacccctttctcttcagccgctgcgcttcctcccggttcctacgcttctctggatggtaccacgacaaaggccgagggaaggatccgcacaagacgccagtcctcggggtctgccacaaacgtggcctctactccagataatagaggccgtagccgggccaaggtggtcagccagtctcagagatctcgcagcgcgaatccggctggcgctggatcgcggagcagcagccccgggaagttgctggggagcgggtatgggggccttacaggaggcagtagccgtgggcctccagttacaccatcctccgagaaaagatcaaaaattccacgcagtcaggggtgtagtagggaaacaagccctaacaggatagggttagatcgcttcggcctgggacagccaggcaggattcccggatctgtgaacgccatgagagtcctcagtactagcacggacctcgaggctgccgtggcagatgcgctattacttggcgattcccgctcgaagaagcctgtgcgccggcgttacgaaccatacggaatgtattccgatgatgacgccaattctgatgcgagcagtgtctgttccgaacggtcttatggctcccgtaatggtggtatcccccattatctaagacaaaccgaggatgtcgctgaagtcctcaatcactgcgcatctagcaattggtcggaacgcaaggaggggttgctgggcctgcagaatcttctgaaatcccaaagaaccctgtcaagagtcgaactgaaaagactgtgtgagatcttcactagaatgtttgccgatcctcacagcaaagtgttttctatgtttctcgaaactctggtcgattttatcataattcacaaggatgacttacaggattggctgttcgtgttgctaacacagctgctcaaaaaaatgggtgcagacttacttggaagcgtgcaggcaaaagtgcagaaggctctggacgttactcgggattcattcccgtttgatcagcagttcaacatcttgatgcggttcatcgtcgaccagactcagactccaaacctgaaagttaaggttgcaatcttgaaatacatcgagtctctggcccggcagatggaccccaccgattttgtcaattcctccgaaacccgtctcgcagtgagccgcattatcacatggaccaccgagcccaaaagctcggatgtgagaaaggccgctcaaattgtgctcatctcgttgttcgaacttaatacaccggaatttaccatgctgttgggcgcacttcctaaaaccttccaggacggagctactaaactattgcacaatcacctcaaaaacagctcgaatactagtgtcggtagccctagcaatactatcgggcggacaccttcaaggcatactagttctcggacgtcaccactgacatccccgacaaactgctctcacggcggactcagtccatccatgctggattacgacacagagaatctgaactccgaggagatctattcaagtctgcggggagtgacggaagcaattgaaaaattcagtttccggtcccaggaagacctcaacgagcccataaagagagatggcaagaaggagtgcgatattgtcagccgcgatggcggagcagccagtcctgccaccgagggcagggggggtagtgaggtggagggtggcagaactgccttagacaacaaaacttcccttctcaacacccagccgccccgtgccttccctgggccaagggcacgggactacaacccatacccatacagtgatgctataaacacttacgataaaactgccctgaaagaggcagttttcgatgatgacatggaacagttgagagatgtgccgatagaccactccgacctcgtggctgatctcttaaaggagctcagtaaccacaatgaacgggtcgaggagcggaagggcgcactgctcgagctcctcaaaatcacacgagaggattctctcggtgtttgggaagagcactttaaaacgattctgctgttgttgctggaaaccctgggcgacaaagatcactcaattagggctctggcccttcgagttcttcgggaaatccttcggaatcagccggccagattcaagaactacgcggagttgacaattatgaagaccctggaagcccataaggacagtcacaaggaggtggtgagagctgccgaggaagcagcgagcactcttgctagctcaattcatcctgaacagtgtattaaagtgctatgcccaataatccagactgctgactaccctattaatctcgctgccataaaaatgcagactaaagtggttgagcgaatcgctaaagaatccttgcttcaactgctggtcgacataatcccagggctgcttcagggctacgacaatacagagagcagcgtccggaaggcctccgtgttctgcttggtggcgatttactccgtgatcggggaggatttgaagccacacttggctcagctgaccggaagcaaaatgaagctgttaaatttatacatcaaaagagctcagacaactaactctaactcctccagcagtagcgatgtgagtactcactcatag

SEQ ID NO: 184586 - DNA, 2988 bp, Artificial Sequence
  Description of Artificial Sequence: Synthetic coding sequence
atgggcctgcggaaccacttccccggcgaggccgagaccctgtacaacagcctggagccttcctaccaaaagtccttacaaacttatctgaagtcctctgggtctgtggcaagtcttccccaaagtgacagaagtagtagcagtagccaggagtctttgaacaggcccttttcctccaagtggagtaccgcaaaccctagcacagtggccggccgggtaagcgccggttcatccaaagcgtcaagtttgcctgggtctttacagagaagcaggtcggatatcgatgtcaacgccgcggccggggccaaggcccatcacgcagcgggccagtctgtccgttctggtagactcggcgccggcgcgctgaacgccggatcttatgccagcctggaagatacttcggacaagttagatggcacggcgtcagaggatgggagagtgagggctaagttaagcgcaccccttgctggaatggggaacgccaaagctgactcacgtggaaggagtagaactaaaatggtgagtcaaagccagcccggtagtcggtccgggagccctgggcgcgtgttgaccacaaccgccctgtccaccgtctctagtggcgtgcagagagtactggtgaatagcgcttcagcacagaagaggagtaaaatccctcgcagtcagggttgctcccgagaggcgagtccgtctcggctttcggtggcgagaagtagtcgcattcccaggccctctgtgtcacagggatgtagccgtgaagcaagcagagaatcctctcgggacaccagccctgtgcgatctttccagccactggggccaggctatggaatctctcagtcgagccggctcagctctagcgtgagcgcaatgcgtgttctgaacacaggcagcgacgtggaggaggccgtcgctgatgcactaaaaaaaccagcccgccgaagatatgaaagttatggcatgcacagtgacgacgatgccaattctgacgcatcctcagcttgtagcgaacggtcctatagctctaggaacggttccattcccacctatatgcggcaaactgaagatgtggctgaagttctaaatcggtgcgcatcatctaactggagtgaaaggaaggagggtctgcttggcctgcaaaacctcctgaaaaatcagcgcactctgagccgcgtggagctaaagagactctgcgagatcttcacacggatgtttgccgatccacatggaaagcgtgtattcagcatgttcctcgaaacattggttgatttcatccaggtgcataaggacgacctgcaagactggctcttcgtgctgctgacccagcttctgaagaaaatgggcgcagacctgctgggatccgttcaggcgaaagtccaaaaagccctggacgtcacaagagaatcattccccaatgaccttcaattcaacattctcatgagatttactgtggaccagacgcagacaccaagtttaaaagtgaaagtggctattctcaaatacatcgagacactggctaagcagatggacccaggcgactttatcaactcctccgaaactaggttggctgtgtcaagggtgatcacttggacgacagaacctaagagcagtgacgtccgaaaagctgcccagagcgtgcttataagtttattcgagctcaatactcctgaatttactatgctactgggcgctctccctaagacatttcaagacggggccacaaagttactacataaccacctaaggaatacagggaacgggacacagtctagcatggggtcccctttgactagacctactcctcgctcgccagcgaactggtcatccccccttacaagtccaacaaatacatctcaaaataccctgagtccctccgcgtttgattatgataccgaaaatatgaacagtgaagacatctatagcagcttgagaggcgtgacagaagccattcagaatttcagcttcaggtcccaggaggacatgaatgagccccttaagcgtgactccaaaaaggatgatggtgatagcatgtgtgggggcccaggcatgagcgaccctagagcggggggcgatgcgactgactcaagtcagacagcacttgacaataaggcatccctcttgcactctatgcccactcactcatcacctcgatcaagagattataacccctataactacagcgatagtatctccccttttaataaatctgctctcaaggaggccatgtttgatgatgacgcagatcaatttcccgacgacctctcgctggaccactccgatctagtagcagaactgctcaaagagcttagtaaccacaatgaacgagttgaggaacgcaagatagcactgtatgagttgatgaagttgactcaggaggagtccttttcagtttgggacgagcactttaagacgatcctgctactgcttctcgagactctaggggacaaagagccaactatcagagccctggcgctcaaagtgctccgggagatcttgcggcaccaacccgcgcgctttaaaaactacgctgaactgaccgtgatgaaaacgctggaggcccacaaggatccgcataaagaggtagtgcgcagtgcagaagaagccgcgagtgttttagccacttccatatcaccggaacagtgtatcaaggtgttgtgcccaatcattcagacagccgattatcccatcaacctggctgccatcaagatgcagaccaaagtgattgagagagtatccaaagaaaccctcaacctactgcttcctgagatcatgccgggcctgatacaaggctatgacaattcagagtccagcgtgcgtaaggcctgcgtcttctgcctggtggccgtacatgcagtgattggtgatgagcttaaaccccatctctcccagctcacaggttccaaaatgaagctgttgaacctttacattaaaagagcacagacagggtccggcggcgccgatccaaccacagatgtcagtggccagagctag

SEQ ID NO: 184587 - DNA, 1296 bp, Artificial Sequence
  Description of Artificial Sequence: Synthetic coding sequence
atgcggcggctgatctgcaagcggatctgcgactacaagagcttcgacgatgaagagtctgtcgacggtaaccggccttcctcagccgcttccgcctttaaagttcccgcccccaagacctccggtaaccctgcaaacagcgcaaggaaacccggcagtgcaggaggccccaaggtgggcggcgcttcaaaggaggggggcgctggggcggttgacgaagacgattttattaaggctttcacggatgtcccttcaatccagatatactcgtcacgagaattggaggaaactctgaataaaatacgggaaattttatctgatgacaaacacgattgggaccagcgagccaatgctcttaagaagatccggtcccttctagttgctggggccgcgcagtatgattgtttctttcagcatctgagactgctggacggcgctcttaagctctcagctaaggatctgagaagccaggtggtacgagaggcatgcattacagttgcacacctgtccacagtgctgggaaataagttcgaccacggggccgaggctatcgtgccaactctatttaatcttgtgccaaacagtgctaaagttatggctacaagcggctgtgctgcgattcggtttattatccgacatacccatgtgccaaggttaattcccctgatcacgtcaaattgcacatctaagtcggtgcccgttagacgtagatctttcgaattcctggatctactgttacaagaatggcaaacacattccctggaacgccatgccgccgtgcttgttgagacaataaaaaaagggattcacgacgccgacgccgaggctcgcgtagaagctcgtaagacatacatgggtttgcgaaaccacttccctggagaggccgaaacactttataacagcctggaacctagttatcagaagtccctgcagacgtaccttaagtcttccggctcagttgcctctctacctcaatccgacaggtcctcgtcgagcagtcaggagtcactaaacaggccattttcttccaagtggtcaaccgccaatccttccacagtcgcaggaagagtctcagctggaagcagcaaagcatcttcactccccggcagcttgcaacgctccagaagcgacatagacgttaacgccgcagccggagctaaggcccaccatgctgccggccagagcgtgcggagcggccgcctgggcgctggcgctctcaacgcgggaagctacgccagtctcgaatgtgaagccttctggaggtccggcagaaccgctaagttgtacagtgtctag

SEQ ID NO: 184588 - DNA, 4518 bp, Artificial Sequence
  Description of Artificial Sequence: Synthetic coding sequence
atggagccccggagcatggagtacttctgcgcccaggtgcagcagaaggacgtaggagggcgactacaagtcgggcaggagctgctgctgtatctcggcgccccaggggccatttcggatttagaggaggatcttggcaggctcgggaaaaccgtggatgctctcaccggctgggtgggatcttccaattatcgagtgtccctaatgggcctggagatccttagcgcgttcgtggacaggctctcaacgagattcaagtcgtatgtcgctatggtgatcgtggctcttattgatcgcatgggcgacgcgaaagataaggtgcgcgatgaggctcaaacccttatcctcaagttaatggatcaggtggcaccgcccatgtatatatgggagcagctggcctccgggttcaaacacaagaatttccggtcacgggaaggagtgtgtctctgcttaatcgaaacccttaatatttttggggcacagcccctggtcattagtaagcttatccctcatttatgtattctcttcggcgattcaaattcacaagttagagatgccgcgatccttgcaatcgtagagatctatcgacatgtgggagaaaaagtacgcatggacctatacaagaggggaatccctcccgcacgacttgagatgatttttgcaaagttcgacgaagttcaatcctccggaggcatgattctgtcagtgtgtaaggacaaatcattcgatgatgaggaatctgtagatggcaatagaccctccagcgccgcttctgccttcaaagtccctgctcctaagacttcagggaatccagccaactcagccaggaagcctgggagcgccgggggacccaaagttggcggtgcttccaaggaaggtggtgccggcgccgttgatgaggatgatttcataaaagcctttacagacgtgcccagcatccaaatttactccagtagggaactagaggagactcttaataaaatcagggagatccttagcgatgataagcatgactgggatcaaagggcaaatgcgctcaaaaagatcagaagtctgcttgtggctggtgcagctcagtacgattgtttcttccagcacctgcggctgctggacggggctctgaagctgagcgctaaggacctccgtagccaggttgtgcgggaggcctgcataaccgtggcccacctcagcaccgtgttaggtaataaattcgaccatggtgcagaagccattgttcctacactatttaacctggtgccaaactcagccaaggtgatggcgacctccgggtgcgccgccatacggttcataatccgccacacccatgtcccacggctgattcccctgattacgtcaaattgcactagcaagagcgttccagtgaggaggcgcagtttcgaatttttggatctgctactgcaagagtggcagacccatagcctggagcgtcatgctgccgtgctagtggagacgatcaagaagggaattcatgatgcagacgcggaagcaagagtagaggctcgaaagacgtacatgggactgcgcaaccattttcctggcgaagcagagactctgtataacagtctggaaccttcttaccagaaatctctgcagacatacctgaagagcagtggttccgtggcatctctcccccagtcagacaggtcgagttcgtcttcacaggagagcttgaatcgaccgtttagttcaaagtggtccaccgctaacccttctactgtggctggcagggtaagtgctggaagcagtaaggccagttcattgcctggatccctgcagagaagccgctccgacatagacgtgaatgccgccgccggcgctaaagcacaccatgcagcaggccaatctgttagaagtggccggctcggtgcaggtgccctgaatgcaggtagctatgctagcttagaagatacttccgacaagttagacgggacagccagcgaagacggcagagtgagagctaagctgagcgctccacttgcaggcatgggcaatgcaaaggcagattcgagaggccggtcccggaccaaaatggtcagtcagtctcaacccggcagccgttcagggtcacctggtcgcgtactaactaccaccgccctgtctacagtatcctctggcgtgcagcgggtgctcgtgaacagtgcctccgcccagaagcgtagtaagatccctagaagccagggatgtagtcgcgaggccagtcctagcagactctctgtggcaagatcatccagaattcctcgtccttcagtttcacaggggtgctcccgtgaggcgagtcgggagtccagcagagataccagcccagttcgttcttttcagcccctcgggcctggctacggcatttctcagtcctcaagactgtcatcaagcgtgtccgcgatgcgcgtgctgaataccggttctgacgttgaggaggcagtggccgatgcattgaagaaacctgcgcgtcgtcgctacgagagctacggcatgcattcggatgatgatgcgaatagcgatgcatccagtgcatgtagtgagaggtcctattccagtagaaacgggtctatccccacctacatgcggcagaccgaagacgtcgcggaagtcctgaaccgttgcgctagctcaaattggagtgaaaggaaggagggcttacttgggctgcaaaatttgctgaagaatcagcgcactctaagccgtgtggagttgaagcggctgtgtgagatcttcactagaatgtttgctgacccacacgggaaagtcttttcaatgtttctggaaacattagtggactttatccaggttcacaaagacgacctgcaggactggttgttcgtgctcctgacgcaactgctgaagaaaatgggcgctgacctattgggtagcgtacaggctaaagtccagaaggccctcgatgtaaccagggaatcctttcccaatgacctccagttcaatatattaatgcgatttaccgtagatcagactcagactcccagtctcaaggtcaaagtcgccatattaaaatatattgaaactctggccaagcagatggaccctggagattttattaattctagtgaaacgcggttggccgtgtcacgagtgatcacatggacaactgagcctaagtcttcggacgtgaggaaggccgcccaatccgtgttgatctctcttttcgagcttaatactccagaatttacgatgctcctcggagccctgcctaagacatttcaggacggcgccacgaaacttctgcacaaccatttgagaaacaccgggaacggtacacagtcaagtatggggtcaccgcttacaagaccgacccccagaagcccagctaattggtcaagccccctcacatccccaaccaatacatcccagaatacgctgtccccttccgcatttgattacgacacggagaatatgaactccgaggacatttactcatccttgcggggggtgacggaagccatccaaaacttttctttccggtcacaggaagatatgaacgagccactgaagcgggattcaaagaaggatgatggcgattcaatgtgcggcgggccgggtatgtcagaccccagggctggcggggatgctaccgattcgagccagaccgcactagataataaggcatctctgctccatagtatgcctacccatagctccccccggagcagagactacaatccttacaactactctgattccataagcccgtttaataagtcagcgctgaaggaggcaatgtttgacgacgacgccgatcaatttcctgacgacctgtccttggaccattctgacctggttgctgaattgctgaaggaactaagtaaccacaacgagagagtcgaagaacgaaaaatcgctctgtatgaactgatgaagttaacgcaagaagagtctttctccgtgtgggacgagcactttaagacaatcctccttctgcttctagaaacactgggcgataaggaaccaacaattcgtgccctggcattgaaagttcttagagagatcctccggcaccaacccgccagatttaaaaattatgctgaactgacagtgatgaagacactggaggcccataaagatcctcataaggaggtagtgcgttcggcggaagaggccgcctcggttttggcgacatccatatctccggaacagtgcatcaaagtcctgtgccccataatacagaccgctgattaccctattaacctggccgcaatcaagatgcagactaaagttattgaacgggtgtctaaggagactcttaaccttcttctgcccgagattatgccgggtttaatccaggggtacgacaattctgagtcttcagtcaggaaagcatgtgtattttgcctcgtagccgtgcatgccgtgattggcgacgaattgaagcctcatctgagccagctcaccggatcaaagatgaagctgctcaacttgtatatcaagcgggcgcagacaggctccgggggggcggatccgacgactgacgttagtggtcagagctag

SEQ ID NO: 184589 - DNA, 4542 bp, Artificial Sequence
  Description of Artificial Sequence: Synthetic coding sequence
atggagccccggagcatggagtacttctgcgcccaggtgcagcagaaggacgttggcggtcggctacaggtcggccaagagcttttactatatctgggcgcacccggcgccatttctgatcttgaggaagacctgggtagactagggaagaccgtggatgcccttaccggctgggtgggatccagcaactatcgcgtgtctctgatgggcctggaaattttgagtgcgttcgtggacaggctttctacccgctttaagtcctacgtggccatggtgatcgttgcgctcattgaccgtatgggcgacgccaaagacaaggttagggatgaggctcagacactaatcctgaagctgatggatcaggtggccccccccatgtatatctgggaacagctcgccagtggatttaaacacaagaacttccggtcgcgagagggcgtatgtttatgtctgatagaaaccctcaatatcttcggggctcaacctttggttatttctaagctgatccctcatctctgcatcctgtttggggacagcaattctcaggtgcgtgatgccgcgatcctggctattgtggaaatttaccggcacgtgggggagaaagttagaatggacctgtacaagcgcggaatcccacctgcccgactcgagatgattttcgccaagttcgacgaggtccagagttcaggtggaatgattctgtctgtttgtaaggataagtcttttgatgacgaggagtcagtggatggaaacagaccaagctctgcagcttccgcatttaaagtccccgcccccaagacgtccggcaatccagcaaacagcgccagaaagcccggctcagcaggcggcccgaaggtcggcggcgcctcaaaggagggcggggccggtgctgtcgacgaggacgactttattaaggctttcaccgatgtccccagcatccagatttacagctcccgagaactagaagagacattaaacaaaatccgagagatcttgtcagatgacaagcatgactgggatcagcgggccaacgccttaaagaaaattcgatcacttttggtcgcaggtgcagcccagtacgactgcttcttccagcatctgcgcctactggacggtgcattaaagctgtcagcgaaagacctgagaagtcaagtcgtgagagaagcgtgtatcaccgtcgcacatctgtccactgttctgggtaacaagtttgaccatggcgcagaagccatcgttccgaccctcttcaacctggtgcctaattccgctaaggtgatggccactagcggatgcgcagccatccggtttatcataagacatacgcacgtaccccgattgatccctctcatcaccagcaactgcactagtaaaagcgttcctgtacgacggaggagcttcgaatttctcgatctgctgctccaggaatggcaaacccattccctggaacgccacgccgccgtgctggtggaaaccatcaagaaggggatccacgacgctgacgcagaagccagagttgaagcgagaaagacctacatgggacttcgtaatcacttcccaggcgaagcggaaactctgtataactctttagagccttcctaccagaagtccctgcaaacgtatctgaagagttccggctccgtcgcctcccttccacaaagcgaccggtcttcgtctagttcccaggaaagcttaaaccgcccattttctagcaagtggtcaaccgccaatcccagcaccgtggccgggagggtgtctgctggctcttctaaggcaagtagccttccaggaagcctgcagcgttctcgaagtgacattgacgtcaatgctgctgctggggcgaaggcacatcacgctgcgggacagagtgtacgcagtggccgcttgggcgcaggcgccctaaacgctggatcctatgcctccctggaagacacatccgacaaattggatggaaccgcctctgaggatggccgggtgagagccaagctgtctgcgcccctggccggtatgggtaacgcgaaggcggacagccgcggacggtcacgtactaagatggtgtctcaatctcagccgggctctcggtctggcagtccaggtcgtgttctgacaactaccgcgctgagcacagtgtcctccggtgtgcagcgggtgctggttaacagcgcctccgctcagaaaaggtctaaaatcccaaggtcccaggggtgctcaagagaggcctctccaagcaggttgtctgtggcaaggtcatcacggattccccgtccaagtgtgtctcagggctgttcccgcgaggcgagcagggaatccagccgcgatacgtctccagtgagaagcttccaaccgttgggcccaggatacggaatctcacagagtagcaggctgtcctcctctgtgagtgcaatgcgagtgctcaacacgggctcagacgtagaagaggcagtggctgacgctctcctcctgggagatattcgaaccaaaaagaaaccagcgagacggcgctacgagtcttatggaatgcactctgacgacgacgcaaactccgacgcgagttccgcttgctcggagcgaagttactccagtcgaaatggctctatccccacatatatgcggcagacggaggacgttgctgaggtgttgaaccgctgcgcttcctccaattggtccgagcgcaaggagggcctgctggggctgcagaatctactcaagaaccaacgaactctgagccgagttgagctgaaaaggctttgtgagatcttcacccgcatgttcgcagatcctcacgggaaagtcttttcaatgttcttagagaccttagtggacttcattcaggtgcataaggacgatttacaggactggctcttcgtcctgctgacacaacttctgaaaaaaatgggagctgatctgctgggttctgtgcaggccaaagtgcagaaggctcttgatgtgacaagggaatccttccctaatgacctgcaatttaatatcctcatgaggttcactgtcgaccaaacccagacccctagtcttaaggtgaaagttgcaatccttaaatatattgagacccttgcaaagcagatggatccaggggattttattaactccagcgaaacccgtctcgcagtaagcagggttatcacgtggactactgaacctaaatccagtgatgttaggaaagcagcccagtcggtgctgatcagtctgttcgagctcaacacacctgaattcacaatgttgctcggtgccctgcctaagactttccaggacggggctactaaactgctccataatcatcttaggaatactgggaacggcacccaatctagcatgggttcgcccttgactaggcccacaccacgatctcccgcaaactggtcttctccacttacgtcccccactaacactagtcagaacactcttagtcccagtgctttcgactacgacacagagaatatgaattccgaggacatctacagttccctgagaggcgtaacagaggctatccaaaacttttcattccgtagccaggaggacatgaacgaaccactgaagcgcgatagcaagaaggatgatggcgactctatgtgcggcggtccaggcatgagcgacccaagggctggaggagacgctacagactccagccaaactgcgctcgataacaaagcatcactcctgcacagcatgcctacacatagcagcccccggtctcgggactacaacccatacaattactccgacagcataagtcccttcaataagtccgctctgaaggaggcaatgttcgatgacgacgcagaccagttccctgacgatttaagcctcgaccatagcgacttggtcgctgaactactgaaagaattgagcaatcacaacgagcgcgtagaggagaggaaaatcgctctctatgagctgatgaaactcacccaagaagaatcgttcagtgtctgggacgagcatttcaaaactatactgcttttactgctggagacccttggcgataaggagcccactattagggctctggccttgaaggtgcttagagagatcctccgacatcaacctgcccgtttcaagaattatgccgaacttaccgtcatgaaaacactggaggctcacaaggacccacacaaggaagtggtgaggtcagcagaagaggcagctagtgtgttggccacctccatctctccggaacagtgcatcaaggtgctatgtcccatcattcagacagccgattacccgattaacttagctgccataaaaatgcagactaaagtgatagagcgcgtttccaaggagaccttgaatctgctgttgcccgaaataatgcccggactgatccagggatatgataacagcgagagctctgtgagaaaagcctgcgtattttgtctcgtggccgttcatgctgtgataggtgatgaacttaaacctcatctctcccaacttaccggctcaaagatgaagctgctcaatctgtatatcaagagggctcaaaccggcagtggcggcgctgaccccactacagacgtgtcaggccagtcctag

SEQ ID NO: 184590 - DNA, 4545 bp, Artificial Sequence
  Description of Artificial Sequence: Synthetic coding sequence
atggagccccggagcatggagtacttctgcgcccaggtgcagcagaaagatgtgggcggtagactccaggtgggccaggaactcctgctctatttaggggccccaggcgcaatcagcgatctggaagaagatctcggcagacttggcaaaacggtggatgctctgaccgggtgggtaggatcttctaattatcgcgtgagtcttatgggattggaaattttgtccgcttttgtagaccgactttcaacacgcttcaagtcctacgtggccatggtgattgtagcattgattgaccgaatgggcgacgcaaaggacaaagttcgtgatgaggcccaaacccttatattgaagctcatggatcaagttgcccctcctatgtatatatgggagcagttagcctccggttttaaacacaaaaattttcgcagcagagaaggtgtctgtctctgtctcattgaaactttgaacatatttggtgcacagcccctagtcatctctaagcttattccccacctatgcatcctgttcggggatagtaattcacaggtacgggatgcagccattctggcgattgtggagatttatcgacatgtcggtgaaaaagtcaggatggacctctataaacgcgggataccccctgctagactggagatgatattcgccaaattcgacgaggtccagtcgagtggcggcatgatcctgagcgtgtgcaaagataagtcttttgacgacgaggaatctgtggatgggaaccgaccctcaagcgccgcttctgcttttaaggtgccagcaccgaaaacttccgggaacccagcgaactcagcacgaaagcccgggagtgcgggggggcctaaggtgggcgctggcgcctctaaggaggggggcgccggggcggtggacgaggacgatttcatcaaggcatttacagacgttccaagcatccagatctactcatcacgtgaactcgaagagacattgaataagatccgggagatccttagcgatgacaaacacgactgggaccaacgggccaatgccctgaaaaagattcgctcgttactggtggccggagctgcacaatacgactgtttttttcagcacctgcggctgcttgatggcgccctgaagttatctgctaaggatctgagatcacaggttgtgagagaagcatgcattacagtggcacacctgtccactgttttaggaaataagttcgaccacggggccgaggctatcgtccctactctgtttaatctagtaccgaatagtgctaaagtgatggctaccagcggatgcgcagccatcagatttatcattcgccacacgcatgtgccgagactgatccctctgatcacctccaattgcacctctaagtcggtaccagttcggaggagatccttcgagtttttggacctccttcttcaggagtggcagacgcactctctggaacggcacgctgctgtcctcgtggagacaattaaaaaaggaatacacgacgcagacgccgaggcacgggtggaggcccggaagacgtatatgggacttagaaaccactttccaggagaggcagagactctgtacaattctcttgaaccgtcctatcagaaaagcctgcagacttatctcaagtcttccggctccgtcgccagcttgccacagagcgatcgctcatcatcttcttcacaagaatccttgaaccggccattcagctccaagtggtccactgccaatccctccaccgttgccggccgagttagcgctggaagctctaaggcatcctccctgcccggcagcctgcagcgctctcggtccgacatcgacgttaacgctgctgctggagctaaggcacaccacgccgccggccaatccgtgcgttctggccgactgggtgcaggagcactcaatgccggcagttacgcatcactggaggacactagcgacaagctcgacggtaccgcctcagaggatggccgggttcgggctaaactgtcagcccccctcgctggaatgggcaatgccaaggctgactcccgcggcagatccaggaccaaaatggtgtcgcagagccagcccggttctcgttccgggtctccgggccgcgtgctgaccactacagcccttagtaccgtttcatccggagtgcagcgggtattggtgaatagcgcatcggcccagaagcgctcaaaaattcctcgatctcagggctgctcccgcgaggccagtcctagcaggctgagtgtagcccggtcttctagaatacctaggcctagcgttagtcagggatgttcccgggaagcctcccgggaatcttccagagacacttctcccgttcgctcctttcaacctttaggccccggatatggcatcagtcagtcttctaggttgtcctccagtgtgtccgcaatgagggttctcaatacagggagtgacgtcgaagaggccgtggctgacgccctgctcttgggggatatccgcacaaaaaagaagccagccagacgccggtatgagtcctacgggatgcattcagatgacgacgccaactctgacgcttcaagtgcatgtagtgaacgatcttactcgagtaggaatggaagcatccccacttacatgagacagaccgaagacgtggctgaggtactgaatcgctgcgccagctctaactggagcgagcgaaaggaaggacttctggggctgcagaatctgcttaaaaaccagaggaccttaagccgggttgaactcaagcgactgtgcgaaattttcactagaatgtttgctgacccccatggaaaagtcttttcgatgtttcttgaaacactggtggattttatccaggtacacaaggacgacctccaggactggttatttgtgcttctgacccaactactcaaaaaaatgggcgccgatctgttgggatccgtacaggcaaaggtgcagaaggcactagacgtaacaagagagtcattccccaacgacttacagttcaatatattaatgaggttcaccgtggatcagacgcagactccgtccctcaaagtcaaggtggccattctgaagtacatcgagacacttgcaaagcagatggaccccggagacttcatcaattcatcggaaacccggcttgctgttagccgtgtgataacctggaccactgagcctaagagctccgacgtgaggaaggcggcccagtccgttctaattagtctattcgagctgaacactccagaattcacaatgttgcttggtgccctgcctaagacctttcaggatggagcaactaaactcctccataaccacctcagaaacaccggtaacggtacacagagttccatggggagccctcttacccgtcccacgccaagatcccctgcgaactggtcatcccccctcacatcgcccactaacaccagtcagaacacactctctcccagtgcatttgactatgacactgagaacatgaattccgaagatatctacagctctttacggggcgtcacagaggcaatacagaacttttcctttagatcacaggaggacatgaatgaacctctcaagagggactctaagaaagatgatggcgattctatgtgcggcgggccgggaatgtccgatcctagagcgggaggcgacgccacagatagcagtcagacagcactggacaacaaggcaagtctccttcattctatgcccactcatagcagtccacggagcagagactacaacccatacaactactctgattcgattagtcctttcaataaaagcgctctcaaagaggccatgttcgatgacgatgcagatcaattccccgatgatctatccctggaccacagtgaccttgtggccgagttgctgaaagaactctcaaaccataatgagcgtgtggaggagcggaagattgcattgtatgaactgatgaaactgacacaggaggaaagcttcagtgtgtgggacgagcacttcaaaactattctgctgctgctgttggagaccctcggtgacaaggagcctaccattcgtgccctagccttgaaggtgctacgcgaaattctgcggcaccagccagcccgcttcaagaattatgcagagctgacggtgatgaagacgctggaggcacacaaggacccccacaaggaggtcgtccgcagtgcggaggaagcagcaagtgtcctcgcaacgagtatcagtcccgaacagtgcataaaggtgctatgccccattatccagaccgccgactaccctataaacctagcagctattaagatgcaaacaaaggtgatagagagggtctctaaggaaacactgaacctgctgctccccgaaatcatgcctggcctgatccagggttatgacaatagcgagtctagtgttaggaaggcttgcgttttttgcctcgtcgccgtccacgccgtgataggggacgagctcaaaccccacctgtcgcaacttacgggaagcaagatgaagctcctaaacctgtatattaagcgtgcgcagactggctctggaggggcagatccaactacagatgtgtcagggcagtcttag

SEQ ID NO: 184591 - DNA, 3882 bp, Artificial Sequence
  Description of Artificial Sequence: Synthetic coding sequence
atggccatgggcgacgacaagagcttcgacgacgaggagagcgtggacggaaatcggcctagttccgctgcctctgcttttaaagtccctgctccgaagacgtctggtaaccccgccaacagtgccaggaaacccgggagcgcagggggccccaaagtgggaggcgcttcaaaggaaggcggtgcaggcgccgtggacgaagacgatttcatcaaggcatttacagacgtcccctccatccagatttacagctctcgcgagctggaggaaaccttaaacaagattcgcgagatactgagtgatgacaagcatgactgggaccaaagggctaacgccttgaagaaaattagatctcttttggtagccggggccgcacaatacgattgtttttttcaacacttgagactgctcgacggggcgctaaaattaagtgctaaggaccttcgatcccaggtcgtgagagaagcctgtattaccgtagcccatctgagtacggtgctgggcaacaaatttgatcacggagccgaggccattgtgccaaccctgtttaacctagtgccaaactcagcaaaggttatggctacatcaggatgcgccgcaatccgctttattattcggcacacacacgtgcccaggctcattcctcttatcactagtaactgcaccagcaaaagcgtccccgtacggaggcgatcattcgaatttctcgacctgttgctgcaggaatggcagactcattccctggagaggcacgctgccgtgctcgttgagacaattaaaaagggtatccatgatgcagatgcagaggcccgtgtcgaagcgaggaaaacatatatgggtctgcggaatcacttccccggggaggccgagaccctgtataactccctggagccctcgtaccagaagtcactccagacgtacctgaagagttccgggtccgtggcctctctccctcaatccgaccgcagttcctccagcagtcaggagagcctgaatcggcccttcagcagcaaatggtctaccgccaatcctagcactgtcgcgggcagagtgtccgctgggagtagcaaagcctcaagtctgcccggatccctgcagaggtcccggagcgacattgatgtgaatgctgccgctggagctaaagcgcatcatgccgctgggcaatctgtgcggtcgggtagacttggcgccggagccttaaatgctggcagttacgcgtctctcgaggacacatccgataaactggatggcaccgctagcgaggacggcagggtccgagcgaaacttagcgcacccttggccggtatgggcaacgctaaagctgacagtagagggaggtcccgcaccaagatggtgagtcaatcccaaccaggcagtcgatcaggttcacctggaagagtcctcactactaccgctctatctacagtctcatccggcgtgcagagggtcctagttaattctgcaagcgcgcagaagcgtagtaaaatcccgaggtcacagggttgctccagagaggcatccccttcacggctttccgtagctcggagctcaaggatcccccgcccttctgtatctcaggggtgctcccgggaagctagcagagaatccagtcgagacacctctcctgtgcgctcctttcagcctcttgcgtcgcgccatcacagccgaagtacaggtgctctctacgcaccagaagtatatggagcaagtggcccagggtatggaatctcccaatcatctaggctgtctagctccgtgtcagccatgcgggtgctgaacacaggatctgatgtggaagaggccgtcgccgatgccctaaagaaaccggctcgtaggcggtacgaaagttacggaatgcatagtgacgacgatgcaaattccgacgcctcttctgcctgctcggagaggtcttatagttccaggaacggctccatacccacttacatgagacagactgaagacgtggcagaggtgttgaacaggtgcgccagttccaactggtctgaacgaaaagaagggctcttggggttacagaacctactcaaaaatcagcgaaccctgtcccgggttgagttaaaaagactgtgtgaaatctttactaggatgtttgctgacccccatggaaaggtcttttcaatgtttctggagacactcgtggacttcatacaggttcacaaggatgacctgcaggattggctgtttgtgctactcacgcaactgctgaagaaaatgggcgcagacctgttgggtagcgtacaagctaaagtccagaaagctctggacgttacccgggagtcttttccaaatgatctccagttcaacattctgatgaggttcacggtcgatcaaacccaaacccctagtctgaaagtgaaagtggccatcctgaagtatatcgagacactcgccaaacagatggacccaggagacttcatcaatagtagcgaaacgaggttggcagtgtccagggtgataacatggaccacagagcccaagagcagcgatgtgcgaaaggcggctcagagcgtcttaatatctttatttgagctgaacacgcccgagtttacgatgttacttggtgccctcccaaagacttttcaagacggtgccactaagctactgcacaaccatctgcgaaacacaggcaacggcacacaaagcagtatgggaagccccttaacacggcccactccacgttcacctgccaactggagttcgcccttaacctctcccaccaacacttcacagaacaccctttcccctagcgccttcgattatgacaccgagaatatgaatagtgaagatatctacagctccctccggggtgtgacagaagcaatccagaacttttccttcaggtcccaggaggatatgaacgagccactgaagcgagactcaaagaaggatgatggtgactccatgtgcgggggcccgggcatgtcagaccccagggcgggcggcgatgcaacggacagcagccagactgccctggataataaagcctctctgcttcacagtatgcctacccactcatcgccaagaagcagggattataatccctataactattcagattcgatcagtccattcaacaaaagtgctttgaaggaggctatgtttgacgacgacgcagaccagttcccggacgatttgtctttggatcatagcgatctggtggcagagctgctgaaggaactttcaaatcacaacgaacgtgtggaggaacgcaagatcgccctctacgaactgatgaagctgactcaggaagagtcattttctgtgtgggatgagcactttaaaacaatactgttactgctgctcgaaaccctcggtgacaaagagccaaccatcagagcgcttgccctcaaggtgttacgcgaaatcttacgccatcaacccgcccggtttaaaaactacgctgaactgacagtgatgaaaacattggaggctcataaggacccccacaaggaagtcgttcgttctgccgaagaggccgcttctgtactggccaccagtattagccctgagcagtgcattaaagtactgtgtcccattatccaaaccgcggattatcccataaacctggccgcaattaaaatgcagactaaggttatcgagcgcgttagcaaagagacactgaaccttctcctgcccgagattatgcccgggcttatccagggatacgataattcagagtcctccgtccggaaagcttgcgtcttctgtctagttgccgttcacgcagttattggggatgagctgaagccccatttgagccagctgacaggctcaaaaatgaaactgcttaacctgtacatcaaaagagcccaaacaggcagcgggggagcggaccctaccacagacgtctctggacagagttag

SEQ ID NO: 184592 - DNA, 3192 bp, Artificial Sequence
  Description of Artificial Sequence: Synthetic coding sequence
atgcggcggctgatctgcaagcggatctgcgactacaagagcttcgacgacgaagaatcggttgatggcaaccggccgtctagtgcagccagcgcttttaaggtgcctgcaccaaagaccagcggtaacccagcaaactcagcccgaaagcctggttcagctggggggcctaaagtgggtgagcttctgagtattatgatctacagcagcagggagttggaggagaccctgaacaagattagagaaattctctcggacgacaaacacgattgggaccagagggccaatgctttaaaaaaaattaggtcactcctcgtcgccggggccgcacaatatgactgtttcttccaacacttgcgtttgctggatggggctctgaagcttagcgctaaagacctgcgatcccaagtggtccgggaggcctgtattacagtcgcccacctatctacagtcctgggaaacaagttcgaccatggtgccgaggctatcgttcccaccctgttcaatttagtccctaattcagccaaagtaatggctacctctggctgcgctgccatccgcttcattattcggcatacccacgtgccccgcctcatcccacttatcacgtctaactgtacctctaagtccgttcccgtgcgtaggcgtagtttcgagttcttggatctactgcttcaggagtggcagacacattcactcgagcggcatgcagcggtcctggttgaaacgatcaaaaagggtattcacgacgctgatgcagaggccagagtcgaagcccgcaaaacatatatggggcttcggaaccacttcccaggtgaagccgagacgctttacaactccctagaaccttcataccagaaaagtttacaaacttaccttaagtcctcaggctcagtggccagtctgccccaatctgacaggagctcctcgtccagccaggaatccctgaaccgacctttctcgtcaaaatggtctacagcaaacccctccaccgtggctggtcgcgtcagcgctgggtcaagcaaagcctcgtcgctgcctgggtcactgcagcgatccagatctgacatcgacgttaatgccgcagcaggtgctaaggcacaccacgctgcgggccagagcgtccgctctggacggctcggcgccggggcacttaacgctggctcctacgccagcctggaggatacctcagacaagcttgatgacttgttttcggacaacggaagagtgcgggcaaagttatccgctcccttggccgggatgggtaacgcgaaagccgatagcaggggccgcagcagaacaaagatggtgtcacagagccagagaagtagttctcccgacaagaatgagggttcccagagcgcgaacacgataggagccgggtcaaggagcgggtccccaggaagagtcctgactacaaccgccctctccacagtgtccagcggcgtccagcgcgtcctggtgaatagtgcttccgcccagaaaaggagtaaaattcccagatcccagggatgttcacgtgaggcttctccttcaagactctccgttgcccggtcaagccggattccacggccatctgtgtctcagggatgctccagagaggcctccagagagagttccagggatacaagtccagtgcgctctttccagcccttgggtcccggctacggcatatctcagagcagcaggctttcatcgagtgtctccgcaatgagggtgctcaacaccgggtcagacgtggaggaggcagtggccgatgccctggtgctctttgacttcaaaactaagaagaaaccagcaaggaggcggtacgaaagttacggaatgcactcagacgatgacgcaaactctgatgcatcaagcgcttgttcggaaaggtcatattcttcccgcaacggttcgatccctacctacatgcggcagacagaggatgtggctgaagtattgaatagatgcgctagcagtaactggtccgaaagaaaagagggacttctggggctgcaaaatctgctgaagaatcagcggaccctgtctcgcgtggagttgaagcgcctgtgtgagatcttcacacggatgttcgctgaccctcacggtaaggtgttttctatgtttcttgaaacattggtggacttcattcaagttcacaaggacgacttgcaggactggctgttcgtcctgctaacccagctgctcaagaagatgggcgcagacttgcttggcagtgtgcaggcgaaggtgcagaaagctttagacgtaactcgtgagagtttccccaacgatcttcagttcaacatactcatgaggttcaccgtggatcagactcagacccctagcttgaaggtaaaggttgcgatattgaagtatatcgaaaccctcgctaaacagatggatcccggcgattttattaatagtagcgaaacaagacttgcagttagtcgggtaatcacctggaccactgagcccaaaagttctgatgtgagaaaagctgctcaaagcgtgttgatctcactatttgagctgaatacccccgaattcacaatgttactgggagcactacccaaaaccttccaggacggagcaactaaactgcttcataatcatctgagaaacaccggaaatggaacacaatcgtcaatgggaagccccctcacgagaccaacacctcgatctccggctaactggtcctctccattgacttcgccgaccaacaccagtcagaacaccctgtctccctcagcatttgactacgacacggaaaatatgaacagcgaagacatttacagcagcttgcgtggggtgacagaagctatacagaacttcagctttcggtcccaggaggacatgaatgagccgctgaaacgcgacagtaaaaaagatgatggtgatagcatgtgcggggggcctggcatgtcagatccccgggcgggaggcgacgccacagatagtagccagacggctctcgacaacaaggccagcctcctgcatagcatgccaactcacagctcaccacggagccgtgactataacccttataattactctgactcaatcagcccattcaacaaaagtgcgttgaaggaagctatgttcgacgatgatgctgaccagtttcccgacgacttgtctctagatcactcagacttggtcgctgagttgttgaaggagttgagtaatcacaacgaacgggtttag

SEQ ID NO: 184593 - DNA, 1680 bp, Artificial Sequence
  Description of Artificial Sequence: Synthetic coding sequence
atgcccccccccagccccgacagcgagaacggcttctaccccggcctaccatccagtatgaaccccgccttttttccttcttttagccctgtcagccctcacgggtgtactgggctctccgtaccaacaagcggaggcggaggtggcggtttcggcgggccgttttcggcaactgccgtgcccccgcctcccccccctgcaatgaatatccctcagcagcaaccgcccccacccgccgctccccaacaaccccaaagcaggcgtagtcctgtcagcccgcagctacagcaacagcaccaggcagccgcagctgcgtttttgcagcagagaaattcatacaatcaccatcagcccctgctcaagcagagtccctggtccaatcaccagagctccggctggggcacaggcagtatgtcctggggcgcgatgcatggacgcgatcatcggcggaccggtaatatgggcattcctgggacaatgaaccagataagtcccctcaagaaacctttttccggtaacgtcatcgcaccacctaagtttacaagaagtaccccctcactgaccccgaaaagctggatcgaggacaatgtttttcgcacggacaataatagtaacacccttctccccctgcaggaccggtccagaatgtacgattcacttaacatgcactctctggagaattctctcatagatatcatgcgagccgagcatgatcccctcaaaggacggctatcatatcctcaccccgggacagacaacctgcttatgttaaacggccgatctagcctgtttcctattgatgatgggctgcttgacgatggccactcagaccaagttggcgtgctgaatagcccaacctgttattcggctcaccaaaatggagaaagaatcgagcgcttctcccgaaaggtgttcgtgggtggcttacccccggacattgacgaggacgagattactgcctcattccgaaggttcggaccgttagtggttgactggccacacaaagccgagagcaaatcctattttccacctaaaggatatgctttcttgctgtttcaggaggagtcatcggtccaggccctgatagatgcttgcatcgaggaagatggtaaactctatctttgcgttagtagccctactattaaagacaagccagtgcaaatcaggccttggaacctatccgacagtgactttgttatggacggcagtcagcccctggaccctcggaagacgattttcgtgggaggcgtacctcgtccactgcgcgccgtggagctagccatgatcatggaccggttgtacggcggcgtttgctacgcaggcatcgataccgacccggaactaaagtaccctaaaggggccggcagggtggccttctccaatcagcagtcctatatagccgcgatctccgctaggttcgtgcagttgcagcacggcgacatagacaagcgggtggaggttaagccttacgtgctcgacgatcagatgtgtgatgaatgccagggagcgagatgtggtggaaagtttgctcccttcttttgcgctaacgtgacctgtctccagtactactgtgagttctgctgggccaacattcatagtcgagccgggcgagagttccataagcccctggtgaaagaaggcgccgatcgtccgcggcaaatccacttcaggtggaactag

SEQ ID NO: 184594 - DNA, 1731 bp, Artificial Sequence
  Description of Artificial Sequence: Synthetic coding sequence
atgcccccccccagccccgacagcgagaacggcttctaccccggcttaccaagctccatgaatccagcattctttcctagctttagtccagtgagccctcatggttgcaccggcctgagcgtgcccccaccacccgcgatgaatattcctcagcaacaaccccctccacctgccgctccgcagcagccccagtcaaggcggtcccctgtttctcctcagctgcaacagcagcaccaagctgcagctgccgccttcctccagcagcgcaacagctacaatcatcaccagccgctgctaaagcaaagcccctggtcgaaccaccaaagctccggatggggcactgggtctatgtcgtggggggctatgcacggtagagatcaccggagaacaggcaacatgggaatcccaggaacgatgaatcagatctctcccctcaagaaaccattcagtgggaatgttattgctccacccaaattcactagatcaactcctagtctgacaccaaaatcctggattgaagataacgtcttccgcactgacaacaactctaacactctcctgcccttgcaagtgagaagcagcctgcaattgccagcttggggtagcgactccctgcaggactcttggtgtaccgcggcagggacatcgagaatagatcaggaccgatctagaatgtacgatagtctgaatatgcacagtcttgaaaattcattaatcgatattatgcgggccgagcacgatcctctcaagggtcggctgtcttacccccatccaggcactgacaacctgctaatgcttaacgctcgatcctatggacggaggagggggaggtcgtctcttttccccattgacgatgggttgctcgacgacgggcactcggatcaggtcggagtgcttaactctcccacttgttacagcgctcaccagaacggcgaaagaatcgagcggttttctcgcaaagtgttcgtcgggggcctgcctcccgatatagatgaggatgagatcaccgcctcattccgacggttcggtcctctggtcgtggactggccccataaggccgaaagcaaaagctattttccgccgaaggggtacgcctttctgttgtttcaggaggagagctctgtccaagccctcattgatgcatgtattgaggaggacggtaaactgtatctgtgcgtgagttccccaaccatcaaagacaagcccgtgcagattcgaccgtggaatctgtccgactctgacttcgtaatggatggcagccagcctctcgacccgcgtaagacgatcttcgtagggggggtgccacgtcccttgcgggccgtggagctggccatgatcatggacaggctgtacggtggtgtgtgctatgccggaatagacactgatcccgaactgaagtatccaaagggagcgggtcgagtggccttttcaaaccagcagagctatatagccgcaatctccgcccgcttcgtccaactgcagcatggggatattgacaaacgcgtggaagtaaaaccttacgtccttgacgaccagatgtgtgacgaatgccagggagcccgctgtggaggaaagttcgccccctttttctgtgctaacgtgacctgtctacagtactactgcgagttctgctgggccaacatccatagtagagccggcagggaatttcacaaaccactggtgaaggagggcgctgatcgcccccggcagattcactttcgttggaactag

SEQ ID NO: 184595 - DNA, 1704 bp, Artificial Sequence
  Description of Artificial Sequence: Synthetic coding sequence
atgcccccccccagccccgacagcgagaacggcttctaccccggcttgccgtcttccatgaacccggcattctttcccagtttctcacccgttagtccccacggctgcactggactgtctgttccgacaagtggaggaggaggcggagggttcggggggccctttagcgcaaccgctgtgcctcctccgccgccgcccgctatgaacatcccccagcagcagcccccgccccccgccgcaccacaacagcctcagagccgaagaagccctgtgagtccgcagctgcaacagcagcaccaggctgcggcggctgccttccttcagcaacggaactcttataaccatcatcagccgttgttaaagcagtcgccctggtcaaaccaccagagtagcggctggggcacaggcagtatgtcgtggggggctatgcacggccgggaccatcggcgcactgggaatatgggcatccctgggacaatgaatcagatcagtcctcttaagaagcccttcagtggaaatgttattgccccaccaaaatttacccgctccactcccagcctgacacctaagagctggatagaagacaatgtttttaggacagacaataactctaataccctgttacctctccaagacagaagtcggatgtacgatagcctcaatatgcactcccttgagaactctcttatcgatatcatgagggcagagcacgacccccttaaaggtcgactgtcctatccacaccccgggactgacaatctgctaatgttgaacgcacgcagctacggacgacgccgcgggagatccagtctttttccaatagacgacgggctgctggatgatgggcatagcgatcaggtgggtgtcctgaattcacccacttgctattctgcgcaccagaacggtgaaaggatagaacggttctcaagaaaggtcttcgtcggtggattacctcccgacatcgacgaagacgagatcaccgccagtttcagacggttcgggccattagtcgtggactggccccataaagccgaaagtaagagctacttcccacccaaaggctacgcttttctgctgttccaggaagagtccagtgtacaggccctgattgatgcatgtatagaagaagacggaaaattgtatctctgtgtgtcaagcccaaccattaaagacaaacccgtgcagataagaccttggaacctgtcagactccgattttgttatggatggctcccagccgctggacccacgtaagacaatttttgtgggcggggttccgcgccctcttcgcgctgttgagctcgctatgatcatggatagactgtatggaggggtttgttatgccggcatagatactgaccctgaactgaagtacccgaagggcgccggtcgagttgctttctctaaccagcagagctacatcgcggcgatctccgctaggtttgtacagctgcagcacggcgatatcgacaagcgcgtagaagtaaaaccatatgtcctcgacgatcagatgtgcgatgaatgtcagggcgcacgctgtggaggaaagttcgcaccctttttctgtgctaatgtgacatgcctccagtactactgtgagttctgttgggcaaacatacactccagggccggccgtgaattccacaaaccattggtcaaagagggtgccgatagacctcgccagatacactttcggtggaactag

SEQ ID NO: 184596 - DNA, 1689 bp, Artificial Sequence
  Description of Artificial Sequence: Synthetic coding sequence
atgcccccccccagccccgacagcgagaacggcttctaccccggcctgccatccagtatgaaccctgccttttttcccagtttcagtcccgtgtctccacatggctgcacagggctgtccgtgcctacctctggaggcggaggcggtggattcggcgggccgttcagcgccaccgcggttcctccacctccccctcccgctatgaatattccacaacagcagccacccccacccgccgccccccagcagccccagtccaggaggtccccggtcagtccccaattgcagcagcagcaccaagctgctgcagccgcctttctccagcagcggaactcatacaaccaccatcagcccctcctcaagcagtccccttggagtaatcaccagtcttcaggatgggggaccgggtcgatgtcgtggggagccatgcacggacgagaccacaggaggactggcaatatgggtattcctggcactatgaatcagatctcgcccctgaaaaagccattcagtggtaacgtcatagccccacccaagtttacacgctccacaccttccttaactcctaaaagctggattgaggataacgtgttccgcaccgataacaactcgaatacccttctacctctccaggtccggatggaccggagccgaatgtatgatagcctcaatatgcactcgttggaaaactcattgatcgacattatgcgcgctgagcacgatccattaaagggacggttgtcctaccctcacccaggcaccgacaacctgctgatgctaaatggacggagcagtcttttccctatcgacgacggcctcttggacgacgggcatagtgaccaggtgggagtccttaactcaccgacatgctattccgcccaccaaaacggcgagaggattgagcgtttttcccggaaagtcttcgtgggggggcttccacccgatattgatgaggatgagattaccgcctctttccgccgcttcggccccttagtcgttgactggccacataaggcggaatcaaagtcgtactttccacccaagggatatgcattcttgttgttccaggaagagtcatctgtgcaggcactcatcgatgcttgcatcgaggaagacggaaagctctatctctgtgtgtcaagcccgaccattaaggataagcctgtgcagatccgaccgtggaacctgtcggattctgattttgtaatggatgggtcccaaccactcgaccccagaaagaccatcttcgtcgggggggtccctcgcccgttacgtgctgtggagttggccatgatcatggacaggctgtacggaggcgtttgttacgccggcatagatacagaccctgagttgaaatatccaaaaggagcgggtcgggtggccttttcaaatcagcagagctacattgccgcaattagtgccagattcgtccagctgcaacacggagatatcgacaagcgcgtggaagtcaagccctacgtgcttgatgatcaaatgtgcgacgaatgccagggagcacgctgcggaggtaagttcgcccctttcttctgtgccaatgtgacttgcctccagtactactgcgagttctgctgggctaacattcattccagagctggccgagaatttcataagcccttggtaaaggaaggtgcggataggccgagacagattcatttccgttggaactag

SEQ ID NO: 184597 - DNA, 3024 bp, Artificial Sequence
  Description of Artificial Sequence: Synthetic coding sequence
atgcgggacttcggcttcggcgtgctgcagaccgcccccctgcggtcaagctccccaggtccgctgttctgcggagaggcctacgggccatatgccgtcggctcggtgaatccactaccgagtgctaccccgttcggacccctctcccccccccccctgcccgttaccggatttttagaggcagccagcccttttagcgtgcctctggggggtggggctggctcccctgcggcagccgctagttcctcatcccccttcctggcccatcagcagacgatgcaggatgagttactgctcgggctgactcagcaacctgcccgaccgctctccggtgccgccgcaacagagaagctgccagaccaccatcctggcggggggaccatcgcgggagtgactcacctgctgccttctcaggacttcaaaccttcattgcaccacccaagctcgtcatccgcttcatcatgctgctgctgcagaacctcgagccctcaggatttttcaaagagacagcagcagcagttgtcttctcagaagaggaaagagttcagcccccctcacctgccccatccacccgactctaagccgccacctccccctcctcctctgcactgtcccggaaggttcagcccaccaccaccacccgccggtccactgcttcagccagcccaattggcccagcggcagcaacagcaaccgcctcagcagttttctttactccatcagcagcatttgtctccacaggactttgctccacgtcagcggccagcagaccttccccctctgccacaactcccaccatccccgcctgccgcacccagaaggcggcacggcggtgccggttctccaaggaagaccccggctgctggggagggaagcgccgccgaatccccaaacgctggcttggcttcctcaactcctgtgaacccagcacccgggtctatggagtccccgaatcatccactgctgaattccccaagcaatctgttaccagggggcgcactcggggcgggtgccttcagtagtctgcagtctccagacctgccacatcctggggggggtgggggaggcggagggggagggcctccaggcggtggagggggcggcgggtcggcatcaccacctcctctccccggttttggtactccctggtccgtgcaaaccgcctccccccctccacagcctcaacagcccccgcctacgcagcctcagcaacagcccccgccccctcagcagcctccacagcctcagccccagcctccaggtagcagcgcgacgacacctggcggcgggagcggtggatcgcttagtgccatgccacccccgtcacccgatagcgagaatggtttttatcctggcctcccctcctcaatgaatccggcatttttcccatcattctctcccgtgagcccccatgggtgcacagggctttccgtgcccacgtcaggaggaggagggggcggtttcggcggaccattctcagccacagccgtgcccccacctcctccgccggcaatgaatatcccacagcagcagccccctccccctgctgcacctcagcaaccacagagtcgccgcagccctgtttcgcctcagctgcaacagcaacatcaagctgctgcagccgccttcctccagcagcgcaattcgtataatcaccatcaaccccttctgaagcagagtccgtggtcaaatcaccagtcttcaggttggggaactggatccatgagttggggtgccatgcacggcagagatcatcgtaggaccggaaatatgggcatacctggaactatgaaccagattagccctctcaagaagcccttctcagggaacgtgatagcaccccccaagtttactcgcagcacaccctccctgaccccaaagagctggatcgaagataacgtgttccgcaccgacaataacagcaacaccctcttaccactgcaggttaggatggaccgctctcgaatgtacgattcacttaatatgcacagtctggagaactctctcattgatattatgagagccgagcacgaccccctgaaaggccggcttagttatcctcaccctggaaccgacaatctactgatgttgaacgctaggtcttacgggcgacgccggggccgatcttctttgtttcccatagacgatggtctgcttgacgacggacactcagaccaggtaggcgttctgaattcacccacctgctactccgcccatcaaaacggggagaggatcgaaagatttagccgcaaggttttcgtcggaggcctccccccagatattgatgaggatgaaataacagcaagttttcgcagattcggtcctctggtggtcgattggccacataaagcggagtcgaagagttatttccctccaaagggctatgccttccttcttttccaagaggaaagctcagtccaggcccttatcgacgcatgtattgaagaagatggaaagctttacttgtgcgtgtccagtcctactatcaaggataaaccagtccagatcagaccctggaatctatcagactctgacttcgtgatggacggctcccagcccttggacccgcgcaagaccatcttcgtagggggagtaccacgaccacttagagccgtggagctggctatgattatggacagactgtacggtggtgtatgttatgccggcatagataccgaccctgaactcaagtatcccaagggcgccgggagggtggccttctctaatcaacagagctacattgctgcaatttctgcaaggttcgtgcagttacagcacggggatatcgacaaaagggtcgaggtgaaaccctatgtgttagatgatcagatgtgtgatgaatgtcagggcgctcggtgtggtggcaaattcgcgccatttttttgcgctaatgtgacctgcctccagtattattgtgaattttgctgggctaacatccattctcgcgctggaagggaattccataaacctttagtgaaggagggcgccgatagacctcgacaaatacattttcgctggaattag

SEQ ID NO: 184598 - DNA, 1770 bp, Artificial Sequence
  Description of Artificial Sequence: Synthetic coding sequence
atgcccccccccagccccgacagcgagaacggcttctaccccggcctgccctcatctatgaaccccgctttcttcccttcattctctcctgtgtctccccacggctgtactggtctcagcgtgcccaccagcggcggtgggggcgggggcttcggagggccgttctccgcaactgctgtcccaccccccccacctcctgcaatgaacatcccgcagcagcaaccaccgccgccggctgcaccccagcaaccacagagccggcggtcacccgtttcccctcagctgcagcagcaacaccaggcagccgcggctgcctttctccagcagcggaactcttacaaccatcaccaaccgctactgaagcagagcccctggagtaaccaccaatcctctggctggggaactggtagtatgtcctggggggccatgcacggccgagaccataggaggacaggcaatatgggcatcccagggacaatgaatcagatttcccctctgaaaaaaccctttagcggcaatgtgattgcccccccaaaatttacccggtcgacaccatccctcacgcctaagagttggatagaggataacgtgttcaggaccgataataatagcaacacactgctacctctgcaagtgaggagctcgctgcaattacctgcatggggctctgattcacttcaggactcttggtgcaccgcagctggcacctcgcggatagaccaggaccgatcccgcatgtatgacagcctcaacatgcattcgctcgagaatagcctgatcgatatcatgagggccgagcatgaccctctgaagggtcgactgagctatccacatccgggaactgataaccttctcatgctgaacggaagatcctctctgttccctatagatgatggcctgctggacgatggacactcagaccaggtcggtgttctgaactcaccaacctgctacagtgcacaccagaatggagagagaatcgaaagattctcccgcaaggtgtttgtaggaggattacccccagatatcgacgaggacgaaatcaccgcctccttcagacgcttcggccccctggtggtggattggccccacaaagctgaatccaagtcatactttccaccgaagggttacgccttcctcttattccaagaagaaagttccgtgcaagcactgatcgatgcatgtatcgaggaagacggtaagctgtatctgtgcgtgagctcacctaccataaaggacaagcctgtgcagatccggccctggaacttgtcagactccgatttcgttatggacgggtcccaacctctcgaccctagaaagacaatctttgtcggaggcgtacccagacccctgcgcgctgtcgagttagctatgatcatggataggctgtacggtggcgtttgttacgctggaattgacaccgaccccgaacttaaatatccaaagggagccggtagagtagccttttcgaaccaacagagctacatcgcagctatttccgctagattcgtccagctgcaacacggcgatattgacaagagggtcgaagtcaagccctatgtgcttgacgatcagatgtgtgacgaatgtcagggagcgagatgcggcgggaagttcgctcctttcttctgtgcaaatgttacttgcttgcaatattattgtgagttctgttgggcaaacattcactcccgcgccgggagagagtttcataagcccctcgtgaaggaaggtgccgaccggcctaggcaaatacacttccggtggaattag

SEQ ID NO: 184599 - DNA, 3105 bp, Artificial Sequence
  Description of Artificial Sequence: Synthetic coding sequence
atgcgggacttcggcttcggcgtgctgcagaccgcccccctgcggtcctcttcccctggtcccctgttttgcggggaagcctacggcccatatgccgtaggatccgtaaatcccttgcctagcgccactcctttcggacccttgagtccacctccgcttcccgtcaccggcttcctggaggccgcaagcccattctctgtgccactagggggcggcgccggctcccctgccgcagctgcctccagttcatccccttttcttgcacaccagcagaccatgcaggacgaacttttgttgggactgactcagcagcccgcccgacctctgtctggtgctgcagccacagagaaactacctgatcatcaccctggtggcggaacgattgcaggcgtaacgcatcttcttccctctcaggacttcaagccttcactccaccatccatcctccagctctgcctccagctgttgctgttgccggacaagcagtccccaggacttttctaaaaggcagcagcagcagctgtcttcccagaaaagaaaggagttttctccaccacacttaccacatcccccagacagtaaacccccgcccccccccccccctctgcactgcccaggcaggttcagtccccccccccctcctgccgggcctctgctccagcccgcccagctggcccagcggcagcagcagcagcccccccaacaattctctctgctgcaccagcagcatttgagtccccaagatttcgcccccagacagcggcctgccgacctacccccacttcctcaactgcccccaagtccgccagccgcaccacggcgtaggcacggcggagctgggagccccaggaagacaccagcagcaggtgagggaagtgcggccgagtccccgaacgccggactcgcctctagcacacctgtgaaccccgctccaggatccatggagtccccgaaccacccactgcttaactctcccagcaacttactgcccggcggggctctgggcgccggagcattttctagccttcaaagcccggacctcccccaccctggcggtgggggaggagggggcgggggaggacctccggggggcgggggcggtgggggatccgctagtccgcctcccctacctggttttggaacaccatggagtgtgcagactgctagtcccccaccacagccccaacagccccctcccactcaaccccaacagcagccccctccaccacagcagcccccccaaccccagccccaacctccgggtagctccgcaaccacccctgggggaggtagcggagggtcattgagcgccatgcccccaccctcccccgactccgagaacggtttctaccccggactgccttccagcatgaatcccgcatttttcccgagcttcagtccagtctccccccatggctgtaccggcttgagtgttccaacatcaggtgggggtggtggtggtttcggtggtccattttccgctacagctgtgccccctccccctccgccagccatgaacatcccacagcaacaacctcctcctccagctgctcctcagcagccccagtctagaagatccccagttagccctcagctgcaacagcagcaccaggccgcagcagccgcctttcttcagcaacggaatagctacaaccatcaccagcccttgctgaagcagtcgccttggtcaaaccaccagtcttccggatggggcacaggtagcatgagctggggcgcaatgcacggccgcgaccaccgtcgcacgggcaacatgggaattccagggaccatgaatcagattagcccacttaagaagccattttcgggcaacgtaattgctcctcctaaattcacacggagcacacctagcttaaccccgaaaagttggatcgaggataacgtctttcggacagataataattcaaacacacttttaccactacaggtaagatcttcgttgcaactacccgcttggggatcagattccctgcaagattcgtggtgcaccgccgccggtacaagccggattgaccaggatcgatcaaggatgtatgactctctgaacatgcactcactggaaaacagtcttattgatattatgcgagccgagcatgacccgctgaagggtagacttagctacccccatccaggaacggataatctattgatgctgaacgcacggtcctacggtagacgccgggggagatccagcctcttccccattgacgatggcttactcgacgatggccatagtgaccaggttggagtgctgaacagcccaacatgctattctgcacaccaaaatggagagcgtattgaacgatttagtagaaaggtgtttgttggcgggctcccccctgatattgacgaggacgaaatcacggccagcttccgccggttcgggcccttagtcgtggactggcctcataaggcagagagcaagtcttacttcccaccaaaaggctacgcctttctcctgttccaggaagagagctcagtgcaggcccttatcgacgcgtgtatcgaagaggatggtaagctgtatctttgtgtctcttccccaacaatcaaagataagcccgtgcagatcaggccctggaatctgagcgatagcgattttgtgatggacgggtcacaacctttggacccccggaagactatatttgtcggtggtgtacctaggcccctgagggctgtggagctggctatgattatggaccggctgtatggaggcgtttgttatgctgggatagatacggatccagaattgaagtacccgaagggagccggtagagtggcattctccaaccaacagtcatatatagccgccatttcagccaggtttgtacagcttcagcatggggatattgataagcgggtggaggtgaagccttatgttctggatgaccagatgtgcgacgaatgccagggagcccggtgcggcggcaaattcgcccccttcttctgcgccaatgtgacttgtctccagtactactgtgagttctgctgggccaacatacactctagggctggaagggaattccacaagcctctggtgaaggagggcgctgaccggccaagacagattcatttccgatggaattag

SEQ ID NO: 184600 - DNA, 3081 bp, Artificial Sequence
  Description of Artificial Sequence: Synthetic coding sequence
atgcgggacttcggcttcggcgtgctgcagaccgcccccctgcggagttctagccctgggcccctgttttgtggtgaggcctacggaccttacgcggtcggcagtgtgaatcccctgcctagtgccactccatttgggccccttagccctccccctctcccagtgactggttttctagaggcggcttccccatttagcgtccccttaggaggcggagccggcagccctgccgcagcagctagcagcagcagtcctttcttagcccatcagcaaactatgcaggacgagctgctactgggtttaactcaacagccagctagacctttgtctggagcagccgctactgaaaagctcccagaccaccacccaggtgggggaactatcgctggcgtcactcacctcttgccatctcaggacttcaaaccctcactccaccaccctagtagttcctcagccagctcatgttgctgctgccgcacctcctctcctcaagacttttctaagaggcagcaacaacagctgtccagccagaagagaaaagaattctcccctccgcacctgccacaccctccagactccaaacccccaccacccccccctcccttacactgccctggacgcttttctcctccccctccccccgcaggccccctgctgcagcccgctcaacttgctcagcggcagcagcagcagccacctcagcagttctccctcctccaccagcaacatctgtcccctcaagactttgccccccgccagcgtccagccgacctgccccctctaccccagctcccgccatctccacccgctgcccctcgccgcaggcacggcggagcaggcagcccacggaaaacacctgcggctggggaggggagtgccgctgaaagtccgaacgccggcttggcttcaagtacacctgtcaatccagccccaggctcgatggagagccctaatcatccactcctgaattcaccgtccaacctgctgcccgggggagctctaggcgctggtgccttcagcagcttgcagtctccggacctgccccaccctggggggggcgggggtggcggtggtggggggcccccaggaggaggcgggggggggggcagcgcgagccccccaccactgccaggctttggtactccttggagcgtgcagacggcatcacccccacctcagccccagcagccaccgccgactcagccacagcaacagcctccgccaccccagcagccaccgcaaccacaaccccagccccctggttctagcgccacaacacctggcggaggctccgggggctctttgtccgctatgccaccaccctcccctgatagcgagaatgggttctaccctggcttgcccagctcaatgaaccccgctttcttcccatccttctcacctgtgtcccctcatggctgtaccggtctgtcagtccccacatccggcggcgggggcggaggcttcggaggaccttttagtgccacggcagtgcccccgcctccccctcctgctatgaacataccacagcagcaacccccccccccggctgccccccaacagccgcagtctagacgatctccggtgtcaccgcagctgcagcagcagcaccaggctgcagcagcagccttcttgcaacagagaaatagctataaccaccaccaacctctactgaagcagtccccgtggagcaatcaccagagctctggatggggcaccggatctatgagctggggagccatgcacggccgcgatcaccgcaggaccgggaacatgggcatacccggaacaatgaatcaaatcagccccctgaagaagccttttagtggtaatgtgattgcgcctccgaaatttacccgctctacccctagtcttactcctaaatcctggatcgaggacaacgtgttccggacagacaacaatagcaacaccctgcttccactccaagtccggagctcattgcagctgcctgcttgggggagcgatagtcttcaggattcctggtgtaccgccgccgggacctctagaattgaccaggatcgttcccgcatgtacgactcccttaacatgcatagccttgagaattccctcattgacatcatgcgggcagagcatgatcctttaaagggtaggctgtcatacccccaccccggaaccgacaacttgctgatgctgaacggccgctctagcctctttcctattgatgacgggctccttgatgatgggcattcagatcaagttggggtccttaattcgcccacctgttattctgctcatcagaacggcgagaggattgagcgcttctctcgtaaagtatttgtgggtggactgcctccggacattgacgaggacgagatcactgcttccttcaggcggttcggaccactcgtagtagactggccccataaagctgagtctaagagttacttccccccaaaaggctacgcctttctgctgtttcaagaggaaagctcggtgcaggctcttattgatgcgtgtatcgaggaggacggcaagttatatctttgcgtatcaagccctaccatcaaagacaaaccagtccagatcagaccttggaacttgtccgactccgatttcgttatggacggctcccaaccgcttgatcctagaaagacaatatttgtgggcggcgttccccggcccctccgggcggtggagctggccatgatcatggatcgattgtacggcggcgtatgttacgccggcattgatacggaccctgaacttaagtaccccaagggagccggccgcgtggccttctctaaccaacaatcttacattgcagccataagcgctagatttgttcagctacaacatggggatatcgataagagagtcgaggtcaaaccttatgtcctcgacgaccaaatgtgcgacgaatgccagggggccagatgcggaggcaagtttgcacccttcttttgtgccaatgtgacctgtctacaatattactgcgagttttgctgggcaaacatccattcccgggccggcagagagtttcacaagccgcttgtcaaagaaggagcagaccggccaagacagatccatttcaggtggaattag

SEQ ID NO: 184601 - DNA, 2097 bp, Artificial Sequence
  Description of Artificial Sequence: Synthetic coding sequence
atgcaggacgacctgctgatggacaagagcaagacccagccccagcctcagcaacagcagaggcaacagcaacagccccagccagaaagttcagtcagcgaggctccttctactccactctcttccgagactccaaaacctgaggaaaactcagccgtcccggccttaagcccagcagctgcccccccggcccccaatggccccgacaagatgcagatggagagccctctcttgcccggccttagctttcatcagccaccacaacagccacctcctccacaggaacccgcggcccccggtgcatccctaagtccaagcttcggcagcacatggtccaccggtactacgaacgccgtagaagactcattcttccagggaatcacacccgtcaacggcaccatgctgttccaaaactttcctcatcatgttaatcctgtgttcgggggcaccttttcgcctcagataggtttggcgcagacccagcatcaccaacagcccccacctccagctccagctcctcagcccgcccagccagcccaacctcctcaagctcaacctccgcagcagagacgttctccagcgtctccctcacaagccccttacgcacaacgttctgcagctgcagcatatggtcaccaacctattatgacatccaagccatcatcaagctctgccgtggctgcagccgctgctgctgccgccgcctctagcgccagcagtagttggaatacccaccagtccgtgaacgcagcttggagcgctcccagtaacccttggggggggctgcaagcaggccgcgatcctcggagagctgtaggtgttggagtaggggtgggtgtcggtgtaccttcacccctgaatccgatatctcctttgaagaaaccgtttagctccaacgtcatcgcaccgccaaagtttcctcgagccgcccccctcactagcaagtcatggatggaagataacgcatttagaaccgataacgggaataatctcctgccatttcaggaccgctcacgaccgtatgacaccttcaatctgcacagtttggagaatagcctcatggacatgattcggaccgaccacgagcccctgaaagggaagcactatcctccaagtggtccacctatgtcttttgctgacattatgtggaggaaccactttgccggccgaatgggcatcaattttcaccatccagggacagacaacatcatggccttgaataatgccttcctggatgactcgcacggagaccaggcactctccagcggcttatcctctccaaccaggtgtcagaacggtgaaagggtggagcgctatagtaggaaggtcttcgtgggcggcctgcctcccgacatagatgaagacgaaattaccgctagtttccgccggtttggcccactggtggtggactggccacacaaggccgaaagtaagtcatattttcctcctaagggctatgcattcctcttatttcaggaggaatcttccgtgcaagccctcatagacgcttgtctggaggaggatggcaagctttacctgtgcgttagttcacctacaatcaaggacaaacccgttcagataagaccatggaacttgagtgactctgacttcgtgatggatgggtcccagccactggatcctcgaaagactatttttgttgggggggtgccgcggcctctgagggccgtagaactcgctatgatcatggaccgcctgtacggtggcgtatgttacgcagggattgacaccgacccggaactcaaataccctaagggagctgggcgcgtcgctttttcaaaccagcagtcatacatcgctgcaattagtgctcgatttgtccagctgcagcacaacgatatagataagagagtggaggtcaaaccctatgtgctcgatgatcagatgtgcgatgaatgccagggcactcgctgtggagggaagttcgccccctttttttgcgccaacgtcacatgcttgcagtattattgtgagtattgttgggcgagtatccactcacgcgccggtagagagttccataaacccctcgtcaaagaaggaggggaccgacccaggcacgtgccctttcgctggagttag

SEQ ID NO: 184602 - DNA, 2055 bp, Artificial Sequence
  Description of Artificial Sequence: Synthetic coding sequence
atgcaggacgacctgctgatggacaagagcaagacccagccccagcctcagcagcagcagcggcagcagcaacagcctcagcccgaatcctctgtctccgaggcgccctcaacaccgctatcttcagagacacccaagccggaagagaacagtgctgtgccagcgctgtcacctgcggcggcgcccccggcacctaacggacctgacaagatgcagatggaatcccccttgttgccaggcctgagcttccaccagccccctcagcagcctccacctcctcaggaacctgcagcccctggcgcatctctctcaccctcctttggcagtacgtggtctaccgggactacaaacgcggtggaagattccttctttcaggggattacacctgtaaacgggaccatgctctttcagaactttcctcaccacgtgaatcccgtttttggggggaccttctccccccagataggcctggctcagactcagcatcatcagcagccacctccacccgctcctgccccccagccggcacagcctgcccagccccctcaggcgcagcctccccagcagcgacggagccccgcctccccttcccaggccccttatgcccagagatccgccgccgctgcgtatggccaccagcccatcatgacgagtaagccgagctcaagctctgcagttgccgctgcggcggcagctgccgccgccagttctgcatcatcctcgtggaacactcaccagtccgttaacgctgcgtggtccgctccttcaaacccatggggaggtctgcaagccggaagggatccgagacgcgctgtcggcgtgggggtcggagtgggcgtgggcgtcccttcacccctgaatcccatttcccctctcaagaagccattctcttcaaatgtaatcgccccaccaaaatttccgcgggccgctccgcttacaagcaagagttggatggaggacaacgccttccggaccgacaatggcaacaatctcctgccctttcaggacaggtctcgaccatatgacaccttcaacctccacagtcttgagaattcgctgatggacatgatcagaaccgatcatgagccgcttaagggacgcatgggtataaacttccaccatcctgggaccgataacatcatggcactgaactccaggtccagcttatttccctttgaggatgccttcctcgatgacagccacggggatcaggcattgtcttcgggcctgagctctcccactcggtgccagaatggtgagcgggttgaacgctactctcgcaaagtgtttgttggggggctaccccccgacatcgatgaggacgaaatcactgcaagcttcagaaggttcggtcctctggtggtcgactggccccataaagcagagagcaagagttactttcctccaaaagggtatgctttcctcctgttccaagaggagagttctgttcaagctttgattgatgcatgtttggaggaggatggtaagctgtatctgtgcgtgtctagtccgacaattaaggacaaacccgtgcagataaggccctggaatctgtccgacagcgattttgtgatggatggctcacagcctctagatccaaggaaaactatcttcgttggcggcgtaccaagacctctcagggccgttgaacttgccatgatcatggacaggctgtacggtggcgtctgttacgccggcatcgacacagatcctgagcttaagtacccaaagggagccggacgggtggcattcagcaaccagcaatcatacatagcagctatctctgcccggttcgtgcagttacaacacaacgacatcgacaaacgcgtggaggttaaaccctatgtcctggatgaccaaatgtgtgatgaatgccagggcacccggtgtggtggcaagttcgcacccttcttctgtgcaaatgtgacctgtctgcagtactactgcgagtactgctgggcgtctattcattctcgggccggaagggagtttcacaagccacttgtgaaggagggcggcgatcggccacggcatgtgccatttcgctggtcctag

SEQ ID NO: 184603 - DNA, 2055 bp, Artificial Sequence
  Description of Artificial Sequence: Synthetic coding sequence
atgcaggacgacctgctgatggacaagagcaagacccagccccagccccagcagcagcaacgccagcagcagcagccgcaaccagaatcaagcgtttccgaagcgccaagtacacccctgagcagcgagaccccgaagcccgaagagaactcagccgtgcccgctcttagtcctgccgcagccccccccgcccccaatgggcccgataagatgcagatggagtcaccactcttgcctggtctctcctttcatcagcctccccagcagccccctcccccccaggaaccagctgcacccggtgcctctctgtctccatcctttgggtctacatggtcgacggggacaactaatgccgtggaggattccttcttccagggaataacaccagttaacggcaccatgctgttccagaatttcccccatcatgttaaccctgtttttggcggcacctttagtccccagatcggcctggcccagactcaacatcaccagcagcctcccccccctgccccggccccacaacccgcccagcccgcccaacccccccaggcacagccaccccaacagagaagatctcccgccagtccatcacaggccccctacgcccagagatccgcagcagccgcttacggccaccagccgattatgactagtaagccaagttcaagcagtgctgtcgccgccgcggccgcagcggccgctgcatccagcgcgtcgagcagctggaacactcaccagagcgtcaacgccgcctggagtgcaccatcgaacccttggggcggcctgcaggcaggccgggatcccagacgcgcagtcggcgttggcgtaggtgtcggggtaggagtgccttcgcctctgaacccaataagtcctcttaagaaacctttctcatccaacgtcattgcgccacctaagttccccagggccgctccacttacatcgaaatcctggatggaggataatgcctttcgtaccgataatggtaacaacttgctgccattccaagacagaagcagaccgtacgacactttcaacctacacagtctcgaaaacagtctcatggacatgattcgcactgatcacgagcccctgaagggtcgaatggggatcaactttcaccacccggggacagacaacatcatggcattgaattccaggagctccctatttcctttcgaggacgcgttcctggacgacagtcacggcgatcaggccctgtctagtggattatcatcaccgacccggtgccagaatggcgagcgcgtggaaagatacagcagaaaagttttcgtgggaggcctgccccccgatatcgacgaggatgaaatcacagcatcctttagaaggtttgggccactggtggtcgattggcctcacaaagctgagtctaagagctactttccaccgaagggctacgctttcctcctgttccaggaagagtctagtgtgcaagccctgatcgacgcttgtctggaggaggacggtaagctttatttgtgcgtatccagtcccactattaaggacaagccagtccaaatccgtccctggaacttgagcgattcagatttcgtgatggatgggtcccaacccctcgaccctcgtaagaccatttttgttggtggagtgccacgtcccctgcgggctgtagagctggctatgatcatggacaggctatatggtggggtctgctacgcagggattgatacagacccggagttgaaataccctaagggcgccgggcgagtggctttctctaaccaacagagttacatagctgctatcagtgcgcgcttcgtccagctacaacataatgacatcgacaagcgggtagaggttaaaccgtatgttctcgatgatcagatgtgtgacgaatgccaaggtaccaggtgcggtggtaagttcgccccatttttttgcgccaatgtgacatgcttgcagtactactgtgagtattgctgggcctccatacatagtcgcgcaggccgcgagtttcataagccgctggtgaaagaaggaggcgatcgacccagacacgttccattccgctggtcctag

SEQ ID NO: 184604 - DNA, 2190 bp, Artificial Sequence
  Description of Artificial Sequence: Synthetic coding sequence
atgggcgactacggcttcggcgtgctggtgcagagcaacaccggcaacaaaagtgctttccctgttcgttttcacccccacctacaaccaccacatcaccaccaaaacgcaacgccctctccagctgctttcatcaataataacaccgctgctaatggctcctctgccggctctgcttggctgttcccagctcctgccacgcataatatccaagatgaaatactggggtcagaaaaggcgaagtcccagcagcaggagcaacaggatcctctcgagaagcagcagctatctccttcccccggtcaggaagccggcatcctgcccgagactgaaaaggctaagtccgaggaaaaccagggagataactcctctgaaaacggcaacggaaaggagaaaataagaatcgagagccctgtgctgactgggtttgactaccaggaggccacaggtcttggcacttctactcagccactgacgagctccgcatcctccttgactggattcagcaattggtccgcagcgattgcacccagtagctccacaataattaatgaggacgccagttttttccatcagggcggagtgcccgcagcaagcgcgaacaatggggctctcctgtttcagaactttccacaccacgtcagtcctgggttcggaggatccttctcccctcaaattgggccgctgagccagcaccatccacaccatccgcacttccagcaccatcactcacagcatcagcagcaacggaggtcacctgcgtccccccatcctcccccattcacccatcgcaatgcagctttcaaccagctccctcatctggccaacaacctaaacaaacccccatccccatggtcatcatatcaatcaccatctcctacaccatcatcatcatggtccccagggggcggcgggtatggaggatggggggggtctcaaggccgtgaccatcgacgtggccttaacggtggaatcactcccctgaacagtattagccctctaaagaagaacttcgcctccaaccatattcagctgcagaagtacgccagacctagcagtgcatttgctccaaagtcatggatggaggattccctcaaccgggctgacaacatcttcccttttccggatcggccacgaaccttcgatatgcatagcctcgaatcatctttgattgacattatgcgagccgagaacgacactatcaaaggtcggctgaattatagctacccaggatcagattccagcctgctgattaatgcgcggacctatggaaggagacgcggccagtcgagcttgttccccatggaagatggttttcttgatgacggaagaggtgatcaacccctgcactcgggactcggctccccgcattgtttttcccatcagaacggcgaacgcgttgagcgctacagccggaaggtttttgtcgggggactcccacccgatatagatgaagatgagattacagcctcctttaggaggtttggtccacttatcgtcgactggccacataaggctgagagcaaatcctattttccacccaagggatacgccttcttgctgtttcaagacgagtcctccgtgcaggccctcatcgatgcatgcatcgaggaggatggcaagctgtatttgtgtgtgtcaagtccgaccattaaggacaagcctgttcagatacggccttggaacctctctgactccgattttgttatggacggctcccagcctctcgacccaagaaagacaatctttgtgggtggggtgccaagacccctgcgggcagtcgagctcgccatgattatggatcgcctgtacggcggcgtttgttatgcgggcatcgacaccgatccggagctgaaatatccaaagggtgccgggcgcgtcgcatttagtaatcaacagagctatatcgccgctatcagtgcccgcttcgtccagctgcaacacggcgaaatcgacaagcgggtcgaggtgaaaccttacgtacttgacgatcaactttgtgatgaatgtcagggggcaaggtgcgggggaaaatttgcgccctttttctgcgctaatgtaacctgtctgcagtactattgtgaatactgctgggcagcaattcacagcagggcgggcagagagtttcacaagccccttgtgaaggaaggcggagatcggcccagacacatctccttcaggtggaactag

SEQ ID NO: 184605 - DNA, 2139 bp, Artificial Sequence
  Description of Artificial Sequence: Synthetic coding sequence
atgggcgactacggcttcggcgtgctggtgcagagcaacaccggcaataagtccgcttttcctgtgcgtttccatccacatctccaacccccacatcatcaccagaatgccaccccctccccagctgcatttatcaacaataatacggctgccaatggctcctccgccggcagtgcctggctctttcccgcgccggccacccataacatccaagacgaaatactgggctccgaaaaggccaagtctcaacaacaggagcagcaggatcccttggagaagcagcagctcagtccgtcacccggccaagaggccggaatactacccgaaacagagaaggccaaatctgaagaaaaccagggcgacaacagttctgagaacgggaatggaaaggagaagatccgcatcgagtctccagtgttgacgggcttcgattatcaggaagccacaggactcggaacctcaacgcaaccactgacctcgtccgccagctctctgacaggcttttcaaactggagcgccgccattgccccatcatctagcacgatcatcaacgaggatgcaagtttcttccatcagggaggcgtacctgccgcatctgccaacaatggggcattgctatttcagaactttccccatcacgtaagtcccggatttggggggtccttttcaccgcagattggacctttgtctcagcatcatccacaccacccccactttcagcaccaccatagtcaacaccaacagcaaagacgatcaccagcctcaccccacccaccaccattcacccacaggaacgctgccttcaatcagctcccccacctggcaaacaatctcaataaacctcccagcccctggagttcttaccagtccccctcacccacacccagcagctcttggtcccctggaggaggcgggtatggtggctggggtggctctcaaggcagagaccacagaaggggcctgaacggcgggataacaccgctaaactccatatccccacttaaaaagaatttcgcgagtaatcacattcagctccagaagtacgcccgtccaagttcagcattcgctccaaaatcttggatggaggactcactcaatcgggcggataacatcttcccctttcctgatcgcccccgcacctttgacatgcacagtttggagtcctctttgattgacattatgcgcgccgaaaacgatactatcaaagctcgaacctacggaagacgcagggggcaatcctcactttttccaatggaagacgggtttttagatgacgggcgaggagaccaaccactgcattccggattgggcagtccccattgtttctcacaccagaatggggagagagtagagcgctatagcaggaaggtgtttgtgggcggtctcccccccgatatcgacgaggacgagatcaccgccagctttaggagattcgggccgttgattgtggactggccccataaagcggagagcaagagttactttccccctaagggatacgcatttctccttttccaagacgagtcgtcagtgcaggcactcatcgatgcctgcatcgaggaggatggaaagctctacctgtgcgtgtcatctcccactatcaaggataagcccgtgcagattaggccttggaatctttccgacagcgacttcgttatggacgggtcacaaccattggaccccagaaagaccatctttgtggggggtgtgccgcggcccctgcgggccgttgagctggctatgatcatggaccgactgtacggaggcgtttgctacgcagggattgacaccgatccggagctcaagtacccaaaaggcgcagggcgcgtggccttttccaaccagcaaagctatatcgctgctatatctgctaggttcgtccagctgcagcacggggagattgataaaagggttgaggttaagccctacgttcttgacgatcaactgtgcgatgaatgccagggggctcggtgcggagggaaatttgcgccattcttctgcgcgaatgtgacatgcttacagtactattgcgaatactgctgggcggccattcattctagagcgggtagagagttccacaagccgctagttaaggagggaggcgaccgacctcgccacatttctttccgctggaactag

SEQ ID NO: 184606 - DNA, 2049 bp, Artificial Sequence
  Description of Artificial Sequence: Synthetic coding sequence
atgagcacccccgccgtgccccaggacctgcagctgccccccagccagcgcgcacaaagcgctttcaaggaacagcggcggcagaagttgaaggagcatttactgcgacgaaagaccctgttcgcttataaacaggaaaatgagatgttgagctccagggaccagcgcgttgtcacctcagaggatcaagtgcaggaaggcaccaaagtgttgaaactcaagaccaagatggccgacaaggaaaatatgaagcgacctgcggagtccaaaaataatactgtggtgggcaagcactgtattcccctcaaacctagcaatgagcttacaaatagcaccgtagtgattgacacacataagccaaaggacagtaatcagacacctcacctgctcttgacagaggatgaccctcagagccagcatatgacattgagtcaagcgttccacctcaagaataattcaaagaagaagcaaatgactaccgagaaacagaaacaggatgccaatatgcccaagaagccagtgttaggttcttatcgagggcagatcgtacaatccaagataaactcctttagaaagccactgcaggttaaggatgagtctagtgccgctacaaagaagctcagtgccacaatccctaaagctacaaagccccagcctgtgaacacgagctcagtgacagttaaatccaaccgctcctccaacatgacagccacaacaaagtttgtttctaccaccagccagaacacacagttggtgcgcccacctatcaggagccatcatagtaacacaagagatacagtcaaacagggaatcagccgtacatcagccaatgtgacaatacgaaagggaccacatgagaaggagctgttacagagcaagactgcactgtcaagcgtgaagaccagcagctcccaaggtatcattcggaacaaaacgttgtctagaagcattgctagtgaagttattgcccgcccagcctcattgagcaatgacaagctgatggagaaatcggagcccgtggatcagaggaggcatactgcgggtaaagcgattgtggactctcggagcgctcagccaaaggaaacctccgaagaacgcaaggcaagactatcagaatggaaggccggaaagggcagggtactgaagcggccccctaactctgttgtgacccagcacgagccagccggacagaacgagaaacccgtcggcagtttctggacgaccatggccgaagaggacgaacaaagactatttacagagaaggtaaataatacattctccgaatgtctgaatcttatcaacgaaggctgtcctaaggaggacatcctcgttacactaaacgacctcatcaagaatattccagatgctaagaaattagtaaagtactggatctgtctggccctcatcgagccaattaccagtcctatagagaatatcattgcaatttacgagaaggcaattctggctggagcacagcctattgaagagatgaggcataccattgtggatatcttgacaatgaagtcacaggagaaggcaaacctgggagaaaacatggaaaaatcgtgtgcttctaaagaagaggtcaaggaggtatctatcgaagatactggagtagacgtggatcctgaaaaattggaaatggagtcaaaactgcatcgaaatttgctgtttcaggattgcgagaaggagcaggataacaagacaaaggaccctacacacgacgtgaaaactcctaacacagagacaaggacctcttgtcttattaagtacaacgtgtccaccaccccatatctgcaaagcgtgaagaagaaggtgcagttcgacgggacaaactccgccttcaaggagctgaagttcctgacccctgtccgccggtcccggcgactccaagagaaaacttcaaagctgccagatatgctgaaagaccactatccctgcgtgtcatccctagaacagctgacagagctggggagagaaacagatgcatttgtgtgccgaccaaacgccgccttgtgtcgagtgtattatgaggccgatacgacctag

SEQ ID NO: 184607 - DNA, 1485 bp, Artificial Sequence
  Description of Artificial Sequence: Synthetic coding sequence
atgagcacccccgccgtgccccaggacctgcagctgccccccagccagcgcgctcagagcgccttcaaagagcagcggagacagaaactcaaggaacacctgctccggcgtaagactttgttcgcttacaagcaggagaacgagatgctgagttcccgcgaccagcgagtggtgacctctgaagatcaggtgcaggagggtaccaaggtcctcaagctgaagaccaagatggctgataaggaaaacatgaaacgtcctgccgaatctaaaaacaacacagtcgtcggcaagcactgcattccacttaaacccagtaacgagttgactaatagcaccgttgtcattgatacccataagccaaaagatagcaatcagacccctcatcttctgctgaccgaggatgatccacagtcgcagcatatgacactgtctcaggcatttcatctgaagaataacagcaagaagaaacagatgacgacagaaaagcagaagcaggatgccaacatgccaaagaagcctgtgctcggatcctatagaggacagattgttcagagtaaaattaatagtttcaggaagccactgcaggttaaagacgagagctctgctgccactaagaagctctccgctaccatccccaaggcaacaaagccccaaccagtgaatacatcaagcgttactgtgaaaagtaaccgctcctccaacatgaccgcaaccaccaaatttgtgagtacaacctctcagaatactcagctggttagacccccaatccgcagtcaccacagtaacactcgggacaccgtgaaacagggaatctcccgaactagtgcaaacgttacaatccgtaagggtccgcatgagaaagaacttcttcaatcaaaaacagccctgtctagtgtgaagacaagttcctcgcagggcattattcgcaacaagacccttagccgttcaatagcttctgaggtgatcgcacgtcctgcctccttatctaacgacaaactgatggagaagtccgaacctgtcgatcagcggcggcacactgcagggaaggctattgtcgactcccgcagtgctcaacctaaagagactagtgaagaacggaaagcacgcctgagcgaatggaaggccgggaaagggagggttctgaaacggcccccgaacagtgtcgtgacacagcacgaacctgctggccagaatgaaaagcccgtaggtagtttttggaccaccatggccgaggaggatgagcaaaggcttttcacagaaaaggtgaataacacattctccgaatgtctaaacttaataaacgagggctgtcctaaggaagacatcctcgttactttgaatgacctaattaaaaacatccccgatgcaaaaaaactagtgaagtactggatctgcctcgcactcatagagccaatcaccagccccattgagaatattattgctatctacgagaaggccatacttgcaggagcccaggttcggtag

SEQ ID NO: 184608 - DNA, 2052 bp, Artificial Sequence
  Description of Artificial Sequence: Synthetic coding sequence
atgagcacccccgccgtgccccaggacctgcagctgccccccagccagcgagctcagtctgcattcaaagaacaacggcggcagaaacttaaggagcaccttctcaggcgcaaaactctcttcgcatataagcaagaaaacgaaatgctgtcatcttccagagaccagagggtggtgactagcgaggaccaagtgcaggagggaaccaaagtgctgaagttaaaaaccaaaatggccgataaagaaaacatgaaacgtccggctgagtcaaagaacaatacggttgtaggaaagcactgtattcctctcaagcccagtaacgaactgaccaatagtaccgtggtaattgacacccacaaaccgaaagactctaatcaaacaccgcatctgctgttaacagaggacgacccacagtcacaacacatgacactgtcccaggcatttcatctgaagaataacagcaaaaagaaacagatgactactgaaaaacagaagcaggacgccaacatgcctaaaaagccggtgcttggaagttaccgcgggcaaattgtccagtctaaaattaacagcttccggaaaccactgcaagtgaaggatgaatcttcagctgcaaccaaaaaactgtccgccacaattccaaaggccaccaagcctcagcctgtgaacacgtcctcagtcaccgtcaaatctaacagatccagcaatatgacagcaaccacaaagtttgtttcgactacctctcagaacacacagctcgtgcgtccaccaattcgatctcaccactcaaacactagggacactgtgaaacagggaatctcccgtacatccgcaaacgtcacaattagaaagggccctcacgaaaaggagctgctgcaaagcaaaactgccctgtctagcgtcaagaccagcagtagccaagggataataagaaataagacgctgtcgcggtctatagctagcgaagtgatcgctcggcctgccagcctgtcaaacgacaagttgatggagaaaagcgaacctgtggaccagcggcggcacactgcaggcaaggccatcgtcgactcaaggagcgcccagcccaaagagacatctgaggaaagaaaagcaagactctctgagtggaaagccggcaaaggaagagtgctcaagcgccccccgaattcggttgttactcaacatgaacctgctggtcagaatgagaagcccgtcgggtcattctggacgacaatggccgaagaagacgaacagagactgttcacggagaaggttaataatacctttagtgagtgcctgaacctcatcaacgaaggctgtcctaaagaagacatcctcgtgaccctgaatgatttgatcaaaaacataccagatgccaagaagcttgtgaagtattggatttgcctcgcccttatagaacctatcacaagtcctatcgagaacatcatcgccatatacgaaaaggccattttggccggcgctcagccaattgaggagatgagacatacaatcgtggatatcctgaccatgaaatcacaggaaaaagcaaacctcggagaaaacatggagaaatcgtgcgcttcaaaagaagaagtaaaagaagtctcgatcgaggacaccggcgtggacgtggacccggagaagctggaaatggagagtaagctgcatagaaacctgctatttcaagattgtgagaaggagcaggacaataaaactaaagacccaacacacgacgtgaagacacctaacactgaaaccaggactagttgcctaatcaagtacaacgtttccactaccccgtatctccagtctgtgaaaaagaaagtgcagttcgacgggacaaattcggctttcaaagaacttaaatttctgacaccagttcgcaggtcaaggcgccttcaggagaaaacttccaagctgccagacatgcttaaggatcactacccatgcgtcagctctcttgagcagctcactgagctgggccgtgaaaccgacgcttttgtctgcagacccaacgctgcgttatgtcgtgtgtattacgaggcagataccacttag

SEQ ID NO: 184609 - DNA, 1488 bp, Artificial Sequence
  Description of Artificial Sequence: Synthetic coding sequence
atgagcacccccgccgtgccccaggacctgcagctgccccccagccagcgcgcccagagtgcattcaaagagcaaagaagacagaaattgaaggaacatctgctgaggaggaagacgctcttcgcctataaacaagagaatgagatgttgagcagctctcgggatcagagagttgttactagtgaggatcaggtgcaggaaggtacgaaggttttgaagttgaagactaagatggccgacaaggaaaatatgaaaaggccggcggagagcaaaaacaacacggttgtgggaaaacattgtatccctttaaagcctagtaatgaactcaccaatagcaccgtggtgattgacacccacaagccaaaagattccaatcaaacccctcatctgttactgactgaggacgaccctcagtctcagcacatgacactgagtcaggccttccatctgaagaataattcaaagaagaaacaaatgaccacagaaaagcaaaagcaggatgctaatatgccgaagaaacccgtgctgggctcctatcgcggtcaaatagtgcaatctaaaataaactcttttcggaagcccctccaagttaaggacgagtcatcagccgcaacaaagaaactttctgccacaatccctaaggcgactaaaccccagccagtgaacacatcctctgtgacagtgaaatcaaatcgatcttccaatatgactgctaccaccaaatttgttagcaccacttcgcaaaacacacagcttgttagacccccgattcgcagtcatcatagcaacactcgggatactgtcaagcagggcatcagccggacaagcgcaaatgttaccatccggaagggccctcacgagaaggaactccttcagtctaagacggccctgagctcggtgaagacatcatctagccagggtatcattcggaataaaactctctcaaggagtattgctagcgaggtaatagcccgccccgctagcctgtccaacgacaagcttatggaaaaaagcgaaccagtggaccaacgcaggcacacggcggggaaagctattgtcgattcacgcagtgcacagccaaaagagacctcagaagagcggaaggccagactctccgagtggaaggcaggtaagggccgagtcctaaagagaccaccaaacagtgttgtgactcagcacgaaccggccggacaaaatgagaagcccgtcggatccttttggaccaccatggctgaggaggacgagcagaggctgttcactgagaaggtgaacaacaccttctctgaatgtttaaatcttatcaatgagggctgtcctaaggaggatattttagtcaccctaaacgacctcattaaaaacatccctgacgccaaaaaactggtcaaatactggatctgcctcgcgctcatagaaccaatcacttccccaatcgagaacattatcgcaatttacgagaaggcaatactggctggggcccagcacatctag

SEQ ID NO: 184610 - DNA, 5919 bp, Artificial Sequence
  Description of Artificial Sequence: Synthetic coding sequence
atgggcgacgacagcgagtggctgaagctgcccgtggaccagaagtgcgagcacaagctgtggaaagctcggttatccggctatgaagaggccctgaaaatctttcagaaaattaaagatgagaagagccctgagtggtctaaattcctggggttaatcaaaaagttcgtcaccgactcgaacgcagtggtccagctgaaaggcctggaagcggcactggtgtatgtggagaacgcccatgtggccggaaaaactacaggagaggtagtgtccggagttgtgagcaaggtcttcaaccaacctaaggccaaggcgaaagagctaggcattgaaatctgtctaatgtatatcgagatcgagaaaggcgaagctgtacaagaagagcttctgaagggcctcgacaacaaaaatcctaagatcatcgtggcctgtatcgagactttaaggaaagcgctctctgagttcgggagcaaaatcattctgctgaagccaataatcaaagtactgccaaagctgtttgaatcacgggagaaggcagttcgggatgaggccaagctgatagctgtagagatttaccgatggataagagacgccctgcgccctcccctacagaacattaactccgtccagttgaaagagcttgaggaagaatgggtcaaactacccacaagcgcacctagacccacgcgcttcctgcgctctcagcaggagctggaggcgaaacttgaacaacagcagtctgccggcggggacgccgaaggcgggggtgacgatggcgacgaagtgccacagatagatgcttacgagttgctggaagcagttgaaattctgtccaagctcccaaaagacttctacgataagattgaggccaagaaatggcaggaacggaaagaggctctggagtccgtagaggtgttaatcaaaaaccctaaattggaagcaggggattatgccgacctggtgaaggcattgaagaaggtcgttggaaaagacactaacgtgatgctggtggccttagccgcaaagtgcttgacgggcctcgcagtgggtttacggaagaagttcggacagtacgcgggccatgtggttcctaccattctcgaaaagttcaaggagaagaagccacaggttgtccaagctttacaggaggctattgatgccatctttctcacaaccaccctgcagaacatttcagaggatgttttggccgtaatggacaacaagaacccaacaattaagcagcaaacatcccttttcattgccaggagctttagacactgcaccgcaagcacactgcccaagtcactgctgaagcctttctgcgcagccttgctcaaacatattaacgatagcgcccccgaggttcgcgacgccgcctttgaggccctgggaacagccctgaaagtagttggcgagaaagctgtcaacccattccttgccgatgtcgataagctgaagttagacaagatcaaagaatgctccgagaaggttgagcttatccatggaaaaaaggccggactggccgctgacaagaaggaattcaagcctctgcccggaaggacagcagcatctggggctgctggcgataaggataccaaggatattagtgctccaaaacccggcccgcttaaaaaggcgcctgcagctaaggcgggagggcccccaaagaaaggcaaaccggccgcccctgggggcgcgggcaatacaggcaccaagaacaagaaaggtctggagacaaaggagatagtcgaacctgagctgagtatcgaggtctgcgaggaaaaggcctctgctgttctgccgcccacttgtatacagctgcttgactcaagcaattggaaagagcggctcgcttgcatggaggaattccagaaagcagtggaactgatggaccgaactgagatgccctgtcaagccctggtacgcatgctggcaaagaagcctggatggaaagagactaatttccaagtgatgcaaatgaagttgcatattgtggccctgattgcgcagaagggcaatttctccaaaacctccgcacaggtggtgttggacggcctggttgacaaaattggggacgtcaaatgcggtaacaacgctaaggaggccatgaccgccattgctgaagcatgcatgcttccatggaccgctgagcaggtcgtctccatggctttttcacagaaaaacccaaagaaccaatccgagaccctgaattggctgtcaaacgccattaaagaattcgggttttcaggactgaacgtgaaagctttcatttcaaacgtcaagaccgcactcgctgccaccaatcctgctgttcgcaccgcagctatcacccttctaggtgtgatgtatctgtacgtgggaccttccctaaggatgttttttgaggacgaaaagcccgccttgctgagccagatcgacgccgagtttgaaaagatgcagggccagtcaccccctgctcctacccgaggaatctcgaagcacagcacctcaggcactgacgagggcgaggatggggacgaacccgacgatggcagtaatgacgtcgtcgacctgctgccacggacggaaattagcgataaaataacttcagaactcgtgagcaagataggtgataaaaattggaagatccgaaaggaaggccttgatgaggtggccggaatcataaacgacgctaaatttattcagccaaatattggtgagttgcctactgctttgaagggtagactgaacgacagcaacaaaattctggtacagcagacgctaaatatcttgcagcagcttgctgtagctatggggccaaacatcaagcagcatgtgaagaaccttgggatcccaatcattacggttcttggggattccaagaataacgtgagggccgcggctctcgccacagtaaatgcgtgggcggagcagacggggatgaaagaatggcttgaaggagaggacctttctgaggaactcaagaaggagaaccccttccttaggcaggaattactcgggtggttagccgagaagttgcctactctccggtcaactcctacagacttaatcttgtgcgtgccacacttgtactcttgtctggaagataggaacggtgacgtccggaagaaggcccaggatgcgttgcccttctttatgatgcacctgggttatgagaagatggccaaagccactggcaagcttaaacctacgtccaaagatcaagtcctggcaatgttagaaaaggcaaaggtgaacatgccagcgaagcctgcaccgcctaccaaggccacctccaaacccatgggcgggtccgcacccgccaaatttcagccagccagcgcccctgcggaggattgcatatctagctctacagagccgaaacctgatccaaagaaggctaaagcccccggcttgagtagtaaggctaaatccgcccagggaaagaaaatgccttcaaagacctccctgaaagaggacgaagataagtcgggaccaatctttattgtcgttccaaacggtaaggagcagcggatgaaagatgagaaaggcctcaaagtgttgaagtggaatttcacaacccctagggacgagtacatcgaacagctgaagacacagatgagtagctgcgtggcaaagtggctgcaggacgagatgtttcatagcgacttccagcatcacaacaaggctctggcggttatggtggatcaccttgaatcagagaaggaaggcgtgattggctgcctggacctgattctcaagtggctgaccctgaggttctttgacacaaacacttctgttctgatgaaggccctggaatacctgaagttgttgttcaccctgctctccgaagaggaatatcacctgaccgaaaacgaggcgagttcctttattccctatctggtcgtcaaggtgggcgagcccaaggatgtcatccggaaggatgtgagagcaatcctgaataggatgtgtttggtttaccctgcctccaaaatgtttccatttattatggaaggaactaaatccaagaactccaaacagagagcagagtgcctcgaggaactgggctgcttggtggagtcatacgggatgaatgtgtgccagcccacacccggcaaggccctgaaagagattgctgtgcacatcggagatcgggacaacgccgtgcggaatgccgcactcaacacaatcgtaactgtgtacaatgttcatggtgaccaggtgtttaaacttatcgggaacctatcagaaaaagatatgagtatgctggaggaacgcatcaaaagatccgctaaaaggccctcagccgctcccataaaacaggttgaggagaagcctcagagggctcagaatattagttccaatgccaatatgttgcgcaaagggccggcagaggatatgtcatccaagctgaaccaagcgcggtctatgtcagggcaccctgaggcggcccaaatggtcaggagagagtttcaactggatttggatgagatcgagaacgataacggaacagtgcggtgcgagatgccggagctggtccaacacaagcttgacgacatcttcgagcctgtgctcatacctgaacccaagatccgcgccgtctcaccccacttcgatgatatgcatagtaacacggcctcgacgatcaacttcatcattagccaggtcgcctctggtgatataaacaccagcatccaggcccttactcagctctttcaaatagaaagcctggctcgggaggccagcaccggggtcttaaaagatttgatgcacggcctgatcaccctcatgctcgactctcgtattgaggatctagaggagggccagcaagttattaggagcgtgaatctcctggttgtaaaggtattggaaaaatcagatcagactaacatactcagcgccctcctggttctgcttcaagattctctgctggcgaccgcctccagcccaaaattcagtgaacttgtgatgaaatgcctatggcggatggtaagactgctgccggacactattaattccatcaatttggaccgtatcctacttgacatccatatctttatgaaggtgtttccaaaagaaaagctcaaacagtgcaagtcagaatttccaataaggaccctgaaaacactgctgcatacactatgtaaactaaaaggaccgaaaatactggaccacctgactatgatcgataacaagaacgaatctgaactagaggcccacctttgtagaatgatgaagcactctatggatcaaacgggatccaaatccgacaaagagaccgaaaaaggagccagccgcatcgacgaaaaaagttccaaagccaaagtcaacgattttctagccgagatctttaaaaaaataggaagcaaggagaatacaaaagaaggcttagccgagctgtacgagtacaagaaaaaatatagtgatgccgatatcgagcctttcttaaagaacagttcccaattcttccagagctacgtcgagagaggcctgcgggttattgagatggaaagggaaggaaagggacgaattagcacatccaccgggatttcccctcaaatggaggttacatgcgtgcctacgcccacatcgactgtgtcatcaatcggtaatacaaacggagaggaagtggggccctcggtgtatctggaacggctgaaaatcctgcgtcagagatgtggactagataacactaaacaggatgatcgccccccgttaacctccttgctcagcaagcctgccgtgcccacagtcgcaagctcgacagacatgctccactccaaactctcccagctgcgtgagagtagagaacaacatcagcattcagatctggactctaaccagacccattcaagcgggacagtgactagcagttcgtctactgctaatattgatgatctcaagaagcggctggaaaggatcaagtcaagtaggaaatag

SEQ ID NO: 184611 - DNA, 5919 bp, Artificial Sequence
  Description of Artificial Sequence: Synthetic coding sequence
atgggcgacgacagcgagtggctgaagctgcccgtggaccagaagtgcgaacacaagttgtggaaggcccgcctgtccggatacgaagaagcactgaaaatctttcagaaaatcaaagacgagaaaagtccggagtggagtaagttcttggggctcataaagaagttcgtgactgattcaaatgcagtcgtgcaactgaagggactggaggccgccctcgtctacgtggaaaacgcccacgtcgcgggcaaaacaaccggggaagtcgtctccggtgtagtatcgaaggtgttcaaccagcctaaagccaaagccaaggagctgggtatagagatttgtctgatgtacattgagatcgaaaagggagaggctgtgcaggaggagctactgaagggattagacaataagaacccaaaaatcatagtggcttgcatcgagacgctcaggaaagccttgagtgagttcggttctaaaattatcctgctgaagccaatcattaaggttttgcccaaactatttgaatcccgcgagaaggccgtaagagatgaggctaagctgattgcagtcgagatctatagatggatccgcgacgcattgcggccaccactccaaaatattaattccgttcagctcaaggaactcgaggaagaatgggtaaagcttccgacatcagccccacggccgacacgcttcctgcgttcccagcaggagctggaagctaagctagagcaacagcagagcgccggcggggacgcagaagggggcggcgatgatggggacgaagtcccacagatcgatgcttacgagttattggaggccgtcgaaattctgtcaaagctgcccaaggacttttacgataaaattgaagcgaagaaatggcaggaaagaaaagaggccctggaaagcgtggaggtgctgatcaaaaatccaaaactggaagccggagactacgccgacctggtaaaagccctgaagaaggtggtgggcaaggacactaacgtgatgctggtggccctggccgctaagtgtcttactgggttggccgttgggctgagaaagaaatttggccaatacgcaggtcacgtggttcctacgatcttggaaaaatttaaggagaagaaacctcaggtggttcaggccctacaagaagccatcgatgctatattcctcaccactaccctgcagaatataagtgaggacgtcctcgccgtcatggataacaagaaccctactattaagcaacaaactagtctctttattgctaggagttttagacactgtactgctagtaccctgcccaaatctctccttaagcccttctgcgccgcgctgctcaagcatattaatgactctgcacctgaggtgagagatgcggcattcgaggcactaggcacagctctgaaggtggtgggcgagaaagccgtcaaccccttcttagccgatgtggataaactgaaactggataaaattaaggagtgctcagagaaggtagagctaatccatggcaagaaagcgggtctcgccgctgacaagaaggagttcaagcccctgccaggaagaacagccgcctcaggagcagccggcgataaagacaccaaggatatctctgcccccaaacctggcccattgaagaaggcccctgccgctaaagccggagggcccccaaaaaagggaaaacctgccgcacccggcggtgccgggaacactggcacaaaaaataagaaggggttggagacgaaggaaattgtggaacccgaactttctatcgaggtatgcgaagagaaagcctcagccgtactaccccctacctgcatacaacttttggatagctcaaattggaaagagcggctcgcctgtatggaggagttccagaaagcggttgagttgatggaccgcaccgagatgccatgccaggctctggtccgcatgctggccaaaaagcccgggtggaaagaaaccaatttccaggtaatgcaaatgaagctccatattgtggctctgatcgctcagaaaggtaatttctcaaaaacctcagcccaggttgtattggacgggctggtggataaaatcggcgatgtgaaatgtggcaataacgccaaggaggccatgacagcaatcgctgaggcatgcatgcttccttggaccgccgagcaggtggtgtcaatggctttctctcagaagaatcctaagaaccagagcgagacactcaactggctgtccaacgccattaaagaattcgggtttagtggactgaatgtaaaagcttttatttcgaacgtcaagactgccctggccgccaccaatccagccgttcgaacggccgctatcacacttctgggcgtcatgtatttatacgtcggcccctctctgcgcatgtttttcgaggatgagaagccagcccttctgtcccagatcgatgccgaatttgaaaagatgcagggccagagcccgccagctcccacaagggggattagtaagcactcgacgtccggcacggatgaaggcgaggatggcgatgaacccgacgatggcagtaacgacgtggtcgaccttctgccacggacagagatatccgacaagatcacgagcgagctcgtttccaaaattggtgacaagaattggaaaatcagaaaagagggcctggatgaggttgctgggatcataaatgatgctaaatttattcagcccaatatcggagagttaccaacagccctgaaaggacggcttaatgattccaacaaaatcctggtccaacagactctcaatattcttcagcagctggccgttgccatgggaccaaacatcaagcagcatgttaagaacctgggtatccctatcattactgtccttggggattccaagaataatgtccgagccgcagcgctggccacagtgaatgcctgggccgagcagactggaatgaaggagtggttggagggagaggacctgtctgaggagcttaaaaaggagaacccctttttaaggcaagaacttctcggctggctggccgagaagctccctactctcagaagcacgcccacagatctcattctctgcgttccccatctgtattcatgcctggaagatcggaatggagacgttcggaagaaggctcaggatgccctgcctttctttatgatgcatctagggtacgaaaagatggcaaaggccacaggaaagttgaaaccaacctcaaaggaccaggtcctggcaatgctggagaaagctaaggttaatatgccagctaagccggcgccccccacgaaggccacaagtaagcctatgggagggtcggcccccgcgaagtttcagccagcctcagcgccggccgaagactgtattagcagctccactgagccaaaacccgacccaaaaaaggctaaggcgccaggcctgtcttccaaggctaaaagtgcccagggtaaaaagatgcccagtaaaacctcactgaaggaagacgaggacaagtctgggcccattttcatcgtagtccctaacggcaaagaacagcgaatgaaagacgagaagggtctcaaagtgctgaagtggaacttcacaacccctcgcgatgaatacatcgaacagctcaaaactcagatgagttcctgcgtggccaaatggcttcaggatgagatgttccatagcgactttcagcatcacaacaaagccctggcggtgatggtggaccaccttgagagtgagaaggagggcgtcatcggttgcctggacctaattctgaagtggctgaccctacggttcttcgacaccaatacatccgtgcttatgaaggccttagagtaccttaaactcctcttcaccttgctaagcgaagaggaatatcacttgacagagaatgaggcctcaagctttatcccataccttgtggtgaaggtgggtgagccaaaggatgttatccgcaaggatgtgagagccattttaaatcgcatgtgcttggtatacccggcctctaaaatgtttccctttatcatggaggggactaagtctaaaaatagcaagcagcgtgctgaatgtctggaggagctcggatgtctggtggagtcttacggcatgaacgtatgccagcctaccccaggcaaagctttaaaagagatcgccgttcatatcggcgatcgcgacaatgccgtgcgcaacgccgctctcaatactattgtgactgtctataatgtccatggcgatcaggtgttcaaactgattggcaatctgtctgagaaagacatgtcaatgttggaagagaggatcaaaagaagcgccaaaagaccttccgctgcccccatcaaacaagttgaagagaaaccgcagcgtgcacaaaatattagctccaacgccaacatgctgcgaaagggtcccgcagaggatatgagctctaagctgaatcaagcacggtccatgagcggtcaccctgaagccgcccagatggtgcgacgagagtttcagctcgatctcgatgaaatcgaaaacgataatggaaccgtaaggtgtgaaatgcccgaactggttcagcacaaactggatgatatctttgagccggtgttgatccccgagccaaagatccgcgccgtcagtccacatttcgacgatatgcactctaacactgcgtctaccataaattttattatttcccaggtagccagtggggatattaatacctccattcaggcacttacgcagctattccagatagaatcactggcgcgagaggcttccaccggtgtgcttaaggacttgatgcacggtctgattactctgatgctcgacagcaggatcgaggatctggaagaaggacaacaagtgattagaagcgtcaacttgctcgtagtcaaagttctcgaaaagagcgaccagaccaatatcctgtcagcactgctggtgctgctgcaggacagtctcttagccacagccagttcgcctaaattcagcgagctggtcatgaagtgtctatggcggatggtgcggctcctgcctgatacgatcaattccatcaatttggacagaattcttctggacatacacatctttatgaaagtatttccaaaggaaaagttaaaacagtgtaaaagtgaattccccatccggaccctcaaaaccctcctgcataccctttgcaaacttaagggccccaagattctggatcacctgactatgatcgacaataagaatgaatcagagctggaagcacatctttgtcgcatgatgaagcactctatggaccagactggttcaaagagcgacaaggaaactgaaaagggagcaagtcgcattgacgagaaatcatcaaaggccaaggtgaacgatttcctcgcggagatctttaaaaagataggatccaaagagaatactaaggagggtctggcggaactctatgaatacaagaagaaatactccgacgctgacatagagccgttcctgaaaaatagttcccagtttttccagtcttacgtggagagaggcctgagggtgatagagatggaacgtgagggtaagggccgcatttctacctccaccggcatatcgccccagatggaggttacatgtgtacccacccccacttccacggtcagtagcattggaaacacaaacggagaggaggtcggacctagcgtgtatctcgaacggctgaagatattgaggcagaggtgcgggctggacaatacaaaacaggatgatcgcccaccattgacctcactgctgtccaaacctgcagtaccaacagtcgcatcctccacagatatgctgcacagtaagctgagtcagctccgggaaagtcgcgaacaacatcaacactccgatctggactccaaccagacccacagcagcggaacagtcacctctagctcaagtacggccaacattgatgacttgaaaaagaggttggagaggataaagtcttcccgaaaatag

SEQ ID NO: 184612 - DNA, 906 bp, Artificial Sequence
  Description of Artificial Sequence: Synthetic coding sequence
atgggcgacgacagcgagtggctgaagctgcccgtggaccagaagtgcgaacataagttgtggaaagcaaggttatctgggtacgaagaggccttaaaaattttccaaaaaataaaggacgaaaagtctcccgagtggtccaagttcctcggcctgattaaaaagtttgtgaccgatagcaatgcagtcgttcagctgaaggggctggaggctgcgctggtgtatgtggagaatgcacacgtcgccggcaaaacaaccggcgaggtcgtctccggggtcgtgtccaaggtttttaaccaaccaaaggccaaagccaaagaactgggcattgaaatctgtttgatgtacatcgagattgagaaaggggaggctgtgcaagaggagctcctgaaaggccttgataataagaatccaaagatcatcgtcgcttgtatagagactctgcggaaagcactgtcggaattcggcagtaagattatccttctgaagcctatcatcaaggttctgcctaaactgtttgagtcaagagagaaggccgttcgcgatgaggctaaactgatcgcagtggagatttaccggtggatcagggatgccttaagacccccattacaaaatatcaattcagtgcagctgaaggagctcgaggaggagtgggtgaaacttcccactagtgcaccacgccctactcgctttctcagaagccagcaggagctggaagcaaaactagaacagcaacagtccgcgggcggagacgctgagggaggcggcgacgatggggatgaggttcctcagatagacgcttacgagctcctggaggctgtggaaatcttgtctaagcctaaaacctttatgactaagcttcgacagaaaaacggcaaacgggagaaaaggccctggtcactatag

SEQ ID NO: 184613 - DNA, 6120 bp, Artificial Sequence
  Description of Artificial Sequence: Synthetic coding sequence
atgggcgacgacagcgagtggctgaagctgcccgtggaccagaagtgtgagcacaaactgtggaaggctcgattatcaggctacgaggaagcactcaagatcttccaaaagatcaaagatgagaaaagccccgaatggtccaaatttctaggtcttatcaaaaagttcgttacggactctaacgctgtggtccagctaaaaggcctggaggccgctcttgtttatgtcgaaaacgcacatgttgcgggaaagacaaccggcgaagtcgtgtccggcgtcgtgagcaaggtattcaaccagcctaaggccaaagccaaagagctagggatcgaaatttgcctcatgtacatcgaaatagagaagggggaggccgtgcaggaagaattgctgaagggcctggacaacaagaatccgaagatcattgttgcatgtatcgaaacactgcgcaaagcgctgagtgaatttggaagtaagattatcctactgaaacccattatcaaagttctgcctaagctctttgagtcccgtgagaaggcagttagagatgaggccaagctcatagccgtggagatatatcgatggatcagggacgctctgcgccccccattgcagaatatcaactctgtccagctgaaggagttggaggaggagtgggtgaaacttcccacaagcgcgccacggcccacacggtttctgagatcgcagcaagagctcgaggctaagttggaacagcagcagagcgcaggaggcgatgcagaggggggaggtgatgatggcgacgaagtgccgcagatcgacgcctacgaactgctggaagctgtagagattctgagcaagctgcccaaggacttctatgataaaattgaggccaagaaatggcaggagcggaaagaagccttagagtctgtggaagtgctgataaagaaccccaagcttgaagccggcgattatgctgatctggttaaggccttgaaaaaggttgtgggtaaagacaccaatgtgatgctggtggcattggctgctaagtgcctgacagggcttgcagtgggactacggaagaagttcgggcaatacgccgggcacgttgtccccactatcctggagaagttcaaagaaaaaaagccccaggttgtacaggccctccaagaggcgattgacgcaatcttcctgaccacaacattgcagaacattagcgaggatgtcctggccgtgatggataacaagaatcctaccatcaagcagcagacctcactgttcatcgctcgcagcttccggcactgcactgcttccaccctgcctaagtctcttctgaaacctttttgcgctgctcttctgaaacatattaatgactcagcccctgaagttcgggacgcagcctttgaggctttaggcaccgcgctgaaagtggtaggtgagaaggcagtgaatccttttctagcagacgtggataaactgaagcttgataaaattaaagagtgctcggaaaaagtggagttaatccacggaaaaaaggctggtctcgcggcagataagaaggaatttaaaccactccctggaaggactgccgcaagcggtgccgccggcgacaaggacaccaaagacatatcagccccaaagccaggccccctgaagaaagcgcccgcagccaaagccggtggtcctcctaaaaagggaaaaccagcagctcctggaggtgccgggaatactggcaccaaaaacaagaaagggttggagacaaaggagattgtagaacccgaattgagcatagaagtctgcgaagagaaagcttccgccgtactgcctccaacatgcatccagctactggattcgagcaactggaaagagcgtctcgcatgtatggaggaattccagaaagctgtagagctgatggatagaaccgagatgccctgtcaggccctggtcagaatgttggcgaaaaagcctgggtggaaggagactaactttcaggtgatgcagatgaagctgcacattgtggctttaattgctcagaaaggaaacttcagtaagacatcggctcaggtcgtgctggatggactggtagataaaattggagatgtgaaatgcggaaataacgccaaggaggcaatgaccgccattgccgaggcctgcatgctgccatggactgccgagcaggtagtctcgatggcattttctcaaaaaaatcctaagaatcagtcggagacgctcaattggctgagcaatgcaatcaaggagtttggcttcagcggactgaacgtgaaagcctttatctccaatgttaagaccgccttggcagccaccaaccccgccgtacggaccgctgccattaccctgttgggagtaatgtatctatacgtagggccgtctctgcggatgtttttcgaggatgagaagccagcacttttgagccagattgatgctgagttcgaaaagatgcagggccagagccctccagcacccacgagggggatttcaaagcattctacatcagggacagacgagggggaggatggcgacgagcccgacgacggctccaacgatgtggtggacctcctgccacggaccgagatcagcgacaaaataacaagtgaattggtgtctaaaatcggcgacaagaattggaaaatcaggaaggagggactggacgaggtggctgggatcataaacgatgccaaatttattcagccaaacattggagaacttcctactgcacttaagggtagattaaatgattcaaacaaaatcctcgtgcagcaaacccttaatatcttacagcagttagcagttgctatgggccccaacatcaaacagcacgtcaagaatctcggaatcccgatcatcacggtgctgggggattctaagaataatgtgcgtgccgcggcactggccaccgtcaacgcttgggctgagcaaactggtatgaaagagtggttagagggcgaagatctgtccgaagagcttaaaaaggagaatcctttcctcagacaggaattacttggatggctggccgaaaaactgcctacgttacgatccacccccacggatctgatcctctgtgtgccacatctctactcctgcctcgaggatcgcaacggagacgtgagaaagaaggcccaggatgcactacctttctttatgatgcatctggggtacgaaaagatggcgaaagctactggcaaactcaagccgacctccaaagaccaggttttggctatgttggagaaagccaaagtaaatatgccagccaaaccagcccctcctacaaaggctaccagcaagcctatgggcggcagtgcgcctgccaagttccagccagcatcggccccggctgaagactgtatatccagctccacagaaccaaagcccgatccgaaaaaagccaaggcacctggattatctagcaaggccaaatctgcccagggcaaaaaaatgccttcaaagacttcccttaaggaggatgaagataaaagtgggcctatctttatcgtggtgcccaacgggaaggaacaaagaatgaaagatgaaaaaggtctcaaagtgttgaaatggaacttcacaaccccacgcgacgagtacatagaacagctgaagacccagatgtcttcctgcgttgctaagtggctccaggacgagatgttccactcagattttcagcatcacaataaagcactcgccgtcatggtagaccatctggaatcagagaaggagggcgtaatcggatgtttagatctgattctcaaatggcttaccttgaggttttttgacacaaatacctctgtgctgatgaaggcgctcgaatacctgaagctgctgttcaccctgctgagcgaggaagaatatcacttaactgaaaacgaagccagttccttcatcccctacctcgtggtgaaggtcggtgaacccaaggatgtcatcaggaaagacgttcgcgccattctaaatcgcatgtgtcttgtgtatcccgcgtccaagatgtttccatttataatggaggggaccaagtcgaagaactctaagcagagagctgaatgtctcgaggagttgggctgtttagtggaaagttacggaatgaacgtctgccagcccacaccgggcaaggccttaaaagaaatagccgttcacattggagatagagataacgctgtacgcaacgcagccctcaataccatcgtaacggtgtacaacgtgcatggtgatcaggtgtttaagttgataggcaacctgagcgagaaagatatgagtatgctcgaggaacggatcaaacgcagtgccaagcgcccttcagcagctcctattaagcaagttgaagaaaagccccagcgcgcccagaatatttctagtaacgccaatatgctgcgcaagggtcctgcagaagacatgagctccaagctcaaccaggctcgcagcatgagcgggcatccggaggcagcacagatggtgaggcgggagttccaactcgacctggacgagatcgagaacgataatggtaccgtgcgctgcgagatgcctgagctcgtgcaacacaagttggacgacatcttcgaacccgtgctcatccccgagccaaaaataagggcagtgtctccgcactttgatgacatgcattctaacaccgcgagcacgatcaacttcataatcagtcaggtggcctccggcgacatcaacacttccatacaggctctaacgcagattgacgaggtactgaggcaagaggataaggcagaagccatgtccgggcacatcgatcaatttttaattgccactttcatgcagctgagactgatttacaatacgcatatggctgatgagaaactcgaaaaagacgagattatcaaattatatagttgtattatcggtaacatgatttctctgtttcaaatcgaatcacttgcaagggaggcttccaccggagttttgaaggacctgatgcatggcctcataacactcatgttagactccaggatcgaggacttagaagagggacaacaggtgattcgctctgtgaacctcttggtagtgaaggtcttagaaaagtccgaccaaactaatatcttaagtgccctcctggtgctgttacaagactctctcctcgccactgcatctagccccaagttctccgagctggtgatgaaatgcctgtggcgtatggtcagactgctccctgacacaattaatagcatcaacctggatagaatcttgctggacattcacatcttcatgaaagtcttccctaaagagaaattgaaacagtgcaagtcagagttccctatcaggacactgaagaccctattacacaccctgtgcaagctgaaaggtccaaaatcctgtatgtgcttgccccagatattagaccaccttactatgatcgataataaaaatgaatctgagctagaggcacacctgtgtagaatgatgaagcatagcatggaccagactggaagcaagtctgacaaagaaacagaaaagggagccagcaggattgatgagaagagttctaaagccaaggttaatgacttccttgctgagattttcaaaaaaatcggctcgaaagaaaacaccaaagaagggctggcagagttgtatgagtacaaaaaaaagtacagcgatgccgatattgagccattcttgaagaatagttcccagttctttcagtcctatgtcgaacgtggattgagggtaattgaaatggagcgagagggcaagggtcgaatctctacatcaacaggcatctccccccagatggaggtcacttgcgtgccaacgccaacaagcactgtttccagtattgggaatacgaacggcgaggaagtggggccgagcgtctatctggagcggttgaaaattctgaggcagcgctgtggactggacaacacaaaacaggatgaccggccacctttaacgtctttgttatctaagccggccgttcctacagtagcaagctctacagatatgctgcattccaaactgtcccaactgagagagagccgcgaacagcatcaacacagtgacctggacagcaaccaaacgcatagtagcggaacagttacttcctccagctcgaccgctaacattgacgacctcaaaaagaggctggaacgcatcaagtcttctcgcaagtag

SEQ ID NO: 184614 - DNA, 456 bp, Artificial Sequence
  Description of Artificial Sequence: Synthetic coding sequence
atgggcgacgacagcgagtggctgaagctgcccgtggaccagaagtgtgagcataagctatggaaggcacgactttccgggtacgaagaagctcttaaaatctttcagaagatcaaggacgagaaatcccccgagtggagcaagttcttgggactcatcaaaaaattcgttaccgattcaaatgccgtggtgcaattgaagggcctagaagccgccctcgtatatgtggagaatgctcacgtcgcaggtaagacaaccggcgaggtcgtatccggcgtggtgagcaaggtgttcaatcaacctaaagccaaggctaaggaattagggatcgagatctgtctgatgtacattgagatcgagaagggagaggctgtccaagaagagctgctcaagggactggacaacaagaaccccaaaattattgttgcttgcatagaaactctgcgcaaggcatag

SEQ ID NO: 184615 - DNA, 6099 bp, Artificial Sequence
  Description of Artificial Sequence: Synthetic coding sequence
atgggcgacgacagcgagtggctgaagctgcccgtggaccagaagtgcgagcataaactgtggaaggctcgtcttagtggctacgaggaggcgctgaagatcttccagaaaatcaaagacgagaagtctcctgaatggtccaaattcttgggtctgattaagaagttcgtcaccgattccaacgcagtggtgcagttgaaaggcttggaggctgccttagtgtatgtcgagaacgctcatgttgccggaaagacaacaggcgaagtagtgtctggggtcgtgagcaaagtgtttaaccaaccaaaggccaaagcgaaggaactgggcatagagatctgcttgatgtacatcgagattgagaagggtgaagctgtgcaggaagagcttctcaaaggattggataataaaaaccctaaaattattgtcgcttgtattgaaacactgcgaaaagctctgtctgaattcggcagtaaaatcatcttattaaagcccatcatcaaagtgctgcctaagttatttgagtctagggaaaaggccgtcagagacgaagctaagctgatcgctgtggagatttaccggtggattcgggatgccctccgcccccccctgcagaacatcaattcagtgcagctgaaagagctcgaggaggagtgggtgaagctaccaacttcagcacctcgaccaacgcgctttctccggtcccagcaggagctggaggctaagctggagcagcaacagtcagcggggggggacgccgaaggcggaggtgatgatggggatgaggtcccgcagatcgacgcatatgagcttttagaagcagttgaaatcctctccaaacttccaaaggacttctacgataaaattgaggcaaaaaagtggcaggaacgtaaagaagccctggaatccgtggaggtgctcattaaaaatcctaagctggaggccggggattatgctgacctcgtaaaggccctgaaaaaggtagtgggtaaggatacaaatgtgatgctggttgccctcgccgctaagtgccttactggactggcagttgggctacggaaaaaatttggacaatacgccggccatgtagttcccactattttggagaagtttaaggaaaagaaaccccaggtggttcaggccctccaggaggccattgacgctatttttctcaccactacacttcaaaatatatccgaagatgtcctggcagtcatggacaacaaaaatccaaccatcaagcagcagaccagtttgtttattgctcggagttttcgccattgcactgcaagtaccctgccaaagagtctcctgaagccattctgcgcagccttactcaagcatataaacgactcagccccggaggtcagagacgctgcctttgaggctttgggcacagcgctgaaagtcgtcggcgagaaggctgttaaccccttcctggctgatgtggataagctgaaacttgacaagattaaagagtgctccgagaaggtggaattaattcatggtaagaaggctggtctagcggcggataagaaggagttcaagcccctgccaggccggactgccgcaagcggtgcagcaggagataaagacacgaaggacatttccgcccctaagcctggtccgctgaaaaaagcacccgctgccaaggcaggggggcctcctaaaaaaggaaaaccagccgccccggggggggctggcaataccggcacaaaaaacaagaagggcctcgagaccaaggagatcgtggagcccgaattgagcatcgaagtctgcgaggagaaagcttccgcagtcttgccaccaacttgtatccagttattagatagttcaaattggaaggagagacttgcgtgtatggaggaattccagaaggccgttgaactgatggatagaacagagatgccatgccaggcacttgtgcggatgctggccaaaaagcccggctggaaggagacgaattttcaggtgatgcaaatgaaattgcacatcgtcgcccttatcgcacagaagggaaacttttcaaaaactagcgcccaggtcgttttggacggtctggtcgataagataggagacgtgaagtgcggcaataacgctaaagaggcgatgactgctattgctgaggcttgtatgttgccgtggacagcagagcaggtggtctcaatggccttttcacagaaaaacccgaagaaccagagtgaaaccctgaactggctgtctaacgccatcaaagagttcggcttttctggcctgaatgtcaaagcatttataagcaacgtgaaaacagcacttgctgccacgaaccccgctgtccggacagccgcgatcactctcctgggtgtcatgtacctctatgtgggacccagcctccgcatgtttttcgaagacgagaaaccagcacttctatctcagatagatgcagaattcgaaaaaatgcagggacagtcccccccagcaccaacccgtggcatctctaagcattctacctccggcacagacgaaggggaagacggggacgagccagacgatggtagcaatgatgtggttgacctgctccctaggaccgagatctcagataaaattaccagtgaactcgtatcaaaaattggagataaaaactggaagattcggaaggagggattagacgaggtagcgggaattataaacgacgccaagttcatacagcccaacattggcgaactgcccacagccctgaagggccgcctcaacgatagcaataagattcttgtgcagcaaacattgaatatcctccaacagctggcagtggctatgggtcctaatatcaaacagcatgtgaaaaatctcggtatcccaatcatcactgtgctgggtgattcgaagaacaatgtccgagccgctgccctggccaccgtcaacgcctgggctgagcagaccggtatgaaggaatggctcgagggggaggatcttagcgaggagcttaaaaaggagaatcctttcctgaggcaggagctcttaggctggctggccgaaaaattacccacgctgcgcagcacccccactgacctcattctgtgtgttccgcacctttactcctgtttagaggatcggaatggagacgtccgtaagaaagcccaggatgccttgcccttcttcatgatgcaccttggttacgagaagatggctaaggcaacagggaagttaaaaccgacttcaaaagaccaggtgttggctatgttggaaaaagcaaaggtaaacatgccggccaaaccagccccgcctacgaaagctacgagcaagcctatgggaggaagcgcacctgcaaaattccaacctgcatctgccccggctgaggactgtatctctagttccacagagccaaaaccagaccctaagaaagccaaagcaccgggactctccagtaaagcaaaaagtgctcaggggaagaaaatgccaagcaaaacctcattgaaagaagatgaggacaagtccgggccaatctttattgttgtcccaaatggcaaagagcagcgtatgaaggatgagaagggtttgaaagttttaaagtggaacttcacaactccccgggatgagtacattgagcagctgaagacccagatgagctcctgcgtggccaagtggctgcaggacgagatgtttcactctgacttccagcaccataataaggccttggctgttatggtggatcatctggagagcgagaaagaaggagtgataggctgcctcgacctaatcctgaagtggcttaccttacgcttctttgacacaaacaccagcgttctgatgaaggcattggagtatctcaaactcctgttcaccttgttgagcgaagaagaatatcacctgactgaaaatgaagcgtcctcttttataccttatctggtcgtcaaggtaggggagcctaaagatgtcattaggaaggatgttagagccatcctaaatcgtatgtgcctggtatacccagcttccaagatgtttccattcatcatggagggaaccaagagcaaaaatagtaagcagcgggccgaatgtttagaggaattggggtgccttgtggaaagctacggtatgaacgtgtgtcagccaactcccgggaaggctttgaaagaaatcgctgttcacattggtgatcgcgacaacgccgtgcgtaatgccgccctgaacaccattgtgaccgtgtacaatgtccacggtgaccaggtgttcaagcttatagggaatctgagtgaaaaagatatgtccatgctagaggaaaggattaagcggagcgctaagcggcccagcgcagcccccatcaaacaagtggaagaaaagccccaaagggcgcagaatatttcttcgaatgcaaacatgctgcgcaaaggaccagcagaagatatgtctagcaaacttaaccaggctcgttcgatgagcggacaccccgaggctgcacagatggtgagaagggaattccagttagatctcgacgaaatcgagaacgacaacgggaccgtgaggtgtgaaatgcctgagctcgtgcagcataagttggatgacatcttcgaaccagtgctaatacccgagccgaagattcgcgctgtctctccgcatttcgatgacatgcatagcaacaccgcaagcaccattaatttcataatttcacaggttgcctctggagacatcaatacatccatacaagctcttactcaaattgatgaggtcctccgtcaggaggataaggcagaagccatgagcggccacatcgatcagttccttatagcaacatttatgcaattgcggctcatctataatactcatatggcagacgaaaaactggaaaaggatgagatcatcaagctgtacagctgcataatcggcaatatgataagcctattccaaatcgagagcttagcgagggaggcatcaaccggtgttctaaaggacctcatgcatggtctgattactttgatgctggatagcaggattgaggacctggaagaagggcaacaggtgatccgtagcgttaacttgctagtcgtgaaggttctggagaaaagcgatcagacgaacattctatcagctttgttggtactactgcaggattctctgttggcgactgccagtagccctaagttttcagaactggtaatgaagtgcctatggagaatggtccgcctgctcccagacaccattaattcaataaacttggatcgaatcttgcttgatatccatatctttatgaaggtttttccaaaggagaagctcaagcaatgtaaatccgaatttcctattcggacactgaaaactcttctgcataccctctgcaaattgaagggtccaaaaatactggaccacttaacaatgatcgataacaagaacgaaagtgaactggaagcacacctctgtagaatgatgaaacactcaatggatcagaccggttctaagtcagacaaagagactgaaaaaggtgcatctaggatcgatgaaaagagctctaaggctaaagtgaatgacttcctggccgagattttcaaaaaaatcggatctaaggaaaacactaaagaaggattggcagagttgtacgaatacaagaaaaaatactctgacgcggacattgaaccctttctcaagaattcctcacagtttttccaatcctacgtggaaagaggcttgcgtgttatcgaaatggaacgggaaggaaaaggccgaatctcaacaagtacaggcattagcccacagatggaggtgacttgcgttccaacaccgacgtcaaccgtttcttcgatcggaaatacaaatggagaggaagtgggtcctagtgtgtacttggaacggttaaaaatcctgagacaaagatgcgggcttgacaacaccaaacaggacgatcgcccacccctcacgtccctgctctcgaaacccgctgtgccaactgtcgcctctagtaccgacatgctgcacagtaagctgagtcagctccgggaaagcagggagcagcaccagcactctgacttggattctaaccagacgcactcctctgggacagtgacatccagcagttcaacggctaacattgacgacctcaagaaacgcctggaacggattaagtctagccgcaagtag

SEQ ID NO: 184616 - DNA, 1020 bp, Artificial Sequence
  Description of Artificial Sequence: Synthetic coding sequence
atgaaggacagcctggtgctgctgggccgggtgcccgcccaccccgatagcaggtgttggtttttagcatggaaccctgctgggacccttctggcatcctgcggcggtgatcgccgcattaggatttggggcaccgagggtgacagttggatctgtaagagtgttctctccgaagggcatcagaggactgtgcgcaaagtggcctggtccccttgtggtaattacctggcgagtgccagcttcgacgctaccacttgtatttggaaaaagaatcaggacgacttcgagtgtgtaactacattggaagggcatgaaaatgaagtcaagtccgtcgcctgggctccttcaggcaatctcctagcaacgtgttcacgcgataagagcgtttgggtgtgggaagtggacgaagaagacgagtatgaatgcgtctccgttctcaactcacacacacaagacgtgaagcacgtcgtctggcatcccagccaagagctgcttgcatcggcctcgtatgatgataccgtaaaactgtaccgcgaagaggaggatgattgggtctgttgtgctacactcgagggtcacgaatcaacagtatggagtttagcttttgaccctagtggccagcggttagcaagttgtagcgatgatagaaccgttagaatctggcgacagtacctgccggggaacgagcagggagttgcttgctcaggatctgatccctcctggaagtgcatttgtacactgtcgggattccattcccgcacaatctatgatatcgcctggtgccagctgacgggagctcttgccacagcatgtggagacgacgctattcgtgtgttccaagaagatcccaattctgacccgcagcagcctaccttttcattaactgcacatctgcatcaggcccattcacaggacgttaattgcgttgcgtggaatcctaaggagccaggtctgttggcatcatgctctgacgacggcgaggtcgccttttggaagtaccagcggcctgaggggctgtag

SEQ ID NO: 184617 - DNA, 1380 bp, Artificial Sequence
  Description of Artificial Sequence: Synthetic coding sequence
atggccgccagcggcgccgtggagcccggcccccccggcgccgccgtcgcaccctctccagctcccgccccacccccagcgccagaccacctcttccggccgatcagcgccgaggatgaggaacagcagccaacagagattgagtccctgtgcatgaactgctattgcaatgggatgacacgcctcctcctcaccaagataccattcttccgcgagatcattgtgtcatccttttcctgcgagcattgtggatggaacaacacagagatacagtccgccggccggatccaggatcaaggcgtgagatatacacttagtgtccgagctctcgaggatatgaatcgtgaagtggtgaagaccgactccgcagccaccaggatcccagagcttgactttgagatccctgccttttcccagaagggtgccctgacaacagtggagggtctcattacccgcgccattagcggcttagagcaagatcaacccgcgagaagggctaacaaggacgccacagcggagagaatcgatgagttcattgtgaagcttaaagagctgaaacaagtagccagcccattcacactcatcatagacgatccatcaggtaacagctttgttgagaacccgcacgctccccagaaggatgatgcactggtgattacacattacaatcgtacgagacaacaggaggagatgttaggactccaggaggaggctcctgccgaaaaaccagaggaagaggatcttcggaacgaagtccttcagttttccactaattgcccagagtgcaacgctcccgcccagaccaacatgaaattggtgcagataccacattttaaagaggtgatcataatggccaccaactgcgagaactgtgggcacaggaccaacgaggtgaaaagcgggggtgctgtggagcctctcggcacacgaattacactgcatattacggacgcctcagacatgacccgcgacctactcaagtctgaaacctgttccgtggagatccctgagctggagttcgagctaggaatggctgtgcttggaggcaagtttacgacccttgagggcctgctgaaggacatccgcgaactagttaccaagaatccttttaccctgggggatagttcaaatcccggccagactgaaaggctgcaagagttcagccaaaagatggatcagataatagagggcaacatgaaggcacattttattatggacgatcctgccgggaattcctacctgcagaatgtgtacgcacctgaagacgaccccgaaatgaaggttgaacgttataagcgcacatttgatcaaaacgaagaactgggcctgaatgatatgaaaacggagggctacgaggccggcttagcgccccagcggtag

SEQ ID NO: 184618 - DNA, 585 bp, Artificial Sequence
  Description of Artificial Sequence: Synthetic coding sequence
atgtgggtgaagctgctgagcatcgtggccgagttctgcttcagccctttcctggtcacggacgaggaaacagctagcgacgctcttgagcggaattctctttcttcacaggatccgcagcagcccacatcaactgtgtccgtgaccgaggatagctccacctccgagatcgacaaagaggagaaagagcagaccacccaggatccagacctcaccacagaggccaacccccagtatcttggactcgctagaaaaaagtcaggtatcctgttgttaactttagttagttttctaattttcatcctttttatcatcgttcagctgtttatcatgaagctcagaaaagcccatgtgatctggaaaaaagaaaatgaggtctcagagcacaccttggaaagttaccgatctcggagcaataatgaagaaacctctagcgaagagaagaacggtcaatccagtcatcctatgaggtgcatgaactatatcaccaagctgtattcggaggctaagacaaagcggaaagagaacgtgcaacacagtaagctggaggagaaacatatccaggttcctgaatctatcgtctag

SEQ ID NO: 184619 - DNA, 525 bp, Artificial Sequence
  Description of Artificial Sequence: Synthetic coding sequence
atggcctgcctgggcttccagcggcacaaggcccagctgaacctggccactagaacttggccttgcacgctgctgttcttccttctgtttatacccgtattttgcaaagccatgcacgtggcccagccagctgtggttctcgcgtcttcaagaggcattgcctcattcgtgtgtgaatacgcctccccgggcaaggccacagaggtcagagtgactgtgctgcggcaggcagatagtcaagtcaccgaggtgtgcgccgctacatatatgatgggaaacgaattgacgttcctggatgatagcatttgcacagggacatcttctgggaatcaggtcaatctcacaatccaagggttgagggcaatggataccggactgtatatctgtaaggttgagcttatgtacccacctccgtattatttaggtatcgggaatgggacgcaaatatacgtgatagcgaaggagaagaaaccctcatacaatcgaggactctgcgaaaacgcaccaaatcgggctaggatgtag

SEQ ID NO: 184620 - DNA, 672 bp, Artificial Sequence
  Description of Artificial Sequence: Synthetic coding sequence
atggcctgcctgggcttccagcggcacaaggcccagctgaacctggcgacacgaacctggccgtgcaccttgctgtttttccttctgttcattccagtcttctgtaaagccatgcatgtagctcagccagctgtggttttggccagcagcagagggatcgcatcattcgtgtgtgagtacgcctcacccggtaaggccactgaagtgcgagttaccgtacttaggcaggcggatagccaggttactgaggtgtgcgccgccacgtatatgatgggcaacgagctaacatttctggatgactctatttgcacaggaacctctagtggcaaccaggtgaatctaacaattcaggggctgagggctatggatactggcctgtacatctgcaaagtcgagcttatgtacccacccccttattatctcgggatcggaaatggaacgcagatttacgtgattgatccagagccatgccctgactctgacttcctgctgtggatccttgctgcagtttcctcaggattgttcttttattcattcctactgactgcggtctccctctccaagatgctgaagaaacgctcgcctctaacaaccggggtgtacgtgaaaatgccccccacagagccagagtgcgagaagcaatttcagccctactttatcccgatcaactag

SEQ ID NO: 184621 - DNA, 414 bp, Artificial Sequence
  Description of Artificial Sequence: Synthetic coding sequence
atgcacgtggcccagcccgccgtggtgctggccagcagccggggcatcgccagcttcgtttgcgaatacgcttctcccgggaaggctacagaggtgagggtaaccgttctgcgccaggccgattctcaggttaccgaagtgtgcgctgctacgtacatgatgggaaatgaactaacctttctcgacgactcgatttgtactggcacaagcagtggcaatcaggttaatctaaccatccagggcttgcgcgccatggatactgggctatacatatgcaaagtggaattgatgtaccctcccccttactacctaggtatcggcaatggtacacaaatctatgtcatcgcaaaggagaagaagccttcatacaaccgaggactgtgcgaaaacgcaccaaatagagctagaatgtag

SEQ ID NO: 184622 - DNA, 171 bp, Artificial Sequence
  Description of Artificial Sequence: Synthetic coding sequence
atggcctgcctgggcttccagcggcacaaggcccagctgaacctggctactcggacatggccctgcacattgctcttcttcctgctatttattcctgttttctgtaaggtgccccccaccgagcccgagtgcgaaaaacagtttcagccctacttcattccaattaactag

SEQ ID NO: 184623 - DNA, 660 bp, Artificial Sequence
  Description of Artificial Sequence: Synthetic coding sequence
atggccagcgccggcgacacccaggccggcccccgggacgccgccgaccagaactttgactatatgttcaagctgttgctcataggaaatagtagcgtgggcaagaccagctttctgtttaggtacgctgatgattctttcacacctgcattcgtcagcaccgtcggtattgactttaaggtgaagacagtctatcgtcacgacaaacggattaagctgcagatatgggacaccgccggtcaggaacgatacaggactattactaccgcctactataggggagcgatgggttttctgctcatgtacgacattgcaaaccaggagtcctttgcagccgtgcaggactgggctactcagataaagacctattcctgggataacgcccaggttatacttgtggggaataagtgtgatttagaagacgagcgcgttgtgccagccgaagacggtcgccggttggcagatgatctcgggttcgagttcttcgaagcatcagccaaggaaaacataaatgtgaagcaagtgtttgagagattagtggacgtgatctgtgagaagatgaatgagtcgctcgaaccctcaagtagctccgggagcaacggcaaaggacccgcggttggcgatgcgcccgccccacagcccagctcttgtagttgctag

SEQ ID NO: 184624 - DNA, 1566 bp, Artificial Sequence
  Description of Artificial Sequence: Synthetic coding sequence
atgctgccccggcggcccctggcctggcccgcctggctgctgcggggagcacctggggccgctgggagttggggccggccagtcgggccacttgctcgacgtgggtgctgttctgcacctgggaccccagaggtgccgctcacaagagaaaggtacccggttagaagattgccatttagtacagtcagtaaacaggacctggccgcgtttgaacgaatcgtccctggaggcgtagttactgaccctgaagcactgcaggcccctaatgttgactggcttcgtaccctacggggttgctccaaagttctattgcggccccgcacgtctgaagaggtgtcacacatcctgcgccactgccacgagagaaacttagcagttaatccccagggcgggaacaccgggatggttgggggatcagtgcctgtgtttgacgagatcatactttcaaccgcccggatgaatagagtcctgtcgtttcacagcgtgagtgggatcctagtgtgccaggctggctgtgttctcgaagagctgtcaagatatgtcgaggaacgggacttcatcatgccattagacctgggggcaaagggatcatgccacattggtgggaacgtcgctaccaacgctggaggattaaggttccttagatacgggagtttgcacggtaccgtgctaggactcgaagtcgtccttgctgacgggaccgtccttgattgcttaaccagcctcaggaaagacaacaccgggtacgacctgaaacagctctttatcggtagtgaaggcacgctgggcatcatcaccacggtgtctattttatgtcctcctaaaccgcgggccgtgaacgttgcctttctaggatgtcctggcttcgccgaggtgctgcaaactttctctacatgtaaaggaatgctcggggagatcttatccgcattcgagtttatggacgctgtgtgcatgcaattggtcggtcggcatctccatctggcctcaccagtgcaagagagccctttctacgtcttgatcgagacctctggctctaacgccggccatgacgccgaaaagctgggccactttctggaacacgcactaggcagtggtctcgtgacagacggaaccatggccacagatcaacgaaaagttaaaatgctatgggctctgcgcgagcgcattacggaagctttaagcagggacgggtatgtgtacaaatatgatctatcgctgccggtggagcgcctgtacgacatcgtcaccgatctccgagctcggctgggccctcatgccaagcacgtggtcggatacggccaccttggggatggcaatctccacctgaatgtgactgcagaggccttcagccccagccttctcgccgccctggagccccacgtgtatgaatggacagctggtcagcagggttcggtttctgctgagcatggagttggctttcgcaaacgggatgttcttggctacagcaaaccgcccggggctcttcagctgatgcagcagctcaaggcactcctcgatcctaaagggattctaaacccctacaagaccctgccatctcaagcctag

SEQ ID NO: 184625 - DNA, 960 bp, Artificial Sequence
  Description of Artificial Sequence: Synthetic coding sequence
atgctgccccggcggcccctggcctggcccgcctggctgctgcggggagctcccggcgctgccggatcttggggccgccctgtcggaccgctcgcccggcgaggctgttgctccgcgccaggcacacccgaagttccactgactagagagagatatcccgtacggaggttacccttcagcactgtatccaaacaggacctagccgccttcgaacgaattgtgccaggcggtgtggtgaccgacccagaggccttgcaggctcccaatgttgactggctgagaactctgcgcggttgcagcaaggtgctgctgcggccacgtacctccgaagaggtgtcccacatcctgaggcactgccacgagagaaatctggccgttaacccgcaaggggggaacaccggaatggtgggcggcagcgttccagtgttcgacgagataatcctctcaactgcacgtatgaaccgagtcctgagtttccattccgtctctggtattctcgtgtgccaggcggggtgcgtactcgaggagctctcccgatacgtggaagagcgtgatttcataatgccccttgacctgggcgctaaaggatcctgtcatattggcggaaatgtggccactaatgccggagggctaaggtttttgcgttacgggtccctacatggcaccgtcctcgggctggaggtcgtgcttgcagacggaaccgtactcgattgtcttacgagcctgagaaaagataatactgggtacgacttaaagcaactattcattggttctgagggaaccttaggtatcataactacagtgagtattctctgtccgccaaaaccacgggcagtcaatgtcgcctttctcgtgacctgcgtcccccccgcctgcgggccaggatcccctagaccagcacgtctgccgcaccctgcattgcggacaccaggcgtgtgcccgcagcctctcaggctttag

SEQ ID NO: 184626 - DNA, 1164 bp, Artificial Sequence
  Description of Artificial Sequence: Synthetic coding sequence
atggtgggcggcagcgtgcccgtgttcgacgagatcatcctgagcaccgcacgcatgaatcgtgtgcttagtttccacagcgtaagtggcatcctcgtgtgtcaagctggatgtgtcttggaagaactgtcccggtatgttgaggaacgggattttatcatgccactcgacctcggggccaagggaagctgccatatcgggggcaacgtggctactaatgccggtggcctgcgattcctgagatacgggagcctccatggcacggtgctggggctcgaagtggtgttagccgacggaactgtgcttgattgcctgacatcactgcgcaaggataacaccggttatgacttaaagcagcttttcatcggaagcgaggggacgctgggcattatcacaaccgtctccatcctttgcccacctaaaccacgcgccgtgaacgtggccttcctcggatgcccaggctttgcagaggtcctccaaactttcagcacctgcaaaggaatgctcggcgagattctgtctgcctttgagttcatggatgcagtttgtatgcagttggttggccggcacttgcacctggcctcgccagtgcaggagtcgccgttttatgtgctgatcgaaacctctggatccaatgccggtcatgatgctgagaagctgggacattttctggagcatgcccttggaagtggtttggtcaccgacggcaccatggccacagaccagcgaaaggtaaaaatgctgtgggcgcttcgggaacgcatcacagaggccctgtccagagacgggtacgtgtacaagtatgatttgtctttgcccgtggaaaggctttatgacatcgtgactgacctgcgggccagactgggcccccacgccaaacatgtcgtgggctatggacatttgggggacgggaacctacatctgaatgttaccgctgaggcattcagtccgagcctgctagcagctctggaaccacacgtctatgaatggaccgccggacaacaggggagtgtgtctgccgaacatggggtgggcttccggaaacgcgatgttttgggatatagcaaaccacccggcgccttgcaacttatgcagcagctcaaggctctgctggatccaaaaggaatcttaaacccttacaaaaccttaccatcccaagcatag

SEQ ID NO: 184627 - DNA, 978 bp, Artificial Sequence
  Description of Artificial Sequence: Synthetic coding sequence
atgctgccccggcggcccctggcctggcccgcctggctgctgcggggtgctcctggcgctgcggggtcctggggccggccagtgggcccccttgcccgtcggggttgttgtagtgcacctggtacgcctgaggtaccgttgacccgagaaagataccctgtccgccgcctgcctttttccacagtgtccaagcaagacctggccgcattcgagcggatcgtccccggcggagtggtcactgaccctgaggctctacaggcgccaaatgtagattggttaaggaccctgcggggatgctccaaagtgttactgcggccccgaaccagtgaagaagtttcacacatactccgacactgccatgaaagaaatctagctgtgaaccctcaggggggtaatactggaatggtgggcggctcagttcctgtgttcgacgaaatcatactttccactgccagaatgaaccgtgtattgagcttccactcagtctccggcattttagtgtgccaagcaggctgtgtccttgaggaattgtcgcgatacgttgaagagcgggatttcattatgccccttgatttgggcgctaaaggatcttgccatataggcggtaacgtcgccaccaatgctggcgggttacggttcctcaggtatggttccctgcacggcactgtgcttggtctggaagtcgtactggcagacggcaccgtcctcgattgtctgacctctcttcgaaaagacaatacgggctatgacctgaagcagttgtttatcgggtccgagggcaccctgggaataattacgaccgtgtctatcctgtgtcctcccaagcccagggcagtcaacgtcgccttcctggttacctgcgtgcctcctgcttgcggtcccggaagcccgcgacctgccagactgccacaccctgcgctcagaacacctggcctccgccaagagtctctcgcatcgagctgtcatgcacacgtttag

SEQ ID NO: 184628 - DNA, 426 bp, Artificial Sequence
  Description of Artificial Sequence: Synthetic coding sequence
atgctgtgggccctgcgggagcggatcaccgaggccctgagccgggacggatatgtatataagtacgacctctccctgccagtggagaggctgtacgatatagtaacagacctgcgtgcaaggctcggcccacacgccaaacacgttgtgggctacgggcacctaggggacggaaatctccacctgaacgttactgcggaggcattttctccatccctcctggctgcattggagccacacgtttacgaatggaccgctggacagcaggggagcgtcagcgccgaacatggagtggggttccggaagagggatgtactgggctactctaagccacctggagctctgcagcttatgcagcagctgaaggcactgcttgacccgaaagggatccttaacccttacaagaccctcccatctcaggcttag

SEQ ID NO: 184629 - DNA, 609 bp, Artificial Sequence
  Description of Artificial Sequence: Synthetic coding sequence
atgagcttcccccccctgtggcccacccggcacgtgcccgccagccaccccacgtgcccacttctgcctggcccttgctgctgccctcactgcctgtgcgacagtgctccgccctcactgccttgcccaacactggttcaaggcgcatccagacccatcctcattctacgggccttccctggaccgtgtcactctgtgccgtgtcacgatctcaaactgcaggttggcgcctccccattccgtcatggttgccccccctccgtccggtgccctagccgcttaatcgctggcgttcccgggtgtagtgtgctgtcctggtctctggggcactctctatcaggcattgactcgagagtgggcgccacgccaggtctgggccatagcttgtcatgggttagagcaccacctggtctgggtcatagtttgtccggcgttggggctaccccgggtcttgggcacctactttccggagtcggcgcttctccaggtgaagacactgagcacgctgctgccctgaccccatgcggcgtgcctcctgtgcccggatgccgctcacactctcagccactgtcacatctcgtgtcttcctctcggtgctgcggcccctag

SEQ ID NO: 184630 - DNA, 849 bp, Artificial Sequence
  Description of Artificial Sequence: Synthetic coding sequence
atggccctgagctgcagcagctggtgccggagcccccagtggaagtttgaggcctccaagagccacgctaaccatcggcccatttgcctgtcacctcgcatatggcccgggagtgcctccgccacatcgacggtgtgctcgagttcagaatctttcttgccaaggggaccgccagccgtcagtcttctcctgcacggaccgccaacagtgagcttcccccctccctggccaacgcaccacgtactcccctcaccagttgctcacccgccctgtccttgtctgcctcccgacatgcctcttgaattaccgggcccatgctgttgcccacattgtttgtgtgattccgcgcctccaagtctaccttgtccaacattggtgcagggagcgtcccgcccaattctcatcctcagggctttcccgggcccatgccatagtgtgccctgtcacgatctcaagcttcaagttggggcttcccctttcagacacggctgccccccatctgtacggtgtcccagcagattgatcgctggggtgccgggatgtagcgtactgtcatggagcttgggccacagcctgagtggtatcgacagcagggtaggcgccacaccagggctaggacattcactctcctgggttagggctcccccgggactaggccatagtctgtcgggggttggggccacacccggtttgggccacctgctgtccggtgtgggggccagccctggtgaggatacagagcatgctgcagctcttacgccgtgtggggtccccccggtgcctggatgccgttcacattcgcagcccctgagccacctggtctcaagctcaaggtgctgcgggccctag

SEQ ID NO: 184631 - DNA, 1245 bp, Artificial Sequence
  Description of Artificial Sequence: Synthetic coding sequence
atgggcggcctgagcgcccggcccaccgccggccggaccgaccccgccggcacttgctggggccaggatcccgggagcaagatggccaccgttattcccggtcccctgtcattgggagaggacttctaccgggaagccatcgaacattgccgttcgtacaacgcccgcctgtgcgctgagcgatccctgcggctgccttttctcgactcacagaccggggttgctcagaataactgctatatctggatggagaaaacccatagaggccccggactggccccaggacagatttacacctacccagccaggtgttggagaaagaagcggcgccttaacatcctggaagaccctcggctgcgaccctgcgagtataaaattgactgcgaggccccactgaagaaggagggcggcctacccgagggcccggtgctggaggctttgctatgcgcggagaccggggaaaaaaagatagagctgaaggaggaggaaaccatcatggattgtcaaaagcaacagctgttggagttcccacatgaccttgaggtcgaggaccttgaagatgatatcccaagacgaaagaatcgagccaaggggaaagcatatgggataggggggctgaggaagagacaggacaccgcaagtctggaagacagggataagccctacgtgtgtgatatctgcgggaaaaggtataagaaccgacccggcttaagctaccactatacccacacccacctggctgaggaagagggggaggaaaacgctgaacggcacgctctgccattccaccggaaaaacaatcacaagcagttttataaggaactggcttgggtgcccgaagcccaacgcaagcatacagcaaaaaaagctcctgatgggaccgtcattcctaatgggtattgcgacttttgcttgggcggctctaagaaaacaggatgtcctgaagacttgatatcttgtgccgactgtggccggtcagggcaccctagctgcctccaatttaccgtcaatatgactgctgccgtgaggacttatcggtggcaatgcatcgagtgtaagtcttgctccctgtgcggcacgtcagaaaatgacgaccagttgctcttctgcgatgattgtgaccgaggatatcatatgtattgcctgagtccgccaatggccgagcctcctgaagggagttggtcgtgccacttgtgtttaagacatctcaaggagaaggctagcgcgtatattaccttgacttag

SEQ ID NO: 184632 - DNA, 1074 bp, Artificial Sequence
  Description of Artificial Sequence: Synthetic coding sequence
atggccaccgtgatccacaaccccctgaaggccctgggcgaccagttttacaaagaggctatagagcactgtcgatcttacaattcacgtctctgtgccgaaaggagcgtcagattgcccttcctggattctcagaccggggtagctcaaaataattgttatatatggatggagaagagacatcgcggtcccgggttggcacccggtcagctgtacacttaccccgctcgatgctggcgcaagaagagacgcctccacccacctgaagatcctaagctccggcttctggagattaaaccagaggttgaactgcctctgaagaaagacgggtttaccagcgaaagcacaacactcgaagcactgcttaggggcgaaggcgtagagaaaaaggtggacgcaagagaggaagaaagcatacaggagatccagagagtgctagagaacgatgagaatgtcgaggaaggcaacgaggaggaggatttagaggaggatattccaaaacgtaaaaatcgtacacgcgggcgggcacgtgggtctgcgggcggccgtagaagacatgatgccgctagccaagaagaccacgataagccatatgtgtgcgatatctgcggaaaaagatataagaaccgtcccggactaagctaccactacgcacacacgcacctggcttccgaggagggcgatgaagctcaagaccaggagactcgctccccaccaaatcacagaaatgagaaccaccgcccgcagaagggaccagatggtactgtgatccctaacaactattgcgatttttgcctgggtggctctaatatgaacaaaaaaagcgggcggcccgaagagctcgtgagctgcgctgattgcggcaggtccgcccacttaggaggcgagggacggaaggaaaaggaagctgcggctgccgcccgcacaacagaggatctgtttggtagcacttcggagagtgacacatcaacgttccatgggttcgacgaagatgacctggaagagccacggtcgtgccgtggcagacgatctggtaggggtagcccaacggcggacaaaaaggggtcttgttag

SEQ ID NO: 184633 - DNA, 999 bp, Artificial Sequence
  Description of Artificial Sequence: Synthetic coding sequence
atggagaagacccaccggggccccggcctggcccccggccagatctatacttaccctgctagatgctggcggaaaaaaagacgactcaatatcctcgaggacccgaggctgcgtccctgcgaatataagatcgactgtgaagcacctctcaaaaaggagggcggtctacctgaagggcctgtcctagaggccctgttgtgcgctgagaccggtgagaagaagatcgagctcaaagaagaagagaccatcatggactgtcagaaacaacaactcctagagttcccacatgacctggaggtggaagacctggaagatgatattccaaggcgcaagaatcgtgcaaaaggcaaggcgtatggtataggcggtttgagaaagaggcaggacaccgcttcattagaagatcgagacaagccatacgtgtgcgacatatgcgggaagcgatacaaaaacaggcccgggctgtcatatcattatactcacactcatcttgctgaagaagaaggcgaagagaacgccgagagacatgctttacccttccaccggaaaaacaatcacaaacagttctacaaagagttggcctgggtgccagaggcccaacgaaaacatactgccaagaaagccccggatggaacggttatacccaatggttactgtgatttttgcttaggggggagcaagaaaaccggatgtcccgaagatcttatctcctgtgcagattgcggcaggagcggccatcctagttgcctccaatttaccgtcaacatgaccgccgctgtccgaacgtaccggtggcaatgcatcgagtgcaagtcctgtagcctgtgtggcacctctgaaaatgatgatcaacttttgttttgcgacgattgcgaccgaggctaccacatgtactgcctgagtccccccatggctgagccgcctgaggggagctggtcatgccacctctgccttcggcatttaaaggaaaaggcctctgcatacatcacgcttacctag

SEQ ID NO: 184634 - DNA, 1143 bp, Artificial Sequence
  Description of Artificial Sequence: Synthetic coding sequence
atgggcggcctgagcgcccggcccaccgccggccggaccgaccccgccggaacatgttggggacaggatccaggtagcaagatggccaccgtaatccctggaccgctttctttgggggaggacttctaccgagaagcaattgagcactgtcgaagttataacgcacgactctgtgcagaacgctcactcaggctgccattcctggacagccaaactggagtggcccagaataattgctacatctggatggaaaaaactcatcgcggcccagggcttgcccccgggcagatttacacatacccagcaaggtgctggaggaaaaaaaggcgcctgaatattttggaggacccgcgattgaggccttgcgagtacaagatagattgcgaggcacctctgaagaaagaggggggactaccagaaggccccgtcctggaagctctattatgcgctgaaacaggggagaagaaaattgagctcaaagaggaagagaccattatggattgccagaaacaacaattgcttgaattcccccatgacttagaggtagaggacttagaagacgatatcccaagacggaagaaccgcgcaaagggtaaagcatatggaataggcgggctgcgcaaaaggcaggataccgcttccctggaggaccgagataagccctatgtttgcgataaattctataaggagcttgcttgggtaccagaggcccagaggaagcataccgcaaagaaggctcccgacggtaccgtaatccctaatggctattgcgacttctgcctgggaggaagtaagaaaactggttgtcccgaagatttaatttcttgcgctgattgcggaagatcagggcacccctcttgccttcagtttaccgtgaacatgactgctgccgttcggacctacaggtggcagtgcattgaatgcaagagctgcagcctttgtggcaccagcgagaacgatggcgcctcctgggccggcctgaccccccaagaccagctgcttttctgtgacgactgtgaccgcggttatcatatgtactgcctctctcctccgatggcagagccccctgagggatcttggtcatgccacttatgtttgcgacatcttaaggagaaggcctccgcttacattaccctaacttag

SEQ ID NO: 184635 - DNA, 612 bp, Artificial Sequence
  Description of Artificial Sequence: Synthetic coding sequence
atggccaccgccatccagaaccccctgaagagcctgggcgaggacttctacagggaggctattgagcactgtcgcagttacaacgcacggctttgcgcggagcggagcttgcgcctcccgtttttagattcccagaccggagtcgcccagaacaactgctatatctggatggagaagacgcatagggggcccggactcgctcccggtcagatctacacttacccagctagatgttggcggaagaaaagacggctgaatattcttgaagaccccagacttcgcccatgtgagtataagatcgactgcgaagctcccctgaaaaaggaaggtggactgccggaaggtccggtccttgaggctctgctgtgcgctgaaacgggggaaaagaagattgagctcaaggaggaggaaaccatcatggactgtcaaaagcagcagttgctggagtttcctcacgaccttgaagtggaagacctggaggatgatattcctagaagaaagaaccgcgcgaagggaaaagcctacggaatcggaggactgcgtaagcgccaggataccgcctcgctggaagaccgtgataaaccctacgtgtgcgattctgagtctttttag

SEQ ID NO: 184636 - DNA, 1245 bp, Artificial Sequence
  Description of Artificial Sequence: Synthetic coding sequence
atgggcggcctgagcgcccggcccaccgccggccggaccgaccccgcaggaacttgctggggacaggacccaggctccaagatggccaccgtaattcccggaccactgtccctgggcgaagacttttaccgggaagctatcgagcattgtcgctcatacaacgctcggctgtgcgcagaaaggtctctgcggctgcccttcctggactcccagacaggggtggcccagaataattgttacatttggatggagaaaacccaccgtggacccggcttggccccgggccagatctatacttaccccgcacgttgttggaggaaaaaacggcgtctcaatatactggaggacccacgactccgaccgtgtgagtataagattgactgcgaggccccgttgaagaaagagggcggactcccagaaggaccagtccttgaagcgctgttgtgcgcagagacaggcgaaaagaagatcgaactcaaggaagaggaaacaatcatggattgccaaaagcagcagctcttggagtttccccatgacctagaggtcgaagaccttgaggatgatatcccgcgccgaaagaatcgggccaaaggaaaagcctacggaattggtggactgagaaaacgacaggacaccgcatctctggaagaccgcgacaaaccatatgtttgcgacatctgcggaaaaagatataaaaatcggcctggcctttcctaccactacacccacacacatttggctgaggaagagggagaggaaaacgcggagaggcacgcactgccgtttcatcggaaaaacaatcacaagcaattctataaagagctggcctgggtgccagaggcgcagcggaagcatacagccaagaaggcccctgacggtacggtcatccctaatggctactgcgacttctgtcttggaggctcaaaaaagactggctgccctgaggacctgatatcttgcgctgactgcggccgatccggacacccatcatgccttcagtttaccgtgaatatgacagccgctgtccgcacttaccggtggcagtgtatcgagtgtaaaagttgctcattgtgtgggaccagcgaaaacgatgatcagctcttgttttgcgatgattgcgatcgcggttaccatatgtactgtttatccccccccatggcagagcctcctgagggatcctggagctgtcatctgtgtctccggcatctgaaggaaaaagcgtccgcatacattactctcacgtag

SEQ ID NO: 184637 - DNA, 1167 bp, Artificial Sequence
  Description of Artificial Sequence: Synthetic coding sequence
atggccaccgccatccagaaccccctgaagagcctgggcgaggacttttaccgggaggcgattgaacactgtaggtcttacaacgcccgactatgcgccgaacgctccttgagattgccgttcttggattcacagaccggcgtggcacagaataactgttatatttggatggagaagacacatcgaggcccgggcctggccccaggccagatctacacttaccccgcaagatgctggcgtaagaaaaggcggttgaacattctagaggatccccgactccggccctgtgagtacaaaatagattgcgaagctccgcttaagaaagagggaggcctcccagagggaccggtcctggaggctctcctctgtgctgagaccggcgaaaaaaagatagagctgaaggaggaggagacaattatggactgtcagaagcaacagctgttagagttcccacacgatctggaggtggaggacctcgaagatgacatccctagaagaaagaaccgggccaagggcaaggcctatggcattgggggcctgcgtaagcgtcaggacacggcttccctcgaggatcgagataagccttacgtttgtgacatttgcggcaagcgatataaaaaccggcccgggctgtcctatcattacacacacacacacctggcagaagaggagggggaggaaaatgcggaaagacacgctctgcctttccatcggaagaataatcacaagcagttctacaaggagttggcgtgggtacccgaggctcagcggaagcatactgccaaaaaggcacctgatggtactgttattcccaatggctactgtgacttttgcctgggaggtagcaagaagaccgggtgtcctgaggacttgatcagttgcgccgactgtgggaggtcgggccacccctcttgcctgcagttcaccgtcaacatgaccgcggcagtgagaacatatcgctggcagtgtatcgaatgcaaaagttgtagcttatgcggcacctcggagaatgatgatcaactcctgttttgtgatgattgtgatcgcggctatcacatgtactgcctttctccaccaatggcagagcctcccgaggggtcatggagctgtcatctctgtctgcgccacctcaaggagaaggcgagtgcttatatcaccctcacttag

SEQ ID NO: 184638 - DNA, 1176 bp, Artificial Sequence
  Description of Artificial Sequence: Synthetic coding sequence
atggccgccgtggtggagaacgtggtgaagctgctgggcgagcagtattacaaggatgctatggaacaatgccacaactacaacgcccgcctgtgcgccgaacggagtgttcgccttccatttctggacagccagactggtgtggcgcagtccaactgttacatttggatggagaaacggcatcggggacctggcctggcgagtggacagctttattcttaccctgcaaggcgctggcggaagaagcgccgagcccacccaccagaggacccgcgactgagtttcccatccataaagcccgacaccgaccaaaccttaaaaaaagaagggctcatcagccaggacggatcttcccttgaggcccttctgcgcacagatcccctggagaagaggggcgcaccggatccgcgcgtggacgatgattctttgggagaattccctgtgacaaactcgcgtgcgaggaaaagaattctcgaaccagatgattttctggacgaccttgatgatgaggattacgaggaagacaccccgaagcggagaggcaaggggaagagcaagggaaaaggtgtcggctcagcacgcaaaaaattggacgcgagcatcctagaagaccgggataaaccttacgcttgcgacatttgtgggaagcgatataagaataggcccggtctcagttaccactatgctcactctcatcttgctgaagaagagggtgaagataaggaagactctcaacccccaactcccgtttcccaacgaagcgaggaacagaaaagcaagaagggccctgatggtctcgccctccctaataattactgcgacttctgcctcggcgatagcaaaatcaacaaaaaaacgggtcagcctgaggagctggtttcttgttcagattgtggccggtccgggcaccctagttgtctccagtttaccccggtgatgatggcagccgtgaagacataccgttggcagtgcatcgaatgcaagtgttgcaatatttgcggcacaagcgaaaatgatgatcagctgttgttttgtgatgactgcgataggggctatcacatgtactgcttaacccccagtatgtctgagccccctgaaggttcttggtcctgtcacctgtgcttggatctgctgaaagagaaggcaagcatttaccagaaccagaattccagctag

SEQ ID NO: 184639 - DNA, 1134 bp, Artificial Sequence
  Description of Artificial Sequence: Synthetic coding sequence
agcagcatcatccagaaccggctgaagaagctgggcgaccagttctacaaggaagcaatcgagcactgcagaagctataactcgcgcctgtgtgcggagcgctccgttcggttaccgtttctggactcccagaccggtgttgcccagaataactgttatatctggatggagaaaaggcaccgggggcccggcttagcccctggtcagctctacacgtatcctgcgcgctgctggcgcaagaagagacgtctgcaccctcccgaagatcccaagctgcgcctgttagagataaagcccgaggtcgaactgccactgaagaaagatggcttcacatcagagagcaccactcttgaagctttgcttagaggagagggggtggagaaaaaggtcgacgcccgggaggaagaatccatccaagagattcagagagtcctcgagaatgacgaaaacgtggaggaaggcaatgaggaggaggacctggaagaagacattcccaagaggaaaaaccggacgagaggacgggctcgcggaagcgccggtggccgcaggcgccacgacgcggcctctcaggaagatcatgacaagccatacgtgtgcgacatttgtggtaagaggtacaaaaacaggccgggactgtcttatcactacgcccacacgcacctcgcctcagaagagggtgatgaggcccaagatcaagaaaccagatccccaccgaatcaccgcaatgagaaccacaggccgcaaaaaggaccggacgggacagttatacccaataactactgcgatttctgcctgggtggctccaatatgaataaaaaatcaggaaggcccgaagagctggtgagctgtgctgattgcgggaggagcggacaccctacatgtctgcaatttaccctgaacatgactgaggccgtcaagacatacaaatggcagtgcattgaatgcaaatcctgtatcctctgcggaaccagtgagaatgatgatcaactgttgttttgcgatgattgcgatcggggttaccacatgtattgtcttaacccgccagtcgctgaacctccggaggggtcctggtcgtgtcacctttgttgggaactgctgaaagagaaagcttcggcatttggatgtcaagcttag

SEQ ID NO: 184640 - DNA, 1074 bp, Artificial Sequence
  Description of Artificial Sequence: Synthetic coding sequence
atggccaccgtgatccacaaccccctgaaggccctgggcgaccagttctacaaagaagctatagaacattgccgcagttacaatagtcgtctctgtgccgagcgcagtgtccgcttgccttttctggacagccagaccggggtggctcagaacaattgctacatctggatggaaaagagacatagagggccaggactagctcccggccagctgtatacataccccgcacggtgctggcgtaagaagcgaaggctccatccccccgaggatcccaaactgaggttgctcgagatcaaacccgaggtggaattacctcttaaaaaggacggttttacgagtgaatccactaccttggaagcattgctacgcggagaaggcgtcgaaaagaaggtcgacgcacgcgaggaagaatccatccaggaaatccaaagagtactggagaacgatgagaatgtggaggaaggtaacgaagaggaggacttagaagaggacattcctaagcgtaaaaatcggacccgcggccgagctcggggaagtgccggggggcgccgccgtcatgatgctgcctcacaggaggatcatgacaagccctacgtgtgtgatatttgcggcaagcggtataaaaacaggccgggactctcctatcattacgcccatacacacctagcatcagaggagggagacgaggcacaggaccaggagacacgatctccacctaaccatcgcaatgagaatcaccgaccccagaaagggccagatggcacagtgatccctaataactattgcgatttttgtctcgggggcagcaacatgaacaagaaaagcggccgccccgaagaactagtctcatgcgccgattgcggaagatctgctcatctgggaggcgagggtcgtaaggaaaaggaggccgctgcagcagcccgcaccactgaagatctctttgggtcaacgagtgagtccgacacttccacctttcacgggttcgacgaggacgatttggaagaaccccggtcctgtcgcgggagacggtcaggtagaggttcgccaaccgccgacaaaaaaggcagttgttag

SEQ ID NO: 184641 - DNA, 1137 bp, Artificial Sequence
  Description of Artificial Sequence: Synthetic coding sequence
atggccaccgtgatccacaaccccctgaaggccctgggcgaccagttctacaaagaggctattgagcactgtcgctcttataatagccgtctttgcgctgagcgaagcgtgagactgcctttccttgattcgcagacgggcgtggcacaaaataattgttatatctggatggaaaaaaggcaccgaggccctggactggcccccgggcagctgtatacgtaccctgcacgctgttggcgtaaaaagcgccggctgcaccctcccgaggacccgaagttaagacttctggaaattaaacccgaagtagaactccccctaaaaaaggacgggttcacaagcgaaagtaccactctagaagcccttctgcgaggagagggagtggaaaagaaggtagatgcacgagaggaggaaagtatccaagagatccaacgggtactcgaaaacgacgagaatgtcgaggagggtaatgaggaggaagacctggaagaggacatacctaagcgcaaaaacaggaccagaggccgggcacgggggtccgccggaggtcgccggcgccacgatgctgcctctcaggaagaccatgataagccatatgtgtgtgatatctgcggtaagcggtataagaatcgacctggtctgtcataccactacgctcacactcacctggcctctgaggaaggtgacgaagcccaggatcaagagacacggagtcctccaaatcaccgtaacgagaaccacagaccccaaaagggccccgatggaacagtgatcccaaacaactattgtgacttttgcctgggcggttccaatatgaacaagaagtcagggcggccagaagaacttgtgagctgcgctgactgcggacgcagtggccatcccacctgtctgcagtttaccttgaacatgaccgaggcagttaaaacttataaatggcagtgcattgaatgcaagtcatgtattttgtgtggtacatcggagaacgacgatcagctactgttttgtgacgattgcgatagagggtaccacatgtattgtctgaacccgcctgttgccgaaccgccagagggctcttggagctgtcacctgtgctgggaacttctgaaggaaaaagcctccgcattcgggtgccaggcgtag

SEQ ID NO: 184642 - DNA, 4110 bp, Artificial Sequence
  Description of Artificial Sequence: Synthetic coding sequence
atgagcccctgcggccggaagatgggcgagggccggcagcagcggcgcgctccggtggggaaactcctgctgctcccaggccggcgcgacacaccccacggaaggagcggatcatcaggagcacgaacccagaggagtctcctctggctgctggtgcacgtttggttatgggcagctagcgggagtagcgcgcagctttttaacctcacattgtctgtagacgagggtctaccacccgataccctggtaggcgacatcagggccgggctgcccgcagctcagcagcaagaaggcagtgggttctttttatcagaggactccgacgactcccccctgctggatgatttccacgttcaccctgacacaggcatcatccgaaccgcacggcggttggacagggagcgacgtgaccactatagcttcgtggcagccacgcttttgggcgctgtggtgcaggtggaaatccgcgtgaatgacgtaaatgatcacagtccacgtttcccattggattctttacagctggatgtaagtgagcttagccctcctggaacagcgtttcgcctgccagtcgctcatgatccagatgcggggctcttcagtacgcaagggtatactctggttcagccaagtgacctgccaaaggaccccgcaggtccgttctttcagctgcgttacagaacccctggacctctgccttcccctttactacctggctcatcctcacctctggaaccactcgacctcgtactcctgcgcaggcttgacagagaggaggcagccgcccatcgcctgcagattgaggcgtgggatggggggcgccccaggagaaccgggctgctgagcgtggagctgcgggtcctggacgagaacgacaacccaccagtgttcgagcaggacgagtatcgggcggctgtgagagaggacgctcaacccggagccgaggtgtgccgcgttagggccacagaccgcgacctcgggcccaatggattcgttcggtactccgttagggctaggcaagtgcccggagcgggctccggcgggggcgccctgggtgatgccgcatattttgcagtcgaggaactgtcaggcgtggtcagagtctggcgtcctctggaccgtgaggcccaggcatggcatcagctcgttgttgaggcacgggacggtggcgcggaaccagaagtagcaacagtaagagtaagtattgctgtactggatgttaacgacaaccgcccggcaattcacgtcctgttcttaacagagggaggggtggccagggtatccgaaggcgctagaccaggcgactacgtggccagggtcagtgtgtcagatgcagacggcgactgggagaaggaggatgaggcaactggagagctaggggtgggcctgggggacggatctatcagcctgtcgcttgaaggtggagagggagatttcgccctcctacctggggggcccccgggcgtgttctttttgtgtgtcgaggggccattggatagagagtcacgtgacctctacgagctccttctagtggcaactgatgcaggttccccacccttgtctacagaggagacactgttgctccgcgtcgctgacctcaatgatcagcctcctcttttctcacagcaacattataaagcctccgtgtccgaggccgccgcaccgggtacggtggttatgtgggtctccgccagtgacgccgacgaggcgggttctgatcatgcatggctcagatatactgtcgtccagctaagtgcaccctgcaacctgggttccttgcaaagcaagatggttcacacagctgaatgtgggccttcttttgccattgattccgagagtggggccattagcacaattcgaacactggatagggaagtgcaagaggctgttgagttaaaagtggtggcgcaggacctgggtgaacctcctttaagcgctacgtgcctggtctctattactgtcgacgacgtgaatgataacgaaccaattttctggaggcaggtctataatgcaactattgccgagcatgctccagtgggtcactgtttcttgcaggtaactgcctcagacgctgactccggactctacggtttcatcgaatattcactgtacgacggtttcttgagctacgaggctcctcaggcttttaggatcgacccccatgacggtcaaatttgtgtgagccaggacatcgatcgcgagcgggacccagctacttacgacttgctggtggaagccaaagatggaggcggactgtctgcgcaggcctttgttcgagtggacttggaagacgtgaacgataaccatcctgtgtttaacccgtcaacgtacgtaactagcattagtgatgagacacaaccgggcaccgaaattatcaatgtgctagctacagatcaagattcgggtatttacggaacagtcgcctatgagctgatccccggaaacgtctccagcctgttcacaattgactctactacgggaattatttatctgacactccccctgagccacttggaatccacaacactctcactcatggtttctgctcaggatggaggaggcctaactgctgtcattaacgccgacgtgaccattcacatcttccagactaccctagcaccagctgaattcgagcgtccaaaatataccttcctggtgtacgaggacgtgccggaagactccccgattggcacagttaaggcgagagaacccctcaattcctccgaacccatcttttatagaattagtagcggcgacctcggcggaaaattctctatccatcctcgcctcggcaccattagaacaaggaagcctcttgatcacgagacgcaacctgtggtagtgctgactgtgcaggctcaactcgggtcagcccctgcttgcagcagtactgaagtgaacatcaccgttatggacgtgaacgataaccatccggccttcttgaggacatcagatgaaattcggatctctcagactacccccccgggtacagccctttacctagcccgggctgaggatcgggatagcggccgaaatggtctcatacgatattccattgcatccccccaaccaggagtctttgccattgaccgcgctctcggtgtgctcttcctgaatggaagtctgggggcgggcgaacagcgggaattgacccttactctccgggccgaagaccagggagtgcacccccaggcggctttgctggtgttgacggtggtgatcgaaaaacgggagcattctcccagttggacttttgagcacctcgtgtaccaggtagaggtcagcgaatctctgagccctatgactcagatgctccagactcaggcccacccgctgggcccacagagggccgcatccccccttagatattcgctggagccatctgtggatagtgctatgtttggcattaggccatataccggatggatttaccttaggagacagttcgactatgagagtacacagacttacaacttcagggtgttcgcttggatccctgaggatggttttctccaaaatgtgagcacaaccgtgattgttcgcgtttgggacgaaaacgacaacagcccgacgtttctgcacgacgtgcttttcctgaaagtggaggaaagtccggtgccccagggcgtcattggaaagatcaccgctattgatatggactccgggaagaatggccagctcctgtatttcctgttgtccgatgggaaattctttaagatgaaccccaacaccggggaactgattaactgggtagcacttgatcgtgaacatcggggacaccacgagatgacggttctcgtgaccgacaggggatccccaccaagaaatgccaccatggccgtgtacgtcagcgttaccgacatcaacgacaacaggcctttcttcccacagtgcctgcctggcaaggagcttcatgtgaaggttctcgaaggccagccagttaacatgcttgtcactaccgtctttgccaaggatcctgacgaaggaaacaatgcggaggttacctacagtgtctcttctgctcgaccaatgcccctgaagggcaagacagccttcggtaagcaaagctgcaagaagcagaccaataagcagaccaataaaatactgacttag

SEQ ID NO: 184643 - DNA, 8751 bp, Artificial Sequence
  Description of Artificial Sequence: Synthetic coding sequence
atgcggctggacgagatcaccaagagcgagaacgaggacggcgagaagaagatgtttactcaacaatttgagagtactgacgcctgcgtgtatgaggtctatgtgaaaattaattccattgtgaagtcacagtctcagtgtggactgaagcgcgggagcccggagactgagctgtggggggccatagtctttcgaagtcaggaagaaaacgcgaagccagtgaaagagaccgaagttaccgccagcgacgccgactcagggttgtacggcttcatcgaatattcactctatgacggctttttaagttatgaggctcctcaggccttccgcattgaccctcacgacggacagatctgtgtgtctcaggacatcgatcgagaacgcgaccccgcaacgtacgacttgctggtggaggcaaaagacggagatgagcaaaggatgacccacctcgccctagtcaaggggggcctgtcagctcaagcattcgttagagtggatcttgaggacgtcaacgacaatcacccagtgttcaacccatctacatatgtgacaagtatttccgacgaaacccagcctggcacagaaataataaatgtgctggccacggaccaggacagcgggatctacggaacagtcgcctatgagctcattcccggaaatgtgagctccctttttaccattgactccaccactgggttatacagcccagaggtggaaattctttctgcagtcaacttctcagcagacaaagaggtgatgaactctttagaaatgttcctgcctctgctcaggcacttcaaaaaagtggaaagggacgaagaggcggccgagaaaaaatttgaggcgtcacgtgggtggtttatgagattcaaagggcggcgtcacctgcactatctgaaagtccaggacgaagcggctagcgccgacggcgaggctgcagcccgatatgttgcgaatctggcaaaaatcctgggcgaaggaatcatctatctgactctcccgctgtctcatctcgagagcaccactttatctctgatggtcagtgcacaggacggagggggtttgacagccgtcattaatgcagacgttacaattcatatcttccagactacccttgcccctgcagagttcgagagacctaaatacacctttcttgtgtacgaagacgtgccagaggactcaccaatcggcactgtcaaagcccgggagccactcaacagctcagaaccaattttttaccgcatctcaagcggggatcttggtgggaagttttctatacatcctaggctcggcaccattcggacacggaagccacttgaccatgagacacagcccgtggtcgtcctaactgtacaagcccagctcgggtccgccccagcctgttccagtacagaggtcaatataacagttatggatgtcaatgacaatcacccagcgttcctgcgcacatccgacgagatccgaatcagccaaactactccaccgggaacagcgctttatctggccagagccgaggatcgcgattcaggtaggaacggcctcattcgctatagtattgcttcaccccaacctggagtctttgccatagatcgcgctctgggtgtgctgtttctgaacgggtcactgggggccggggagcagagagaactgacactgacactgcgtgccgaggatcagggggttcacccccaggcagcattgctcgtgttgacagtcgtgatcgaaaagagagagcattcaccgagctggacattcgagcatctggtttatcaagttgaggtgtccgagtccctgtcaccaatgacccagatgctccagacacaggcccacccattgggacctcagagggcggcctctcccctgagatactcactagagccttcagtcgattctgcaatgtttggcatccgaccctataccggttggatttacctgcgtagacagttcgactacgagtccacccagacttacaactttcgcgtgtttgcttggatcccagaggacggtttcctgcagaatgtttcgacaacagtaattgtgcgggtctgggacgaaaatgacaactcccctacatttttgcatgacgttctcttcttgaaggtcgaagaaagccccgtgccacagggcgttattggcaaaatcactgcaattgatatggatagcgggaaaaatggtcagttgctttatttcctgttgagcgacggcaagttctttaaaatgaaccccaacaccggaccagcggggactatctacgttatcacttgggctgatggagccgcggcattctctggaaccgacttcgcgttttcctccgatgaactccaggcttttgtgctcaagtcactcttctgtgagctcggggagggagagctgatcaattgggtagcactcgacagggagcacaggggccaccatgagatgacggtactagtgacagataggggaagtcctccacgaaacgctacaatggccgtttatgtttcggtgacggatatcaacgacaacagaccattttttccccaatgcctcccagggaaggagctgcatgtcaaggtcctagaggggcagccggtaaacatgctggtcaccacagtgttcgctaaagatccagacgagggtaataatgcggaagtcacatattcggtgtcatctgaggacagcagtgatcacttcaagatcgacgcaaataacggagagatccggactaccaccatcctttcatacgattataggccatcctaccggatgtcggtcatagcgacagatcagggcgtcccaccgctgcaggggcaagctgtggtcaacatccaggttatccccctgtccaagggccgcgccatcatgagccaaaacatcagacatctgataatccccgagaacctgaagcctacgaagattatgtcactgatcaaatcatcagaccacctccagcagcattacaatggcaagcttcacttctctatcgttgctgacgacaaggacggacacttcgaaattgacagctcaactggcgatctgttcttgagtaaagagctggactacgagaccacctcacattatctattccgtgttatcacaacggatcatagcaagaacctcagtctgagtagcacagtctttctgtctattgacgtggaagatcagaacgatcacagcccctcttttcaggacgaactgattgtgatctccgtcgaagagaacgtgcccatcggtaccctcgtgtacgtctttaatgcgaaggacgatgacggttcttttctgaattctaggatccagtactacatcgaaagtcacaacccaggcaccaaccctttcctgatccacccctcctttggcacattagtcaccgtcagtcgcttggaccgtgaatcaatccccaccgtcatcctgacagtaacggcctcagaccaggctgtaaacgtaactgataggcggttgagatctctgaccgcacagatcgtgatactcgacgtgaacgaccacaatccaacgtttatctccttcccaaatgcccacgtcaaggaagacgtgaccgtaggctcactggtgcatcatattaccgcacatgaccctgatgaggggcggaatggcaaggtgacgtactcaatcctgagcgggaacgagaacatgacattcatgctggacgagtcaagcggcctactgaccactacttgtcctttggattatgagatgaagacacagcatatactgaccgtgctcgccctagatgacggtacacctgcactgagcagctcccagacattgaccgttaccgtgctggatgtgaacgacgaagcaccagtttttaagcagcacttatatgaggcgtcagtaaaggagaatcaaaaccccggggaatttgtgacccgtgtcgaggctctggacagggactctggagtaaactccaaactccaattcgagatcatgccgggcgccagtttcgagctgtttgagatcaactcagatactggcgaagtggttacaactacaatccttgacagagaaatccaggaagtattcacgctgcgggttctcgtcagggacggagggtttccatcactaagctctactaccactatactttgcactgtcgaagatgagaacgaccatgctcccgaatttatagtttcctcctacgacattgaagtgttggagaaccaggaacctgaagtggtgtacacagtgcttgcatctgatatggatgctgggaataatagagctgtggagtaccacatcatagacgggaacactgacgagtgctttacgataaacgaaatgtccggggagctgtccaccacgcgcgctctggacagagagcagatttccaacttcaccctcgtgattctatgcagtgatttgggggaccccccgagatcctccgtgatacaccttcaagtgagagtgttggatgcaaacgaccactctccaagttttcccaccctgtactatcaatctagcgtcagggaagatgcggaagttggcactgtggtcctggtcctgtccgccgtggacaaagacgaggggctcaatggacagacagagtactttctcacagacgaagcgagcggggccttcactatcgatcccatgagcggcaccctgaagacctcgaacaccctggatagggaggctagatctcagcacacattttccgcagtcgcgcgcgactgtagcattcaaggatccagaagcaccacggtaatcattaaagtgtatgttacagatgtcaatgataatgatcccgttctggaacagaacccatttgatgttttcctgtctccggaatcccccacaaaccagacaaccgtcattgtccgggcggacgacctggacctcggacccaatggcacagtagtgttcagtttcgcggagactcagtccatgttctccatagataagtacactggagaaattcaattccagcagaaccccagttcagagtacttccccatctggttgcagctgaaagtgacagatcagggcattcctgcacgaaccaccacgggtctcctggtgatccatatggaaggcgaggacgtcaagatcagtttctcccaccacttatacaaaggtctggtcaccgaaaattgtgaggccggaacatcaatagttactgttaaggctttcgcccccgacagtatacaggactccatgaagtactccatcttctctggcaatgaagatggcgttctctcactctgcagcaaatccgggcaactgaccgtcaaggagcccaagttcctggattttgaggtccggaacgaggtgcagcttatcgtgcttgcagagagctccggtcaccgggcctattgcaaggtggccgtcctgatccaggatgaaaatgataacagcccatgcttcgaacagtccatatatcaggcctccgtttctgagtctcagctatataacgcccacgtgattcaggtgtttgcaaccgatcttgactccggcctgaacgggctcatagagtacagcatcctgagtggcaatcaagaagaagcgtttcaaatcgacgctctgagtggagtcatcaccacaaaagcaattctcgattatgagctgacctcctcttactcactcatagtccaagctactgataagggaatgccacgtctgtctaacactaccgtaattaaagtgcaggtgaccgacatcaatgataacgctccagcattcctcccatccgaggccgttgagatcaccgaagattccttacctggcgtcatagtgacccacgtgtctgtgcatgacgtggatctgaacagcgccttcatcttttctttcgctaaggagtcaaaccccggtacgaagtttgctatcgaccagaataccggagtcgtcgtccttgtgaagaccctggatttcgaggagatgacagagtatgagttgctgatccaaatttctgactccgtccattacaccgaaggggcgctagtcgtccgcgtgttagacgtgaatgacaatccgcccgtgttcagtcaagatttctaccaggtaacagtgccagagtccatccccgttgggtacagcgtgctgacgctctccgctactgacctggaaagtaatgagaacatcagctaccgcatcctgtcatcttcaaaggagttttccattgacccaaagaacgggacgatctttactatatctccagtattactcctcgacacgatcagcaccactcagttcttagtggaagctagcgatggcggcaaccccgacctcagggcattaactttagttgagattggcattgaagatatgaacaactacgccccggagttcacagtaaagtcctacaatctgtccctgtccgaggacgcccttgtgggctcaaccctcgtgactttttccaatatcgaccacgactggacacgcgagaacacctacgtcgagtactccatcataagcggcaactcccagaacaacttccacgttgaaactaagttcttccacagtgaatacccgtataagcaagtaggctatctcgtacttctgcattctttggatcgagaggccagcgcatcccatgagcttgtgatattagctagtgactcgggatgtccaccattgagttccactgccgtaattagtatccaagtgctggatgtcaacgataacccacccaacttcagttcactaagctaccatacacatgtgaaggaatctacacccctcgggtcccacatcacagttgtgtcagcaaacgaccgggacaccggcagccatgcagaaatcatttataacatcatttcaggcaacgaaaaaggtcatttctatctcgaggagaatacaggagtgctgtacctcatcaagcccctggattacgagaagatgactaaatttacgctgactgtgcaggcaagtgacgctgaaaaaaaacactttagtttcgccgtggtgttcgtgtccgtcctggacgataatgatcatgccccccagttcatgtttagttcctttagttgtattgtccccgaaaatttgcctatcagtagcaccatctgttctatcaatgcgttggacttcgacgctggaccatacggggaactgacatactcgattgttagcccatgcttcttgacccacggcatgagctacgatcacgacctgttcctgatcgatcccctgactggggacatccatgcaaaacaaatattggactacgaaaatggaaataaatattgcctgaccgtccaggctaaagacaaaggggacgccacagcgtcgttggttgtctgggttgatattgagggcatagacgagtttgagcctattttcacacaggaccagtacttttttactctgccagagaagaacaaagacaggcagctgatcggtcgagtggaggccagcgatgccgatgctggcatcgatggcgtgatactgtacagtctcggcacgtcttcccccttcttcagcgtgaataaaacaaacgggaacatctaccttatccgggctctccccctaatcaaaagccaactcaacaaggaggacacgctagagatgaagattatcgctcatagcccaaaaagcgatagtaaattcgcttcttgtactgtatttgttaacgtgagttttagttctgaagggactcctctggccgtgttcgctagctcgttttcaatcagcctggttgtgtcttttttagttttcctgatcctgatctgtatactaattgtaatgatcctccggcataaacagaaagacactattaataactacgaagaaaagaagacctcttctcttgacgctgacctgcgcgtgactagggatgcctcagtcctcaaagcttttcagaagacagacgattgttccaacgaggtggttcccgtggatgcaacacctgagtggctctctttgatcagcataatggagaaggatatcgtgaacctgtatcggcatagcaacagcagcggacactgttccgtcgaaggcgagacggcggaggacaaagagatccagaggatcaacgagcacccgtacagaaaatgcagcgactccgcactctcagaccacgaatctcgagtcccagattctggtataccacgagactcagaccaactgagctgcctatccggggagacggatgtcatggtgactgcggagacagctgaagcgagccagacatttggagagggagatcagggagaggggtgtagtactacttgcgcacagaacaatgtactgccacaaactgtgcagaagagggaggccaaggaaagtattctggccgacgtgcggaaagagagcgtctttatctctggtgatcaggaggtgagatgcgctgcgttgagcacccagacaacttcagaccacgacggaaaggataactaccactggaattacctactgagctgggagccgaagttccagcctctggcctctgtcttcaatgatattgccaaactcaaggacgaacacctccatatgcctggtatccctaaagaaaagaagagctttgtgtttccacccccattgattaccgcagttgcccaacccggaatcaaggccgtaccacctaggatgccggcggtgaatctggggcaggttccacctaagcaccccagatctcccataccatatcatctagggtcgctgcccgaaggtatgacaccaaatttctccccctctctgtccctgttaacaatgcaaccgccggccctgagtccactgctccgcgaaggagagctgctgggtacccatatcagcgggacctgccatgaacttaaagcagaggacgaggtgcaaatatag

SEQ ID NO: 184644 - DNA, 2130 bp, Artificial Sequence
  Description of Artificial Sequence: Synthetic coding sequence
atgagcccctgcggccggaagatgggcgagggccggcagcagcggagggcaccagtggggaagctgttgctgcttcccggacgtagagacacgcctcacgggaggtccggtagcagcggcgcaaggacgcaacgttcccttctctggctgctggtacacgtttggctgtgggcagcttccggctccagcgcccagcttttcaaccttaccctgagtgtggacgaaggactgcccccagacacacttgtgggggacataagggcaggattgcccgcagcccagcagcaggaaggctccggcttcttcttgtccgaggatagcgatgattcccctctactggatgacttccacgtacacccagacacaggaatcattagaacggcccggagactcgaccgcgagcggagggaccattactcctttgtggctgcgaccttgctcggcgccgtggtgcaagtggaaatacgggtgaacgatgtcaatgaccattcaccccgcttccctcttgattcgctccagctggatgtctccgaacttagccccccaggaacagcatttcgcttgccagttgcgcacgacccggatgcgggcttgttctcgacccaggggtacacattggtgcagcccagtgatctgcccaaggatcctgccgggccattttttcagcttcgctaccgtaccccgggcccccttccttctccgctgctgcccgggtcgtcatcccctctggagcctctggatctagtcctgctgaggcgcctggatcgggaggaggcagctgcccaccgactgcaaatcgaggcttgggatggaggccggcctaggcggacaggtcttctgagtgttgaactccgtgtcctggatgagaacgacaatcctcctgtgtttgaacaggacgaataccgcgctgctgtgcgggaggatgctcagcccggtgcggaggtgtgtagggtgagggcaacagatagagacctgggccccaatggtttcgttcggtactctgtacgagcccgacaggtgcccggagccgggagtgggggcggggcactgggagacgcagcgtatttcgccgttgaggaactgagcggtgtggtccgagtttggaggcctctggaccgcgaggctcaggcatggcaccagttggtagtagaagcgcgggacggcggcgccgagccagaagtggctactgtgagggtgtcgattgccgtcttagacgtgaatgacaaccgacctgctattcatgtgctgtttctcacagagggaggggtggcccgggtctcagagggtgcccgcccaggggattacgtggctagggtctcagtttcagatgcagatggcgactgggaaaaagaggatgaggccacgggggaactcggagtgggcttgggcgacggatccattagtctcagtctcgagggaggggagggggactttgctctcctccccgggggcccccctggggtgttcttcctttgtgtcgaggggcccctggatagggaatcacgggatctgtacgagttattgttggttgccactgatgctggaagtccaccactgagtacagaggagactctgctgctacgagtggccgacctgaatgatcagccacctctgttcagtcagcagcactacaaagcaagcgtgtccgaagctgccgccccagggaccgttgtgatgtgggtcagtgcgtccgacgctgacgaagccggaagtgaccatgcctggctgcgttacaccgtcgtgcagctgtctgctccgtgtaatctcggtagcctccagagcaagatggtgcacaccgcagagtgcggacccagcttcgctattgacagtgaatcaggagcgatttctaccattcggacgctggacagggaggtccaggaagcggtggaattaaaggtggtggctcaggacctgggagaacctcccttgagtgctacttgcctcgtcagcatcactgtagacgatgtcaatgataatgaacccatcttttggaggcaggtgtataatgccaccattgctgaacacgcacccgtcggccattgtttcttgcagctgatttccgcccaggtagcatttgtgaagattaagcagaagcagaaggaaattcaggagaagcaaaatctggcatag

SEQ ID NO: 184645 - DNA, 2109 bp, Artificial Sequence
  Description of Artificial Sequence: Synthetic coding sequence
atgggcgagggccggcagcagcggcgggcccccgtgggcaagctgcttctgctccccggcaggcgcgataccccacacggacggtctgggagcagcggggcccggacccagaggtcactcctgtggctcctcgtgcatgtgtggctttgggccgcctctgggtccagtgctcagctctttaacctcacattaagtgtggatgagggacttcctcccgacacattggtgggcgacatcagggcaggacttcctgcagctcaacagcaggaggggagtggattctttctttctgaggactcagacgatagcccgttactggatgattttcacgtgcatccagacacaggaatcattagaaccgccagaaggctggaccgtgagcgcagagatcattattcatttgtagcggccaccctcctgggagccgtggtacaagtggagatcagagttaacgacgtcaatgaccactcacctcgctttcccctggacagcctgcagctcgacgttagcgagctgtcccccccaggcaccgctttcagacttcccgtagctcacgatccggatgccggcctgttcagcacccaaggttacactttggttcagcctagtgatctgccaaaagaccccgccgggcctttttttcagttgcgctataggactcccggccccctgccgagtcctctgctccctggctccagcagtcccctggagcccctcgacctcgtgttgttgcgtcgactcgatcgggaggaagctgccgcacacaggctccagatcgaagcctgggatggcgggagacccagacggacgggtcttctgagtgtggagctgcgagtgcttgacgaaaacgataacccacctgtatttgaacaggatgaatacagagcggccgtccgtgaggatgctcaacctggcgcggaggtctgccgcgtccgggccactgatcgggatctcggcccaaatgggtttgtgagatattcagtcagggcccggcaagtcccgggagccgggtcgggaggtggtgccctgggagatgccgcgtacttcgccgtcgaggagctgtcaggggtagtgcgcgtgtggagaccactggaccgagaggcccaggcctggcaccagctcgtcgtcgaggccagagacggcggagctgagcctgaagttgcaaccgttagggtctcaattgcagtccttgatgtgaacgataacagaccggccatacatgtactgttccttaccgagggtggcgtggccagagtaagtgaaggcgcccgccctggagactatgtggccagagtgtcagtgagcgacgctgacggcgattgggagaaagaggatgaagctactggcgagctgggcgtcggactaggcgatggcagtatttctctgtccctggagggcggcgagggggactttgccctcctgcctgggggccctcccggagtgtttttcctctgcgtcgagggccctttggatcgtgaatccagggacttatatgaattgttgttggtcgccacagatgcaggatcaccccccctaagcaccgaggaaacgctgctgttacgtgtcgccgatttaaatgatcaacctcctctgtttagccagcaacattacaaagcctccgtttcagaagcagccgcaccggggaccgtggttatgtgggtcagtgcctcagacgccgatgaagcagggtctgatcatgcctggctgcgctataccgttgtgcagctgagtgccccctgtaacctcggatccttgcagtctaaaatggtgcacactgcagagtgtggcccttcctttgccatcgacagtgagagtggagccataagtaccattaggaccctggaccgagaggtgcaggaagcagtcgaattgaaagttgtcgcccaggacctgggtgagccaccactctcggccacctgcctcgtgtcaatcacagtggacgatgtcaatgacaacgagccgatcttctggcgccaagtctataacgcaaccattgctgagcacgctcctgttggccactgcttcctgcagctgattagtgcccaggtggcgtttgttaaaattaaacagaaacagaaggagatccaggaaaaacagaacttggcatag

SEQ ID NO: 184646 - DNA, 4101 bp, Artificial Sequence
  Description of Artificial Sequence: Synthetic coding sequence
atgagcccctgcggccggaagatgggcgagggccggcagcagcggcgggccccagtaggaaagctcttgctcctacctggccgaagagatacacctcacggacgatccggaagctcaggcgccagaacccagaggagtctgctgtggttattagtccacgtgtggctatgggccgcttcaggatccagcgctcaactcttcaatctcaccctctccgtggatgagggactgccaccagacacattagttggagacatccgagcaggacttcctgcggcccaacaacaggagggatctgggttcttccttagcgaagactcggacgatagtccgctgttggatgatttccacgtgcacccggacaccggcatcatcaggactgcacgaaggttagatagggagaggcgggaccattacagcttcgtggccgcaactttactgggtgcagtggtgcaagttgagattcgggtaaatgacgtgaacgaccacagccccagatttcctctcgactcactgcaactggacgtgagcgagctgtccccccctggtactgcctttcgactaccagtggcccacgatccagacgcagggctcttcagcactcagggctacacactggtgcaacctagcgatcttcctaaagaccccgctgggccattttttcagctacggtatagaaccccaggtccactgccctctcccttgctccccgggagcagtagtcccctcgaacccctggacttagtgcttttgcgcagactcgacagagaagaggcggccgctcaccggttacagattgaggcgtgggatggcgggagaccaagaagaacaggcttactgagtgtcgaactgcgagtgttggacgagaacgataacccccccgtgtttgaacaggacgagtatcgagctgctgttagagaagacgcacagcctggcgcggaggtctgtagggtcagagccactgaccgggatctcggaccaaatgggttcgtccgctattccgtgagagccagacaagtgcccggcgcaggcagcgggggtggcgcgcttggcgacgcagcatactttgccgtagaggagctgtccggagtggtcagagtgtggagaccgctggatagggaagcccaggcgtggcatcaactggtcgtagaggcaagggacgggggtgctgagcccgaagtggcaacagtgagagtgtcaattgctgtactggatgtgaatgataatagaccggcgattcatgtgttattcctgaccgaaggcggtgtggctagggtctcagaaggggccaggccaggcgactacgtggcacgggtgtctgtatccgatgccgacggtgattgggagaaggaggatgaagctacgggagagctaggcgtagggctgggcgacggcagcatttcactaagccttgaaggcggagagggcgactttgccctcctccctggaggcccgcctggagtctttttcttgtgcgtggaaggcccccttgacagggagtcccgcgatctctacgagctactcctcgtcgccacagacgcaggatctccaccactcagcactgaagaaactctgctgctgcgggtagctgacctgaacgaccagccccctctgtttagccagcagcattacaaggcctctgtgtccgaagccgcagcccctggcacagtcgtcatgtgggtgtccgcctccgatgctgacgaggctggcagtgatcatgcctggctccggtatacagtggtgcagctctcagccccttgcaacctcggatcccttcagagcaaaatggttcataccgccgaatgcggccccagctttgccatcgatagcgaaagcggggcgatcagcacgattcgaactctggatagagaggtgcaagaggcagttgaactgaaggtcgtggcccaggacctgggtgaacctccactgtccgctacctgtctggtctccatcactgtggatgacgtcaacgataatgagccgattttttggcgacaagtgtacaacgcgaccatcgctgagcacgcccccgtgggccattgtttcttgcaggtcaccgcctcggacgccgacagcggtctatacggattcatcgagtactccttatacgacggatttcttagctacgaggctccacaagctttccgcatagacccacacgatggccagatttgcgtatcccaggatatagatcgcgagcgcgaccctgcaacttacgatctcttagtggaagctaaagacggcggaggacttagtgcacaggcattcgtcagggtggaccttgaggacgtcaatgacaatcaccccgtgttcaatccatccacctacgtgacttccattagcgacgaaacacaaccaggcacagagatcatcaacgtcttggctacggaccaagattcgggaatctacggtaccgtggcctacgaacttatcccaggaaacgtatctagtctgttcactattgattctacaactggcatcatctatctgacccttccattgagccatttggagagcaccactctttccttaatggtcagtgctcaggatggcggaggtctgacagccgtcatcaacgccgacgtcaccattcatatcttccaaacaaccctggcccccgccgagttcgagagaccgaagtatacattcctggtgtacgaggatgtccctgaagactctccaatcggcacagttaaagcgagagagcccctcaatagttctgaaccgatcttctaccggatcagctctggggacctgggggggaagttcagtatccacccccggttggggacaatcagaacaaggaagcccctggatcacgagactcagccagtggtcgtgcttacagtgcaggcccaactagggagcgccccggcatgctcctccacagaagtgaatattaccgtcatggatgttaacgacaatcaccctgcattccttagaacgtctgacgaaatccggatatcccaaactactccaccaggtacggccttatacttggcaagggcagaggatagggactccggtaggaatggactaatcagatacagtatagcatccccccagccaggggtgtttgcgatagaccgggccttgggggtcctgttcttgaacgggagcttaggggcaggagagcaacgggagctgactttgacactgcgcgctgaagatcagggtgtccacccacaagccgctctactagtgcttaccgtggttatcgaaaagagagagcacagcccttcatggacattcgagcacttggtgtaccaggtggaggtatccgaatccctgtcccctatgactcagatgctgcaaacgcaggctcacccactggggcctcagcgtgcagcctctcctctgagatatagcctggaaccaagcgttgacagcgccatgtttgggattaggccatatacaggctggatttacctgagacgacagttcgattatgagtcgacccaaacctacaacttccgcgtgtttgcttggatccccgaggacggttttctgcagaacgttagcacaacagtgatcgtaagggtgtgggatgagaatgataattctcccacctttctgcacgacgtattgttcttgaaggtggaagaatccccggtgccccagggcgtgattggcaaaatcaccgccattgatatggattccggcaagaacggacagctgctctatttcctcctgtcagatgggaagttttttaagatgaaccctaatactggcgaactcattaactgggtcgcactggatcgggaacatagagggcaccatgagatgacggtgctggtcactgatcggggatccccacctagaaacgcgactatggccgtgtatgtgagcgtcacggatattaacgacaataggccattcttcccccagtgcctaccaggaaaggagctccatgtgaaggttcttgagggccagcccgtgaacatgctggtgacaaccgtgttcgctaaggaccccgacgaaggtaacaatgccgaggtcacctattccgtgagctccgctaggccaatgcccctgaagggtaaaaccgcatttgggaaacagagctgtaaaaaacaaaccaataagcagactaagtcatag

SEQ ID NO: 184647 - DNA, 462 bp, Artificial Sequence
  Description of Artificial Sequence: Synthetic coding sequence
atgctggagaagctgatgggcgccgacagcctgcagctgttccggtcgagatacaccctgggtaagatctattttatcggctttcaacgcagtattctcttaagtaaatccgaaaacagcctcaattctattgcaaaagaaacagaggagggccgggagaccgtgacacggaaagaaggatggaagaggcggcacgaggacggatacctcgaaatggcccagcgacatctgcaacgctccctgtgcccttgggtttcctatctccctcagccttacgccgaactggaagaggtctccagtcatgtcggaaaggtgttcatggccaggaactacgagttcctggcatacgaggctagcaaagatagaagacagcctctagaaagaatgtggacctgtaattacaaccagcagaaagatcagagttgcaaccacaaagagatcacatcaaccaaggccgaatag

SEQ ID NO: 184648 - DNA, 249 bp, Artificial Sequence
  Description of Artificial Sequence: Synthetic coding sequence
atggcccagcggcacctgcagcggagcctgtgcccctgggtgagctacctgccacagccctacgccgagctggaagaggtctcctcacacgttggcaaggtgtttatggcacggaactacgaattcctggcctacgaagcgagcaaagaccggcgccaacctctcgaaagaatgtggacttgtaattataatcagcaaaaggaccagagttgcaatcataaggaaattacatccacaaaggcggaatag

SEQ ID NO: 184649 - DNA, 378 bp, Artificial Sequence
  Description of Artificial Sequence: Synthetic coding sequence
atgcggaccgccatctggaagtggcaccggggcatctaccgggaccactacgtgttggggtccctgaccttcctctcccccatgcagcgtgcaggtactagcaatcagtggaacatgggcaaagttatgactctggattctggggacgaagtaacatttcataagacctggcccaccgagactggtagtccatatcggttggaagaggtctccagccacgtaggtaaagtgttcatggctcggaactacgagtttctggcatacgaggccagtaaagaccggcggcagcccctggagaggatgtggacctgtaactacaaccagcagaaagaccagtcctgtaaccataaagagattacttcaactaaggccgagtag

SEQ ID NO: 184650 - DNA, 1725 bp, Artificial Sequence
  Description of Artificial Sequence: Synthetic coding sequence
atggagctgaaggccgaggaggaggaggtgggcggcgtgcagcccgtaagcatccaggccttcgcctcctcatccacactccacgggctggcccacatcttcagctacgagaggcttagtctgaagcgagcattatgggcgctctgtttcctggggtcacttgcagtcttattgtgcgtttgtacagaacgggtacaatactatttccactaccaccacgttactaagctggatgaagtggccgcaagtcagctgacctttcccgcagtaaccctctgtaatcttaatgaattcagattcagtcaggtttccaagaacgatttataccacgccggggagttgttggcgctgctgaataacaggtatgagatcccagatacccaaatggccgatgaaaagcagctggagatcctgcaggacaaagccaacttccgctcattcaagccgaaaccgttcaatatgagggaattctatgacagggccggccacgatatacgtgacatgctcttatcatgccatttcaggggcgaagtctgtagtgccgaggactttaaagtagtattcaccagatatggcaagtgttacacattcaattccggcagagatgggcggcccaggctcaagaccatgaaggggggaacaggtaacgggctggagatcatgctggacatccaacaagatgaatacctgcctgtgtggggcgaaaccgatgagacatcttttgaggccgggatcaaggtgcagattcacagtcaggatgagccaccgttcatagaccagctcggtttcggagtggcacctgggttccagaccttcgtggcatgccaggagcaacgtctgatatatttacctcctccatggggcacttgcaaagccgtcactatggattctgacctcgacttttttgattcatattcaattacggcttgtaggattgactgtgagacaaggtacctggtggagaattgtaactgtcgtatggttcacatgcccggagatgcaccatactgtacgcccgagcagtacaaagaatgtgcggatcccgctctcgacttccttgtcgagaaggaccaggaatactgtgtttgcgagatgccctgcaatttaacacgatacggcaaagagctatctatggtaaagataccctccaaggcttccgctaagtaccttgctaaaaaattcaacaagtccgagcagtatataggagagaacatactggtgctcgacatttttttcgaggttctgaattatgagaccattgaacaaaagaaagcatatgaaattgccggccttttaggcgaactgctgatgactcctgtgcctttttcctgccatggacatggggtcgcaccttatcaccctaaggccgggtgttcactgctgtcccatgagggccctcccccccaaagacccttccctaagccctgctgcctgggcgatattggtggccaaatgggcctgttcataggcgcatcaattctgacagttctcgaacttttcgattatgcttacgaggtgatcaaacacaaactctgccggcggggtaagtgccagaaagaagcgaagcgcagctctgccgataaaggtgtggcgctgagtctagacgacgtgaaacgccacaacccctgtgagtctcttcggggtcatcccgctggcatgacctatgctgctaatatcttaccccaccaccctgcacggggcaccttcgaggactttacttgctag

SEQ ID NO: 184651 - DNA, 594 bp, Artificial Sequence
  Description of Artificial Sequence: Synthetic coding sequence
atgcgggtggtggtgatcggcgccggcgtgatcggcctgagcaccgcactgtgcatccacgaacggtatcactctgtcttgcagcctctggatatcaaagtttatgcggaccgttttacgccccttaccaccaccgatgtggccgccggcctttggcagccctatctctcagaccccaacaatccacaagaggcagattggtctcagcagacatttgactatcttctcagccatgtccattctcctaacgcagaaaaccttgggctgttcctgatctctggttacaacctgttccatgaagccatccccgaccctagttggaaggatacagtgctgggcttcagaaagctcaccccccgggaacttgatatgtttcccgactacggctacggctggtttcacaccagtctcattttggaaggcaaaaactatctgcagtggctaacagagcgcttaacagaaagaggagtgaagttttttcagcgcaaagtagaaagcttcgaggaggtggcaagagaaggggccgatgtcattgtgaattgcaccggcgtctgggccggcgccttacaaagggacccattgctgcagccatag

SEQ ID NO: 184652 - DNA, 2400 bp, Artificial Sequence
  Description of Artificial Sequence: Synthetic coding sequence
atgaagcccagccccgccggcaccgccaaggagctggagccccccgctcccgcccgcggagagcaacgaacagccgagcccgaagggcggtggcgagaaaagggggaggccgatacagaacgacagcgcacccgcgagagacaggaggcaaccctcgcaggtctggctgaactggaatatctacggcagaggcaggagctgctggtaaggggggccctgaggggggccggcggagcgggtgccgccgcgccccgagccggggagctccttggcgaggctgctcagcgctccagactcgaagagaaatttctggaagagaacatactgctcctccgcaaacaattaaattgcctgaggcgcagggacgccggtctgcttaatcagctgcaggaactcgataagcagatctcagacctgaggctggacgtcgagaaaacgagcgaggaacacctggaaactgattccaggccaagttctggcttctatgaactctccgatggcgcctcaggatccctgagtaacagttccaatagcgtgttttccgaatgcctgtcgtcctgtcacagcagcacgtgtttctgtagcccgttagaggccacgttatctctctctgatggctgtcccaagtccgctgatgttaatccgaaataccagtgcgatctcgtctcgaaaaacggaaatgacgtctacagatatccgtcacctctacatgcggtcgccgtccaatcaccgatgttccttctatgcctcaccggcaatcccctgcgtgaagaagaccggctgggaaatcacgcatcggatatttgcggtggaagcgagttggacgccgtcaagacagattcctctctcccttccccttctagtttatggtcagcgtcgcatccctcctcttccaaaaagatggacggatatattctgtctcttgtgcaaaaaaagacccacccggtacgaactaacaagccaagaacctctgtcaacgcagacccaacgaagggtctattgcgaaacgggtccgtgtgtgtgcgcgcccctgggggtgtttcccaggggaacagtgtaaacctgaaaaacagtaagcaggcctgtctccctagtggtggcatcccttcgcttaataatggcacattctcacccccaaagcagtggtctaaggaaagtaaagccgagcaggccgagtcaaagcgggtgcccttgccagaggggtgtcctagtggcgccgcgagtgatctgcagagcaaacatctgcccaaaactgcgaaaccagcaagtcaggaacacgcgagatgctcggcaattggcacaggtgagtccccaaaagaatcagcacagctgagcggcgccagcccaaaggagtctcctagcagagggccggcacctcctcaggaaaacaaggtggtccagccactgaaaaagatgtcacagaagaactctcttcagggtgtaccacctgctactcctcctttactgtctaccgcttttcctgtggaagagagaccagccctggacttcaagagcgaggggagcagccagagcttggaagaggcccatctcgtcaaggcacaatttatcccaggccagcaacctagtgtccggctccacagagggcatcgaaatatgggggtcgtaaaaaacagctccctgaagcatcgtggcccagcattacagggcctagagaacggcctcccaactgttcgggaaaagactcgggcaggttcaaagaaatgtaggttccccgatgacctcgacactaacaaaaagctcaagaaggcctcctccaagggaaggaaatccggaggcggtcccgaggcgggcgtccctggccggcccgccggcggcggacaccgggcgggctctagagcccacgggcatggtcgggaggctgtggtggccaagcccaaacacaagcgaactgattaccgtcggtggaagtctagcgcagagatcagctacgaggaggctctgcggagagcaaggcgagggaggcgtgaaaacgtggggctttaccctgcacctgtgccgctgccgtatgcctcaccttatgcatacgtggctagtgactctgagtactctgccgaatgcgagagcctattccattccaccgttgtggacacttctgaggacgaacagtccaattacactaccaattgctttggcgattcagagtctagcgtgagcgagggcgagtttgttggcgaatccaccaccacctccgactccgaagagagtggtggcctgatttggtcacagttcgttcagacgctaccgattcagacggttacggcacccgacttacataatcacccggccaagacatttgtgaagataaaggcatcgcacaacctaaagaagaaaatcctgaggtttcggagcggcagcctgaagctgatgaccactgtgtag

SEQ ID NO: 184653 - DNA, 2511 bp, Artificial Sequence
  Description of Artificial Sequence: Synthetic coding sequence
atgaagcccagccccgccggcaccgccaaggagctggagccccccgccccggctaggggagaacagaggacagctgagcctgagggccgctggcgagagaagggcgaagcggacaccgaacgtcaacgcactcgcgaaaggcaggaggccacccttgctggactggccgagctggaatatctccgacagcgacaagagctgcttgtccggggggccctgcgcggagccgggggagcaggggctgccgcgccaagagctggggaacttctcggagaggccgcccagagaagcagacttgaagagaaatttctcgaagagaatatactcctgttgaggaagcagctgaattgtctgcgcaggcgggacgccgggctgctcaaccagcttcaggagttggataagcaaatatccgacctccggcttgacgttgagaagacaagcgaggaacacttggagaccgattcccgacctagctcaggcttttacgagctcagtgatggcgcctctggtagcctgtctaatagttcgaattcagtgttcagtgagtgtttgagttcttgtcacagttctacctgcttctgtagcccactggaggcaactctgagcttgtcagacggatgccctaagtcggccgatctaattgggctgctggagtataaagaagggcactgcgaggaccaggcatcgggcgcggtatgccggtccctgagcaccccgcagttcaacagcctggatgtgatcgccgatgttaacccgaagtaccaatgcgaccttgtctccaaaaacggcaatgacgtatatcgatatcccagcccactgcacgctgtagccgttcagtccccaatgtttttgctatgtctcactggaaaccctctgagagaagaagaccgtctaggcaatcacgcctcggatatctgcggaggaagtgagttagacgcagtcaaaaccgactccagccttccctcaccatcttccctttggtctgcgagccatccctcttccagcaagaaaatggatgggtacattctgtctttggtgcagaagaaaacccatcctgtccgtactaacaaacccaggacatcagtgaacgccgacccgactaagggcctcctcagaaatggctctgtatgtgtccgggcacctggtggagtctcacagggcaatagcgtcaatcttaagaatagtaaacaggcctgcctccccagtggggggatcccgtccttgaataacggaacttttagccctcccaaacagtggagtaaggagtcgaaggccgagcaggctgaatccaaacgcgtgcccctacctgaagggtgtccatcgggagcagcaagtgatctgcagagcaagcatctgccaaaaaccgccaaaccagcatcacaggaacatgcacggtgctccgcaattggtaccggcgagagtccgaaagagtccgctcaactatccggagcctcgcccaaggagtcccctagccgagggcccgccccccctcaggagaacaaggtagttcagccgttgaaaaaaatgtctcagaaaaattcactgcagggggtccccccagccacacctcccctgctcagtacagcatttcctgtagaagagcggcctgcccttgattttaagagcgaagggtcgtcacagtcccttgaagaagcacatctggtgaaggcccagtttatacctgggcagcagccctcagtgaggttgcatcgtggacaccgcaacatgggtgtggtgaaaaacagttctctaaagcacagggggccagctctccagggcttggaaaatggactgcccacggtacgggagaaaacacgggctgggtccaagaagtgccggtttccagacgatttagacacgaataaaaaactcaagaaggcatcatctaagggtagaaagtcaggcggcggaccggaggccggcgtgcccggccgccctgccgggggcgggcaccgtgcaggcagtcgggcccatggccatggacgggaggcagtggtagcgaagcccaagcataagagaacagactatcgccgctggaaatcttcagccgagatatcttacgaggaggccttgagaagagctagacggggaaggcgcgagaatgtaggcctgtatcccgcccctgttccgctaccgtacgcttccccatatgcctatgtggctagcgatagcgagtattcggccgagtgcgagtccctgttccactccaccgtggtcgatacgagtgaagatgagcagagcaactacaccacaaactgctttggggattccgaatccagtgtgtcagaaggagagttcgtgggcgaatcgactaccacatccgattcagaggaaagtggcggactgatctggtcccagttcgttcagaccctgcccatccagaccgtgaccgccccggacttgcacaatcacccagccaagacattcgtgaagatcaaggcctcccacaaccttaaaaaaaaaatcctgcgcttcaggtcaggatcactgaagctcatgactacagtttag

SEQ ID NO: 184654 - DNA, 2325 bp, Artificial Sequence
  Description of Artificial Sequence: Synthetic coding sequence
atgtggacccccggcggcccccccggcagcgccggctgggaccggcgccgtctgggcgcgcggctaagggcagcctttgcagggcttcaagagttgcaggggctccgggctacgcagcaggaacgggtcaggggcgctcttgcactccagcccccccctgcacccgcagcgccctgcgggccccacggtctgcacgggcctgagcagcagctcgaggcggctctagccgcactgcaggaacagctaagccgcctgcgccaacaggatattgggttaaagactcaccttgaccagcttgatctccaaatctctaagctgcagctggatgtggggaccgcatctggcgaggccctggacagcgattccaggcctagcagcggtttttacgagatgtctgacggaggctcctgcagcctgtccaccagctgtgctagcgtttgcagcgatcatatttccccttccctggggtctcttctccccgtcgcacaggcccacaaagcaagaccttccatgggagactggcgtccacggagtgtggatgaaaccacagtgcccgcatggaggcctcaggctacagaagagggtgctagaccccctggatccgtagaagatgctggccagccctggggcactttttggcctcgccctgtgagtacaggcgacctggatagggcactgccagccgataccggcttgcagaaggcctccgctgacgcggaactgttgggactactgtgccaaggagtcgacattccattgcatgtcccagatccaaaatatcgacaggatctggtaagccagggtgggcgtgaggtgtacccgtaccctagccccttgcacgctgttgccctccaatccccacttttcgtcctgacaaaggagaccccccagaggggtgggcctagctttccacgagaaagccccagggggcccgccggcttaaacaccattcagacaggccccgtgctggaagcagggcccgcacgggcacgcgcttacattgacaggctgctgcacctgtggggccgagagacacccgccaagggatctgaaggcgagcagggacctctccggcacgcagcctcacctagcccacagcgccaaggcgggtggtctactgatggcggtggtcggctgctggtcttcgccccggggagagaagacgagggaggaccggcacagtcgagaggcgctggccgggggggcccccaacaacagggatacatgccgctggagggcccccagcaatctggcagtcttcctgaggagggtagcaagccctccaactcgtgtgtgctaagggagaccatggtgcaagcaagcccttcctcaaaggcccagcagaccccctctgcacaggactatgggcgcggtaacataattagtccttctaggatgctcgataagtccccatccccagcctcggggcattttgcccacccctccttcgctgcatcactcaagatgggcccacctaagagtaaagcagaaaagatcaaacgtagtcccatggacaaggtcctaaggttcgcccgccagccactgctgcttctggatagacccgagggcgctcatgctgccccacagccctcattagagtgggaccccgcccactggccaaccgggcggggtggactgcagcgcagaccagctctggcctgggaggcacccgggaggagctgctcagagtccaccctctatccaatgcctgtgctagtacccttggccgtcgccccccaggaaagccaccgaacttcagcccaggcccttttcccatttgaagcctcactgctgacctcggtggcaagaaggaagcaccgacggtggcagagtacggttgagattagcgctcgggctaggcttgcaagttgccctgagtctaacctgggtccaccgcgcccagtcgctcgcagggcgggcgggcccttagctagaggtcgcccttcacttgtccgccaagacgcctacacccggtcggatagtgagcccagcaaacattctgcagaatgtgaccccaggtttccatctgtgatcccggagacttccgagggggagtctagcgaccacaccaccaacagatttggagacagagagtcctcgtccagtgatgaggagggtggtgctcagagcagggactgtgatttggctctgggctacgtggcagcggggcacgctgaactggcttggactcaggaggcgcctgttagcagcggtcctctcctctcccccgtgccaaagctgtgccggattaaagcatccaaggcactgaaaaaaaagatccggcggttccaacccaccgcattaaaggtcatgaccatggtctag

SEQ ID NO: 184655 - DNA, 843 bp, Artificial Sequence
  Description of Artificial Sequence: Synthetic coding sequence
atgtggacccccggcggcccccccggcagcgccggctgggaccggcgtagactcggcgcgcggcttcgcgccgccttcgctgggctccaggagcttcaaggcttacgggccacacagcaggaaagagtaaggggggctttggccctgcagccacccccggcacccgctgccccatgtggcccccacggcctgcacggccccgagcagcagctggaagccgctctggccgcactgcaggagcaactatcccgactcagacaacaagacataggcctaaaaacccatctagatcagctcgatcttcagatcagcaagctgcaactggacgtagggaccgccagcggagaggccctagattctgactctcggccatcatccggtttctatgagatgtctgacggcggtagctgtagtctctccaccagctgcgcatctgtgtgttccgaccatatctcaccctccttgggctcgttacttcccgtcgctcaggcgcataaagcaaggccaagtatgggtgactggaggccacgctccgtggacgagaccacagtgcccgcctggcggccacaggcaacagaagaaggggcgcgacccccaggctctgtagaggatgcgggccagccatgggggactttttggccccgccccgttagcacggaattgtgcaatgcccccggcgaattagacatgcacgcgccacctgccggctgcacgtcatcatccttgactggagtgggaagtgggctgcggggtaaatgcggactgtgtggctgccagctgcccttctgcagtgtcaatacatcctccaaaaccaaaagtagtggaatttcaagacagcagtag

SEQ ID NO: 184656 - DNA, 1890 bp, Artificial Sequence
  Description of Artificial Sequence: Synthetic coding sequence
atgatccgggccttcagcttccccgtgagccccgagcggggccggttgagaggttggcttgaaggctccctggctggcctttgtgagctgcactggcttagggagaggcaagaatacagggtgcagcaggcgctcaggctggctcaaccaggtatggggggtgctgaagcggaggacgaggaggacgctgatgaggatgaagatgctgcagctgctcgacgggctgctgcagctttggaagaacagctcgaggcgcttcctggacttgtgtgggatctgggtcagcaactaggcgatctgtctcttgaatctggagggcttgagcaggagtctggccgatcctctgggttctacgaggaccccagctcgactggcggacctgacagcccacctagtaccttctgtggcgactcaggtttcagcgggtcctcctcctatggtcgtctaggaccctcagagccccgaggtatctacgccagtgagcgccctaagtccctgggcgatgcctccccgtccgccccggaggtcgtgggcgcccgcgctgcagtgcctaggtccttcagcgcaccgtatccgacagctggaggcagtgccggaccagaggcctgctcctctgccgaacgacgagcacgggccggccctttccttacgcccagtcctctgcatgcggtagccatgcgttcgccacgcccctgtggtcggccccctaccgacagccccgacgccggaggagccgggagacccctggacgggtacatctctgccctactgcggcgacgccgccgaagaggggccggccagccccgcacatctccaggtggcgcagacgggggcccccggaggcaaaatagcgtgagacaacgccccccggacgcatccccaagtcccggtagtgcccgcccggcccgggaaccaagcctcgaacgagttggtggacatcctactagtccagcagcactaagccgggcctgggccagcagttgggaatcagaagccgcaccagagccagcagctccaccagcagccccgagtccccccgacagccccgccgagggtcggctcgttaaagcacaatacatccccggcgcccaggcagctactcggggactcccaggcagggctgcccgtcgcaaaccccccccacttacccgtggacggtccgtcgagcaatcccctccacgggagaggccgagagccgccggccggcgtgggagaatggcagaagcttccgggaggagaggttcacccagggccaggaaagcgtcgaggtcacagtccgaaacctcccttctgggccgagcttcagccgttcccagcggccctcctaagtatccaacagccgagcgtgaagagccccgtcctccacgtcctcgcaggggccctgctcctacattagcggcccaagccgctgggagttgccgccggtggcggtccacggctgaaattgatgctgccgatgggcgcagagtgagaccaagggccccagcagcccgggtgcccggtcccggcccctccccctctgcccctcagcgccgcctgctctacggttgtgctggttcagattccgaatgttcagcagggaggctcggccccctggggaggagaggtccggccgggggcgtcggggggggctacggagaatcagaatcttctgccagcgagggtgaatctcctgctttcagtagcgctagtagcgactcagatgggtctgggggcctggtgtggcctcagcaactagtcgcagccactgctgcatccggcggaggcgccggtgccggcgcgcccgccgggcccgcgaaagtgttcgtaaagatcaaagcgtcccatgcacttaaaaagaaaatccttcgctttcgcagtgggagcttaaaggtgatgacaactgtctag

SEQ ID NO: 184657 - DNA, 2025 bp, Artificial Sequence
  Description of Artificial Sequence: Synthetic coding sequence
atgaacagcggcgccatgcggatccacagcaagggccacttccagggaggaatccaagttaaaaacgagaaaaataggccctcactgaagagcctgaagaccgataaccgtccagagaaaagcaaatgtaagcctctgtggggcaaagtattctacctggacctgccctctgtcacgatctctgaaaagttacagaaagatatcaaggacttgggcgggcgcgtggaagaattcctgagcaaagatataagctacctaatctctaataagaaggaagccaaatttgcccaaaccttgggtcggattagtcctgtgccttccccagagagtgcctatacagccgagaccaccagccctcacccgtcacatgacggatcttcctttaaatcccctgacactgtgtgtctcagtagaggcaaactgctagtggagaaggctattaaagaccatgactttatcccgagtaactcgattctgtcgaatgccctgagctggggagtcaaaatcctgcacattgatgatatccggtactatattgaacagaaaaagaaggaactttaccttctgaagaagtcctctacttccgtacgagacggaggcaagcgtgtgggctcaggagcccagaagacacggaccggcagattgaaaaaaccttttgtcaaagtagaggatatgtcgcagttgtaccgccccttttatctacaattaactaacatgccctttatcaattacagcatccagaagccatgcagccccttcgacgtcgacaagccaagtagtatgcaaaagcagacccaggtcaagctgcgtatccagacagacggcgacaaatacgggggcacatctatccagctccaacttaaagagaagaagaagaaggggtactgcgaatgctgcctgcagaaatatgaggacttagagacccatctcctctctgagcagcatagaaacttcgcccaatctaaccagtatcaggtagttgacgatattgtgtctaagctggtcttcgactttgtcgagtacgaaaaggacacaccaaaaaaaaaaaggattaagtatagtgttggtagcctatccccggtgtctgcttctgtgctgaaaaaaactgaacagaaggagaaggtagagctccaacacatctcccaaaaggattgtcaggaggacgatacaactgtaaaagagcagaactttttatacaaggaaacacaagagaccgaaaagaaactgctttttatttcagagccgattccgcatccctctaatgagctaagaggcctgaacgaaaaaatgtctaataagtgttccatgctgagcaccgcggaggatgacatccggcagaattttacgcagttgccgcttcacaaaaataaacaagagtgcatactggatataagtgaacacactctctctgaaaatgatttggaggagctgagagtggaccactataaatgcaacatccaggcctccgtccacgtcagtgatttttccactgacaatagcggctcccagccgaaacagaagagtgataccgttttgtttcctgcgaaagatctcaaggagaaggacttacattccattttcacacatgattctggtctaattactatcaactcaagtcaagagcacctcacagttcaggccaaggcccctttccacactccaccagaggagcctaacgaatgcgactttaagaatatggattcactgccctccgggaagattcataggaaagtcaagattatcctgggccgcaatagaaaagagaatttggagcccaatgcagaattcgataagagaacagaattcatcacacaagaggagaataggatctgctccagtcccgtgcagtctcttctggacctttttcaaacttctgaggaaaagtcagaattcctcggtttcacctcctacactgagaaatcgggaatctgtaacgttctggatatctgggaagaggagaacagtgacaacctgttgacagccttcttctcaagtccaagcacgtctacgttcactggcttttag

SEQ ID NO: 184658 - DNA, 654 bp, Artificial Sequence
  Description of Artificial Sequence: Synthetic coding sequence
atgaacagcggcgccatgcggatccacagcaagggccacttccagggaggcatccaggtcaaaaacgagaagaatcgcccatcgttgaagtccctgaagacggacaatcgccctgaaaaatccaagtgcaaaccactttggggtaaggtcttctacctcgacctgccttctgtgacaatctctgagaagttacagaaggacatcaaagatctgggcgggcgggttgaggagttcctgtctaaggatattagttatctgatttcaaacaagaaagaagccaagttcgctcagactctaggcagaatatcaccggtgccttctcctgaatctgcgtatactgcagaaacaacgagcccgcatcccagccatgatggttccagtttcaagagcccagataccgtgtgtctctcccgcgggaagctgctggtcgagaaggcaatcaaggaccatgacttcattcccagcaattctattctgtcgaacgcactcagctggggagtcaagattcttcatatcgatgatatcagatattatatcgagcagaaaaagaaggaattatatctgctgaaaaaatcctccacaagcgtgcgagacggcgggaagcgcgtagggtccggcgcacaaaagacacgaaaagcgcttcagtctatttag

SEQ ID NO: 184659 - DNA, 1848 bp, Artificial Sequence
  Description of Artificial Sequence: Synthetic coding sequence
atgagcgagcccggcaagggcgacgactgcctggagctggagagcagcatggccgagagcagactgagggctcccgatctcggtgtctccaggtgtctgggaaagtgtcagaaaaatagtcccggtgcccgaaaacatccctttagcggtaaatccttttatttggacctgcccgccgggaagaacctacagttcttgacgggcgccatccaacagcttggcggggtgattgagggcttcttaagcaaggaggtatcatatattgtgagctcaaggagggaggtcaaggcagaatcttctggaaagagtcacagaggatgtccatcccccagccctagtgaagtacgagtggagacaagcgcaatggtcgacccaaaaggtagtcacccacggccatcacgtaagcctgtcgattctgttcccctgtctcggggcaaagagcttttacaaaaagccatcaggaaccagggctccataagtggcggaggctcagggggaagttcatcattgctcaccaatgctcgatcatggggtgtgcggatcctccacgtagacgaaatgatgatgcatgtgcaacaactgtccttagccagcttgtgcgtgaagaaacagcagcctaaaaagcctgaagggacctgccccgccgccgagagcaggactagaaaagttgcccgcttaaaggcgccttttctgaagatcgaagacgaatcaagaaaatttcgccctttccaccatcagttcaagagcttccccgaaatttccttcctgggtccgaaggatgcctctccattcgaagccccaaccacactggggtccatgcaccacactcgggaatcgaaagacggcgagcccagcccgcgctctgccgcccatacaatgccacgacggaagaaaggatactgcgaatgctgccaggaagcttttgaagaactgcacgtccatctccaaagcgcccagcaccgttcatttgcactggaggctcatttatacgccgaagtggacagaattatcgcccaattgagccactcgttcgccgacatccctttccaggctgggctgccgaggtggagcggatccccggcttctgactgtgaccctctgtgtcctgagacgctgcaccctcaccagcctagtcatccaagagctgccagcccgagaataaggaaagaggatagctgtcaagcctccgtgactcaggggcgtgctgcaggacagcaaagatggaccgaatcgctagacggggtgatgggtccgccggcatctcatacctgcgtgtcagctactacattgttgcccgcgctgccgaaaggttctagggagcagggctgtctctgcccatgcccagctagcttcacccagtcccatctggtcacttccctggccttacttcccggcgagtggagccctgctgaagacatgcccttgcatccaagtcaggagaactcctttgctccggccgacatccccgttaagggacctttacttttcccagaagccaggccgtggttaatgtctgcccgatgttgggtcagaccctttccgtttgtaacgtgggggtgcctgatccctcacgatacaacaccacttcatgaagaggtcagtccatgcccctgcctgcgactaggatatttatacctgctgctgacccagtcgctgtggtgtagggtgagggtgccttcattaagcacagccgggccaatcccaagaacctcccatccctgtaccctcgccttcccaagctacctcaacgatcacgacctcggccacttgtgccaggccaagccacagggatggaatacccctcaaccattcctccactgcggctttctggcggtcgatagcgggtag

SEQ ID NO: 184660 - DNA, 1296 bp, Artificial Sequence
  Description of Artificial Sequence: Synthetic coding sequence
atgagcgagcccggcaagggcgacgactgcctggagctggagagcagcatggccgagtccaggctaagggctccagacctcggcgtcagtaggtgtctcggcaagtgccaaaagaattctccgggcgcgcggaaacacccattctccggaaagtcattttacttagatctccctgcaggcaagaatctccaattcctgaccggagctattcagcaacttggcggagttatcgagggctttctttcgaaagaggtgagctacattgtcagctctcgaagagaggtgaaagctgaatcttccggcaagtcacatcgcggatgcccttcgccctccccaagtgaggtgcgagttgagacctcagcaatggtggaccctaaaggctcacatccacggccttccaggaagccggtggacagtgttcctctgtccagggggaaagagctgctgcagaaggcgattcggaaccaaggatcgatctccggcggcggtagcggcgggtcctcctctctcctcaccaatgctagaagctggggcgtgcgcatattacatgtcgacgaaatgatgatgcacgtgcaacagctatctctcgcctccctttgcgtcaaaaagcagcagccaaagaagccagaggggacatgcccagctgccgaatctaggacacgtaaggtggcccggctgaaagctccttttctgaaaatagaggacgaaagtagaaagtttaggccatttcaccaccagtttaagagttttccggagatctcatttctggggccaaaggacgcttccccgttcgaagcacccaccacactgggctcaatgcaccacactcgggagagcaaggacggggagccttcacctagaagcgcagcacacacaatgcccagaagaaagaaaggctattgcgagtgttgccaagaggcctttgaagaattgcatgtacacctccagtcggcccaacacaggagtttcgcgctagaagctcatctctatgccgaagtagacagaatcattgctcagctgagccactcattcgcggatatccccttccaggcaggccttcctaggtggagcggcagtccagcaagcgactgcgatcccctttgtccggagaccttacatccccaccaaccatcccaccccagggccgcttccccccgaattcggaaggaggactcttgccaggcctctgtgacccaaggacgcgcagccgggcagcaacgatggacggaatccctcgatggcgtcatggggccaccagcctcacacacatgccacaggccatgcagactgccatag

SEQ ID NO: 184661 - DNA, 474 bp, Artificial Sequence
  Description of Artificial Sequence: Synthetic coding sequence
atgagcgagcccggcaagggcgacgactgcctggagctggagagctccatggctgaatcaaggttgagggcccctgatttgggagtcagcagatgcctcggaaagtgccagaaaaacagtcccggcgcccggaaacatcccttctcagggaaatcattctatttagacctgccagcgggtaagaatttacaatttctgaccggcgcaattcaacagctgggtggagtgatagaagggtttctcagcaaggaagtgtcctatatcgttagttcccgcagggaagtaaaggcagaaagttcaggcaaatctcacaggggctgtccatctcccagtccctccgaagtgcgcgtggagacctctgcaatggtggacccaaaagggagtcaccctcgaccgagtagaaagccagtggactccgtccctctgtccagaggaaaggagctactgcaaaaggcaattcggaatcaaaagtag

SEQ ID NO: 184662 - DNA, 570 bp, Artificial Sequence
  Description of Artificial Sequence: Synthetic coding sequence
atggtgggcggcggccagccctgcggccccaacatgagcgaggtgagctgtaaaaaacgcgacgattatttagaatggcctgaatactttatggccgtcgctttcctgtccgcgcaacggagtaaagaccccaactcccaagttggagcatgtatagtcaactcagagaacaagatcgtgggcataggctacaatgggatgccaaacggctgcagcgacgatgtgctaccctggagacgcaccgcggaaaacaagctcgataccaagtatccatatgtctgtcatgctgagctgaatgcgattatgaataaaaacagcacagatgtcaagggatgctcgatgtacgtggccctcttcccatgcaacgagtgcgcaaaactgattatccaagccggcattaaggaggtgatcttcatgagcgataagtatcatgatagtgatgaggccacagctgctaggctcctcttcaacatggccggcgtcacatttcggaagttcatcccgaagtgcagtaaaatagttatagattttgacagcattaatagccgcccctcccagaagctgcagtag

SEQ ID NO: 184663 - DNA, 537 bp, Artificial Sequence
  Description of Artificial Sequence: Synthetic coding sequence
atgagcgaggtgagctgcaagaagcgggacgactacctggagtggcccgagtacttcatggccgtggccttcctcagtgcccagaggagtaaggacccaaatagccaggtaggtgcttgcatcgtaaacagcgaaaataagatagtcggcattgggtacaacggcatgcccaacgggtgttccgacgacgtgttaccatggcgtcgcacagccgaaaacaagctggatacaaagtacccttatgtgtgtcatgctgaactgaacgctattatgaataaaaacagtactgacgtgaaagggtgttctatgtatgttgcactatttccttgtaacgaatgcgctaagctgatcattcaagccggtatcaaggaggtcatattcatgagtgataagtatcatgattcagatgaagcaaccgctgcacgactgctgtttaatatggccggggtgacatttaggaagtttattccaaaatgctcgaagattgttatagacttcgatagtatcaactctaggccttcccaaaagctccaatag

SEQ ID NO: 184664 - DNA, 510 bp, Artificial Sequence
  Description of Artificial Sequence: Synthetic coding sequence
atgagcgaggtgagctgcaagaagcgggacgactacctggagtggccagagtatttcatggccgttgcattcctgagtgcccagcggtcgaaggatccaaattcacaggttggcgcgtgtattgtgaatagtgaaaacaaaattgtgggcatcggttataatgggatgcctaacggctgctctgatgacgtgttaccatggaggcgcaccgcagagaacaaactcgatactaagtacccctacgtctgtcacgccgagctgaacgctatcatgaataagaacagcacagacgttaaaggctgcagcatgtacgtagccctttttccttgtaatgagtgtgccaagttgattattcaggctggtataaaggaggtgattttcatgagtgacaaatatcacgattccgacgaagcgacagccgctaggttattgtttaatatggctggtgtcacatttaggaaatttattcctaaatgtagcaaaatcgtaatcgattttgacagcatttag

SEQ ID NO: 184665 - DNA, 222 bp, Artificial Sequence
  Description of Artificial Sequence: Synthetic coding sequence
atgagcgaggtgagctgcaagaagcgggacgactacctggagtggccagaatacttcatggctgtcgccttcttgtccgcccagaggagcaaggatccgaattcccaggtcggggcatgcattgtaaattccgagaacaagattgtaggcatcggctacaatgggatgcccaatgggtgttctgacgacgtattgccatggcggagaacagccgagaattag

SEQ ID NO: 184666 - DNA, 180 bp, Artificial Sequence
  Description of Artificial Sequence: Synthetic coding sequence
atgagcgaggtgagctgcaagaagcgggacgactacctggagtggccagagtacttcatggctgtggccttcttgagtgcccagcgctccaaagacccaaactcccaggttggagcgtgtattgttaattctgagaataagatcgtgggcatcggatataacggcatgcccaatggttag

SEQ ID NO: 184667 - DNA, 72 bp, Artificial Sequence
  Description of Artificial Sequence: Synthetic coding sequence
atgagcgaggtgagctgcaagaagcgggacgactacctggagtggcctgaatactttatggctgtagcctag

SEQ ID NO: 184668 - DNA, 363 bp, Artificial Sequence
  Description of Artificial Sequence: Synthetic coding sequence
atgagcgaggtgagctgcaagaagcgggacgactacctggagtggcccgagtacttcatggccgtcgcattcctgtccgcgcaaagatccaaggaccctaactcgcaggtgggagcgtgcattgttaattcagagaataaaattgtcggcattggatacaacggcatgcccaacggatgtagcgacgatgtcctcccatggagaagaacagcggagaataagctggataccaaatacccctacgtttgccatgcagaactgaatgccattatgaacaagaattcaaccgatgtgaagggatgctcgatgtacgtggccctattcccttgcaatgagtgtgcaaaactcatcattcaggcctag

SEQ ID NO: 184669 - DNA, 537 bp, Artificial Sequence
  Description of Artificial Sequence: Synthetic coding sequence
atgagcgaggtgagctgcaagaagcgggacgactacctggagtggccagaatacttcatggctgtggcatttctgtctgcgcagagaagcaaagacccaaattcccaggttggggcttgcattgtgaattctgaaaacaagatcgtaggtatcggctacaatggaatgcccaatggatgctctgacgatgtgctgccttggcggaggactgccgagaacaagctggacaccaaatacccttatgtgtgccatgccgaacttaacgccattatgaataaaaacagcaccgatgtcaagggctgttcaatgtacgtcgctctgttcccgtgtaacgaatgtgcaaagctcataatccaggccggtataaaagaggttatttttatgagcgacaagtaccatgacagcgatgaagccaccgccgcccgactgctcttcaatatggccggcgtgacatttcggaaatttattccaaagtgcagcaaaatcgtgatagacttcgacagtattaacagtagaccaagtcaaaagttgcagtag

SEQ ID NO: 184670 - DNA, 360 bp, Artificial Sequence
  Description of Artificial Sequence: Synthetic coding sequence
atgagcgaggtgagctgcaagaagcgggacgactacctggagtggcccgaatactttatggctgtggcattcttatccgcccagcggtccaaagaccctaacagccaggttggagcatgtattgttaatagcgaaaacaagatagtgggcatcggttataatggaatgcctaacggctgttcagatgatgtgttgccctggcggcgcactgctgagaataaactggacactaagtatccatacgtctgccacgccgaactgaacgcaataatgaataagaatagcaccgacgtgaaaggctgttccatgtacgttgcgctattcccttgtaacgagtgtgcaaaactgattattcaatag

SEQ ID NO: 184671 - DNA, 297 bp, Artificial Sequence
  Description of Artificial Sequence: Synthetic coding sequence
atgagcgaggtgagctgcaagaagcgggacgactacctggagtggcccgagtactttatggccgtggcgtttcttagtgcgcaaaggagcaaagatccaaattcacaagtgggggcgtgtattgtaaactcggaaaataagattgtcggcatcggatacaacggtatgccaaatggctgctcagacgacgtcttgccctggcgaaggactgccgagaataagcttgacactaaatatccatatgtgtgccatgcagagctcaacgccatcatgaacaaaaatagtactgacgtgtag

SEQ ID NO: 184672 - DNA, 780 bp, Artificial Sequence
  Description of Artificial Sequence: Synthetic coding sequence
atgaacaagctgaagagcagccagaaggacaaggtgcggcagttcatgatattcacacagtcctccgagaagaccgcggttagttgtttatctcaaaatgactggaagctcgacgtggccacagacaattttttccaaaaccccgagctgtatatcagagaatctgtgaagggttctctcgaccgaaaaaagctagagcaactgtataaccgttataaagatcctcaggacgaaaataaaataggcattgacggaattcagcagttctgcgatgacctggccctggaccccgcatccatcagcgtcttaattatcgcctggaagtttagggctgcgacccaatgcgagttttcaaagcaggagttcatggatggaatgactgagcttgggtgcgacagcatcgagaagctgaaagcacaaatcccaaagatggagcaagagttgaaggagcctgggcggttcaaagacttctaccagtttacattcaacttcgctaaaaacccaggccagaaggggctggacctggaaatggcaattgcctattggaatctggtacttaatggtcgttttaaattcctggacctttggaacaagtttttactcgagcatcacaagcgtagtatccctaaggacacctggaaccttttgcttgacttcagcaccatgatcgcggatgacatgagtaattacgatgaggaaggagcctggcctgtactcatcgatgatttcgtggagtttgccagaccacagatcgccgggacaaagtccactaccgtttag

SEQ ID NO: 184673 - DNA, 660 bp, Artificial Sequence
  Description of Artificial Sequence: Synthetic coding sequence
atgaacaagctgaagagcagccagaaggacaaggtgcggcagttcatgatatttacccagtcctccgagaagaccgccgtgtcctgcctgtcacagaatgattggaagctggacgtcgctactgataactttttccaaaaccccgaactatacattcgcgagagcgtgaagggcagcctcgatcgcaaaaagctggaacagctgtacaataggtacaaggatcctcaggatgagaataagatcggaatagatgggatgactgaattagggtgtgactccattgagaagctcaaagctcaaataccaaaaatggaacaggagctgaaggagcctggtaggttcaaagacttctatcagtttactttcaatttcgccaagaatccagggcagaaaggcttggacctagagatggcgattgcctactggaacctcgtcttaaatggccgattcaaattcctggacctttggaacaagtttctcctcgagcatcacaaaaggagcattcctaaggatacatggaacctcctcctagatttttctacaatgattgctgatgatatgagtaattacgacgaggaaggcgcctggccagtcctaattgacgatttcgtggagtttgcccggccacagatcgccgggactaagtctaccacagtgtag

SEQ ID NO: 184674 - DNA, 387 bp, Artificial Sequence
  Description of Artificial Sequence: Synthetic coding sequence
atgatcttcacccagagcagcgagaagaccgccgtgagctgcctgagtcagaatgactggaagctcgatgtagctaccgataatttttttcaaaatccagagttatatattagagagagtgttaagggctccttagatagaaagaagctagaacagctctacaatagatacaaggacccccaagatgagaataaaattggaatcgatggcatccaacagttttgcgacgatcttgcccttgatcctgcctctataagcgtgctgattatcgcatggaaatttagagcggccacccaatgcgagttttccaaacaggagtttatggacggcatgacggagctcggctgcgatagcatagagaagcttaaagcccaaatccccaagtag

SEQ ID NO: 184675 - DNA, 879 bp, Artificial Sequence
  Description of Artificial Sequence: Synthetic coding sequence
atgcacagcgacgccgccgccgtgaacttccagctgaacagccacttatcaaccctggcaaacatccataagatctaccataccctgaataaactgaacctcactgaggacattggacaggatgaccaccagactggatcactccgctcatgctcaagttctgactgtttcaacaaagttatgccacctaggaagaaaaggcgacccgctagcggcgatgacctcagcgccaagaagtcccgtcacgacagtatgtacaggaaatatgattccactagaatcaagactgaggaggaggcgttctcttcaaagagatgtctagaatggttctatgagtacgccggcaccgacgatgtggtgggccccgaggggatggaaaagttttgtgaagatatcggagttgaacctgagaacgtggttatgctggtgcttgcatggaagcttgacgcacagaatatgggctattttacactgcaggaatggttgaaagggatgacatctttgcagtgcgataccacagagaaactaaggaatactctggattatctgagatcgtttctcaacgacagcacaaactttaagctgatctacagatacgcgtttgacttcgcacgggagaaggaccagcggtccctggacatcaacacagcgaaatgtatgctggggctgctgctgggcaagatatggcccctgttcccggtatttcatcagtttttagagcaaagcaagtacaaagtcataaacaaagaccagtggtgcaacgtactggagttcagtcgcaccatcaatttggatctctccaactacgacgaggacggggcgtggccagtcctgttggatgagtttgtggaatggtacaaagacaagcagatgagttag

SEQ ID NO: 184676 - DNA, 699 bp, Artificial Sequence
  Description of Artificial Sequence: Synthetic coding sequence
atgcccccccggaagaagcggcggcccgccagcggcgacgacctgtcagcaaaaaagtctaggcacgattctatgtatcgcaaatacgactccacaaggatcaagactgaagaagaggctttttcctcgaagcgttgcttagagtggttttatgaatacgccggaacggacgatgttgtgggtcctgagggaatggaaaaattctgcgaggatatcggtgtcgaacctgaaaacgtggtaatgctcgttctggcctggaagctcgatgcacaaaatatggggtactttacacttcaggagtggcttaagggaatgacgtccctgcagtgcgatacaactgagaagttacgtaataccttagactacctacgtagctttctcaatgatagcaccaacttcaaattgatctatagatatgcatttgacttcgcccgcgagaaggatcaaagatcacttgatataaacaccgccaagtgtatgttgggtcttctgctgggtaaaatatggcctttgtttcccgtattccaccagttcctagaacaatctaagtacaaggtaatcaataaggaccagtggtgtaatgtgttggaatttagcaggacaatcaacctcgatctttccaattacgatgaagacggagcctggccagtcctgctggatgaattcgtggagtggtataaagataaacaaatgagctag

SEQ ID NO: 184677 - DNA, 774 bp, Artificial Sequence
  Description of Artificial Sequence: Synthetic coding sequence
atgcacagcgacgccgccgccgtgaacttccagctgaacagccacctgtcaactctggccaatatccataagatataccacaccctgaacaaactcaatctgacagaggacataggacaggacgaccaccagactggctctctacgttcctgtagttcctccgactgttttaataaagtaatgcccccccgcaaaaagaggagaccggccagtggcgacgacttgtccgctaagaaaagtcgccacgactctatgtatagaaaatatgattcaactcgtataaagactgaagaggaggctttcagtagcaaacgctgcttagaatggttttacgaatatgctggcacagatgatgtggtgggaccagaaggaatggagaagttttgcgaagatattggggtggagcccgaaaacgtggtgatgctggttctggcttggaaattagatgcacagaacatggggtatttcactctgcaagagtggttgaagggcatgacctctctccagtgtgataccacggaaaagctcagaaacacgttggactacctgcggtcctttcttaatgatagcacgaatttcaagctgatctatcgctacgcgtttgactttgccagacagagcaagtacaaggtcataaataaggaccaatggtgcaatgtactggagttctccaggacaatcaacctcgatttgtcgaattatgatgaggatggtgcttggccagtgttgctggatgagttcgtggaatggtataaggacaaacagatgtcttag

SEQ ID NO: 184678 - DNA, 1011 bp, Artificial Sequence
  Description of Artificial Sequence: Synthetic coding sequence
atggaggtggaggccgccctgggctgcagcggccagggccggggctgcggcggggtagccccggccggccgcggccgtgagagagcttcggaacgtggaacacgcgtgcggatatcgaagggcctctccggcgctggaggctctgtcaggaaggctgattttcaactgaactcccacctgtccacgttggctaacatccacaaaatttaccataccctgaataagctgaatcttacagaggatattggccaagatgatcaccagaccggaagtctgcgctcttgtagcagcagcgactgtttcaacaaagtcatgccgcctagaaaaaaacgcagacctgcatccggagatgatttgagcgctaaaaagtcccggcacgactctatgtacaggaaatacgactccacccgcattaagacggaggaggaggcctttagtagtaagcggtgtttggaatggttctatgagtatgctggcacagatgatgtggtgggaccagagggcatggagaaattttgtgaggatattggggtggaaccggaaaatgtagttatgctcgttctcgcttggaaacttgacgcacaaaacatgggatactttacactccaggagtggttaaaaggtatgaccagccttcagtgtgatactacagaaaagctgcgaaacacactggactacctccggtcttttctgaacgatagcactaattttaaactcatttatcggtacgcctttgacttcgccagggagaaggaccagaggagtttagacattaatacggccaagtgcatgctcggcctcttactgggcaaaatttggccgctgttcccagtgtttcaccaattccttgagcagagcaagtacaaggtgattaataaggatcagtggtgtaacgttctggagttctcccggacaatcaatctggacctgagcaattacgacgaagacggagcctggccagtgctcttggatgaatttgtggaatggtacaaagacaagcagatgagctag

SEQ ID NO: 184679 - DNA, 1854 bp, Artificial Sequence
  Description of Artificial Sequence: Synthetic coding sequence
atggccgccgtggccgccggcggcctggtgggcaagggccgggacatcagcctagcggctttgcagagacacgacccttacatcaacaggatcgtcgatgtcgccagccaggtcgctctttatacatttgggcatcgcgcaaatgagtgggaaaaaacagacgtggaggggaccctgtttgtgtacacacggagcgcgagccccaagcatggattcaccattatgaataggctgagcatggagaataggacagaacctattacgaaggacttggatttccagctccaggaccctttcctactgtatcgtaacgcaagactgtccatttacgggatctggttctacgacaaagaggagtgccaacgcatcgccgaactcatgaagaatctgactcaatacgagcagttgaaggcacaccagggcactggagcaggaatttcgcccgttatcctcaacagcggcgagggcaaggaggtggacattttgcgcatgctcattaaggcgaaagacgagtacactaagtgcaagacctgcagtgaaccgaagaaaattacaagttcctcagccatctatgacaacccaaatctgataaagccgatccctgtgaagcctagcgaaaatcagcagcagaggataccacaaccaaaccagactctggacccggagccacagcacctgagtctgaccgccctcttcggaaaacaggataaagccacctgtcaggagactgtggagcccccacaaaccttgcaccagcagcaacaacagcaacagcagcagcaggagaagctccctattagacagggagtcgtaaggtcactatcctatgaggaaccccggagacactcaccgcccatcgagaagcaactgtgccctgctattcagaaactgatggttcggtcggccgacttgcatcccctgtctgagctccctgaaaaccggccatgtgaaaatggcagcactcacagcgctggagagtttttcaccggacctgtgcagccagggtcccctcataatataggcacctcccgcggagtccaaaatgccagcagaacccagaatctgtttgaaaaattgcagtctactcccggtgctgcaaacaagtgtgatccatctacacctgctccggcctcttccgcagcactcaaccgatccagagctcccacatccgtgacaccagtcgcgcctggcaagggcctcgctcagcccccacaggcgtacttcaacggaagtctacctcctcagactgtggggcatcaggcccacggtcgcgaacagtccacacttcctcgccagacattacctatctccgggtctcagacaggcagcagcggcgtgattagtcctcaggagttgcttaagaagctgcagatcgtccaacaggagcagcagctccatgcgagtaatcggccggccctggctgccaaatttcccgtactcgctcagagctccggtacaggtaaacccctggagagttggatcaataagactcccaataccgaacaacagactcctctgttccaagtgatctcacctcaaagaatcccggccaccgctgctcccagcctactgatgagtcccatggtatttgcacaacctacttccgttccaccaaaggagagagaaagtggtctgctccccgttgggggccaggaaccaccagctgccgccacctccctgctgttaccaatccagagccctgagccaagcgtaatcacctcctctcctctcacaaagttgcagctccaagaggccttgctgtacctcatacagaatgacgataattttctcaacataatctatgaagcatatctcttcagtatgactcaggccgctatgaagaaaacaatgtag

SEQ ID NO: 184680 - DNA, 1548 bp, Artificial Sequence
  Description of Artificial Sequence: Synthetic coding sequence
atgcagatcaaggtgagcatctacggcatctggttctacgacaaggaagaatgccagcggatcgccgaacttatgaaaaacctgactcagtatgaacagctcaaggctcatcagggcacaggcgcaggcatctcccctgtgattctgaattccggcgagggtaaagaagtagatatcctgcgtatgctcattaaggccaaggacgagtacacaaaatgcaagacgtgtagtgagcccaagaaaattacttcatctagcgctatttacgataacccaaatctcatcaaacccatcccggtcaagccttctgaaaaccaacaacagcggattccgcaacctaaccaaaccctggaccctgagcctcaacatctgtcattgacagcgcttttcggcaagcaggacaaggccacctgtcaggagaccgtggaacccccacagactttgcaccagcagcagcagcagcagcagcaacagcaggaaaaactcccaatccgccagggggtggttagatcactgtcctacgaggaacctaggaggcattctccgcctatcgagaagcagctctgccccgctatccagaagctaatggtgcggtctgccgatctgcaccccctgtccgagctccctgagaaccgaccctgcgagaatggttcaacgcactctgccggtgagtttttcaccgggcccgtgcaaccaggttctccacataacattggaacaagcaggggggtgcaaaacgcctcaaggacccagaacctgtttgagaaactccagtccacgcccggcgcagccaataaatgtgatccttctacgcctgcccccgcttcatctgctgccctcaacagatcaagagcgcctacctcagttaccccggtggcccctggcaagggactggctcagcccccacaggcctacttcaatgggtctctacctccacaaacagtgggccatcaagcacatggccgcgaacaatccacattgccaagacagactctgcctatatctggatcccagactggtagtagtggggtcattagtccacaggagctgttgaagaaactgcaaatcgtacaacaggagcagcagttgcacgcatctaatcggccggcgctcgccgccaaattcccagttctagcgcagtccagcggtaccgggaaaccgttggaatcctggattaataaaacgccaaatacggagcaacagacacctctatttcaggtgattagcccacagcgaattcctgcaaccgcggctccttcattacttatgtcgcctatggtgttcgctcagccaacttccgtccccccgaaggagagggaaagcggtctattgcctgtaggaggtcaggagcctcctgccgccgccacatcgttgctgttaccaatccagtctccagagcctagtgtgatcactagctctcctctcactaaattacagctgcaggaagctttgctgtatctcatacaaaatgacgataacttcttaaacatcatttatgaggcgtatctgttcagcatgactcaagcggccatgaaaaaaacgatgtag

SEQ ID NO: 184681 - DNA, 1263 bp, Artificial Sequence
  Description of Artificial Sequence: Synthetic coding sequence
atggagaccaagcgggtggagatccccggcagcgtgctggacgacttttgtagcagatttattctgcatatacccagcgaggagcgagataacgcaattagggtgtgctttcagatcgagctggcacactggttctatcttgacttctacatgcagaacaccccaggcttgccacagtgcggcattcgggacttcgccaaggctgtcttttcccattgtccttttttgctgccacaaggcgaggatgtagaaaaagtgctcgacgagtggaaagaatataaaatgggagtgcccacctacggagctatcatactggatgagaccttggaaaacgtgctcttggtgcaagggtaccttgcaaagtctggatgggggtttccaaagggcaaggtaaataaggaagaggctccacacgactgtgctgccagggaagtgtttgaagaaaccggcttcgacatcaaagattatatttgtaaggatgactacattgagctgagaataaacgatcagctggcccgcttgtatattatcccaggtatccccaaggacacgaagttcaacccgaagacccgtcgcgagatccgaaatattgagtggtttagcatcgagaagttgccttgccaccgaaatgatatgacacccaaatccaagctgggtctcgcacctaataagttttttatggctattccattcattaggcctttacgagactggctttctcgacggtttggagattctagcgattctgacaatggcttcagtagcactgggtctacacccgccaaacctacagtggaaaagttgagccggactaaatttaggcactcacaacagctctttcccgatgggagtcccggagatcagtgggtgaaacatagacagccactgcaacagaagccttacaacaatcatagcgagatgagcgacctgctgaagggcaagaaccaatctatgcgcggtaatggcagaaagcagtaccaagatagtccaaatcaaaaaaagcgaaccaacggcctgcaacccgctaagcaacagaactccctgatgaagtgcgaaaaaaagttgcacccccgtaagctgcaggataactttgaaaccgatgctgtgtacgacttaccctccagtagcgaagaccaactgcttgagcatgcggagggtcagcccgtggcatgcaacggtcattgcaagtttccctttagcagtcgtgcctttctctccttcaagttcgaccacaacgccataatgaaaattctcgacttgtag

SEQ ID NO: 184682 - DNA, 1158 bp, Artificial Sequence
  Description of Artificial Sequence: Synthetic coding sequence
atggagaccaagcgggtggagatccccggcagcgtgctggacgacttctgcagccgctttatccttcatattcccagcgaggagagagacaacgctatccgcgtgtgcttccagatcgagctggcgcactggttctatttggacttttatatgcagaatactcccggactgccccagtgcgggatccgggatttcgccaaggccgtttttagccactgccctttcctgttgccacagggggaagatgtggaaaaggtgttagacgaatggaaggagtacaagatgggcgtaccaacttacggagcgatcattcttgatgagaccttggagaacgtactgctggtgcagggatatctggcaaaaagcggatggggatttccaaaaggcaaggtcaacaaggaggaggcccctcacgactgcgctgcaagagaggtattcgaggaaacgggcttcgatataaaggattacatctgcaaagatgattacatcgagctcagaatcaacgaccaactggccaggctgtacataattcccgggatacccaaagataccaagtttaacccaaagacccggagagagatccggaacatcgaatggttcagtatagaaaagctgccctgccacagaaatgacatgactccaaagtctaaattgggtttggcccctaacaagttttttatggcaattccatttattaggccgttacgagattggctttctcggcggtttggggacagctcagactccgacaacgggttttcgtctactggctcgacgcccgccaagcccactgtcgagaaactgtcccgcacgaaatttcggcactctcagcaactgttccccgacggaagccccggcgatcagtgggtaaaacataggcagcccctgcagcagaaaccttacaataaccatagcgagatgtcagacctccttaaaggaaaaaagtgcgagaaaaagctccatccaaggaagctccaggataacttcgaaacggacgccgtatatgacctgcccagttctagtgaggaccagctgctggagcacgcagagggccaaccagtcgcctgtaatggtcattgtaaattcccattctcctctagagccttcctcagtttcaagttcgatcacaatgcaattatgaagatactggacttgtag

SEQ ID NO: 184683 - DNA, 630 bp, Artificial Sequence
  Description of Artificial Sequence: Synthetic coding sequence
atgacccccaagagcaagctgggcctggcccccaacaagttcttcatggctatccctttcatcagaccactgcgagattggctctcaagacggttcggcgactcttctgattccgacaatggctttagcagcaccggctcgacccctgcaaaacctacagtggaaaagctatcccggacaaagtttcggcatagccaacaactgttccctgacggatctccaggtgatcaatgggttaaacaccggcaacccttgcagcagaaaccgtacaacaaccacagtgagatgtccgaccttcttaaaggtaagaaccagagcatgaggggcaacggaaggaagcagtaccaggactctcccaaccagaagaagaggacaaatggcctgcagcctgctaaacagcaaaacagcctgatgaaatgcgaaaagaagcttcacccacgaaagctgcaggacaacttcgagacggatgctgtgtatgacctgccctctagcagcgaagatcaactcttagagcatgcagaagggcaaccggtggcctgcaacggacactgtaagtttccttttagctctcgcgcatttctatcattcaagtttgatcataatgcgatcatgaagatcttggatctctag

SEQ ID NO: 184684 - DNA, 1341 bp, Artificial Sequence
  Description of Artificial Sequence: Synthetic coding sequence
atgaccgagctgggcatggtggtgctgggcatcgacaccacccacttgtggatgcttcctctcacgcctggtagctggaactcaatgagaagccgtcacaagtggaactggccccaggggtcttggggtctgggaggtccaccaaggtcaacagcctttctggagtgttgtacttcctttctgccgaatgacctgggatttaccgacagctattcccagaaggccttttgcggtatttactccaaggacggacaaatattcatgtccgcatgtcaggatcagactattcgcttatacgactgcaggtatgggagatttcgcaagttcaaaagcataaaagcaagggacgtggggtggagcgtgctcgacgttgcctttacaccagacgggaaccactttctgtactccagctggagcgattatatacatatatgcaacatctacggcgagggcgacacacatacagccttggacctcaggccagacgaaaggagatttgctgtgtttagcatcgctgtgagcagtgacgggcgagaagtgctgggcggcgcgaatgatgggtgcctgtatgtcttcgatcgcgaacagaaccggagaactttgcaaattgagtcccacgaggacgacgtcaacgctgtggcctttgcagatatcagttcgcagatcttgttctccggtggcgacgacgccatctgcaaagtgtgggaccgccgcacaatgagagaagatgaccccaaaccggtaggagcactggccggccaccaggacggtatcactttcatcgatagcaagggcgatgcccgctacctcatatcaaattccaaagatcagactattaagctctgggatatcaggaggttttccagccgggagggaatggaggcctccaggcaagctgccactcagcagaactgggattatcgatggcaacaggtccctaagaaagcatggcggaagctgaagctccccggagactcatccttaatgacataccgagggcatggcgtgctacatacacttattcggtgtcgcttctcacctattcattcgactgggcagcagtttatatacagcggatgctccacgggcaaagtggttgtgtacgacctgctaagtgggcacatagtcaagaaactaacaaaccacaaagcctgcgtgcgggacgtgagctggcacccattcgaggagaagatcgtgtcgtcctcatgggacggaaatctcaggttgtggcagtatcgccaagccgaatacttccaggatgacatgcccgaaagtgaggagtgtgcctcagcccctgccccagtgccacagagcagtacacctttctcctcgccgcaatag

SEQ ID NO: 184685 - DNA, 1563 bp, Artificial Sequence
  Description of Artificial Sequence: Synthetic coding sequence
atgggcagccggaacagcagcagcgccggcagcggcagcggcgacccctctgaagggttgcctcgcaggggagcagggctcaggcgaagtgaagaggaagaagaggaagacgaggatgtagatcttgcgcaagcccttctcgacagcgaagaggaaaacgatagagcttgggatggaagattaggagacagatacaatccacccgtggacgccacccctgacacaagggagctggagtttaacgagattaagacccaggtggagctggccacgggccaacttggtctgagacgggccgcccagaagcactcttttcctaggatgctgcaccagagggaacgtggcctctgccacagaggtagctttagcctgggcgagcagtcacgcgtcatttcgcattttttgcccaacgacttgggctttacagacagctactctcagaaagctttttgtggtatttatagcaaggacggccagatctttatgtcggcctgtcaggatcagactatacgattgtatgattgtagatacggacgattcagaaagttcaaatccatcaaggccagggacgtgggatggtcggttctcgatgtggcgttcactccagacggcaaccatttcctttactctagttggagtgactacattcacatttgcaatatttacggcgagggcgacacccacactgccctggatctgcgcccagatgaacgacggtttgcagtgttttccatagccgtgtccagtgacggacgagaggtcctgggtggcgcaaacgatggctgcttgtacgtgttcgacagagaacaaaataggagaacactccaaatcgagtcccatgaggacgatgtgaatgctgttgcctttgctgatatcagctcacaaattcttttttcaggaggcgatgatgccatctgtaaggtgtgggataggagaaccatgcgagaagatgatccaaagcctgtaggtgctctagccggccatcaggacggaataacatttattgatagcaagggtgacgccagatacttaatctccaattctaaggatcaaactatcaagttatgggacatccgtcggttcagcagtagagaaggcatggaagcatcacgacaggcagcaactcaacaaaactgggattaccgctggcaacaggtgccaaagaaggcctggaggaaattaaagctgcccggcgattcatctttgatgacctaccggggtcatggtgtcctccacacactgatccgctgcaggttctcccctattcacagcacaggccaacaattcatctattccggttgcagcacgggcaaggtcgttgtgtacgacctgctatcaggtcatatcgtcaaaaagcttaccaatcacaaagcctgcgtccgcgacgtttcctggcatccctttgaagaaaagattgtgtcttcatcatgggacggcaaccttaggctttggcagtaccggcaagctgagtactttcaggacgacatgccggaatcagaagagtgtgccagtgcccctgccccagtgccccagagcagcactcccttcagcagcccccagtag

SEQ ID NO: 184686 - DNA, 1641 bp, Artificial Sequence
  Description of Artificial Sequence: Synthetic coding sequence
atgggcagccggaacagcagcagcgccggcagcggcagcggcgaccctagcgaagggcttccacggagaggtgcaggattgaggcgatccgaggaagaggaggaagaagacgaagatgtcgatctcgcccaagttctggcctatctgttgcggaggggccaggttcgactcgtgcaggggggaggggcagctaatcttcagttcatacaggctcttctggatagcgaagaggagaatgatcgagcttgggatggaaggttaggtgatagatacaacccacctgtagacgccactcctgacacacgggaactagagttcaacgagatcaaaacacaggtcgaactcgcgaccggacagctcggactgcgacgtgccgcccaaaagcactcatttccgaggatgctccatcagcgcgaaaggggcctgtgccaccggggatccttcagcctgggggagcagagcagggtgatttctcatttcctacctaatgatctgggttttacagacagctacagtcagaaggccttttgcgggatctattcgaaggatggacaaattttcatgagcgcgtgccaggatcagaccattagactgtacgactgccggtacgggcgtttccgcaagttcaaatcaatcaaagctcgcgatgtggggtggtctgtcctggacgttgcttttacccctgacggcaatcactttctttacagcagctggagcgattacatccacatttgtaatatctacggggaaggcgacacacacactgcactggatctccgacccgatgagcgtcggttcgccgtgttttccatcgctgtaagcagtgatggtcgggaggttctcggaggcgccaacgatggctgtctgtacgtcttcgatcgcgagcagaaccgcagaacccttcagatagagtcccatgaagacgacgtgaatgctgtggcgttcgccgatatctccagccagatcctgttttctggcggtgatgatgcaatctgcaaggtatgggatcggagaaccatgagggaggacgaccctaaacccgttggagccttagcaggccaccaagacggcattacattcatagacagcaagggggatgcacgctaccttatcagcaatagcaaagatcagacaattaaactctgggatattagaagatttagttcccgagaggggatggaggcctccagacaggcagccacacagcagaattgggattatcgatggcagcaggtgccaaagaaggcatggcggaaactgaagctgcctggcgatagtagcctgatgacataccgtgggcacggtgtactccataccctcattagatgcaggttctcccccatacattcaacagggcaacaatttatctactcaggttgttcaacggggaaagtagtggtgtatgatttactgtccggccatatcgtgaagaagctcacgaatcataaggcctgcgttcgagacgtgtcttggcacccatttgaggagaaaatcgtgtcctcctcctgggatggaaatctccggctgtggcagtatagacaggctgaatatttccaggatgacatgccagagtccgaggaatgcgcctccgccccggctccagtacctcagagcagtacgccgttcagtagcccccagtag

SEQ ID NO: 184687 - DNA, 369 bp, Artificial Sequence
  Description of Artificial Sequence: Synthetic coding sequence
atgggcagccggaacagcagcagcgccggcagcggcagcggcgacccttccgaaggcctccctagacgaggtgccggcctccgcagatcagaagaggaagaagaagaggatgaagacgttgacctggcccaggtgctagcatacttgttgcggagggggcaggtgcgccttgtgcagggaggcggcgcagcaaatctccaatttatccaagccctcctggatagcgaagaggaaaatgatcgcgcctgggatggcagattgggagaccgttataacccgcccgtggacgctacacccgatacacgggaattagaattcaacgaaattaagacccaggtggagctggcaaccgggcagctcggactgtag

SEQ ID NO: 184688 - DNA, 222 bp, Artificial Sequence
  Description of Artificial Sequence: Synthetic coding sequence
atgggcagccggaacagcagcagcgccggcagcggcagcggcgaccccagcgaaggactccccagaaggggagcaggactccgtaggtcggaggaagaggaggaagaagatgaagatgttgatctcgcgcaggtgctcgcctatctattgaggcgggggcaagtccggttggttcaaggcggtggggccgcgaacctccaatttattcaagctctgttatag

SEQ ID NO: 184689 - DNA, 282 bp, Artificial Sequence
  Description of Artificial Sequence: Synthetic coding sequence
atgggcagccggaacagcagcagcgccggcagcggcagcggcgaccctagtgagggactgccccggcgaggggcaggtctcaggagaagcgaagaggaagaggaggaagatgaagatgtggatctcgcacaggtgctagcctacctgctgaggcggggccaggttcgtctggttcagggcggcggcgcggccaaccttcaattcattcaggctcttttggattccgaagaggaaaatgacagagcttgggacggcaggctcggtgaccggtacaacccttag

SEQ ID NO: 184690 - DNA, 327 bp, Artificial Sequence
  Description of Artificial Sequence: Synthetic coding sequence
atgggcagccggaacagcagcagcgccggcagcggcagcggcgacccttccgaaggcctaccgcgccgaggtgcaggtcttcgaaggtccgaggaggaagaggaggaggacgaggatgtggacctggcccaggtgctggcctacctactgcgcaggggccaggtgcgcctggtgcaaggcggaggagccgccaatctccaatttatccaggcgctgctagactctgaagaagaaaacgatagggcatgggatgggaggctcggagacagatacaatccccccgttgatgcgactcctgacacaagggaactggagtttaatgagtag

SEQ ID NO: 184691 - DNA, 1641 bp, Artificial Sequence
  Description of Artificial Sequence: Synthetic coding sequence
atgggcagccggaacagcagcagcgccggcagcggcagcggcgaccccagcgaaggacttcccaggaggggagcaggccttaggaggtcagaggaggaggaggaagaggatgaggacgtagacctggcacaggtgttagcgtacttgttaagaagggggcaggtcagactggtccaggggggcggtgccgcgaaccttcagtttattcaggccctgctcgatagtgaagaggagaatgatcgtgcttgggatggacggctcggggatcgctataaccctcctgtcgatgctacccctgacaccagagaattggaattcaacgaaataaagacccaagttgagttggccaccggtcagctggggctcagaagagccgcccagaagcattcctttccgcggatgctccatcagcgcgagcggggtctatgccaccggggatctttcagcctgggagaacaatcgcgggtcatcagtcatttcctgccgaatgatctgggttttaccgacagttattcccagaaggcattttgcggtatctattcgaaggacgggcagatttttatgtccgcttgccaggatcagacaattcggctttacgactgccgctatggcagattcaggaaattcaaatctataaaagcaagggacgtcggctggtcggtgcttgacgtggcctttactcccgacgggaatcatttcctgtacagcagttggagcgactacatccacatatgcaatatctatggcgaaggcgatactcacaccgcattggatctgcgccccgacgagcgacggtttgctgtgttttcaatagcagtatcctctgacggccgtgaagtgctgggtggagctaacgatggttgcctgtacgtgtttgatcgggaacagaacagacggaccctccagattgagtctcacgaggatgatgtgaacgccgtggcatttgccgacatcagttctcagattctgtttagcggaggtgatgacgccatttgcaaggtgtgggaccgtcgcacaatgcgcgaagatgatccaaaacctgtcggggcattggctgggcaccaagacgggatcacattcattgacagtaagggtgacgctcgatatctcatctctaacagcaaagaccagactatcaagctctgggatatacggcgattttcctctcgggaaggcatggaggctagtagacaggccgcaacccaacagaattgggactaccgctggcagcaagtgccgaagaaagcctggaggaagctcaagctgccaggcgattcctccttgatgacatatcgtggacatggcgtactacacacacttatccggtgtagattttctcccattcacagcaccggccagcagttcatctactcggggtgttcaacagggaaggtcgtggtctacgatcttctatctggccatatcgtcaagaaactcactaatcataaagcctgcgtcagggacgtctcctggcatccgttcgaggaaaagatcgtgtcatcgtcttgggacggaaacttgcgcctttggcagtaccgacaggcagaatatttccaagacgatatgcctgagagtgaggagtgcgcgtcagcacctgctccggttccgcaatcttcaacaccattcagtagtccccaatag

SEQ ID NO: 184692 - DNA, 273 bp, Artificial Sequence
  Description of Artificial Sequence: Synthetic coding sequence
atgggcagccggaacagcagcagcgccggcagcggcagcggcgacccgagcgaaggactccctcggagaggcgccggacttcgaagaagtgaggaagaggaggaagaagatgaggacgtggaccttgctcaggccctgctcgattccgaagaagagaacgatagggcctgggacggacgactgggagaccgatacaatccaccagttgatgctactcctgacacacgggagctggaatttaatgaaatcaaaacgcaggtcgaactcgcctag

SEQ ID NO: 184693 - DNA, 93 bp, Artificial Sequence
  Description of Artificial Sequence: Synthetic coding sequence
atgggcagccggaacagcagcagcgccggcagcggcagcggcgacccttcagaaggactgcctaggaggggtgcagggcttcgaaggagttag

SEQ ID NO: 184694 - DNA, 429 bp, Artificial Sequence
  Description of Artificial Sequence: Synthetic coding sequence
atgggcagccggaacagcagcagcgccggcagcggcagcggcgacccctctgagggactgccacgccggggtgccggtctgaggcggtcagaagaagaggaggaagaagacgaggacgttgatctggctcaggtgttggcatacctgctgcggcgcgggcaggtgcgattggtgcagggcggaggtgccgccaatctccagtttattcaagcgctactagatagtgaagaggagaacgatagagcgtgggacggaagactaggggaccgatacaacccacctgtggatgccaccccagacacacgggagctcgagtttaacgaaattaagactcaggtggaacttgctactggccaactaggcctgcggcgtgccgcacagaagcatagtttcccgaggatgctgcatcaacgcgaacggggcctctag

SEQ ID NO: 184695 - DNA, 204 bp, Artificial Sequence
  Description of Artificial Sequence: Synthetic coding sequence
atgggcagccggaacagcagcagcgccggcagcggcagcggcgacccatctgaggggctccctcgcagaggagccggcttgcggagatcagaggaggaggaagaggaggacgaggacgtggatttagcgcagaggccgtctgaggtgggtgctggtcgtagatgctcgaaatttacaatccacagtggtcccctgggtttatag

SEQ ID NO: 184696 - DNA, 321 bp, Artificial Sequence
  Description of Artificial Sequence: Synthetic coding sequence
atgggcagccggaacagcagcagcgccggcagcggcagcggcgacccttcggaagggttgccccggaggggggccggcctccgcagatcagaagaagaggaagaggaggatgaagatgtggatctggctcaggtactggcctatcttcttagacggccttcctggacccagcgaaaacgaatgacagagctcggcatggttgtcttgggaatcgataccacccacttgtggatgttaccgttgactccgggaagctggaatagtatgaggtcacggcataaatggaattggccccaaggctcgtgggggctgggagggtag

SEQ ID NO: 184697 - DNA, 387 bp, Artificial Sequence
  Description of Artificial Sequence: Synthetic coding sequence
atgggcagccggaacagcagcagcgccggcagcggcagcggcgacccttccgagggacttcctcggagaggcgccggattgcgacgttccgaagaagaggaggaggaagatgaagacgtggacctcgctcaggcccttttggattctgaagaggaaaacgatcgggcttgggacgggaggctcggagatcggtacaaccctccagttgacgccacccctgatacgcgcgaactcgagtttaacgagattaaaacacaggtagaactcgctacaggtcagttgggcctccgcagggctgcacagaagcattcttttccccgcatgctccaccagcgcgagagaggactctgtcacaggggcagcttttcactaggtgaacagtcttag

SEQ ID NO: 184698 - DNA, 465 bp, Artificial Sequence
  Description of Artificial Sequence: Synthetic coding sequence
atgggcagccggaacagcagcagcgccggcagcggcagcggcgacccctccgagggtctgcctcgacggggagcgggtttacggaggtccgaagaggaggaggaagaggacgaagatgtcgacctcgcccaagttctggcatatttgctcaggagggggcaagtgcggctcgtgcagggaggaggcgcagcaaacctgcagttcatacaggccttacttgacagtgaggaggagaatgatcgagcctgggacggcaggctgggggatagatataatcctcctgtcgatgcaacacccgacaccagggagctagagtttaatgagataaagactcaggtagagctggctacagggcagctcggcttacggcgggcggcacagaagcacagtttccctcggatgcttcaccagagagaacgggggctgtgtcacaggggtagctttagtctgggcgagcagagttag

SEQ ID NO: 184699 - DNA, 2829 bp, Artificial Sequence
  Description of Artificial Sequence: Synthetic coding sequence
atgaagcggcgggccggcctgggcggcagcatgcggagcgtggtgggttttttgtcccagaggggcctgcatggtgatccgctgctcacacaggattttcagcggagacggctgcgaggttgtaggaatctgtataaaaaggacctgctgggacatttcggatgcgtgaacgccattgagtttagtaacaatggcggccaatggctggtcagcggcggggacgatagacgtgtcctgctatggcatatggagcaggcaatacacagccgcgtcaagcccattcagttgaagggagaacatcattccaacatcttctgtttggcatttaactccggtaatactaaggtcttttctgggggaaatgatgagcaggtcatcttacacgatgtggagtctagcgagaccctcgatgtgtttgcgcacgaagatgcggtgtatggcctatctgtgagtcctgtcaatgataacatctttgccagtagtagtgacgacggtcgtgtgctgatatgggacatcagggagagtccacacggggaacctttctgcctggccaattacccaagcgcctttcactcagtcatgttcaaccctgttgaaccacggctgcttgcaacagccaacagcaaagagggcgtcggactgtgggatatccgcaagccccagagttctctgctgagatatggcggcaatcttagtcttcagagcgctatgagcgttaggttcaactcgaatggcacacaactactcgcactgcggcggcgcttgccgcccgtgttgtacgatatccattcgcggcttcctgtgtttcagtttgataatcagggttattttaactcctgtactatgaaaagctgctgtttcgccggcgatagagatcagtacattcttagcgggagcgacgactttaatctgtatatgtggcggattcccgccgacccagaagcaggtgggattggcagggtggtcaacggagctttcatggtcctcaaagggcataggagcatcgtaaaccaggtgcggttcaatcctcacacttacatgatctgttcaagtggagttgagaagattatcaagatctggtcaccttataagcagcccggctgtacaggtgatcttgatggcaggatcgaagacgactcacggtgtctttacacccacgaagaatacatttctcttgtgctcaattctgggtctggactctcccacgattacgcaaatcaatccgtgcaagaggaccccagaatgatggccttctttgactctctggtgagaagagaaatcgaaggatggtccagcgattccgacagtgatctgtccgaatcaacgattctccaacttcacgctggggtttccgagagatctggctataccgactctgaatcctctgccagcctgccacgttcccctccacccactgttgacgaatctgctgacaacgcttttcacctgggcccactgcgcgtcaccacaacgaacacagttgccagcacccctcccacgccgacgtgcgaagacgccgcttccagacaacagcgactgtctgcattgaggcggtatcaagacaaaagactgctggccctatctaatgagtccgactctgaggaaaatgtatgtgaggtagagttagatacagacctatttcctcgtcccaggtctcccagtcctgaagacgaatcttcctcatcaagcagctcgtcctcctctgaggacgaagaagaactcaatgagcgacgggcttccacgtggcagcgcaacgccatgcggcgcagacagaagacaacgcgcgaggacaagccctccgcacccattaaaccaactaacacttacattggggaagacaactacgactacccacagattaaagtggatgatctgtctagctccccaacttcttcacccgagcggagtacttcaactttagagatccaacctagccgcgccagcccaacatcagacatcgagtctgtagagagaaaaatttacaaagcatataagtggcttcggtattcctacattagctactcgaataataaagacggtgaaacttccctagttaccggcgaggcagatgaagggcgcgctggcactagtcacaaggataatcccgcccctagctcctccaaggaagcttgcctcaacattgccatggctcagcgaaatcaagatctgcctccggaggggtgttcaaaggacaccttcaaggaggaaactcctcgcaccccttccaacggtccgggacacgaacattcatcacatgcttgggctgaagttcccgaaggcacctcccaggacaccggcaattccggatctgtcgaacaccctttcgaaaccaagaaactgaacggaaaggcgctgtcctctcgagccgaggagcctccctcccccccagtgcctaaagctagcggttcaacattaaatagcggtagtggaaattgtccccgaacccagtctgacgatagtgaagaaagatcactcgaaactatctgcgctaaccacaataacggtcgtctgcacccaagaccaccccatccacataacaacgggcagaacctgggcgaactcgaggtagtggcttacagctctccaggacatagtgacaccgaccgtgataattcgtcactcactgggaccctgctccataaggattgttgcggaagcgagatggcctgtgaaacccccaatgctggtacacgggaggatccaactgatacgcctgccactgactcatctagagccgtacacggacattctgggctaaagaggcagcggattgagctggaagacactgacagtgaaaattcatctagtgaaaagaaactgaagacttag

SEQ ID NO: 184700 - DNA, 2583 bp, Artificial Sequence
  Description of Artificial Sequence: Synthetic coding sequence
atggagcaggccatccacagccgggtgaagcccatccagctgaagggcgagcaccattcaaatatcttctgtctcgccttcaattccggcaacacaaaggtgttcagcggggggaatgacgagcaggtcattctccacgacgttgaatctagtgagacactcgacgtgtttgcacatgaggacgctgtgtacggcctctctgtttctccagtgaatgataacatattcgccagtagttcagatgacggtagagtgctgatttgggatattagagaatccccccacggggaacctttttgtctggcaaactacccttctgccttccacagtgtgatgtttaatcctgtggagccaagactactggcaaccgcaaattcgaaggaaggtgtcggactgtgggacatcagaaaaccgcagtcttccctcctgcggtacggagggaacctttcactgcagtctgctatgtccgtgcgtttcaacagcaatggcacccagctgctggccctccgaagaagactaccgcccgtgttatacgatatacacagccgcctgcccgtgtttcagttcgataatcagggttattttaacagttgtactatgaaatcttgctgctttgcaggtgacagggaccagtacatcttgtctggtagcgatgactttaacctgtacatgtggcgcatccccgccgaccctgaagctggtggtattggtagggtcgtgaacggagcattcatggtcttaaaggggcataggagtattgttaaccaggtccggtttaatccacacacgtacatgatttgcagcagtggggttgaaaagattatcaaaatttggagcccttataaacaacccggctgtacgggagacctggatggacgcatagaagatgattcgcgttgtctatatactcacgaggaatacattagtctagtgctcaacagcggctcgggactgagccacgactatgcgaaccagagcgtccaggaggaccctaggatgatggcattttttgattctctggtgcggagagagatcgagggttggtcctctgactcggatagcgatctgtccgagagcactattctgcagctccatgccggggtttcggaaagatcagggtatacggatagtgagtccagcgccagtcttccgagaagccctccccccactgtggatgagagcgccgacaacgctttccacctgggacctctgcgagtaaccaccaccaacacagttgcatctacgccccccacccctacatgcgaagatgctgcaagccgccagcagcgactgtccgccctgaggcgctatcaggataagagattgctcgccctaagcaatgagtctgacagcgaggagaacgtctgtgaagtcgagctcgacacggatctttttccgcggccacggtctccgtcccccgaagacgaatcctccagttctagctcctccagttctagtgaggacgaagaggagttgaatgaacggagggcgtccacatggcagagaaacgccatgcgacgtaggcaaaaaaccactagagaagataagccgtctgcaccgataaagcctacaaacacttatattggggaggacaactacgattaccctcagatcaaggttgacgacctgtcttcaagtccgacatctagtcctgaaaggagcacatcaacccttgagatccagccatcacgggccagtcccacgagtgatattgaatccgttgagcggaaaatctataaagcctacaaatggttgcgatacagttacatctcttattctaacaacaaggacggggagacctctctggtgacaggggaggcagacgagggtcgagcgggcacttcccataaagacaatcccgcaccttcctcctctaaggaggcgtgtctgaatatagccatggcccaaaggaatcaggacctgccacccgaaggatgtagtaaagacacctttaaggaggaaaccccaagaacccccagcaacggtcctgggcacgagcattcctcccacgcctgggccgaggtccccgagggaaccagtcaagacactggcaactccgggagcgtggaacacccatttgagaccaagaagctgaacggcaaggccctgtcctcacgagccgaagaacccccctcaccacccgtgccaaaggcctctggaagtaccctaaacagcggaagtggcaactgtccccggacccaaagcgatgattccgaagagcggagcttagagacaatttgtgccaatcataacaacggcagactgcaccctagacccccacacccacacaataatggacagaatcttggagaactggaggttgttgcctatagtagtcccgggcattcggacaccgatcgagacaacagtagtctcactgggaccctcttgcataaagattgctgtggcagcgagatggcctgcgagacacccaatgctggaaccagagaagacccaacggacacaccagccaccgactcctcccgggctgtgcacggccactcaggactgaaacggcagcgcatcgagctcgaggacacagactcggaaaactcctccagcgagaagaaactgaagacctag

SEQ ID NO: 184701 - DNA, 633 bp, Artificial Sequence
  Description of Artificial Sequence: Synthetic coding sequence
atggagcaggccatccacagccgggtgaagcccatccagctgaagggagaacatcatagtaatattttctgtctggccttcaactcaggaaacaccaaagtcttctctggaggtaacgacgagcaagtcattctacacgatgtggaatctgaaacacttgacgtattcgcacatgaggacgcagtgtacgggctgagcgtttcccctgttaatgataacattttcgcctctagttcagacgacggacgagtcttgatctgggacattagagaatcacctcatggcgaacccttttgtttggccaattaccccagcgcgttccacagcgtcatgttcaatcccgtggaaccaagacttctcgccaccgccaattcgaaagagggtgtggggctgtgggatattaggaagccgcagagttctctgctcagatatggcggcaacctgagcctgcaaagtgcaatgtcagtgaggtttaacagtaatggaacgcagctcttggccctgaggagacgtttacctccagtcctctatgatattcatagcaggttaccagtgttccagtttgacaatcaggggtacttcaatagctgtaccatgaaaagctgttgctttgcaggggaccgggaccagtag

SEQ ID NO: 184702 - DNA, 2583 bp, Artificial Sequence
  Description of Artificial Sequence: Synthetic coding sequence
atggagcaggccatccacagccgggtgaagcccatccagctgaagggggagcaccactccaacatattctgcctggccttcaattccggcaataccaaggtgttttctggcggcaatgatgagcaggtgatactgcacgatgtagaaagctccgagacactggatgtattcgcccatgaggatgccgtgtacggactgtctgtatccccagtcaacgataacatcttcgcatctagcagcgatgacgggagggtgctgatctgggatatcagagagtcaccccatggagagcccttttgcttagcaaactacccatctgctttccattctgtaatgtttaaccctgtcgaacctcgattactggcgacagcgaatagcaaggaaggagtgggactctgggacatcagaaaacctcagtcgagtctactgagatacggaggcaacctctctctgcagtccgctatgtcagtacgctttaattcaaatggcacacaactcctcgcgctgaggagacgtcttccaccagtgctttacgacatccactctcgattacccgtgttccagtttgacaaccaagggtacttcaattcatgtactatgaagtcatgctgctttgcaggagatcgtgatcaatatatcctttcggggtctgatgacttcaatctgtatatgtggcgaatacctgccgatcctgaggccggcggaatcgggcgtgtcgtgaatggagcctttatggttctcaagggacaccggtccattgtgaaccaggttcgctttaacccacacacttacatgatttgcagcagcggagttgagaaaattatcaaaatttggtctccttataagcagccaggctgcactggagatctggacggtagaatagaggacgatagccggtgcctttatacacacgaggaatatattagtttagtgctaaacagcggatccggcctgtcacacgactacgccaaccagtctgtccaggaagaccccagaatgatggcattcttcgactcactggttagacgagaaatcgaaggctggtctagcgactccgatagtgatttgtcagagagcacaatactgcagctgcacgccggggtgtctgagcgttccggctacacagatagcgaaagttcagcctccctgccgaggagccctcctcccacggtggacgaatctgccgacaatgcatttcaccttggccccctgagagtgacgaccactaatacagtggcaagcacaccccctactcccacttgcgaggatgctgcctcacggcagcagcgtttaagtgcgttgcggcgctaccaagacaaacgattgcttgcgctcagtaatgaatccgactctgaggagaacgtgtgcgaggtggaacttgatacggacctcttccctaggccgagatccccgagtccggaggacgagtcctcgtcatcttcatcgtcatcatctagcgaagatgaggaggaactcaatgagcgtcgggcctcgacttggcagcgcaatgctatgaggaggcggcagaaaacaacgagggaagataagccctctgcccctatcaaacctacaaacacctatatcggggaagacaactatgactaccctcaaataaaggtggatgatctgtcatcaagcccaacaagtagtcccgaaagaagtacttcaaccctggaaatccagccatctagggcaagtccaacctcagacattgagtcagtcgagagaaagatctacaaggcgtataagtggctacgctatagttatataagctattccaacaacaaagatggagagacttccttggtaacgggagaagccgacgaggggcgcgctggcacctctcacaaagacaatccagcaccatcctccagcaaagaagcctgcctgaacatcgcgatggcacagaggaaccaggaccttcctccagagggctgttctaaagatacttttaaagaggaaactccgaggacacccagcaatggccctgggcacgaacattctagccatgcatgggccgaagttccagaaggaacctctcaggatacggggaattcagggagtgtggagcacccttttgagactaagaagttgaatggcaaagctctgagctctcgcgctgaagaacctccttcacctcccgtgcccaaggcatccggtagcacactgaacagcggtagtgggaattgtcctcgcacacagtcagatgactccgaggaacgcagcctcgagacaatttgcgctaaccacaacaacgggcggttgcatccacggcctcctcaccctcataataatggccaaaatctgggcgagctcgaggtcgtggcctactcctcacccggtcactctgacaccgaccgggataattcaagcctgacagggacattattgcacaaggactgctgcggaagcgagatggcgtgtgagacccctaacgctggtacaagagaagacccaaccgatacaccagcaacagactcctctcgcgcggtgcacggacacagcgggctaaaaaggcaaagaattgagctggaggataccgactcagagaattccagttcagaaaagaagctgaagacctag

SEQ ID NO: 184703 - DNA, 357 bp, Artificial Sequence
  Description of Artificial Sequence: Synthetic coding sequence
atgcccttcctggagctggacaccaacctgcccgccaaccgggtgcctgccggcttggagaaaagactctgcgccgcggcagctagtatcctcggaaagcctgcggatagagtcaacgtgactgttagacccggacttgccatggcactctcaggttcgaccgaaccatgtgctcaactcagcatctcttctattggtgtggtcggcaccgccgaggacaaccgctcccattctgcgcattttttcgaatttctgaccaaggagctggctctgggacaggaccgaattctgatcaggttcttccctctcgagtcctggcagattggaaagatcggtacggtcatgacctttctttag

SEQ ID NO: 184704 - DNA, 357 bp, Artificial Sequence
  Description of Artificial Sequence: Synthetic coding sequence
atgcccttcctggagctggacaccaacctgcccgccaaccgggtgccagcggggttggaaaaaagattatgtgccgccgccgcatcaatcctgggtaagcctgctgaccgggtaaatgtgactgtgcgacctggactagcaatggcactgtcaggatctaccgaaccttgtgcacagctctctatatctagtataggcgtcgtcggcacagccgaagataacaggtcccactcagcccacttctttgagtttttaaccaaggagctcgcccttggacaggatcgcatcctaatcagattctttccccttgaaagttggcagattggtaaaatcggaacggtgatgacctttttgtag

SEQ ID NO: 184705 - DNA, 399 bp, Artificial Sequence
  Description of Artificial Sequence: Synthetic coding sequence
atgcagctgttcctgctggccgtgagcgtgcccctgcccgccatgcccttcttagaactggatacgaacttgcctgcaaaccgagttcctgccggactggagaagagactgtgcgccgctgccgcctcaatcctcggtaaaccagccgatagagttaatgtcactgtgcgccctggacttgccatggccctgagcggctcgacggagccttgcgcacagctgtccataagcagtatcggcgttgtcggaacagccgaagacaatcgatcgcactccgcccatttctttgagtttctcacaaaagagttggccctaggccaggataggattctgatccgctttttccccctagagtcctggcagattgggaagatcggcacagtcatgacctttctgtag

SEQ ID NO: 184706 - DNA, 348 bp, Artificial Sequence
  Description of Artificial Sequence: Synthetic coding sequence
atgcccatgttcatcgtgaacaccaacgtgccccgggccagcgtgcccgatgggttcctgagcgagctcacacagcagctcgcccaagccacaggcaaaccgccgcaatacattgcggtccacgtcgtgccagaccagctgatggcattcggcggcagtagcgagccttgcgctctgtgcagcttacattctatcggaaaaatagggggagctcagaaccggtcttactccaaattgctgtgtgggcttttagccgaaaggctccgcattagtccagaccgcgtttacattaattattacgacatgaatgctgcaaatgtcggatggaacaattctacctttgcctag

SEQ ID NO: 184707 - DNA, 1224 bp, Artificial Sequence
  Description of Artificial Sequence: Synthetic coding sequence
atgaacaacagcggcgccgacgagatcggcaagctgttcgtgggcggactggactggagcactacccaagagaccctgcgttcctacttcagccagtatggggaagtagtcgactgcgtaatcatgaaagataagacaacaaatcagtctaggggcttcggtttcgtaaagtttaaggatcctaactgcgtcggaacagtactagcctcccggccccatacgctggatgggcggaacatcgatcctaagccttgtacaccgcggggaatgcagcccgaacgaactcgtcccaaggaggggtggcagaaaggacccagatccgacaactccaaatccaacaagatcttcgtggggggaatcccgcacaactgtggggagaccgaactgcgtgagtacttcaagaagttcggcgtagtgactgaagtcgtgatgatctatgacgccgaaaaacagaggccaaggggatttgggttcattacgttcgaggatgagcagtctgtggatcaagctgtaaacatgcatttccatgacatcatggggaagaaagtggaagtgaaaagagccgagccccgcgacagcaagtcccaggccccaggccagccaggggcttcacagtggggatcccgggtggtccccaatgcagccaatgggtgggccggacagcctcctcccacgtggcaacagggctacgggccacaggggatgtgggtgccagcagggcaggctatagggggctacggccctccccccgctggtcgcggcgctccaccgccacccccacccttcacctcctacatcgtgtccacccctcctggcgggtttcctcctcctcaagggtttccccaggggtacggagcacctccccaattctcttttggctacggaccccctccgcccccccctgaccagttcgctcctcctggagtcccacctcctcccgcaacaccaggtgctgctccgttggctttcccacctcctcccagtcaggcagcgcccgatatgtccaagcccccaactgctcagccggactttccatatggacagtacgccggatacggacaggacttgtcaggctttggccagggattttccgacccttcccagcaaccaccgagctacggcgggccgtccgttcccggctctgggggcccacctgctggtggaagcggattcggccggggccagaaccacaacgttcaggggttccacccctataggcgttag

SEQ ID NO: 184708 - DNA, 2223 bp, Artificial Sequence
  Description of Artificial Sequence: Synthetic coding sequence
atggccgccttcagcgagatgggcgtgatgcccgagatcgcccaggcagtggaggagatggactggcttcttcccacagatatacaggctgagtctataccactcattctgggcgggggagatgtgctgatggccgccgagaccggcagcggtaaaaccggagctttttcgatacctgtgatccaaatcgtatacgaaactctcaaggatcagcaagaagggaaaaaggggaagaccactatcaaaacaggcgcctctgtcctcaacaagtggcagatgaatccttatgacagagggagcgcatttgctatcggtagcgacgggctgtgctgccagagccgagaagtcaaggaatggcacggctgtagagccaccaagggtctcatgaagggtaagcattattatgaagttagttgtcatgaccagggtttatgcagggtcggctggagtacaatgcaggcttcattggatctggggactgacaaatttgggtttggttttgggggaaccggcaagaagagccacaataagcaattcgataattacggcgaagaatttacaatgcacgacaccatcgggtgctacttagacatcgacaaaggccacgtgaaattctctaaaaacgggaaggatctggggctggcttttgaaattccgccccatatgaagaatcaagcactgtttcccgcttgcgtgttgaaaaatgccgagcttaagttcaactttggggaggaggagttcaaattcccacctaaggacggattcgtggccctctccaaggcccccgatggctacatagttaagtcacaacacagtgggaacgcccaggtgacacagaccaagtttttgcctaacgctcctaaggcgctcattgtggagccctctagggagctagccgagcagacactcaataatattaagcagttcaagaagtatatcgacaatcctaagctccgcgagctgctgataatcggcggcgtcgccgcccgggatcaacttagcgttctcgagaatggagtggacatagtcgtagggacgcctggacggctggacgacttggtgtcaacagggaaattgaatctctctcaagtgcgcttcttggtccttgacgaagccgacggtctgctcagccagggctattctgactttatcaacagaatgcacaatcagatccctcaggtgacctcggatggaaaaagattacaggtaatagtgtgttccgccactctccattccttcgatgtaaaaaaactcagcgaaaaaattatgcattttcctacttgggtggacttaaaaggggaggactcagttcctgatacagtacaccatgtcgtcgttcctgtgaatcctaagaccgaccgtctgtgggaaaggctcggtaaaagtcacattcgcaccgatgacgtgcatgcaaaggacaatacacgtccaggagccaatagcccagagatgtggagtgaagcgattaaaatacttaagggagagtacgccgtgagagctatcaaagagcataagatggaccaggctatcatcttctgtcgtactaagatcgactgtgataacttagaacagtattttatccagcaagggggcggcccggataagaagggccaccaattctcctgcgtgtgcttgcatggtgacagaaagccccatgaacggaagcagaacctggaacgtttcaagaaaggagatgttaggtttctcatctgcacagacgtcgctgcccggggaatcgacatacacggggttccgtacgttattaacgtgaccctgccagacgagaaacagaactatgtgcacaggatcggccgagtgggccgcgcagaacgaatgggcctggccatatctctcgttgcaacagagaaggagaaagtctggtaccacgtgtgctcttcacgtggcaaagggtgttataatacccgtctaaaagaggacggcggatgtactatctggtacaacgaaatgcagcttttgtcagagatcgaagagcatttaaactgtaccattagtcaggtagagcccgatataaaggtccctgtggacgagttcgatggcaaagtcacgtacggacagaagagagcagccggtgggggcagctataagggtcacgtcgacatcctggctccaacggttcaggagctggccgccctggagaaggaagctcagacctcctttttgcaccttgggtatctcccaaatcagctgtttagaaccttttag

SEQ ID NO: 184709 - DNA, 51 bp, Artificial Sequence
  Description of Artificial Sequence: Synthetic coding sequence
atggccgccttcagcgagatgggcgtgatgcccgagatcgcccaggcatag

SEQ ID NO: 184710 - DNA, 1869 bp, Artificial Sequence
  Description of Artificial Sequence: Synthetic coding sequence
atggccgccttcagcgagatgggcgtgatgcccgagatcgcccaggcagtagaggagatggattggctcctgccaacagatatccaagctgagtctatcccattaattttggggggtggagacgtcctcatggccgcagaaactgggtctggcaagaccggcgccttctccattcccgttatccagatcgtttatgaaacccttaaagaccagcaggagggtaagaagggtaagacaaccatcaagacaggagccagcgttctgaataaatggcaaatgaacccatatgatcgcgaggtcaaggaatggcatgggtgcagagccacaaaaggactgatgaagggtaagcattactatgaagtgagttgccatgaccagggcctgtgccgagtcggctggtccactatgcaggcttccctggatctgggtactgacaaattcggctttggctttgggggcacgggcaagaaaagtcacaataaacagttcgacaactacggcgaggaatttaccatgcacgacactatcggatgctacctggatattgataagggccacgttaaattcagtaaaaacggaaaagatctgggtctggccttcgagatccctccacacatgaagaaccaggcactgtttcccgcctgcgtccttaaaaacgcggaactaaagttcaacttcggggaggaagagttcaagttcccacccaaggacggcttcgtggccctctccaaagctccagatgggtacatcgttaaaagccagcattcagggaatgcacaggtgacccagacgaaatttctacccaacgcgcctaaggctctgatagtggagccatcccgcgaacttgcagaacagacactcaataacattaagcagtttaaaaaatacattgacaaccccaagctcagagaactgctcattattggcggcgtggctgcccgtgaccagctcagtgtgcttgagaatggcgttgatattgtagttggcacccctggacgactggacgaccttgtgtcgaccggaaagctgaaccttagccaggttaggttcctggtgcttgatgaggctgatgggctgctgagtcaggggtactccgactttataaaccgaatgcataatcaaatcccacaggtgacttccgacggtaagcggctgcaggtcattgtgtgcagcgctaccctacacagctttgacgtgaaaaaattgagcgagaaaattatgcacttcccaacttgggtggacctaaagggggaggattccgtgcccgatacggtacaccatgtggtcgtcccagtgaatcctaagaccgatcgtctatgggaacgccttggaaagtcccatatccgtactgacgacgttcatgctaaagataatactcgacctggagcaaattctccagagatgtggtccgaggccatcaaaatcttaaaaggcgagtacgcggtcagagccattaaggagcataaaatggatcaggccatcattttttgcaggacaaaaatcgattgcgacaacctggagcagtattttatccagcaaggaggaggtcctgacaagaagggacatcagttcagctgcgtctgtcttcacggcgacagaaagccccacgagcggaaacagaacctcgagcggttcaagaaaggcgatgtgcgcttccttatatgcaccgatgtggctgctcgcggaatcgacatccacggtgtgccctatgttattaatgtgacattacccgatgagaaacagaattacgtgcataggattggcagagtcgggagagccgaacgtatggggctagcaatttcacttgtggctacggaaaaggagaaagtgtggtatcatatggtacagagggacgcagtgactatttag

SEQ ID NO: 184711 - DNA, 2628 bp, Artificial Sequence
  Description of Artificial Sequence: Synthetic coding sequence
atgggcaagaccgccaacagccccggcagcggcgcccggcccgacccggtgcggagctttaacaggtggaagaaaaagcattcacaccggcagaacaaaaagaagcagcttagaaagcagctgaaaaaacccgaatggcaggtagaacgcgagagcattagtagactaatgcagaactacgagaagatcaatgtgaacgagataactaggtttagtgattttcccttaagtaagaaaacgctgaagggtctacaagaggcacagtataggcttgtcacagagatccagaagcagaccattgggctcgcactgcagggcaaagacgtccttggggctgctaagaccggctccggcaagacgctcgcttttctggttcccgtgcttgaagccctgtatcgtctgcagtggacaagtacagacggtcttggcgttctgattatatctcctacacgagagctagcgtatcagactttcgaagtcctgcgaaaagttggtaagaaccacgattttagcgctggtcttattataggcgggaaagatctgaaacatgaggcggaacggattaacaatataaatatcctagtgtgcacccccgggagactcctccagcacatggacgagacagtgtcattccatgccactgatctgcagatgctagtgctcgatgaagctgatcgcattcttgacatgggctttgccgacacaatgaatgctgtgattgagaaccttccaaaaaaacgacagacactactgttttcggcaacacagactaagagcgttaaagacctggcccgactctctctcaaaaatcccgagtacgtgtgggttcacgagaaggcgaaatacagtaccccagcaacacttgagcagaactacattgtatgtgagctgcagcagaaaatatcagtgctctactccttcctcaggtcacacctaaaaaaaaaatccatcgtttttttctcttcatgtaaagaggtgcagtacctctaccgcgtattttgtagactgcgtcccggcgtgagtatcttagcgctccacggccggcagcagcaaatgcggaggatggaggtttacaatgagttcgtccgcaagagagcagcggtgctctttgccacggatatcgcagcccgggggctggatttccctgcagtgaattgggtcttgcagttcgactgccccgaggacgccaatacttacatccatagggctggtaggaccgcaagatataaagaggacggtgaggcccttctaattctcctgccatcagagaaggctatggtgcagcagctgctgcagaagaaggtgccggtgaaagagatcaaaattaaccccgagaagcttatcgacgtgcaaaagaaacttgagtctatacttgctcaagatcaggaccttaaggaaagagcacagcggtgctttgtgtcctatgtccgaagcgtttacttgatgaaggacaaagaagtctttgacgtatctaagttgccaattcccgaatatgctctatccctcggcttggctgttgcaccacgcgtcagatttctacaaaaaatgcagaagcaaccaacgaaagaactcgtccggtctcaggccgataaggtgattgagccaagagccccaagtctgacgaacgacgaagtcgaagaatttcgagcttatttcaacgagaagatgagtatactccaaaaggggggaaagagactggagggcacagagcataggcaggacaatgacactggaaacgaggaacaggaagaggaggaggatgatgaagaagaaatggaagaaaaactagctaaagccaaggggtcccaggccccgagcctgcctaacacctccgaagcccagaagatcaaagaggtcccaacacagttccttgaccgagatgaggaggaggaagatgccgacttcctcaaggtgaagaggcacaacgtgttcggtctagacctgaaggacgagaagacgctgcagaaaaaggagcctagtaaatcgtccattaagaaaaaaatgactaaggtcgctgaagcgaagaaagttatgaaaaggaacttcaaggtgaataaaaaaattacctttacggacgaaggggagctcgtgcaacagtggccccagatgcagaaaagcgcgataaaagatgctgaagaagatgacgataccggggggattaacctccataaagcgaaagagcgattgcaggaggaagataagtttgataaggaggagtaccgcaaaaagattaaagccaaacaccgggaaaaacgacttaaggaacgtgaagcgaggcgcgaagctaataagaggcaggccaaggccaaggacgaggaggaagccttcttagactggtctgatgacgatgacgacgacgatgatggttttgacccatccactttgccagaccctgataagtatcgctcaagtgaagacagcgactcagaagatatggagaataaaatctctgacacaaagaagaaacaaggtatgaaaaaacgaagcaattctgaagtagaagatgtgggtcccacaagccacaaccggaagaaagccagatgggacactcttgagccgctggataccggcctctctctcgcagaagacgaggagcttgtgctccacctgctcaggtcccaatcttag

SEQ ID NO: 184712 - DNA, 2346 bp, Artificial Sequence
  Description of Artificial Sequence: Synthetic coding sequence
atgggcaagaccgccaacagccccggcagcggcgcccggcccgacccagtgcggtccttcaatcgatggaagaaaaaacacagtcacagacaaaataaaaagaagcagcttcgaaaacagctgaaaaagcctgaatggcaagtcgagagggaatctatttcaagattaatgcagaactatgaaaaaattaacgttaacgagatcaccaggttcagtgatttccctctttcaaaaaagaccctgaaagggctgcaagaggcccagtatcgcctggtgaccgagatccaaaaacagacaatcggtctcgctctccagggcaaggatgtgctgggggctgccaagaccggcagtggcaaaacactggcctttctcgtgcctgttaatgaggcagatcgtattctggacatggggttcgctgacaccatgaatgcagtgattgagaatctaccgaagaagcgacagaccctcctcttttccgcgacccagaccaagagcgtgaaggatcttgctagactttcgctgaagaaccctgagtacgtctgggtacatgaaaaggccaaatattctactccagcaaccctcgagcagaattatatcgtttgtgagctccagcaaaaaatttccgtattgtatagcttccttcggtcccacctcaagaaaaagtctattgtgttcttctcttcctgtaaagaagtccagtacctgtaccgcgtgttttgccgactaaggcccggcgtctcgatccttgctctccacggccgacagcagcagatgcggcgaatggaggtgtataacgagtttgttcgcaagagggctgctgtactgttcgccactgacattgctgcacggggactggacttcccggcagtgaattgggtactccagttcgactgtcccgaagacgccaatacttacatccatcgagccggaaggaccgcccgctataaggaggatggggaagcattgctgattctgctgcccagtgaaaaggcaatggttcagcaattacttcaaaagaaggttccggtaaaggagatcaagatcaaccccgaaaagcttattgacgtgcagaagaaactagagtccatcttagcccaagatcaagatctgaaggaaagggcccaaagatgctttgtgtcttacgttagaagtgtctacttaatgaaggacaaggaagttttcgatgtttctaaactgcccatacccgagtatgccctgtctctgggcttggcagtggccccccgagttcggtttcttcaaaagatgcagaagcagccgacaaaggaactggtccggtcccaagctgataaggtcattgagccacgagccccctcactgacgaacgatgaggtggaggagtttagagcgtacttcaatgagaagatgagcatacttcaaaaaggcggaaagaggctggagggcaccgagcaccgtcaggataatgacactggcaacgaggaacaagaagaggaggaagatgacgaggaggagatggaggagaagcttgccaaagccaagggttctcaagctcctagcttgcccaatacaagtgaggcacagaagatcaaagaggtccccacccagttcctggaccgggacgaggaggaagaggatgcagatttccttaaggtgaagagacataatgtctttggactagatctgaaagatgaaaaaacgctgcaaaaaaaggagcccagtaagtcttctattaagaagaaaatgactaaggtagcggaagcaaagaaagtcatgaaacgaaactttaaggtaaacaaaaagatcaccttcaccgacgagggcgaacttgtccagcagtggccacaaatgcaaaaatctgcaattaaagacgccgaggaggacgatgacacagggggaatcaacttacacaaggcgaaggagagactgcaggaagaagataagttcgataaagaagagtaccgcaagaagattaaagccaagcaccgcgagaagcgtttgaaggagagagaagcacgccgagaagccaataagcggcaggccaaagcgaaggatgaagaggaggcattcctggactggtcagacgacgacgatgacgacgacgacggttttgacccaagcaccctgccagatccggacaaataccgttctagcgaagacagcgactctgaagatatggaaaataagatttcggacactaaaaagaaacagggaatgaagaaacgatccaattcagaggtggaggacgttggccctacaagccacaatagaaagaaggccaggtgggatacactggaaccactagatacaggcctgtcacttgcggaggatgaagagctggtgttacatctgctcagatcgcaatcgtag

SEQ ID NO: 184713 - DNA, 1959 bp, Artificial Sequence
  Description of Artificial Sequence: Synthetic coding sequence
atgcggggcggcggcttcggcgaccgggaccgggaccgggaccggggcggcttcggcgcccgcgggggcggaggccttcccccgaagaaattcgggaatccaggagagcggctgcgtaaaaaaaagtgggacctgagcgaactccccaagtttgagaagaatttttacgtagagcaccccgaggtggcacgtttgactccttacgaagtcgatgagctgaggagaaagaaggagattacagtcagaggaggtgatgtgtgccccaaacctgttttcgcttttcatcacgctaacttcccgcagtatgtaatggacgttctgatggaccagcattttactgagccaaccccgattcagtgccaggggttcccgctagccctcagtggaagggatatggtggggatcgcgcaaactggttcagggaaaacactcgcctatctgctgcctgccattgttcatatcaaccatcagccatatctggagaggggagacggccccatttgtcttgttttggccccgacgcgggaactggcacagcaagtgcagcaggtggccgatgactatgggaaatgcagccgccttaagagtacgtgtatttatggaggggccccgaagggcccccaaatccgcgatctcgaaagaggtgtagagatctgtatcgccacacccggccggctaatcgactttctagaaagtggaaagaccaatctgagaagatgtacgtatctagtcctggatgaggcagatagaatgttagacatgggctttgagcctcagatccggaaaatcgtagatcagattagacctgaccgacagaccctcatgtggagcgcgacttggcccaaggaggtgcgacagctcgctgaggactttctcagagactatacccagattaatgttggaaacctggaactgtcagccaatcacaatatcctgcagatcgtagacgtttgcatggaaagcgagaaagaccataaactgattcagttgatggaagaaattatggccgaaaaggaaaacaagaccatcatattcgtcgaaactaagaggcgatgcgatgacctgaccagacgcatgcgacgtgacggttggcctgcaatgtgtatccacggcgataaatcccagccagagcgggactgggtgctgaatgaattccgttcaggcaaggcaccgattcttatcgccaccgacgtggcctcaagaggtctggggttcgatgtagaggacgtcaagttcgtcataaattacgactaccctaacagcagtgaggactacgtccatcggattggacggacagcccgctccacaaataaaggaacggcctacactttttttacgcccggcaacctaaagcaagccagagagttgattaaggtgttagaggaggctaaccaagccataaacccaaaacttatgcaacttgttgaccatcgcggcggtggtggcggcggaggggggcgttctagatataggacgacatctagcgcaaacaaccccaatcttatgtatcaggacgagtgtgatcgcaggctgaggggggtgaaagatggcgggcgacgcgatagtgcctcttatcgggatcgttctgagactgacagggccggatatgctaacggcagcggatatggcagtccaaattctgctttcggcgcccaggccggccagtacacttacgggcaggggacttacggagccgcggcatatggcacgtcctcttataccgcccaagagtacggcgcaggaacttatggggcctcctctacaacttcaaccgggagaagttcacaatcatcgtcccagcaattcagtgggatcgggagaagtggacagcagccccaacccttaatgtcacagcagtttgcacagcctcccggggccaccaatatgatagggtatatgggacagaccgcctaccagtaccctccaccgccccccccacccccgccaagccggaaatag

SEQ ID NO: 184714 - DNA, 2196 bp, Artificial Sequence
  Description of Artificial Sequence: Synthetic coding sequence
ctgcccaccggcttcgtggcccccatcctgtgcgtgctgctgcccagtccaacccgggaagccgccacagtggctagcgctaccggagatagtgctagcgaaagggagtcagcggctcctgcggcggcacccaccgcagaagcacctcctcctagtgttgttacccgcccggaacctcaagccttaccatctccggctattagagcccctttaccagatctgtacccctttggaacaatgcgtgggggcggctttggcgacagagatagagatcgggatagaggcggattcggcgcaaggggaggcggagggctgccacctaaaaaatttggcaatcctggcgagagactgcggaagaaaaaatgggacttgagcgagctgccaaagtttgagaagaacttttacgtggaacatcctgaagtggccagactcacaccatatgaggtggatgaactgcggaggaaaaaagaaattactgtgagaggcggagacgtttgccctaagcctgtcttcgcttttcaccatgcaaatttcccacagtacgtgatggacgtcctaatggatcagcactttacggaaccaaccccaatccagtgtcagggatttcctctggcactctccggacgcgacatggttggcatcgctcagactgggtctggcaagaccctcgcttacctgttaccagcaatcgtgcacatcaatcaccagccttacctcgagagaggggacggcccaatttgtttggtcttggcacctacacgtgaattagcacagcaagtgcagcaagttgcagacgactatgggaaatgcagcagactcaaaagcacatgcatctacggcggcgcacctaagggtccccaaattagagatctggagaggggcgtggaaatctgcattgccaccccaggtcggttgatagactttctcgaatctggtaaaaccaatcttcgcagatgtacctatttggttcttgatgaggcagatagaatgctcgacatgggatttgagccccagattagaaaaatcgtggaccagattaggcctgatcgccaaacactcatgtggtccgccacctggcctaaggaggtgcgtcagctggcggaggatttccttagggattatacgcagattaacgtggggaatttagaactgagcgctaatcataacatcttgcagattgtggatgtgtgtatggaatcagaaaaggatcacaagctgattcaactcatggaggagattatggcggagaaggaaaataaaactatcatcttcgtggagacaaaaagaaggtgcgatgacctgactaggagaatgcgacgggatgggtggccagctatgtgcatccatggcgataaaagtcagcccgagagagactgggttctgaatgaatttaggagcggaaaggctcctatcttaatagctaccgatgtggcaagccgtggcctggatgttgaagacgtgaagttcgttattaattatgactacccaaattcttccgaggactacgtgcatagaataggccggacagcgagaagcacgaataaagggaccgcctatacattcttcactcctggaaatctgaagcaggccagggaactgattaaagtcctggaggaggctaatcaagcaatcaaccccaaactcatgcaattggttgatcaccgagggggaggaggaggaggtgggaagggaggacgctccaggtatcgaacaacttcctctgcaaacaatccaaacctgatgtatcaagacgagtgcgatcgaagactgcgtggtgtcaaggacggtggacgccgtgattcggcctcgtaccgtgaccgttccgaaacggacagggccggatatgccaatggaagtggctatggctctccaaacagcgcattcggggctcaggcaggacaatacacttatgggcagggaacttacggcgccgccgcgtatgggacctctagttatactgcccaggaatatggagccggcacatatggcgcgagttccacgactagtaccggaagatcctcacaatcatcatcacagcagttttcgggtatcggcaggtcgggccaacaacctcaacctttaatgtcccagcagttcgcccagccgccgggtgcgaccaacatgataggctacatgggccagacagcctatcaatacccccctccccctccacctccgcccccgtccagaaagtag

SEQ ID NO: 184715 - DNA, 2190 bp, Artificial Sequence
  Description of Artificial Sequence: Synthetic coding sequence
ctgcccaccggcttcgtggcccccatcctgtgcgtgctgctgcccagtccgacccgggaagccgccaccgtggcttccgccaccggcgattctgcatcagaaagggaatcagcggccccggcagccgcccccaccgctgaggcaccccctccctcagtcgtgactcgccccgaaccgcaggcactcccatctcccgctatccgagcacctcttcctgacctatacccctttgggaccatgagggggggaggcttcggtgatcgggatcgcgatcgtgatagaggcggtttcggagccagaggcggtggaggacttccgcccaagaaatttggcaatccgggggagagactgcgaaaaaagaaatgggaccttagtgaactccccaagttcgaaaagaatttctatgtcgagcaccctgaagtggcccgtctcactccttacgaggtggatgaacttagaagaaaaaaagaaatcactgttcggggaggcgacgtctgtcccaaaccggtgtttgcatttcaccacgcaaattttccacagtacgtgatggacgtgctgatggaccagcatttcacagagccaacccccatccaatgccagggcttccccctagctctctctggccgcgatatggtgggcattgcgcagaccggcagcggtaagacactggcctacctccttcctgcaattgtccacattaaccaccagccttacttggagagaggcgatggtccaatctgccttgtactggcccctaccagagagttggctcagcaggtgcagcaggtggccgatgattatggcaagtgctctcgactgaaaagcacctgtatttacggtggggcccctaaagggccccagatcagggatctcgagagaggagtggagatttgtattgcaacccctggtcgcctcatagatttcctggagagtggcaagactaacctccgcagatgcacatacctggtgctcgacgaagccgatcgaatgcttgatatggggttcgagccgcagatcagaaagatcgtggatcagattcggcccgaccgtcaaactctgatgtggagcgcaacatggcctaaggaggtcaggcagttggctgaagatttcctcagggactatacacagatcaatgtgggtaacctggagttaagcgcaaatcataacatccttcagattgtggacgtatgcatggagtcagagaaagaccacaaactcatccagctcatggaggagattatggccgagaaagaaaacaagaccatcatctttgtggaaaccaaacggagatgcgatgatcttactcggcgtatgcgcagagacggctggcccgctatgtgtattcatggggacaaatcccaacctgagcgcgactgggtgcttaatgaattccgcagtggtaaggcccccatcctgatcgccaccgatgtcgctagtcggggtcttgacgtggaagacgtaaaatttgttattaactacgattatcctaatagcagcgaagactacgttcaccgcatcggtaggactgctagatccacaaacaagggcacagcttatacttttttcacacccgggaacctgaagcaggctcgcgagttaattaaggtcctggaagaagccaaccaggcaatcaacccaaaactgatgcagttggtcgatcaccggggtgggggaggaggtggaggagggcggtcccgctaccgaacaacaagctccgcaaacaaccctaaccttatgtaccaggatgagtgtgatcgaagactgcggggcgtaaaagacgggggccgcagagatagcgcaagctatcgcgacaggtctgagaccgacagagcaggctatgccaacggctctggctacgggtctccaaattctgcctttggggctcaagccggtcagtatacctacggccagggaacctatggcgccgccgcgtatggaacgagcagctataccgcccaagagtatggggctgggacatatggagcctcttcgaccacttctactgggagaagttcacagagcagttcccaacagttcagcggcatcggtcgttctggacagcagccgcagcctctcatgtcccagcaatttgcacagcctcccggagctaccaatatgatcgggtatatggggcaaactgcgtaccaatatccccctcctccgcccccacctccgccgtctagaaaatag

SEQ ID NO: 184716 - DNA, 2214 bp, Artificial Sequence
  Description of Artificial Sequence: Synthetic coding sequence
cccaacctgcccaccggcttcgtggcccccatcctgtgcgtgctgctgccttcacccactcgggaagcagccaccgtcgcttctgcaactggcgactctgcttcagaacgggaatcggcagcaccagcagctgccccgaccgccgaagctccacctccaagcgttgtgacaagaccggaaccccaggcactgccatcccccgcaatacgcgcccctctgcctgatctctatccgttcgggacaatgcgggggggaggatttggagatagagatcgcgaccgggaccgcggcggttttggagctagaggagggggaggcctaccaccaaaaaaatttgggaacccgggcgagcgcctcagaaaaaaaaagtgggatctgtcagagcttccaaagttcgagaagaatttctacgtcgagcacccggaggtagcccggctcacaccatatgaagtggacgaactgcggcgcaagaaggaaattaccgtaaggggcggtgacgtatgtcctaaaccagttttcgcctttcatcatgctaattttcctcagtacgtaatggacgtgctgatggaccaacacttcacagagcccacacctatacaatgccaagggtttcccctggccctgagcggccgggatatggtcggaattgcccagacagggagcggcaagacgttggcttaccttttgccagcgatcgtgcatatcaatcatcagccttatctcgaacggggagacggcccaatatgtctggttctggctcccacccgggaactggcacaacaggttcaacaggtcgcggatgactatggaaaatgttctcggctcaaatctacctgcatctacggaggtgcacctaaaggaccccagatcagagacctggagcgaggggtcgaaatctgcatcgccacccctgggcggctgattgacttccttgagtcgggcaagacaaatctgcgaagatgtacgtatctggtcctggatgaagcagatagaatgctcgacatggggttcgagcctcagatacggaagattgttgatcagatacggccagaccgccaaactctgatgtggagcgccacgtggcccaaagaagtgcgtcagctcgccgaagacttccttagggactatacccaaatcaatgtgggtaatctggagttgagtgcaaaccacaatatcctccagatagtggacgtttgcatggagtcagaaaaagaccacaagttaattcagctcatggaggaaattatggccgagaaagagaacaagaccattatttttgtagagacaaaaaggcgctgcgacgacctcacgcgacggatgagacgagacgggtggcctgcgatgtgcatccacggagataagagccagccagagcgggactgggtgctgaatgaatttaggtctggtaaagctcccatcctcatcgctaccgacgttgcatcccggggattggacgtcgaagacgtcaaattcgtcatcaactatgattacccgaactcaagcgaggactacgtgcatcggatcggtaggacggcccgcagcacaaacaaggggaccgcctatacgtttttcacaccaggtaacctgaaacaggctcgggagctgattaaggttctagaagaagccaatcaagcaatcaacccaaagctcatgcaactagttgaccacaggggtggaggaggtggtggtggcaagggcggccgctcgaggtacaggactacgtcaagtgctaacaaccccaacttgatgtatcaagacgagtgcgatcgtaggcttaggggagtgaaagacggtgggagacgtgattccgcgtcctatcgggacaggtctgagaccgaccgcgcaggctacgccaacggctctggttacgggagcccaaactccgcctttggtgcacaggccggccagtatacttacggccaggggacctatggtgccgcagcctacgggacatcttcttatactgcccaggagtacggggctggaacttatggagcttcttccacaacaagcactggacgtagttcacagagctcatcccagcaattttcagggattggccgatcggggcagcagccacagcccctgatgtcacagcaatttgctcagccacccggtgctacaaacactttgttgcttctccccctgttactgctccatgttaatgagactacacaggtcgtggtcaccccggccgatctgatcactttttag

SEQ ID NO: 184717 - DNA, 546 bp, Artificial Sequence
  Description of Artificial Sequence: Synthetic coding sequence
atgcagctggtggaccaccggggcggcggcggcggcggcggcggccgaagcagatacagaacaaccagttccgcaaacaaccccaacctgatgtaccaagacgagtgtgatcggcgcctgcgaggcgtgaaagatgggggcagacgtgatagcgccagctatagggatagatctgaaactgatcgtgctggatatgctaatggatccggctacgggtcccctaatagcgccttcggggcgcaagccggccagtacacatatggacaaggtacttacggggctgccgcatacgggacgtcgtcttatacagcacaggaatacggtgcaggcacctatggagcctcctccaccacctctactggtcgctcatcgcagagcagttctcagcagttcagtgggataggaagatctggacagcagcctcagccactgatgtcccagcagttcgcccagccaccgggcgccaccaacatgatcggttatatgggacaaacggcttatcagtatccgcccccccccccccccccacctccaagtaggaagtag

SEQ ID NO: 184718 - DNA, 2013 bp, Artificial Sequence
  Description of Artificial Sequence: Synthetic coding sequence
atgagccacctgcccatgaagctgctgcggaagaagatcgagaagcggaatctgaagctgaggcagaggaacttgaaatttcagggcgcatctaacctgaccctcagcgagacccagaacggggacgtcagtgaagagaccatgggaagccgcaaagtgaaaaagtctaagcagaagcccatgaacgtgggcttaagcgaaacacagaatgggggcatgtcacaggaggcggtgggaaatataaaggtaacaaagtccccacagaaatctacagtccttaccaacggcgaggctgcgatgcagtccagtaacagtgagagcaagaagaaaaagaagaagaaaagaaaaatggtgaatgacgccgagcccgacacaaaaaaggcaaagacagagaacaaaggaaaaagcgaggaagagtcggccgagactaccaaggaaaccgagaacaacgtggaaaaaccagacaatgacgaagatgagtccgaggttccttcactgccactcggacttaccggcgcttttgaggacacaagtttcgcatcgctgtgtaatctcgtgaacgagaacaccctaaaggccattaaggagatgggtttcaccaacatgactgagatccagcacaaaagtatccgccccctcctcgaagggcgggatctgctggcagccgctaaaactggtagtggcaagaccctggcatttctgatccctgcggtggagctcatcgttaagttaagattcatgcctaggaatggcacaggcgtccttattttgtcccccaccagggagttggctatgcaaacctttggcgtcctcaaggaactcatgactcaccacgttcacacctacggtctgatcatgggcgggtctaatcgcagtgcagaagcacagaaattgggaaacggcatcaacatcatcgtcgcgaccccgggacgtctgttggaccatatgcagaacactcctggctttatgtacaaaaacctgcaatgcctggtcatcgatgaggccgataggatactggatgtgggattcgaagaggagttgaagcagataatcaaactgttaccaacaaggaggcagacgatgctgttttccgctactcagactcgaaaagtggaagatctcgcaagaatatctcttaaaaaggagccattatacgttggcgtcgatgacgataaggcaaatgctacagtcgatggtctggagcaaggctatgtggtttgcccctctgagaagagattcttactccttttcactttcttgaagaaaaatagaaaaaagaagcttatggtgttcttcagctcttgcatgtccgtgaagtaccactacgagctcctaaactacattgacttacctgttctggccatccacggaaagcagaagcagaacaagcggaccaccaccttctttcagttttgcaatgcagactccggcaccctcctttgcactgatgtggcagctcgtgggttggacatcccagaggtggattggatcgttcagtatgaccctccagatgatccgaaggagtacatacaccgcgtgggaagaaccgctcggggactgaacggcagaggtcatgcgttgctgatccttcgccccgaagagctcggcttcctcaggtacctgaagcagtcaaaagtcccacttagcgagtttgacttctcctggagtaagatttcagacatccaatcacagttagagaagctgatcgagaaaaattacttcctgcacaagagtgcacaggaggcctacaagagctatataagggcttatgactcacacagtttaaagcaaatttttaatgtgaataaccttaatctgccgcaagtcgctctctcctttgggttcaaggtgccacccttcgttgatctgaacgtgaacagtaacgaggggaagcagaagaaacgaggtggcggaggcgggtttgggtaccagaaaaccaagaaagtggagaagtctaagatctttaagcacattagcaagaaaagctctgatagccggcagttcagccactag

SEQ ID NO: 184719 - DNA, 1230 bp, Artificial Sequence
  Description of Artificial Sequence: Synthetic coding sequence
atggagcaggagcagaccttcggcgtgctgaaggagctgatgacccaccatgtgcatacgtatgggctgataatgggaggcagtaacagatcagccgaggcgcagaaactggggaatggtataaacatcatcgtggccactcctggtagattgctggatcatatgcagaatactccagggttcatgtataagaaccttcagtgccttgtgattgatgaagctgaccgtatcttggatgtgggttttgaagaggaactgaaacagataattaaacttctgcccaccaggcgacagaccatgctgttctctgccacccaaactaggaaggtggaagacctggctaggattagtctaaagaaggagcctctgtacgtcggtgtcgacgacgataaagctaacgcaacagttgacgggctcgagcagggatacgttgtatgcccatctgaaaaaagatttctgctgctgttcactttcttgaagaagaacaggaaaaagaagctaatggtctttttcagttcttgtatgagtgttaaataccactatgagctgctgaactatatcgacctgcctgtgctggctatccatggcaagcagaagcagaacaaacggactacaacctttttccagttttgcaacgccgattcgggaacccttctatgcactgacgtggccgcacggggactggacatccccgaagtcgattggatcgtccaatacgatccaccagatgatcctaaggagtacattcaccgggttggaagaaccgcaaggggcctgaatggtagaggccacgcactcctgattctccgccctgaggaactgggctttctgcgctatctcaagcagagcaaagtgccgctatcagagttcgatttttcctggtccaaaatcagcgacatccagtcacaattggagaaattaatcgaaaagaattacttcctccacaaaagcgctcaggaagcttacaaatcctacatcagagcgtacgactctcattctttaaaacagatattcaacgtgaacaacttgaacctgccccaggtcgctctctcttttggattcaaggttccaccattcgtggatctcaacgttaattctaacgagggcaaacagaaaaagcgcggcggaggcggtggttttggatatcaaaagactaaaaaggttgagaaaagcaaaatcttcaagcacatttccaaaaagtccagcgactcccgacaattttcccattag

SEQ ID NO: 184720 - DNA, 2475 bp, Artificial Sequence
  Description of Artificial Sequence: Synthetic coding sequence
atggccgccgccttcgaggccagcggcgccctggccgccgtggccaccgcaatgcctgccgaacacgtggccgtgcaagtgcctgcccctgagccaactcctggcccagtccgtattctgagaaccgcccaggacctctcaagtccccgcactagaacaggtgacgtacttctggccgagccagctgactttgagtccttgctgttgtcccgaccagtgctcgaaggtctacgcgcagctggattcgagagaccctctccggtgcagcttaaagcaatacctttaggacgctgcggcctggacctgattgtccaggcaaaatctgggacaggtaagacatgtgtatttagcaccatagccctcgattcacttgtcctagagaatctctctacgcagattcttattctggccccgactcgggagattgccgttcagatacacagcgtcattactgctatagggataaaaatggaagggctggaatgccatgtgttcattggcggaacacccctctcccaagacaagactaggctgaagaagtgccacattgctgttggtagcccaggcaggattaaacagctaattgagctggactacctcaaccccgggagtatcagacttttcattttggacgaggccgataagctgttagaagagggaagttttcaagagcagattaattggatctactcatcacttccagcatcgaagcagatgctggcggtgagcgctacatacccagaattcctggcaaacgccctgaccaaatatatgcgcgacccaactttcgtccggctcaactcatccgacccaagtctcatcggcctgaaacaatattacaaggtagttaactcgtaccccctggcacacaaagtattcgaggaaaagactcaacatctccaggagctgttctccaggattcccttcaaccaggcgcttgtttttagtaaccttcattcaagggcacagcacctagctgatatcttatctagtaaaggctttcctgccgagtgtattagcggcaatatgaaccagaatcaacgtctggatgccatggctaagctcaaacacttccactgtcgggttctgataagtacagatcttacgtcacgaggcatagacgctgagaaagttaatctcgtggtgaacctggatgttcctctggactgggagacttatatgcacaggataggacgggctgggcgctttggcacactaggattaaccgttacgtattgctgccggggggaggaggagaacatgatgatgcgcattgcccagaagtgcaatattaatctgctcccccttcccgatccgatcccaagcgggctgatggaagagtgtgtggattgggatgttgaggtgaaagcggccgtgcacacgtacggcattgcctctgtgccaaatcagcctctgaaaaagcaaatacagaagatcgaacgaacgctccagattcagaaggcccacggtgaccacatggccagcagccgcaacaattctgtgagcggcttgtccgtcaaatccaagaataatactaagcagaagttacctgttaagagtcatagtgagtgtgggattattgagaaggctacgagtccaaaagagctcggatgcgacaggcagagcgaagaacagatgaagaactctgtgcagacaccggtggagaactctaccaactcccagcaccaggtgaaagaggcactgcctgtctccctgcctcaaatcccctgtctgtcttcgtttaagatccatcagccctacactctgacatttgctgaactcgttgaagactatgaacattatattaaggaaggcctggaaaaaccagtcgaaataatccgtcactacacagggcccggggatcaaaccgtgaatccacagaatgggttcgtgcgaaacaaagtgatcgaacagagggtgccagttctcgccagttcatctcagtcaggagacagtgagtccgacagcgactcttacagcagcagaacctcaagccagtccaagggcaacaaaagttaccttgaaggtagctctgataaccagcttaaagacagcgaatccacacctgttgatgacaggattagtctggagcagccacctaacggcagcgacacacctaacccagagaagtatcaggaatcgccaggcatccagatgaagacaaggctgaaagagggggccagccagcgagcaaagcagagtagaagaaacctaccaagaagatcatcgtttaggctccagacagaggcgcaggaggatgactggtacgattgccaccgagagatacgcctgtccttttccgacacttaccaggactacgaggagtattggcgcgcctactaccgggcttggcaagagtactacgctgccgcttcccatagctactactggaatgctcaaagacatccaagctggatggctgcataccacatgaataccatatacctccaagaaatgatgcacagcaatcaatag

SEQ ID NO: 184721 - DNA, 417 bp, Artificial Sequence
  Description of Artificial Sequence: Synthetic coding sequence
atggccgccgccttcgaggccagcggcgccctggccgccgtggccacagctatgcccgccgaacacgtggctgttcaagttcccgcaccggaacctacacctggccctgtccgcatcctacgcactgcacaggacttaagttcaccacgtaccaggacaggcgatgtcctcctcgcggagcctgccgacttcgagtccctgctgttgagcagacctgtgctggagggcctgagggcagccgggtttgaaagaccttcaccagtgcagctgaaggccattccactcggccggtgtgggttggacttgatcgttcaggctaagtccggcaccggaaagacctgtgtattctccacaattgcgttggactcattggtgctggagaacttaagtacccaggcagagctaagcaattcctag

SEQ ID NO: 184722 - DNA, 2352 bp, Artificial Sequence
  Description of Artificial Sequence: Synthetic coding sequence
atgcccggcaagctgcggagcgacgccggcctggagagcgacaccgctatgaaaaagggagaaacactgcgcaagcagaccgaagagaaagaaaaaaaggagaaacctaaatcagacaagacagaggagatcgccgaagaagaggagacagtcttccccaaggccaagcaggttaagaaaaaagccgaaccctccgaagtggacatgaatagcccaaagagtaagaaggcaaagaagaaagaggaaccatcccagaacgatatttccccaaaaaccaaatcactgcgcaaaaaaaaggagccgatcgagaaaaaagtggtgtcttctaaaactaagaaagttaccaagaacgaggagccctctgaagaggaaattgatgctcctaagcctaagaagatgaaaaaggaaaaggaaatgaacggcgaaacccgagagaaaagcccaaaactgaaaaacggattcccacaccccgagcctgactgcaatccctcagaagccgccagtgaagagtcaaactctgaaatcgagcaagaaatccctgtggaacagaaggagggagcatttagtaactttcccatatcagaagagactattaagctgctgaaggggaggggcgtgacatttctgttccccattcaggccaagacatttcaccatgtctacagcgggaaggatctcattgctcaggctaggacaggtaccgggaaaaccttcagtttcgctatccctctgatcgagaagctgcacggtgagctccaagaccgaaaaagggggcgggctccgcaggtgctggtgctggcgccgactcgggagttagccaatcaggtttcaaaggatttcagtgacattacaaaaaagctgtccgtagcctgcttttatggagggacaccctatggggggcaattcgagcggatgcggaacggaatagacattctggtcgggaccccaggcagaattaaggatcacatccagaatggtaaactggatctcactaagcttaaacacgtggtgctggacgaggtggaccagatgctagatatgggattcgcagatcaagtggaagagatcctgagcgttgcctacaaaaaggactcagaagacaatcctcaaactctactgttttctgctacctgcccacattgggtgtttaacgtggcaaagaaatatatgaagagcacttacgaacaggtcgacctaatcgggaagaaaacccagaagaccgctattactgtagaacatctcgccatcaagtgtcattggacacagagagcagcagttatcggcgacgtgatcagggtctattctgggcaccagggacgaacaattattttctgtgaaacaaaaaaggaagctcaggagctgagccaaaactccgccattaaacaggatgcacagtccctccatggtgacatcccacagaaacagagagaaattacactgaaaggatttaggaatggatctttcggcgtgttggtggccactaacgtagcagctaggggtttggacatcccagaagtggaccttgtgatccaaagctcaccccctaaggacgtagagagctacatacatcgcagcgggaggaccggtagggctggccgcacgggcgtctgcatttgtttttaccagcacaaagaggagtaccaactggtgcaggtcgagcagaaagcagggattaagtttaagcggatcggtgtgccttccgcaactgagatcattaaggcgtcatctaaggatgctatccgactgctagattcagtgcccccaacagctatttcccattttaaacagagcgcagaaaagctcattgaagagaagggggctgtggaagccttagccgccgctttagcccacatctctggtgctacaagcgtcgaccagagatccctgataaatagcaacgtaggcttcgtgaccatgatcctgcaatgcagcatcgaaatgccaaatatctcatatgcgtggaaagaactcaaggaacagctcggcgaagagattgactccaaagtcaaaggcatggtgtttcttaaaggaaaattaggcgtgtgtttcgacgttcctacggcatccgtcactgagattcaggagaagtggcatgatagtcgccgatggcagctcagtgtcgccactgaacagcccgagctggagggccctcgagaaggctacggcggtttcagagggcagcgcgagggtagcagagggtttagaggccagcgggatggaaaccgaaggttccgcggccagagagaaggctccagagggccacggggccaacgatccggaggagggaacaagagtaaccgctctcagaataaaggacagaaacgaagcttcagtaaggcattcggccagtag

SEQ ID NO: 184723 - DNA, 249 bp, Artificial Sequence
  Description of Artificial Sequence: Synthetic coding sequence
atgcccggcaagctgcggagcgacgccggcctggagagcgacaccgcgatgaagaaaggggaaacgctgagaaagcagaccgaggagaaggagaaaaaagaaaagccaaaatcagacaaaacagaggaaattgcagaagaggaggagaccgtgtttcccaaagccaagcaagtgaagaaaaaagcagagccctccgaagttgacatgaacagtcccaagtcaaagaaaaaaaagaagaagaagaaatag

SEQ ID NO: 184724 - DNA, 2463 bp, Artificial Sequence
  Description of Artificial Sequence: Synthetic coding sequence
atggccggcgagctggccgacaagaaggaccgggacgccagcccctctaaagaagagagaaaacgctcgagaacccccgaccgcgagcgtgatcgggatcgggatcggaagtctagtccatctaaagatcggaagagacacagatcgagagaccgccggcgggggggatctcgatctcggagtagatcaaggtctaaaagcgccgagcgcgagcgtagacataaggagcgggagagggacaaggagagagacagaaataagaaggatcgtgaccgcgataaagacgggcatcggagggacaaggaccgcaaaaggtcgagcctatccccaggaaggggcaaggactttaaatcccgaaaggatagggactccaagaaggatgaggaggacgagcacggggacaaaaaaccgaaagcacagcctctctctctggaggaactgctggcaaaaaaaaaagctgaggaagaagctgaagcaaaaccaaagttcctctccaaggcggagagagaagccgaggctctaaaaaggagacaacaggaggtggaggaaagacagaggatgctcgaagaggaacggaagaagcgcaagcaattccaggatctgggccgcaaaatgctggaggacccgcaggaaagagaaaggcgggagagacgtgagcgtatggaacgggagactaacggaaatgaggacgaagaaggcagacaaaagattagagaggagaaggacaagtccaaggagttacacgccatcaaggagcggtatctggggggaattaaaaaacgccggaggacccgccatcttaatgatcgaaaatttgtgtttgaatgggacgcatctgaggatacctccattgactacaacccattgtacaaggagcggcatcaggtgcaattattggggagggggtttatcgccggaatcgacctgaagcagcagaaacgggaacagagccgcttctacggcgacctgatggaaaagcggaggactttggaagagaaggagcaggaagaagccagactgagaaagctaagaaaaaaggaggcaaagcagaggtgggacgaccgacactggagtcaaaagaagctggatgaaatgaccgacagagactggcggatattccgagaagactattcgatcaccacaaaaggcggcaaaatcccgaatccaatacgttcgtggaaagactcctctctgccccctcatattctggaggtcatcgataaatgtgggtacaaagagcctactccaattcagaggcaggcaattccaatcgggctgcagaaccgcgacattattggcgtagcggagaccgggtccggaaagaccgctgcattcctgatcccattgctggtgtggatcaccactctgcccaagatagatcggatagaagagagcgatcagggtccctacgcaatcatactcgcccccactcgtgaactggctcagcaaattgaggaggagactatcaagtttgggaagccactgggaatcaggaccgttgcagtgattggggggatcagccgagaggaccagggcttccggctcaggatgggctgcgagatcgttatcgcgacaccggggcgtctgattgatgtgctggaaaacaggtatctcgttctctcaaggtgcacatacgtcgtgttggacgaggcggacaggatgattgacatggggtttgagcctgacgttcagaaaattttggaacacatgcccgtgtcaaatcagaagcctgacaccgatgaggcggaggacccagagaaaatgctggcaaactttgagtctggaaagcataagtacaggcagacagtgatgttcacggccaccatgccgcctgctgttgaaagattggccagatcatacctccgacgcccggccgtcgtgtatataggctctgctggaaaaccacatgagagagtggagcagaaagtcttcctaatgagtgagagcgagaaaaggaaaaagcttctggcgatactggagcagggctttgatcctcccatcattatctttgttaatcagaagaaggggtgcgacgtgttagcgaagtccctcgagaaaatgggctacaacgcttgcaccttgcatgggggaaagggtcaggagcaacgagaattcgcactctccaacctcaaggcaggcgctaaagatatcctcgtcgcgaccgatgtggcgggcaggggcatagatatacaagatgtgagtatggtggtgaactacgacatggccaaaaacatcgaagactatattcatcgcattgggagaacaggaagggccggcaagagcggtgtagccattaccttcctcaccaaagaggacagcgcagttttctacgagttgaagcaggcaatcctggagtcacccgtcagtagctgcccacctgaactcgccaaccatcccgacgcccagcacaagcctggcacaatcctgacaaagaaacggagggaggagacaattttcgcctag

SEQ ID NO: 184725 - DNA, 417 bp, Artificial Sequence
  Description of Artificial Sequence: Synthetic coding sequence
atggccggcgagctggccgacaagaaggaccgggacgccagcccctctaaggaagagaggaaacggagtaggacccccgatagagaaagggatagagatcgggataggaaatccagtccctccaaggatcggaaacgccaccggtcgcgggacagaagacgcggaggctctcgctctaggtcaagaagtcggtccaagtcagccgagcgtgagcggcgacataaagagagagagagggacaaagaaagggaccggaacaagaaggatcgggaccgggacaaggacgggcacagaagggataaggatagaaaaaggagttcactctcacccggtcggggcaaagatttcaaatcaagaaaagatagggactccaagaaggatgaggaggatgaacacggagacaagaaacctaaatag

SEQ ID NO: 184726 - DNA, 549 bp, Artificial Sequence
  Description of Artificial Sequence: Synthetic coding sequence
atggccggcgagctggccgacaagaaggaccgggacgccagccccagcaaagaggagagaaagcggagcaggaccccagacagggaacgagatagggatcgggatcggaagtcgtccccttccaaggatcgtaagcgccacagatctagagaccgccggcggggggggagcagatcccgctcaagatcgcgctccaaatcagccgagcgagagaggcggcacaaagaacgggagagggacaaggaacgcgacagaaataaaaaggacagagatcgagataaggatggacacaggcgggataaggaccggaaaaggtccagcctgtcccccgggaggggtaaagatttcaagagtcgcaaggacagagacagcaaaaaggatgaggaggacgaacatggagataaaaagcctaaggcccagcccctatccctggaggaactactggccaagaagaaagcagaagaggaggcggaagctaaaccaaagttcctatctaaggccgaaagagaggccgaagcgttgaagagaaggcaacaggaggtggagtag

SEQ ID NO: 184727 - DNA, 2580 bp, Artificial Sequence
  Description of Artificial Sequence: Synthetic coding sequence
atgaagctgaaggacaccaagagccggcccaagcagagcagctgcggaaaattccagacaaaagggattaaagtggtggggaagtggaaggaggtaaaaatcgatccaaacatgtttgccgatggtcagatggacgatctggtgtgtttcgaagagctgaccgactatcaactggtcagtcccgccaagaatccctcatctctgttttccaaggaagccccaaagaggaaggcacaagcggtaagcgaggaagaagaagaggaggaaggaaaatcctcctcccctaaaaaaaagatcaaactcaaaaaaagcaagaatgtggctaccgagggcacctccacccagaaagagtttgaagtgaaggatcctgagctggaagcgcagggcgacgacatggtctgtgacgaccccgaagccggagagatgacatcggaaaatctggtccagacagcgccgaagaaaaagaaaaataaggggaagaaagggttggagccatctcaatccacagctgcaaaagtaccaaagaaggcaaaaacatggatccccgaggtgcacgaccagaaggccgacgtctcggcgtggaaagatctttttgtgcctaggcctgttctaagagcactatctttcctgggattttctgctcctactccgatccaagctctgacgttagccccggccatcagggataaactcgatatcctgggtgcagccgagaccggatccgggaagactctcgcattcgcaatcccaatgatccacgctgtccttcagtggcagaagaggaacgcggctcccccaccctccaataccgaggctcccccaggagagacacggacagaggcgggggccgaaacccggtcccctggcaaagccgaggctgagtctgatgccctgccggacgataccgtaattgagagcgaggcgctgccaagcgatatcgcagctgaagctagagccaagaccggcggtaccgtatctgaccaggccttgctgttcggagatgacgatgccggcgagggcccatcttcgctgattcgcgagaaacctgtaccgaaacagaatgaaaacgaagaagaaaatctagataaagaacagaccggaaacctgaaacaggaactcgatgataagtcagccacttgcaaagcttatcccaagcggccactactgggactggtgctgacccccactagggagctggcggtgcaggttaagcagcacatcgatgccgtggcccggttcacaggaataaaaacggctatcctggtgggtgggatgtctacgcagaagcagcaaagaatgctgaaccggcgtccagaaatcgtagtggcaactccagggcgcctgtgggagctgatcaaggaaaagcactaccatctccgcaatttacgccagttgcgctgtcttgtcgtggacgaggctgatcggatggtggaaaaaggccactttgctgagctgtctcagctgttagagatgttaaacgacagtcagtataaccccaaaagacaaacacttgtctttagcgctacactgacattggtccaccaagcccccgcacggattctgcacaaaaaacacactaagaaaatggataagacggccaagctcgacctcttgatgcagaagatagggatgagaggaaagcctaaagtgattgatctgacccgtaatgaagccacagtagagacacttacggaaacgaagattcattgcgagaccgatgagaaggacttttacctgtattatttcctgatgcagtaccccggaaggtctctggtgttcgcaaactctatttcctgtatcaagcgtctgagcggcctgctgaaggtgctggatatcatgccactcaccctccacgcctgtatgcaccagaaacagagacttaggaacttggaacagttcgcaaggctggaggattgcgtactgctggccactgatgtggctgcacgcggcctcgacattcccaaggtacaacatgttattcattaccaggtaccgagaacttcagagatttatgtccaccgctccggccggacagctagagccacaaacgagggcctgtcattgatgttgatcggcccagaagatgtcatcaatttcaagaaaatttataagacactgaaaaaagacgaagatataccattgttcccagtgcagactaagtacatggacgtggttaaggaaaggatccggttagcaagacagattgaaaaaagcgagtatagaaactttcaggcctgcttgcacaactcctggattgagcaggcagctgccgccctggaaatcgaactggaggaggatatgtataaaggggggaaggccgaccagcaagaggagcgccggaggcaaaagcagatgaaggtgctcaaaaaggaactgcggcatctactgagccagcccttattcacagagtctcagaagacaaagtatcctacacagtcagggaagcctccactcctggtgagtgccccaagcaagtcagaaagcgccctgtcgtgcctgagcaaacagaagaagaagaaaacaaaaaagccgaaggagccccagcccgaacaaccccagccctctacatccgccaactag

SEQ ID NO: 184728 - DNA, 2415 bp, Artificial Sequence
  Description of Artificial Sequence: Synthetic coding sequence
atgaagctgaaggacaccaagagccggcccaagcagagcagctgcggcaagtttcagaccaagggcatcaaagttgtgggcaaatggaaagaggtcaaaatcgaccctaatatgttcgctgatggacagatggacgacctggtttgcttcgaagaactcactgactaccagctcgtgtcccctgctaaaaatccatccagcctgtttagcaaagaggcccccaagcggaaggctcaggcggtgtctgaggaagaagaggaggaggagggcaagtcctcatcacccaagaagaagattaagcttaagaagtctaagaatgtcgcaacagaaggcacctcaactcaaaaagaattcgaggtgaaagatccagagctcgaggctcagggcgatgatatggtctgcgatgaccctgaggctggggagatgaccagtgaaaaccttgtgcaaactgccccgaaaaaaaaaaaaaacaaagggaagaagggactggagcctagccagtctactgcagcgatccgagacaaattggacatcctaggcgcggcggaaaccgggtccgggaaaactctggccttcgccatcccgatgatacacgcagtcctgcagtggcagaaaagaaacgctgccccccccccatctaataccgaagcgccgccgggcgagacccgcaccgaggccggggcggagactcgcagccccgggaaggcagaagccgagagcgacgccctccccgacgacaccgtaatcgaaagtgaagcgctgccctcagatatcgcggccgaggcaagggctaaaaccggaggtaccgtgagtgatcaagccctcttgttcggcgacgacgatgctggagaaggtccctcaagccttatccgcgaaaagcctgtccccaagcagaatgaaaatgaggaggagaacctggataaagagcaaactggaaatttaaagcaagagttggatgataagtcagctacgtgtaaagcatacccaaagaggccactcctcggtcttgtcctgacaccgaccagggaactggccgtgcaagtgaagcagcatatcgacgctgtggctagatttacgggcatcaagacagctattctggtcggcggaatgtctacccaaaaacagcagcgaatgctgaatcgccggcccgagatcgttgttgcaacacccggccgcctctgggagctgatcaaggagaaacactatcatctgaggaatctaaggcagctgaggtgtctggtggtcgacgaagccgacagaatggtcgaaaaggggcatttcgctgagctgtcacaactcttggagatgctgaatgactctcaatacaaccctaagcgccagaccctggttttttccgcgaccctcactctggtccatcaagcccccgccagaatacttcacaaaaagcacaccaagaaaatggataaaaccgcaaagttagacttgctcatgcagaagatcgggatgcgtgggaaaccgaaagtcattgaccttactcgaaacgaggccaccgtggaaactttaaccgaaacgaagattcattgcgagactgatgaaaaagacttctatctctactacttcctcatgcagtaccctggccgatcacttgtttttgccaactcaatcagctgtatcaagcgtctgagcgggctccttaaggtgttagacataatgccattgacactgcacgcctgtatgcatcagaagcagaggctccggaacctggagcagttcgctcgtctggaggactgcgtccttcttgctaccgatgtggccgctcgcgggctcgacatcccgaaggtgcagcacgtcattcactatcaagtccctcggacatccgagatctatgtacaccgatcgggccgaactgcgcgagctactaacgaggggctgtcccttatgctcatcggacccgaggacgtaatcaatttcaaaaagatttataagaccctgaaaaaggatgaagacatccccctcttcccagtgcaaaccaaatatatggatgtggtaaaggaacggatccggctcgcgaggcagatcgagaaatctgagtacaggaacttccaggcttgcctccataacagctggattgagcaggcagcagctgccctcgaaatcgaactggaggaggatatgtataaagggggaaaggctgatcagcaagaagagaggcggcggcagaaacaaatgaaagtgctgaaaaaagagctgaggcacttgctgagccagcctctgttcactgagtcacagaagaccaaataccctacgcaaagtggcaaaccccctctacttgtgtcggcaccgtcaaagtccgaaagcgcactgagttgcctctcaaagcagaaaaagaagaagaccaagaagccaaaggaaccccagcctgagcagccccagcccagtactagcgccaattag

SEQ ID NO: 184729 - DNA, 2292 bp, Artificial Sequence
  Description of Artificial Sequence: Synthetic coding sequence
atggacgacctggtgtgcttcgaggagctgaccgactaccagctggtgtccccggccaagaacccttcctctctcttcagtaaggaggcacccaaaaggaaagcgcaagctgtttctgaggaagaggaagaggaggaaggaaaaagctctagccccaagaagaagattaagttaaagaagagtaaaaacgtcgccacagaaggcacaagcacacaaaaggagtttgaggtgaaagatcctgagcttgaagcacagggcgacgatatggtttgcgacgatcctgaggcgggcgaaatgacatccgagaatctggtgcagaccgcccccaagaaaaagaagaataaaggcaagaagggattggaacccagccagagtaccgccgccaaggtgcctaagaaggctaagacatggatacctgaggtacacgaccagaaagcagacgtgtccgcatggaaggacctgtttgtgccacgcccggtgctacgcgcactatcctttttggggttctcagctcccacccccatacaagcccttaccctcgcccccgctatcagagataaactagacattctgggagccgcagagaccggttccggtaaaacattggcgtttgctatacccatgatccacgccgtccttcagtggcagaaacgtaacgctgctccccctccctctaacaccgaagcccctccaggggagactcgcacagaggccggcgccgaaacccgcagtcccggcaaagcggaggccgagagcgatgcactgcccgacgacacggtgattgaatctgaggcactgccgagtgacatagccgccgaagcaagagctaagactggtgggactgtgtccgatcaggccctgctatttggggacgatgatgcgggtgagggacccagcagcctgattagagagaagcctgtgccgaaacagaacgaaaacgaggaggaaaatctggataaggagcagactggtaatttaaagcaggagctggacgacaaaagtgctacctgcaaagcttaccccaagaggcccttgctggggctggtcctgaccccaacgcgcgagctggcggtacaggtaaaacagcatattgacgcagtggccagatttactgggatcaagacagctattttggtcggtggcatgagcacccaaaaacagcagcggatgctgaataggcggcctgagatcgtagtagctactccagggcgtctttgggaactcattaaagagaaacactaccatctgcgcaacctccgccagctgcgctgtctcgtggtcgacgaggcagaccgcatggttgagaagggacatttcgccgagctgtcccagctgctggaaatgctgaacgattctcagtacaacccaaaacgacagactctcgtgttcagtgccactctgaccctggttcaccaggctcccgccagaattctgcacaaaaaacacacaaagaagatggacaaaacggctaaactggatttgctgatgcagaaaatcggcatgcgagggaaacccaaagtaattgatctgacccggaacgaggcaaccgtggaaaccctcaccgagacgaaaatacactgcgaaactgatgagaaggacttctacctatattacttcctgatgcagtacccgggccgctcgctcgtgttcgctaactcgatttcctgtatcaagcggctgtccggtctgctgaaggtcctcgacataatgcccttaacgttacacgcctgcatgcatcagaagcaacgactacgtaacctggagcagtttgccagacttgaggattgtgtgcttttggccacagatgtcgcagcgcgagggctggatattcctaaagtccaacacgtcatccattaccaagtcccaaggactagtgaaatctacgtccaccgatcaggtagaaccgcacgggccaccaatgagggtctcagcctcatgctgatagggcccgaagacgttatcaacttcaaaaagatttataagactctgaagaaagatgaggatattcccctttttccagttcagacgaagtacatggacgttgtcaaggaaagaattaggcttgccaggcaaatagagaaatctgagtatcgaaactttcaggcttgcctgcacaactcttggatcgaacaagcagcagcagctttggaaatagagctggaagaggacatgtataaagggggtaaggctgaccaacaggaggagaggaggcgacagaaacagatgaaggtgctaaagaaggaattgagacacctattaagccagccccagccatcaacctcagccaactag

SEQ ID NO: 184730 - DNA, 1458 bp, Artificial Sequence
  Description of Artificial Sequence: Synthetic coding sequence
atgaccaaggccccctgcaaggcctaccccaagcggcccctgctgggcctagtcctcacgcctacccgcgaactggccgtccaggtgaaacagcatatcgatgctgtcgctaggttcacaggcataaagacagcaatcctagtgggtgggatgagcactcagaaacagcagaggatgcttaataggcgtcctgagattgtggtcgcaactcccggccgactgtgggaactcatcaaggagaagcattaccatctacggaatcttagacagttgcgatgtttagtggtggacgaagccgaccgcatggtcgagaagggccattttgctgaattgagccaactgctcgagatgctgaacgattcccagtacaatccgaaacgccaaacccttgtgtttagtgccacccttactctggttcaccaggccccagcccggatactgcataagaagcacactaaaaagatggacaagacagctaaactcgacctcctcatgcagaaaatcggtatgcgcggaaagcctaaggtgatcgatctgacacgcaatgaagcaaccgtggaaactctgaccgagactaagattcattgtgagacagatgagaaagatttttacctgtactatttcttgatgcagtatcccggaagatcactggtctttgcgaatagcatttcttgcatcaagcgcctgagcggactgctaaaggtcctggacatcatgccattgacattgcacgcctgcatgcatcagaaacagcggctgagaaatctagagcagtttgcacggctggaggactgtgtcctgttggccacggatgtggccgctaggggtctggatatccctaaggtgcagcatgtgatccactaccaggtgcctagaaccagcgagatctacgtacatagatcagggagaaccgcacgcgctactaacgagggattaagtctcatgctcatcggtccggaagacgtcatcaattttaagaagatctacaagactctgaaaaaagatgaggacatcccgctgttcccggtccaaacaaagtatatggatgtcgtgaaggaaaggatacgtctggcccgccagatcgagaagagcgagtacagaaatttccaggcctgcctgcataatagttggatcgagcaggccgctgcggcccttgaaattgagctagaggaggatatgtacaaaggtggtaaggctgaccaacaggaggagcggcgccggcagaaacagatgaaggtactgaaaaaggagctccgtcatttgctctcccagccattgtttaccgaatctcagaagacaaaataccctacgcaaagcggaaaacctcccctgctcgtgtccgccccttccaagtccgagtccgcactaagttgcctctcaaagcagaagaaaaaaaaaaccaaaaagccaaaggagccacaacccgagcaacctcagccatcaacgagtgctaattag

SEQ ID NO: 184731 - DNA, 1623 bp, Artificial Sequence
  Description of Artificial Sequence: Synthetic coding sequence
atggccctgacccggcccgtgcggctgttcagcctggtgacccggctcctgttggcccctcggcgaggattgaccgtacgatcaccagacgaaccactgccggtagtccgcataccggtggcattgcagcgacagttagaacagcgtcagtctaggcgacgaaaccttccgcggcccgtgcttgtgaggccaggccctctacttgtctctgccaggcgtcccgagctcaatcagcctgcccggctgactctgggccgctgggaaagagcccctctggcaagccagggttggaagtcaagacgcgcccgtagagatcatttctccatcgagagggctcagcaagaggctcccgccgtcaggaagcttagttccaagggctcatttgctgacttgggtctggaaccacgggtactacacgccctccaggaggcagccccggaggtggtccagcccaccactgtgcagtccagtacaatcccatccctgctgagaggcagacacgtcgtttgcgcagcggaaactggctccggaaagaccctgtcgtatttactgcctctgctgcagcgactcctcgggcaaccctccctagactcactgccaattccggcaccgaggggtctagtgttggtgcccagtcgcgaactggcacagcaagtgcgggctgtggcccagcctctgggtagaagtctcgggctattagtgagagatttggagggcggccacggcatgcggcggattcggttgcagttgagccgccagccttctgctgacgttttggtcgcaactcctggcgctctgtggaaggccctgaagagccggttaatctcgcttgagcagttatctttcttggtattggacgaggcggatacattgttggatgagtcttttctcgaactcgtggattatatcttagagaagagtcatattgcggaagggcccgcagatctggaagatcccttcaaccctaaagcccaactggtacttgtgggagctacgtttccggaaggcgtcggtcagttacttaataaagtggcctcaccagacgccgtcactactataacatctagtaagttacactgcattatgccccacgtaaaacagacttttttgcgactgaaaggcgctgacaaggtagctgagttggtccatatcttgaagcatagagacagggccgagaggactggccctagcggcacagtactggtgttttgcaactcaagctcaaccgtcaactggctagggtatatacttgacgaccacaagattcagcatctgcgactgcaaggccaaatgccagctctaatgagggtaggcatattccagtcatttcagaaaagtagccgggatatcttgctctgtacggacatcgcctccaggggcctggatagcactggtgtagagctcgtggtgaactacgacttcccccccactctgcaggattacatacatcgcgctggcagagtaggccgtgtggggtccgaagtccctggcacagtgatttcgtttgtgacccacccctgggacgtgagcctggttcaaaaaatcgagttagcagccaggaggcgcagatctctgcctgggctggcttccagcgttaaagaacctctcccacaagcgacatag

SEQ ID NO: 184732 - DNA, 1989 bp, Artificial Sequence
  Description of Artificial Sequence: Synthetic coding sequence
atgagccacgtggccgtggagaacgccctgggcctggaccagcagtttgctggcctcgaccttaattcttctgataaccaatcgggggggagtactgcctcaaaaggacggtacattcccccccacttgaggaatcgcgaagccactaagggcttctacgacaaagattcctctggctggtcgtcctcaaaggataaggacgcttattcgtcttttggaagcagaagcgactcaagaggaaagtcttcatttttcagtgacagaggatccggaagtcgcggcagattcgacgaccggggccgttctgactacgatggaattggcagtcgcggagatcgctccgggtttggaaaattcgagcgagggggaaactcccggtggtgtgataagtcagatgaggacgattggagtaaacctcttccaccaagcgaacgactagagcaagagctcttctccggtggtaataccggaatcaactttgagaaatacgacgatatccctgttgaagccaccgggaataattgtccaccgcatattgagagcttttccgacgttgagatgggggaaataatcatgggtaacatcgagctgacaaggtatactagaccaacgcctgttcagaaacacgccataccaattattaaggaaaaacgggaccttatggcttgcgcacaaactggatccggcaagacagccgctttccttttacctatcctttcacagatttacagcgatgggcccggcgaggctctccgggccatgaaagagaatggacgatatgggcgcaggaagcaataccctatctcactggtcctcgcgccaaccagagagctggcagttcaaatttatgaagaggccagaaaattctcatacaggtcacgcgttagaccatgtgtcgtgtatggaggagccgacattgggcaacaaataagagatctggagcggggctgtcatctgctcgttgcgaccccaggccgtctcgtggacatgatggaaagagggaagattggtcttgatttctgcaaatacctggtgctggacgaggccgatcgcatgttggacatggggtttgaacctcaaattcggaggatcgtcgagcaggatacaatgcctccaaagggcgttcgtcacacgatgatgtttagcgccacattccccaaggagattcaaatgctcgctagggactttcttgatgaatatattttcttggccgtgggccgtgtggggtcaacttccgagaatatcactcagaaagtcgtatgggttgaggaatctgataaacggtcctttctgctggacctcttgaacgctactggcaaagactctctcacacttgtatttgtcgagactaaaaagggcgcggattccctggaagattttctatatcatgaaggctacgcttgcacgtccattcacggggatagatctcaacgcgatagagaggaggctctgcatcaattccgtagtggaaagagccccatcttggtcgcaaccgccgtggcagctcggggccttgatataagcaatgtaaaacatgtgatcaactttgatctccctagcgacattgaggaatacgttcatcgaataggccggaccggacgcgttggtaaccttggcctcgccacttccttcttcaacgagaggaacatcaatataacaaaagatctcctagatctcctcgtcgaggccaaacaagaagtgcccagctggttagagaacatggcttacgagcatcattacaaaggctcttctcgtggacgcagtaagagttctcgattttcgggagggttcggggcacgggactatagacaaagtagcggggcctcttctagttctttttccagcagccgagcgtcctcttctcgctctggaggcggggggcacggctccagccggggattcggcggaggagggtacggagggttttataacagcgacggttacggaggcaactacaattcccagggcgtggactggtggggaaactag

SEQ ID NO: 184733 - DNA, 420 bp, Artificial Sequence
  Description of Artificial Sequence: Synthetic coding sequence
atgagccacgtggccgtggagaacgccctgggcctggaccagcagttcgctggcctcgacttgaactctagcgacaatcaatctggcggctccaccgcttccaaagggaggtatatacccccgcacctgcggaacagggaagcgaccaaggggttttacgacaaggacagctccggatggtcctcttcaaaggataaagacgcctattccagctttggaagtaggagtgactcacgaggcaagtccagctttttctcagaccggggctcggggtcccggggtcgcttcgatgacagaggacgctctgactatgacggaatcggctccaggggtgatcggtctggatacgggggcttctacaactcagacggatatggcggaaactataactctcaaggagtggactggtgggggaactag

SEQ ID NO: 184734 - DNA, 1941 bp, Artificial Sequence
  Description of Artificial Sequence: Synthetic coding sequence
atgagccacgtggccgtggagaacgccctgggcctggaccagcagttcgccggtctggatcttaattcgagtgataaccaatccggagggagtactgcttctagcttttatgacaaggatagtagcgggtggagcagctcgaaggataaagacgcctattcatcctttggaagtagatccgatagcagaggaaaatcttcgtttttctccgatagaggatcagggagccgcgggagatttgatgaccgaggccggagcgattatgatggaattgggagccgcggagaccgttcgggttttggaaaatttgaaaggggaggcaactcaaggtggtgtgacaaatccgacgaagacgactggagtaagcctctgcctccatccgaaagactggagcaggaattgttctcagggggaaacaccggaatcaatttcgagaagtacgatgatattccagtggaagcaacaggaaacaactgtccaccccatattgaatcattttctgacgtggaaatgggagaaattattatgggcaatattgaactgactcgatatactagacccacgcctgtacagaaacatgctattcccatcatcaaagaaaagagggacctgatggcctgcgcccaaactggatctggcaaaactgctgcttttctgctcccgatcttgagccagatttactccgatggaccgggtgaagcattgcgcgccatgaaagagaatggacgttatggacgtaggaagcagtaccctattagcttggtgctggctccaacgcgagaacttgcggtgcagatatacgaagaggccagaaagtttagttacaggagccgggtgaggccctgcgtggtatatgggggagctgatattggccagcagatccgtgatctagaaagagggtgccacctgctggtggccacaccaggtaggctcgtggacatgatggagcgcggaaagattggtcttgatttttgcaagtaccttgtgctggacgaggccgatcgtatgctggacatgggcttcgagccgcagatcaggaggatcgtagagcaagacaccatgcctcccaaaggggtgagacatacgatgatgtttagcgcaaccttcccaaaggaaatccagatgcttgctcgcgattttctggatgaatacatatttctggccgtaggtcgcgtggggtccacatctgagaatattacccagaaagtcgtttgggttgaagaaagtgacaagcgctctttcctgctggatctccttaacgctaccggcaaggactctctgacgctggtgtttgtcgaaactaagaagggcgcggatagcctggaagacttcctgtatcacgaggggtacgcgtgcactagcatccatggcgatcgctctcagagggacagggaagaggctctacatcagtttaggagtggcaagagtcctatcctcgtggccaccgccgtggccgctaggggcctggacatctcaaatgtgaaacacgttatcaattttgatctgccgtccgacatagaggagtatgtgcaccgtatagggaggacaggcagagtgggtaatttgggactggcaacctccttctttaatgagagaaacataaacataaccaaggacctgctggatctgctggtggaagccaagcaggaggtcccgagctggctcgaaaacatggcctacgaacatcactacaaaggatcctccagggggcgctccaaatcaagccggttctccggaggtttcggggccagagattacaggcagagtagtggagcctcttcgtcaagcttctcttccagccgtgccagtagtagccggagcggaggagggggccatggcagtagccgcggatttggcggcgggggctatgggggattctataacagcgacgggtatggcggaaattacaattcgcagggcgtggattggtggggtaattag

SEQ ID NO: 184735 - DNA, 927 bp, Artificial Sequence
  Description of Artificial Sequence: Synthetic coding sequence
atgcgggagagccggctgatcagcgacctgggcggcttcgccggcgtgaggagcgcagccggacgcgactggcggccgttctggctcggagggttgcgcccaagtcggctcgcccaacctggatttccctcaggcggccccggaggaacgcggtgtctgcgggcctgcgaacagggcttcgccggcttggatctgaactctagcgataatcagtcaggaggcagtacggcatccaaagggcgctacattccccctcacctgaggaaccgtgaggccacaaagggattttacgacaaagatagttctgggtggagcagttcaaaggacaaggacgcttattcatcttttggatctaggagcgattcccgggggaagtcaagcttcttcagcgaccgtggctcaggaagcaggggcagattcgacgaccgaggtcggtccgactatgacggcattggcagtagaggtgaccggtcaggtttcgggaaatttgaaaggggaggcaattcaagatggtgtgataagagcgatgaggacgactggtctaaaccattaccacctagcgaaaggcttgaacaggaacttttctctggagggaacaccggtattaatttcgagaagtacgatgatattcccgtcgaggccaccggaaataactgtccccctcacatagagtctttctcagacgttgaaatgggcgagataatcatgggtaacatagagttgacgagatacacccggccaacacctgttcagaagcacgcaatcccaattattaaagagaaaagggatctaatggcatgcgcccaaacaggaaagtggaaggtatgggcccctcagaccatccccaatctgttgggaatttctacgaatgagagggttggcagcaccgacctgcgggggtcccagaaaatttttatacctatttag

SEQ ID NO: 184736 - DNA, 1983 bp, Artificial Sequence
  Description of Artificial Sequence: Synthetic coding sequence
atgagccacgtggtggtgaagaacgaccccgagctggaccagcagctggcaaacttggacttgaatagcgagaaacaatctggcggggctagcaccgcaagtaaaggacgttatattcctccccacctgcggaaccgtgaagcctcaaagggcttccacgacaaggactcctccggatggagctgtagtaaggacaaagatgcttattcatcctttgggtccagggatagtcggggaaagcccggatacttctctgagcgaggcagcggctcacgggggagatttgacgacaggggtcggtcggattacgatgggattggcaaccgcgaacgaccaggtttcgggcgatttgagcgatccgggcatagcaggtggtgcgataaatctgttgaggatgactggtctaagcccctgcccccctcggaacgcctggaacaggagctgttctcaggaggcaacacagggataaatttcgagaagtacgatgacatcccagtggaagccacaggatccaattgtccgcctcatatcgagaatttttccgatatcgacatgggggaaataattatgggcaatattgagctcaccagatacacccgaccaacccccgtgcagaaacacgccattcctatcatcaagggcaaacgcgacctgatggcgtgtgcgcaaaccggaagtggaaaaactgccgcgttcctcctgcctatcctctctcagatctataccgacggcccgggcgaagcacttaaggctgttaaggagaatggtcgttatgggagaaggaaacagtatccaattagtctggtgctcgctcctactcgggagttggcggtacaaatttacgaagaggcacgcaagttcagttacaggtcgagggtgcgaccatgtgtagtgtacgggggcgccgacattggtcaacagattcgggaccttgaaagggggtgtcacttgctggtggcaacccccggtcgactggtcgacatgatggaacgaggaaagattggcttagatttttgcaaatatctggtgctggacgaagccgaccgtatgttagacatgggtttcgagccccaaataaggaggatcgttgagcaggacacaatgcctcctaaaggggtcagacatacgatgatgttctcagcaacatttccaaaggagatccagatgctggctagggactttcttgatgagtacatctttctggccgtgggccgcgtaggctcgacttcagaaaacatcacccagaaagtggtgtgggtcgaagatcttgacaagaggtccttcttactggacattctcggcgcaaccgggtcagactcactgaccctggtattcgttgagactaagaagggagcagacagtctggaagatttcctgtaccacgagggatacgcctgtacatcaatacacggagacagatcccaacgcgaccgggaggaagctctgcaccaattccgcagcggaaagtccccaatcctggtcgccacagctgtagccgctcgcggtctggatatctccaacgtgaggcacgtgataaacttcgatctgccctccgacattgaggaatatgtacaccgcatagggagaaccggccgggtggggaaccttggactggctacctcattttttaatgagaaaaatatgaacatcaccaaagatcttttagatttattggtcgaagcaaaacaggaggtgcccagctggctcgaaaatatggcgtatgaacaccattataaaggtggcagtcgcggccggagtaaaagtaacaggtttagcggcgggttcggcgcccgcgattacagacagtcctcagggtcatcttcgtccggcttcggggcctccagaggaagttcttctaggtcagggggcggcggttatggcaactccagagggttcgggggcggtggttacggcggattttacaactccgacggctacggggggaattacaactcccagggtgtcgattggtggggcaactag

SEQ ID NO: 184737 - DNA, 1983 bp, Artificial Sequence
  Description of Artificial Sequence: Synthetic coding sequence
atgagccacgtggtggtgaagaacgaccccgagctggaccagcagcttgccaacctggatctgaatagcgaaaaacagtccgggggcgcgtctaccgcgagcaagggccgctacatcccacctcacctgaggaatagagaagctagcaagggctttcacgacaaggacagcagcggatggagttgcagtaaggacaaggacgcgtattcatccttcggaagcagggattcaagagggaaacccgggtacttttcagaaaggggtagcggcagtagagggaggttcgatgatcggggtcggtcagactatgatgggattggcaaccgcgagaggcccgggtttgggagattcgaaaggagcgggcacagtaggtggtgtgataaatcagtggaggatgattggtcaaaacctcttcccccatccgagagacttgagcaagagcttttctcaggcggaaatacaggtatcaactttgagaagtatgacgatattccagtggaagccactggtagcaactgcccccctcacatcgaaaacttttccgatattgatatgggtgaaatcattatgggcaacatcgagcttacccgctatacacgccccactcctgtccaaaagcacgctattccaataattaagggtaagcgtgatctgatggcctgtgcacaaacagggtcaggaaagactgcagcattcctgctgcccatactttcacagatctacaccgatgggcccggagaggccctcaaagctgttaaagagaatggacgctacggccgacgaaaacagtatccaatcagcctggttctcgcaccgacacgggagctcgccgttcagatctacgaggaagctcgaaagttctcctaccgatccagggtccgaccttgcgtggtatatggcggcgcagatatcggacagcaaatcagagatctggagcgggggtgtcacttgctggtcgccacccccgggcgacttgtggatatgatggaacggggaaagatcggacttgatttttgtaagtacctggtgctggacgaggccgaccgcatgctggacatggggttcgagccccagattaggcgaatcgtggagcaggatacaatgccccctaaaggagtacgacatactatgatgttttccgcaacttttccgaaagagatccaaatgctggctcgggactttctggatgaatacatatttcttgcggtggggagggtgggatccaccagcgagaatatcactcagaaggtggtttgggttgaggacctagacaagaggtctttcctgcttgatatactgggagccactggaagtgatagcctgaccctcgtatttgttgagacaaaaaagggtgcggattcccttgaggacttcctctaccacgaaggttatgcctgcacttccattcacggtgaccgcagtcagcgcgaccgcgaagaggcactacaccagtttaggtcgggcaagagccctattctcgtggccaccgctgtcgccgcgcgtggtcttgacatttcaaacgtacggcacgtgattaactttgacttgccgtcagacattgaggaatacgttcatcggatcggacgaactggccgagtgggtaatttaggactggcgacctccttcttcaatgaaaaaaatatgaatatcactaaggacctgctcgacctgctggtcgaagccaagcaggaagtcccctcttggctggagaatatggcttacgagcaccactacaaaggcgggagccgaggaagatccaaaagcaatcgcttttctggcggatttggtgcacgggactacagacagtcttctgggagctcctcatctggtttcggcgcctctaggggctcttctagccgttccgggggcggtggttatgggaacagccgaggctttggaggtgggggttatggcggattttataattcagatggctatggaggcaactataacagccagggtgtagactggtggggaaattag

SEQ ID NO: 184738 - DNA, 753 bp, Artificial Sequence
  Description of Artificial Sequence: Synthetic coding sequence
atggagatcggccggccccggaaggacacctggaagctggccaacctggatcttaatagcgagaagcagtctggtggagcgtccaccgctagtaagggacgatacatccctccacatttaagaaacagggaagcctcaaaggggttccatgacaaggacagcagtggctggtcatgttccaaagataaagatgcctatagtagttttgggagcagggacagcagagggaagccaggttactttagcgagagaggcagtggctctcgggggcgtttcgacgatagaggaagatctgattacgacggtataggcaatcgagaacgacccggctttggaaggttcgagcgcagtggacatagccggtggtgcgacaaatccgtagaagatgactggtccaagcctctcccaccctcagaacgtttggaacaggagcttttcagtggtggaaatactgggatcaactttgagaaatacgacgatattcccgtcgaagcaacggggtcaaattgccctcctcacattgaaaacttctctgacattgatatgggggagatcatcatggggaatatcgagttaacccggtacactcggcccacacctgtccagaaacatgccatacccatcattaaaggtaagcgcgatctaatggcgtgcgcgcagacaggtagcgggaaaaccgctgcttttctgctccccatactaagtcagatatacacagacggtcctggtgaggccctgaaggcagtgaaatag

SEQ ID NO: 184739 - DNA, 675 bp, Artificial Sequence
  Description of Artificial Sequence: Synthetic coding sequence
atgagccacgtggtggtgaagaacgaccccgagctggaccagcagctggccaacctggatttgaactctgagaaacaatctggtggcgcatctacagcgagcaaggggagatacatccccccacatctcagaaatagagaagcgagcaagggtttccatgacaaagacagctcaggctggtcctgcagcaaggacaaagacgcctactcttctttcgggagtcgagactcaagggggaaacccgggtatttctcagaaagaggatctggctctaggggtaggttcgacgacaggggccgcagcgattacgatggaattgggaaccgcgagcgacccggctttggtcggtttgagaggtctggccactccaggtggtgcgataagagtgttgaagacgactggagcaaacccctgcctcccagcgagaggctggaacaggagctgttctccgggggtaacacaggaataaactttgaaaagtatgatgacatccccgtggaggctacgggttcaaattgtcccccccacatcgagaacttctcagatattgatatgggcgagatcatcatgggcaatatagagctgaccaggtacacaagaccaacccctgtgcaaaaacatgccatccctataattaaaggtaagcgcgatctgatggcctgtgcccaaacttag

SEQ ID NO: 184740 - DNA, 1974 bp, Artificial Sequence
  Description of Artificial Sequence: Synthetic coding sequence
atggagatcggccggccccggaaggacacctggaagctggccaacctggatctaaatagcgagaaacagagcggaggggcgtccaccgctagtaaagggaggtacatccccccccatctcagaaatcgcgaggcaagtaagggatttcatgataaagactccagcggctggtcctgtagtaaggacaaggacgcgtacagcagctttgggtcccgggatagtaggggcaagcctggctacttcagtgagcgcggcagcgggagtaggggaagatttgacgaccgcgggaggtcagactacgacgggataggcaatcgggagcggcctggatttggcaggttcgaaaggtccggtcatagccggtggtgcgataagtctgttgaggatgactggtcgaagccccttccaccctccgaaaggctggaacaggagctcttttctggagggaacaccggtattaatttcgagaaatacgatgacattccggttgaggctactgggtctaactgcccaccacacattgagaacttctccgatatcgatatgggggaaatcattatgggcaacatcgaactgacaagatatactagacctactcccgttcagaaacacgccatccccataatcaagggcaagagggacctgatggcctgcgctcagacagggtccggaaaaacagctgcatttttgctccctatactcagtcagatttataccgatgggccaggagaagccctgaaggcagtaaaggagaatggaagatacggcagaagaaaacaataccctataagtctcgtcctggctcccacacgtgaactggccgtgcagatttatgaggaggcaaggaaattcagctatcgatcccgagtgaggccctgcgtggtgtacggaggtgctgatataggacagcagatcagagatctcgaaaggggatgtcaccttcttgttgctaccccgggtcgtttggtggatatgatggagaggggaaagatcggcctcgatttctgcaagtacctggtgctcgacgaagcggacagaatgttggacatgggcttcgagccacagataaggcgcatcgtggagcaggacactatgccaccaaaaggggtcaggcataccatgatgttcagcgccactttccccaaggagattcaaatgctggcccgcgattttctggacgagtatattttcctcgccgtaggaagggttggctctaccagcgaaaatattacccagaaggtggtttgggtggaagatcttgacaagcggagctttctgctcgatatcctgggtgcaaccgggtctgacagcttaaccctggttttcgtggagacaaagaaaggggctgacagtctggaggactttctttaccacgaaggctacgcatgcacgtccatccacggtgacaggtcccagcgggatagggaagaggccctgcaccagtttaggagcggaaaaagcccgatattggtggctacagcagtggcggcgcgtgggttagacatttccaatgttagacatgttataaacttcgacctgccttcggatatcgaagagtacgtccatagaatcggtaggactggacgcgttgggaatctcggcctcgcgacatctttcttcaacgaaaagaatatgaacataacgaaggacctgctggatctgctagtcgaggcaaagcaagaagttccctcttggctggaaaacatggcctacgaacatcattataagggtggatccagaggaaggagcaagagcaaccgattctctggtggctttggagccagagactatagacagtcaagcggctcttccagtagtgggttcggggccagccggggcagctctagcagatccggaggcggcggctacgggaactccagagggtttgggggcggcgggtatggcgggttctataactcagacgggtatggaggcaactacaacagccagggagtcgactggtggggcaactag

SEQ ID NO: 184741 - DNA, 1278 bp, Artificial Sequence
  Description of Artificial Sequence: Synthetic coding sequence
atggccgagaacgacgtggacaacgagctgctggactacgaggacgacgaggtcgaaacagccgccgggggggacggtgctgaagcacccgctaagaaggatgtcaagggatcatacgtgagcattcactcttcaggcttccgggacttcctgctaaagccggagctcctgcgagccattgttgattgcggctttgagcatccctcggaggtgcagcatgaatgcattcctcaagctatactcggtatggatgtcctctgtcaggcgaaaagtggcatgggcaagaccgcagtgtttgtcctggctactcttcagcagctggagcccgtgacaggtcaggtgtcggtcctggtgatgtgccatacccgcgaactggcattccagatctctaaggaatatgagagattcagcaagtacatgcccaatgtgaaagtggcagtgttcttcggcgggctgagcattaaaaaagatgaagaagttctcaaaaagaactgtcctcacatcgtcgtcgggaccccagggaggattttggcgcttgccaggaataagtctctgaacctaaagcatattaagcacttcatcttggatgaatgcgacaaaatgttagagcagctagatatgagaagggatgtgcaggagatttttaggatgacaccgcacgagaagcaggtgatgatgttttctgccaccctaagcaaggagatccgtcctgtgtgccgcaagtttatgcaggacccaatggaaatattcgtggatgacgaaactaaactgacactccacggcctacagcagtattacgttaagctgaaggacaacgaaaagaaccgcaaattgttcgatctgctggatgtgcttgagtttaaccaagtggttatttttgttaagtcagtgcagcgttgtattgctctcgctcaactccttgtggagcagaactttcccgccatcgctattcataggggcatgccacaggaggagcgcctttctagataccagcagtttaaagattttcagcggcggatcctggtagctacgaacctctttggtcgcggcatggacatagagcgcgtgaacatcgccttcaactatgacatgcccgaggattcagatacctatctgcatcggtgctaccctttgtcccctagtaggtggcccgagcaagcaggtcttgctccccgcgcatggctctcccatctctgtccgatgcgcatgatgccgaggtccagtatgatgtgccggatcgctcttcggtccatcctcgtgtcttgtctcatgcggtag

SEQ ID NO: 184742 - DNA, 1287 bp, Artificial Sequence
  Description of Artificial Sequence: Synthetic coding sequence
atggccgagaacgacgtggacaacgagctgctggactacgaggacgacgaggttgaaacggcagctggcggggatggcgccgaggctcccgcaaaaaaagatgttaagggctcttacgtcagcatacactcttccggattccgtgactttctgctgaagccagagctccttcgagcaattgtggattgtgggttcgagcacccgagcgaagtgcagcatgaatgcattccccaagctatcctcggaatggacgtcctgtgtcaggcaaaaagcgggatgggaaagacggcagtgtttgtgctggcgacgctgcaacagctggagcccgtgacaggccaggtatctgtccttgtgatgtgccatacacgagagcttgccttccagattagcaaagaatatgagagattctccaagtacatgccgaacgtgaaagtggcagttttctttggcggcctctctataaagaaggacgaggaagtgctgaagaagaattgtccccacattgtcgtcggaactcctggtcggattctggctctggctcggaataagtccctgaatctgaagcatattaagcacttcatactagacgaatgtgacaaaatgctcgagcaacttgatatgcgcagagacgtccaggaaatattcagaatgacaccacacgagaagcaggttatgatgtttagcgcaaccctgtctaaggagataaggcctgtctgcagaaaatttatgcaggatcctatggaaatatttgtggacgatgagactaaattgactctccatggcctccagcaatactacgttaaacttaaggacaatgagaaaaaccgcaagctgtttgaccttctggatgtcctggagttcaatcaggtcgttatcttcgtgaaatctgtgcagaggtgcattgctctggctcagctcctcgtggagcagaatttccccgccatagctatccataggggcatgccacaggaagagaggctatctagatatcagcagttcaaggactttcagaggaggatattagtagcaaccaaccttttcggacggggcatggatatcgagcgcgttaatattgccttcaattatgacatgcccgaggatagtgatacttatctgcatcgtgttgcaagggctggacgctttggtacaaagggtctcgccattaccttcgtgagcgacgagaacgatgccaaaatactgaatgacgtacaggacagatttgaggtcaacatctctgaactgccagacgagattgacatctccagctatattgagcagactagatag

SEQ ID NO: 184743 - DNA, 1287 bp, Artificial Sequence
  Description of Artificial Sequence: Synthetic coding sequence
atggccgagaacgacgtggacaacgagctgctggactacgaggacgatgaggtggagactgccgctggcggcgatggcgccgaagcccccgcaaagaaagatgtcaagggctcttacgtgagtatccacagcagcggcttcagggactttctgttaaagccggagttattaagagccatcgtggactgcggcttcgaacacccatccgaggtccagcacgaatgcatcccacaggctatactggggatggatgtgctgtgtcaggctaaatcgggcatgggtaagacagctgtcttcgtgctcgccactctccagcaattggagcctgtaacggggcaggtaagtgtcctggtgatgtgtcacaccagggagttagccttccaaataagtaaagagtacgagagattttccaagtacatgcccaacgttaaagtagcagtttttttcgggggcctcagcataaaaaaagacgaagaggtccttaagaagaattgtccgcacatcgtagtgggaacacctggtaggatcctggctctcgcgaggaacaagagtttaaacctgaaacacatcaaacactttatcctggatgaatgtgataagatgctggagcagcttgatatgagacgcgacgtgcaggaaatttttagaatgactccgcacgagaaacaggtgatgatgttttctgcgacactcagtaaggagatccggccagtctgccggaagttcatgcaggatccaatggagatttttgtcgatgacgaaacgaagcttacactgcacggtctgcagcagtactacgtcaagctcaaggataatgagaagaaccggaagctcttcgacttactagacgtgctcgaatttaaccaggtcgtgatctttgtaaaatccgtgcaacgctgtatcgcactggcgcagctgctggtcgaacagaatttccctgctattgcaatacataggggtatgccacaggaagagagattaagtaggtaccagcagtttaaggactttcagcgaaggattctggtggcaactaatctgtttgggcgaggcatggatatagaacgagtgaacatcgcgtttaactacgatatgcccgaggacagcgacacttacctgcacagggtggcacgcgccggtcggttcgggactaaagggctggccatcaccttcgtgtctgatgaaaatgacgccaagatcctcaacgatgttcaagatcggtttgaagttaacatatcagaattgccagacgaaatcgatatctcctcttatattgaacagaccagatag

SEQ ID NO: 184744 - DNA, 1278 bp, Artificial Sequence
  Description of Artificial Sequence: Synthetic coding sequence
atggccgagaacgacgtggacaacgagctgctggactacgaggacgatgaagttgagactgcagctggtggcgatggtgccgaggcccccgccaaaaaagacgtgaagggatcttatgtgtccatacattcctcagggttccgcgactttctcctcaaaccagaattgctgagagcaatcgtagactgtggctttgagcaccctagtgaagtccagcacgagtgcatcccccaggctatcttgggaatggatgtactctgtcaggctaagtctgggatgggtaaaacggcggtctttgtgcttgctaccctgcagcagcttgaaccagttacaggtcaggtgtctgtgctggtaatgtgccacacccgagaactcgcgttccagatctccaaggagtacgaacgcttcagtaaatatatgccaaacgtgaaggttgctgtgttttttggcggtctctcaatcaagaaagacgaggaagttttaaaaaaaaattgtcctcacattgtcgtgggcacacctggcaggatcctagctctcgccaggaacaagagcttaaaccttaaacatatcaagcatttcattcttgacgaatgtgataagatgttggagcagctggacatgcggcgcgatgtgcaggagattttccgcatgaccccccatgagaagcaagtaatgatgttcagcgctacactcagcaaagaaatccgccccgtttgcagaaagtttatgcaggatccgatggagatatttgtggacgatgagacaaagctgaccctacacggactgcagcagtactacgtgaagctgaaggataatgagaagaacaggaagctattcgacctactggatgtgctcgaattcaatcaagttgtgatctttgtgaaaagcgtgcagcgctgcatcgccttagcacaactgctggtggaacagaatttccccgcaattgccatccaccgtggaatgccgcaggaagagcgcctgagcaggtatcagcagttcaaggacttccaaagacggatcctggtggccacgaatctctttggacgaggcatggatatcgagagggttaacatcgcttttaattacgacatgcctgaggacagcgacacctacctccacaggtgctacccactcagcccctcccggtggcctgagcaggccgggcttgctcctcgcgcctggttgtcacatctctgccctatgcgcatgatgccaagatccagtatgatgtgtagaatcgcacttcggagcatcctggtgtcatgcttaatgcgctag

SEQ ID NO: 184745 - DNA, 1287 bp, Artificial Sequence
  Description of Artificial Sequence: Synthetic coding sequence
atggccgagaacgacgtggacaacgagctgctggactacgaggacgacgaggtagagactgctgccggtggggatggtgccgaagcccccgctaagaaggatgtcaaagggtcatatgtgagcattcactctagtggcttcagagacttcctgctaaagcccgaactgctaagagccatcgtagattgtggattcgaacaccctagcgaggttcaacatgagtgtatcccacaggccatcctaggcatggatgtgctttgccaagcgaaaagcggcatgggaaagaccgcggtcttcgtgttagccacgctgcaacagctcgagccagtgaccggacaggtgagtgtcctcgtgatgtgccacacaagggagttggctttccaaattagtaaggagtacgagcggttcagcaaatatatgcccaacgtgaaagtcgcggtgttcttcggcgggctaagcatcaaaaaagacgaagaggtcctcaagaaaaattgtccgcacatcgtggttgggaccccgggtagaattctagcattagcacgaaataagagtctgaacttaaaacatataaaacatttcatcctagacgaatgcgataagatgctggaacagttggatatgcgacgagatgtacaagaaattttccggatgacaccccatgagaagcaggtgatgatgttctccgccacattgtccaaggagattagaccagtgtgtcggaagttcatgcaggaccccatggagattttcgttgacgacgagactaaactcacgctccacgggcttcagcagtattatgtcaagctcaaggacaatgagaagaatcggaaacttttcgacctgcttgacgtgttggagttcaaccaggtggtgatcttcgtgaagagcgttcaacggtgcattgcactggcccaactgctggtagagcagaactttccagcgattgctatccatcggggcatgccccaggaagagaggctctcgcgttaccagcagttcaaagatttccaacggaggattttggtcgcaacaaatctctttggccgggggatggacattgaacgggtgaatattgcattcaactacgacatgccagaggacagcgacacctatttacatagagtggcacgggccggaaggttcggaaccaagggactggctattacttttgtgtccgacgaaaatgatgccaagatcctcaacgacgtccaggatcgcttcgaggtcaacatcagtgaattaccagatgaaatagatatctcatcatacatcgaacaaactcggtag

SEQ ID NO: 184746 - DNA, 1287 bp, Artificial Sequence
  Description of Artificial Sequence: Synthetic coding sequence
atggccgagaacgacgtggacaacgagctgctggactacgaggacgacgaggtcgagactgcagcgggtggcgatggagcggaagccccggccaagaaagatgtcaagggcagctacgtcagcattcactcatccgggttccgcgactttctgctgaagccggagttgctgcgtgctatcgttgactgcgggtttgagcaccctagtgaagtgcagcatgagtgtattccacaggctattctcggaatggacgtgctctgtcaggccaaatccgggatgggcaagaccgcggtcttcgtactcgctacattacagcaactggagccggttaccggtcaagtttctgtattggttatgtgccacaccagagaactggctttccaaatatctaaggaatacgagcggttctccaaatacatgccaaacgtgaaggtagccgtgttctttggcgggctgagcatcaaaaaggacgaggaggttctgaagaagaactgcccccatattgtcgtgggcacaccaggcagaatactggcgctggcacgtaataagtcactcaatctgaaacatatcaaacatttcattctggacgaatgcgacaaaatgctggaacagctggatatgcgacgagatgtgcaggaaatattccgaatgacacctcacgagaagcaggtgatgatgttctccgctacactctccaaagaaattcggccggtctgtcgcaagttcatgcaggatcccatggaaatctttgtggatgacgagacaaaacttactcttcatggtttgcagcagtactacgtaaaacttaaggacaacgagaagaaccgaaaactgtttgaccttctggatgtgctcgaattcaaccaggtggtcatatttgtgaaatccgtgcagaggtgtattgctctggcacagctattagtcgaacagaattttcctgctatagctattcatagggggatgccccaggaggagcgcctctcaaggtaccagcagttcaaagactttcaacgacgcatcctcgtagctacaaatttgtttggtcgaggcatggatattgagcgtgtgaacatcgcattcaactatgatatgcccgaggattctgacacatatctgcaccgggtggcgagagctggccgctttgggaccaaagggttggctatcacctttgtgtcagatgagaatgacgccaagattcttaatgatgtgcaagacaggttcgaggtaaacatcagcgagttgcctgacgagattgacatcagcagctatattgagcaaacgcgttag

SEQ ID NO: 184747 - DNA, 564 bp, Artificial Sequence
  Description of Artificial Sequence: Synthetic coding sequence
atgggcagcagccacatcggcggcctgagcatcaacgagcggcggtgtagcgcctctctcggcctggtgatggccgaaaacgacgtggacaatgaattgttagattacgaggacgacgaagttgaaaccgctgctggaggggatggggctgaagcccccgctaagaaggatgtgaaagggagctatgtgtctatccatagctccggatttcgggattttctgcttaaacctgagctccttcgcgccatcgtcgattgtggctttgaacacccttcggaagtgcagcacgaatgcatcccacaggctatacttggaatggatgtgctgtgtcaggctaaatctggaatgggcaaaacagccgtattcgtactcgccaccctgcaacaactggagccagtgacaggtcaggtgagcgtgctggtgatgtgccacactagagagctggcctttcagatttctaaggaatacgagcgattttccaaatatatgcctaacgtcaaggtggccgttttttttggcgggctgtcaataaagaaggacgaagaggtgctgaaaaagaactag

SEQ ID NO: 184748 - DNA, 1287 bp, Artificial Sequence
  Description of Artificial Sequence: Synthetic coding sequence
atggccgagaacgacgtggacaacgagctgctggactacgaggacgatgaagtggaaactgccgccggtggggacggggcggaagcaccggcaaagaaagatgttaagggcagttacgtttcaattcattccagcggttttcgcgattttctattaaagccagagctactgcgcgccattgtcgactgtggtttcgagcatccatcggaagtccagcacgagtgcattccccaggcgatactggggatggacgtgctgtgccaagctaaatctggaatgggcaaaaccgcggtcttcgtgctggcaactctccagcagctggagccggttacgggacaggtgagcgtgctggtcatgtgtcacacccgcgaactcgctttccagataagtaaggagtatgaacgcttcagcaaatacatgccaaatgtcaaagtggctgtgttttttggagggctgtccattaagaaggacgaggaggtccttaaaaaaaattgcccccatattgtggtgggcacaccaggacgcatcctggctttggcccggaataaatctctgaatctgaaacacattaagcatttcattctggatgagtgtgacaagatgcttgaacagctggacatgaggagggacgtgcaagagatcttccgtatgactccccacgaaaagcaggtcatgatgttttctgcgacactgtccaaggagatccgaccagtttgtcgcaagtttatgcaggaccccatggagatatttgtggacgatgagacaaaactgacattacacggactacagcagtattacgtaaagttgaaggataatgaaaagaaccggaaactgtttgacctgctggacgtgcttgagttcaaccaggtggtcattttcgtgaagtctgttcagaggtgtatcgcactggcccagttattggtggaacagaattttcctgcaattgctatccatagaggcatgccccaggaagagcggctgtctcgctatcagcaatttaaggattttcagaggagaattctggtggccaccaacctgttcggacgcggcatggacatagagagggttaatatagctttcaattatgatatgccagaagactctgacacttaccttcatcgcgtggcacgcgctggacgattcggcaccaaggggctggccatcacattcgtgtcagacgagaacgacgccaagatacttaacgacgtacaggataggtttgaagtcaacattagtgagctgcctgatgagatcgacataagctcctacatcgaacagacacgctag

SEQ ID NO: 184749 - DNA, 378 bp, Artificial Sequence
  Description of Artificial Sequence: Synthetic coding sequence
atggccgagaacgacgtggacaacgagctgctggactacgaggacgatgaagttgagaccgccgctggcggggacggagctgaagccccagcaaagaaggatgtcaagggttcatatgtgtctattcattcctcaggtttcagggatttcctcctcaaaccagagctacttcgagctatagtggattgcgggttcgaacaccccagtgaagtgcagcatgaatgtatcccccaggctatcctcggaatggatgtcctatgccaggccaagagtggtatgggaaagacagccgtgtttgtcttggcgactctgcagcaattggagccagttaccggacaggtgagtgtattagtcatgtgtcatacgagagagctctag

SEQ ID NO: 184750 - DNA, 1287 bp, Artificial Sequence
  Description of Artificial Sequence: Synthetic coding sequence
atggccgagaacgacgtggacaacgagctgctggactacgaggacgacgaagtggaaaccgccgcagggggcgacggcgcagaggcacccgccaaaaaagacgtgaaagggagctatgtgagcattcattcctccggtttcagggattttctccttaagcctgagctgctcagggctatagtagactgcggcttcgagcacccttccgaagtgcagcatgagtgtattccccaggctatcctcggtatggacgtgctgtgccaggcaaagagcgggatgggaaaaactgccgttttcgtgctggctactctgcagcaactggaaccagtcactggccaagtgagtgtgctggttatgtgtcacacacgcgagctggcatttcagatcagtaaagagtatgagcgcttttccaaatacatgcccaacgtcaaggtggcagtgtttttcggcgggctttctatcaaaaaggatgaggaggttctgaaaaagaattgcccccacatcgtggtgggtacccccggtaggattctggcactggcacgaaataagtctctgaaccttaagcatatcaaacactttattctcgacgagtgcgacaaaatgctggagcagcttgatatgcggcgggatgtccaagaaatttttaggatgacacctcatgaaaaacaggtgatgatgttcagcgcaaccctgagcaaagagattaggcccgtctgtaggaagtttatgcaggacccgatggagatattcgtggacgatgagactaagctaaccctgcatggacttcagcaatactacgtgaagctgaaggacaatgaaaaaaacagaaagctctttgacctccttgacgttctggaatttaatcaggtggtgatattcgtgaagtcagtgcagcgatgtattgctctggcccagcttctcgtggagcagaattttccagccatcgccatccatagaggcatgccgcaagaggaacgattgagtaggtatcagcagttcaaggactttcaacgccgcatcttggtggcgacgaacctgtttggcagagggatggatattgaacgcgtcaacatcgccttcaattatgacatgcctgaggatagcgacacatatcttcaccgcgtagcacgagccgggcgctttggcacgaaaggcctggctattaccttcgtgtccgacgagaacgatgccaagatccttaacgacgtgcaagatagattcgaagtgaacatatccgaactgcccgacgaaattgacatttcatcttatattgagcagactcgatag

SEQ ID NO: 184751 - DNA, 564 bp, Artificial Sequence
  Description of Artificial Sequence: Synthetic coding sequence
tgaagcgaggagcgggacatcggcaagcccatggagatcttcgtggacgacgagactaaactgacactgcacggccttcagcagtactacgtgaaattgaaggacaatgagaaaaatcggaaattattcgacctcctcgacgtcttagagtttaaccaggtggtcatttttgtgaaatctgtgcagcggtgcatagcgctggcccagttattagtcgaacagaacttccctgccattgctattcatagggggatgcctcaagaggagaggctgagcagataccagcagttcaaagattttcagcggcggatcctcgtagccactaatctgttcggaaggggtatggatatcgaacgcgtcaatatcgcgtttaattacgatatgcctgaggatagtgatacttatctgcatagggtggcaagggctggacgcttcggcactaagggacttgccattacctttgtgtccgacgagaatgatgcgaagatcttgaacgatgtgcaggatcggttcgaagtaaacatctcagaactgcctgacgagattgacatctcctcctactag

SEQ ID NO: 184752 - DNA, 378 bp, Artificial Sequence
  Description of Artificial Sequence: Synthetic coding sequence
atggccgagaacgacgtggacaacgagctgctggactacgaggacgacgaagtcgagaccgctgctgggggggacggcgccgaggctccagccaagaaagatgtgaaaggtagctatgtatctatacatagtagtggcttccgggatttcctcctgaaacccgagctgctaagggccattgtagactgcggtttcgaacatccgtccgaagtccagcacgaatgcataccgcaagccattttgggcatggatgtactttgccaagcgaaatccggtatgggaaaaacagccgtgttcgtcctggctaccctccagcaactggagccagtaacaggccaggtcagcgtccttgttatgtgccatactcgtgagctgtag

SEQ ID NO: 184753 - DNA, 1287 bp, Artificial Sequence
  Description of Artificial Sequence: Synthetic coding sequence
atggccgagaacgacgtggacaacgagctgctggactacgaggacgatgaggtggagaccgctgcaggcggagacggggccgaagccccagcaaagaaagacgttaaaggctcgtacgtctctattcattccagcgggtttagagactttcttctcaaacctgagctcctgagggctatcgtggactgcgggttcgagcacccttccgaggtccagcacgaatgcatccctcaggctatcctaggaatggatgttctgtgccaggccaagtcaggaatgggcaaaaccgctgtatttgtcctagctactctccagcagttggagcccgtcacggggcaggtcagcgtgctggtaatgtgccatacacgcgagcttgccttccagatctcaaaagagtatgaacgcttcagtaagtatatgcccaatgtgaaagtcgcagtatttttcggaggtttaagcatcaagaaagacgaggaagtgctgaagaagaactgccctcatattgtcgtcggcacgcctggaaggatcctggccctggcgagaaataaatccttgaacctgaagcatattaagcattttatccttgacgagtgtgataaaatgctggaacagctcgacatgcggcgagacgtgcaggaaattttcagaatgactccccatgagaagcaggttatgatgttttccgctacactctcaaaggaaatccgccctgtatgtagaaagttcatgcaggatcccatggagatctttgtggacgacgaaacaaagttaacactgcacggcttacagcagtactacgtgaagctgaaggacaatgaaaaaaatcggaagctgttcgaccttctggatgttctggagttcaaccaggtggttatcttcgtgaaaagtgtacagcgctgcatcgctttggcacagctgctggttgaacagaattttcccgcaattgcaatccaccgcggtatgccacaggaggagcgccttagccgatatcaacagttcaaggatttccaacgtcgcattctggtggccaccaatctgtttggcagaggtatggacattgagcgcgtgaacattgcttttaattacgacatgcctgaagacagtgacacctatttacacagggtggctagggcgggccgctttgggacgaaaggcctcgccattaccttcgtgagcgacgaaaacgatgccaagattctgaacgacgtgcaggatcgtttcgaggtaaacattagcgagttacctgatgagatagatatctcgtcttatatcgagcaaacgcggtag

SEQ ID NO: 184754 - DNA, 870 bp, Artificial Sequence
  Description of Artificial Sequence: Synthetic coding sequence
atggccgagaacgacgtggacaacgagctgctggactacgaggacgacgaggtcgagacagcggcagggggcgacggggctgaagctccggctaagaaggatgtaaaggggtcatacgtctccatacattcctccggatttagagattttcttctcaagccagagctcttaagggccattgttgactgcggctttgagcaccccagcgaggtccagcacgaatgtattccccaggcgattctgggtatggacgtgctttgccaggccaagtctgggatgggtaaaacagcagtgttcgtgttggccacactgcaacagctggagcctgtgaccggacaggtttccgtcctcgtaatgtgtcatacgcgcgagctggcctttcaaatttctaaggagtacgagcgcttttccaagtacatgcctaacgtgaaagtggccgttttcttcggagggctctccatcaaaaaagatgaagaggtgctcaaaaagaattgcccccatatcgtggtggggacaccagggcggattctcgcactcgccagaaacaagagcttgaatctgaagcatattaaacactttattctagacgaatgtgataagatgttggagcagcttgatatgagacgcgacgttcaggaaattttccggatgacacctcacgagaagcaagttatgatgtttagcgccactctcagtaaggaaattaggccggtgtgccggaaatttatgcaggaccccatggagatcttcgtggacgacgagaccaagctgactctgcacggacttcagcagtattatgtgaaattaaaggataatgagaaaaatagaaagctgttcgatttacttgacgtgctcgaattcaatcaatag

SEQ ID NO: 184755 - DNA, 1287 bp, Artificial Sequence
  Description of Artificial Sequence: Synthetic coding sequence
atggccgagaacgacgtggacaacgagctgctggactacgaggacgacgaggtggaaacagccgcagggggcgatggagctgaagcccctgccaagaaagatgtgaaaggaagttatgttagtatccattcgtcagggtttcgtgatttcttactaaagcctgagctgctgagggccattgtggattgtgggttcgaacatccctctgaggtgcagcacgaatgtataccacaggcaatcctcggcatggacgtgctctgtcaggccaaatccggcatgggcaagacagccgtcttcgtgctcgctaccctccagcagctggaaccagtgactggacaggtgtctgtgttagttatgtgccacaccagagagctcgcctttcagatttcaaaggaatacgaaaggttcagtaagtacatgcctaacgttaaagtggcagtgtttttcggtggcctgtctatcaagaaggacgaggaagtgctaaaaaaaaactgcccccatatcgtcgtcggcactccaggccggatcctggcactggccagaaataagtctctgaacctcaagcatattaagcacttcattttagacgaatgcgacaaaatgctggaacagctcgacatgcggcgagacgtgcaggaaatctttcgcatgactccccacgagaagcaggtgatgatgttttctgctaccttaagtaaggaaattcgtcccgtatgccggaagttcatgcaggacccaatggaaatctttgtggatgatgagaccaagttaactctgcatggtctgcaacaatactacgttaagcttaaggacaacgagaagaaccgaaagctttttgatctgttggatgtgctggagttcaaccaggtcgtgatctttgtaaaaagtgtgcagcgctgtatcgctctggctcagctgctggtagagcaaaatttccccgccatcgccatccaccgcggcatgccccaggaggagaggctgtccaggtaccagcaatttaaggacttccagcggcgcatccttgtggcaacaaatctcttcggcagagggatggacatagagagagttaatattgccttcaattacgacatgcctgaagatagtgatacatacttacaccgtgtagcccgcgccggtcgcttcggcacaaagggcttggccattactttcgtcagcgatgagaacgatgcgaagattctgaacgacgtacaagatcgatttgaagtgaacatcagtgaacttccagatgaaatagacatatcatcttatatagaacagacgcggtag

SEQ ID NO: 184756 - DNA, 291 bp, Artificial Sequence
  Description of Artificial Sequence: Synthetic coding sequence
atggccgagaacgacgtggacaacgagctgctggactacgaggacgacgaggtggaaaccgccgcaggcggagatggagccgaggccccagcgaagaaagacgtcaaaggctcttatgtgagcatacatagtagcgggttccgagatttcctgctaaaacctgaacttctgcgcgctattgtcgattgcggcttcgagcacccctctgaggtacagcatgaatgcatcccccaggccatcctcgggatggacgttctgtgtcaagcgaagtctggcatggggaaaacctag

SEQ ID NO: 184757 - DNA, 378 bp, Artificial Sequence
  Description of Artificial Sequence: Synthetic coding sequence
atggccgagaacgacgtggacaacgagctgctggactacgaggacgacgaggtggaaactgcagcggggggagatggggccgaagctcctgcaaaaaaggatgtaaagggcagctacgtttcgatccatagtagcggatttcgcgatttcctgctcaagcctgagctgctccgcgcaatcgtggattgcggttttgagcacccgagcgaggtgcagcacgaatgcattcctcaggccattttgggtatggatgtcctctgccaggctaagtcaggcatggggaagacagcggtgtttgttctggctaccctgcagcagttagagcctgttactggccaagtgagcgtgctggtgatgtgccacactagggagctctag

SEQ ID NO: 184758 - DNA, 696 bp, Artificial Sequence
  Description of Artificial Sequence: Synthetic coding sequence
atggccgagaacgacgtggacaacgagctgctggactacgaggacgacgaggtcgaaactgccgccggaggcgacggagccgaggcccctgctaaaaaagacgtgaagggcagctatgtgtctatccactccagcggcttccgtgatttcctgctgaagcccgaattgttaagagctatcgtagattgtggctttgagcacccttccgaggtgcagcatgagtgtatcccccaggcgatcctcggcatggatgtgctgtgtcaggccaagagtggcatgggaaagacagctgtgttcgtactggcgacactccagcagctcgagcctgtgactggacaggttagcgtactggtcatgtgtcacactcgcgagctcgcctttcagatctctaaagagtacgagcggttcagcaagtacatgcctaacgtcaaggtcgcagtcttttttgggggcctctcaatcaaaaaagacgaggaagtcctcaagaaaaactgcccccatatcgtggtcgggaccccaggaaggatcttggccctcgcaagaaacaagagtctcaacctgaaacatatcaagcatttcatcctggacgagtgtgataagatgttagagcagcttgacatgagacgagacgtgcaggaaatattccggatgacgccacacgaaaaacaggtaatgatgttttcagctacactgtag

SEQ ID NO: 184759 - DNA, 399 bp, Artificial Sequence
  Description of Artificial Sequence: Synthetic coding sequence
atggccgagaacgacgtggacaacgagctgctggactacgaggacgatgaggtcgagactgcagccggcggcgacggcgcagaagccccagccaagaaggacgtgaaagggagctatgtctcaatccacagtagcgggttccgcgactttctgctgaaaccggagctgcttcgtgccatcgtggattgcggctttgagcaccccagcgaggttcaacatgaatgtataccgcaggccattctcgggatggacgtcctgtgtcaggcaaagtctggcatgggaaagacagccgtttttgtactggcaactctgcaacaactggaacctgtgaccggacaggtatgcttctgtgacagtcacttccctcgaggcgataatgaggagctgcacctcccctag

SEQ ID NO: 184760 - DNA, 1053 bp, Artificial Sequence
  Description of Artificial Sequence: Synthetic coding sequence
atgtggaccatgagcagctggaccatgaagatgatgcggtggcggcagcagctgggcgagatgggactcagaccgctgccaagacgcatgtccagggcacccatgagcccctccactgcactggcatttgtgacatcctgtagctctcagtcttgctccggcccactgtccacagttgctcttagtattaggcagaaggtggcggttttcttcggaggactgagcatcaagaaggacgaggaagttttaaaaaagaactgtcctcacatcgtagtgggcaccccagggagaatccttgctttagcaaggaacaagagtctgaacctgaagcacatcaagcacttcatcctagatgagtgcgataaaatgttggagcagttagacatgaggcgcgacgtacaggagatctttaggatgactccccatgagaaacaggtgatgatgttctccgccaccctctcgaaagaaattcgccctgtgtgccggaaatttatgcaggaccccatggagatcttcgttgatgatgaaacaaagttgacactgcacggcctgcagcagtattacgtgaaactcaaagacaatgaaaagaatcgcaagctcttcgacttacttgatgtcctcgaatttaatcaggtcgttatatttgtaaaatcagtgcagaggtgcatcgctcttgcccagctattggtggagcaaaacttccccgcaatcgctattcataggggaatgccccaggaggagcgactatctcggtaccagcagtttaaagattttcagcgtagaatcctggttgccaccaacttgttcggcagagggatggacattgaacgggtgaatattgcctttaactatgacatgcccgaagatagtgatacctacctgcatcgggtcgccagagccggaaggtttggtacgaagggcctagccattacgttcgtatccgacgaaaatgacgcaaaaatcttaaacgacgttcaggacaggtttgaagtgaatatatccgaactacccgatgagattgacatttcctcatacattgaacagacccgatag

SEQ ID NO: 184761 - DNA, 738 bp, Artificial Sequence
  Description of Artificial Sequence: Synthetic coding sequence
atgtggaccatgagcagctggaccatgaagatgatgcggtggcggcaacagctgggcgagatgggcctgcggcccctcccgcgtcgaatgtcccgcgctcctatgtcacccagtacagctttagcttttgtcacgtcctgttccagccagtcatgcagcggtcctttaagcaccgtggccctgtccattagacaaaaggtggctgtgttttttggcgggctgtctattaaaaaagacgaggaggttctcaagaagaattgtcctcacattgtggtcggcaccccggggaggattctggctttagcgcggaacaagtccctaaacctgaaacatattaagcatttcatcctagacgagtgcgataagatgctggaacaattggacatgagaagggacgtgcaagaaatttttcggatgacccctcatgaaaagcaggttatgatgttctcagcaaccttgtcaaaagagatcaggcctgtctgtagaaagttcatgcaggacccgatggaaatctttgtggacgatgagacaaagctgacactgcatggcctgcagcagtactatgtcaaactgaaggataatgaaaagaataggaagctatttgacctgcttgatgtgcttgagttcaatcaggtcgtgatctttgtaaaaagcgtgcagaggtgcatcgccctcgcccagttacttgttgaacagaatttccctgcaatcgctattcacagagggatgccacagtag

SEQ ID NO: 184762 - DNA, 411 bp, Artificial Sequence
  Description of Artificial Sequence: Synthetic coding sequence
atgggcggcggccggcggccctacgacgtgttcttcagcaaggtgatggccgagaacgatgtcgacaatgaactcctggactacgaagacgatgaggtggagaccgccgctggaggcgatggtgccgaagcccccgcaaaaaaggatgtgaaggggagttacgtaagcatccactccagtggttttagagactttcttcttaagcctgaactgctccgggcaatagtggactgcggattcgagcacccaagcgaggtgcagcatgagtgtatacctcaggccattcttggaatggacgtgctgtgccaagccaaatctggaatggggaagaccgctgtgtttgtgctcgctaccctccagcagctcgaacccgtcaccggccaggtgagcgtactggtaatgtgccactag

SEQ ID NO: 184763 - DNA, 1287 bp, Artificial Sequence
  Description of Artificial Sequence: Synthetic coding sequence
atggccgagaacgacgtggacaacgagctgctggactacgaggacgatgaagtcgaaactgcagctgggggtgatggcgctgaggctccggctaagaaggacgttaaggggtcatatgtttccatccactcttctggcttcagagacttcttgctcaaacccgagctactccgggcaattgtcgactgtgggttcgagcacccgtctgaagtccagcatgagtgcatcccgcaggccatcctggggatggatgtgctctgtcaggccaaaagtggcatggggaaaactgctgtgttcgtgctggcgaccctgcaacaactcgagcccgtgaccgggcaggtgtctgtcctcgtgatgtgtcacacccgtgagttggccttccaaatcagcaaggaatatgaacggttctcaaaatatatgccaaatgttaaggtggcagtgtttttcggcggcttgtccattaaaaaagacgaggaggtgctgaagaagaattgcccacacatcgttgtgggaactcctgggaggattctggccttggcccggaacaaatccttgaatctcaagcacatcaagcacttcatcctagacgagtgcgacaagatgttggaacaacttgatatgcgaagggatgtccaggagattttcagaatgactccacatgaaaagcaagtgatgatgtttagtgcaaccctctccaaagaaatcaggcccgtgtgccgaaaattcatgcaggatcccatggagatttttgtggatgacgagacaaagctcaccctgcatgggttacagcagtactacgtaaaactgaaagacaatgagaaaaatcggaagctattcgatctcctcgacgttctggaattcaaccaagttgtaatctttgtgaagagcgtgcaaaggtgtatagccttggcacagctcctcgtagagcagaacttcccggcaatcgctatccaccgaggcatgcctcaggaggagcgccttagtcggtaccaacaattcaaggactttcagcgcaggattctcgtcgcgaccaacctgttcggcagaggaatggatatcgaacgcgtcaacatcgcctttaactatgacatgcctgaagattccgacacttacctgcaccgggttgcacgcgccgggaggttcggcaccaaaggcctggccatcacatttgtgagtgatgagaacgacgccaaaatcctgaacgatgtgcaggaccgatttgaggttaatatctccgagttaccagatgaaattgacatcagcagctacattgaacaaaccagatag

SEQ ID NO: 184764 - DNA, 594 bp, Artificial Sequence
  Description of Artificial Sequence: Synthetic coding sequence
atggccgagaacgacgtggacaacgagctgctggactacgaggacgatgaggtggaaaccgccgcaggcggggatggagctgaggccccagccaaaaaggatgtgaagggatcttacgtatctatccactcatccggcttccgagactttttgttgaagccagagctgttgagggctattgtcgattgtggttttgaacacccctccgaggtacagcacgagtgcatacctcaggccatactgggaatggatgtgctttgccaggccaagagtggtatgggaaagacagctgttttcgtgctggcaaccttacaacaactggaaccagtaactggacaagtctgcttctgtgatagccactttcccagaggggataatgaagaactacacttaccctacgttagcgtctatttcttgcctaaggtttccgtgctggtgatgtgtcatacacgggagctggcatttcagatttctaaggagtacgaacggttctcaaaatacatgcctaatgtgaaggtagcggtgttttttggcggtctgtctattaagaaggacgaggaagtcctgaaaaagaactgccctcacatcgtgtag

SEQ ID NO: 184765 - DNA, 570 bp, Artificial Sequence
  Description of Artificial Sequence: Synthetic coding sequence
tgagccaccctgcagcagctggagcccgtgaccggccaggtgagcgttctggtgatgtgtcacacccgtgagctcgcattccagatttcgaaagaatatgaacggttttcgaaatacatgcccaacgtaaaggtagctgtgttctttggtggccttagcatcaaaaaggatgaggaggtgcttaagaaaaattgtccccacatagtcgtaggcacgccgggccggattcttgcgctcgctcggaacaaatctctgaacctcaagcatatcaagcatttcatcctggacgagtgcgataaaatgttggagcaactggacatgaggcgggatgttcaggagatcttcagaatgactccgcatgagaagcaggtaatgatgttcagtgcaactttgtccaaggaaattcgtccagtctgcaggaaattcatgcaggaccctatggagattttcgttgatgacgaaactaaattgaccctgcatggattacagcagtactacgtgaaactgaaggataacgagaagaataggaagctgttcgacctccttgatgtgctcgaattcaaccagtag

SEQ ID NO: 184766 - DNA, 1287 bp, Artificial Sequence
  Description of Artificial Sequence: Synthetic coding sequence
atggccgagaacgacgtggacaacgagctgctggactacgaggacgacgaagtcgaaaccgccgcaggaggagatggggccgaagctcctgccaagaaagacgttaaaggctcttatgtgagcattcattcctccggtttccgggattttctgttgaaaccagaactgctgagagccattgtggattgcggttttgaacatccatccgaggtgcagcacgaatgcataccccaagccatcctaggcatggacgtgctgtgccaagctaaatccggtatgggtaagacagctgtttttgtgttagccacactccaacagctcgaacctgtgactggccaggtgagcgtcctggtcatgtgccacacacgtgagctggcctttcagatctccaaggagtatgagagattctctaagtacatgcctaacgtcaaagtggcagtgttctttggaggtctgtccatcaagaaagacgaagaggtactgaagaagaactgtccacacattgtcgtggggacgcctggccggattctagcgctggctcgaaataaaagcctgaatctaaagcacattaagcacttcatcctggatgaatgcgacaaaatgctggagcagttagacatgagacgcgatgtgcaggaaatctttagaatgacaccccatgagaagcaggtcatgatgtttagtgcgaccctgagtaaggaaatccgtccagtatgccgcaaatttatgcaggaccctatggagatcttcgttgatgatgaaacaaaactgaccctacatgggctccagcagtattatgtcaagttgaaggataacgaaaagaaccgaaaactcttcgatttattggatgttctcgaattcaatcaggttgtgatttttgttaaaagcgtgcagagatgcattgccctagcccagctcctcgttgaacagaattttcccgccatcgccattcaccgaggtatgccccaggaagagagactgagtcggtatcagcagtttaaagatttccagagacgtatcctggtcgctaccaacctgttcgggaggggaatggatatcgagagggtgaacatcgctttcaactacgatatgcctgaggatagcgacacctatttacacagggtcgccagagctggccgtttcggcaccaagggactggcgattaccttcgtctcagatgagaatgacgctaagatactgaatgatgtgcaggaccgcttcgaggtaaacatcagcgaacttccagacgaaattgacattagctcatatattgaacaaaccaggtag

SEQ ID NO: 184767 - DNA, 711 bp, Artificial Sequence
  Description of Artificial Sequence: Synthetic coding sequence
atggccgagaacgacgtggacaacgagctgctggactacgaggacgatgaggtcgaaacggcagctggaggagacggagccgaagcacctgcaaaaaaggacgtgaagggatcctatgtcagcattcactctagtggcttccgggactttctccttaagcctgaactcctgcgcgccattgtcgactgcggcttcgaacaccccagcgaggtacagcacgagtgtatcccacaggccattcttgggatggacgtcctgtgtcaggcaaagagcgggatggggaagaccgctgtgtttgtgctagcaaccctccagcaactggagccagtgacagggcaggtgtctgtgctcgttatgtgtcacactagggagcttgcttttcagatcagtaaggagtacgaaagattcagcaagtacatgcctaacgtaaaagtggcagtgtttttcggcggactgtctatcaagaaggacgaagaggtgctcaagaagaattgccctcatattgtcgtcggcactcccggcaggattcttgccctggcccggaataaatcactgaacctgaaacacatcaagcattttatacttgatgagtgtgacaagatgctggaacaattagacatgcgcagagacgtacaggagatcttccggatgaccccacacgaaaaacaggtaatgatgttttctgccactctcagcaaggagattaggtag

SEQ ID NO: 184768 - DNA, 564 bp, Artificial Sequence
  Description of Artificial Sequence: Synthetic coding sequence
atgggcagcagccacatcggcggcctgagcatcaacgagcggcggcgcagcgccagcctcggtctggttatggccgaaaacgatgtggacaatgaactccttgattacgaagacgatgaagtggagactgctgcaggaggggatggcgcagaggcacccgccaaaaaggacgtcaaagggagctacgttagtatccactctagcggattcagggatttcttactgaaacccgagttgctgcgcgctatcgtggactgtggattcgagcatcctagtgaggtccagcacgagtgtatcccccaggcgatactcgggatggatgtcttgtgccaggcaaagagtggaatgggtaaaactgccgtcttcgtgctggcaactctccagcagctggagcccgtcaccggccaggtttctgtgctggtgatgtgccacaccagagagttggcatttcagatcagcaaggagtacgagcggtttagcaaatatatgccgaatgttaaagttgcggtgttcttcggcggcctttcaatcaagaaggacgaggaagtgctcaaaaaaaattag

SEQ ID NO: 184769 - DNA, 399 bp, Artificial Sequence
  Description of Artificial Sequence: Synthetic coding sequence
atggccgagaacgacgtggacaacgagctgctggactacgaggacgatgaggtggaaactgcggccgggggtgatggcgctgaggcacctgccaagaaagacgtgaagggctcttacgtctctattcacagttcaggcttccgggacttcctgttgaagccggaactcttgcgagcaatcgtcgactgcggtttcgagcaccccagcgaggttcaacacgaatgcattccccaagccattctggggatggatgttctatgtcaagccaaatctggaatgggaaaaactgcagtctttgtgcttgccacactgcagcagctagagccagtgaccggccaggtgtgtttttgtgattcccatttccctcgaggggataatgaagagttgcatctcccatag

SEQ ID NO: 184770 - DNA, 1332 bp, Artificial Sequence
  Description of Artificial Sequence: Synthetic coding sequence
atggccgagaacgacgtggacaacgagctgctggactacgaggacgatgaggtggagacagctgcaggtggagatggcgcggaggccccggctaagaaggatgttaaaggttcttacgtttctatccattccagcgggttccgcgacttcctgctgaaacccgaacttcttcgcgctattgtggactgtggttttgagcacccatcggaggtgcaacacgaatgcattcctcaggctatactgggcatggatgtcctctgccaagccaagagtggcatgggcaaaaccgcggtctttgtgctggccaccctccaacagctcgagcctgtgactggacaggtgtacctgggcagagtcctgggccggggattttggtgcgtattcgtctctgtactggttatgtgtcatacacgggagctggcgttccagatcagtaaagagtatgagaggttctctaagtacatgcctaacgtgaaagtcgcggtgttcttcggtggcttgtctatcaagaaagatgaggaagtgctcaaaaagaattgtccacatatcgttgtcggtacacccgggcgaatactggctctcgcacgcaacaagagcttaaacctgaagcacatcaagcattttatactggatgaatgtgacaagatgctcgagcagctggatatgcgccgggatgtgcaggaaatttttaggatgaccccacacgagaagcaggttatgatgttctcagcaaccctcagcaaggagatacggccagtgtgtcgcaaatttatgcaggatccaatggagatcttcgtggacgatgaaacaaagttaaccctgcatggattgcagcagtattacgtgaagctaaaagataacgagaagaacaggaaactgtttgatctattggatgtgctggagttcaatcaagttgtgatcttcgtgaaatccgtacaaagatgcattgccttagcacaactgctagtcgagcagaacttcccagccatcgcaatccaccgcggcatgcctcaggaagaacgtctgagccggtaccagcagtttaaagatttccagaggaggatcctggtcgctaccaatctatttggccgagggatggacatcgaacgggtaaatattgcattcaactatgacatgcccgaggactctgacacttacctgcaccgggtagctagggcaggacgatttggaaccaaaggtctcgctatcacattcgtatctgacgaaaacgatgccaagattctcaatgatgtccaggaccgatttgaggtgaacataagtgagctccccgatgagatagacattagcagttacatagaacaaactcggtag

SEQ ID NO: 184771 - DNA, 870 bp, Artificial Sequence
  Description of Artificial Sequence: Synthetic coding sequence
atggccgagaacgacgtggacaacgagctgctggactacgaggacgatgaggtagaaacggccgctggaggggatggcgcagaagctcccgcaaaaaaggacgtgaaagggagctacgtaagcattcacagtagcggcttccgggacttcctgctgaagcccgaattgcttcgggccatagtcgattgcggattcgagcatcctagcgaggtgcaacacgagtgcatcccacaggccatccttggaatggacgtgctgtgccaagctaaatcaggaatgggcaagaccgcagtctttgtcttggccaccttgcagcagcttgaacctgtgaccggtcaggtgagcgtgctggtgatgtgccacacacgggagcttgccttccagataagcaaggagtatgagaggttctctaaatacatgccaaatgtgaaggtggcagtgttcttcggcggacttagcattaaaaaagatgaagaggtccttaagaaaaattgtccccatatcgtggttgggaccccaggcagaatcctggcactggccaggaacaagagtctcaacctgaagcatatcaagcatttcatactggacgagtgcgacaaaatgctggaacaactggacatgagaagagatgtgcaagagatttttagaatgacccctcatgaaaaacaagtgatgatgttctcggcgaccctgtccaaggaaattcggccagtgtgtagaaagtttatgcaggatcccatggagatcttcgttgacgatgagactaagcttaccttgcacgggcttcagcaatactacgttaagcttaaggataacgaaaagaatcggaagttgtttgatctgctggacgtgttggagttcaatcagtag

SEQ ID NO: 184772 - DNA, 564 bp, Artificial Sequence
  Description of Artificial Sequence: Synthetic coding sequence
tgaagcgaggagcgggacatcggcaagcccatggagatcttcgtggacgacgagaccaaactgactttgcacggcctccagcagtattacgtgaagcttaaggataacgaaaagaataggaaactgttcgatctgctcgatgtcctggagttcaaccaagtggtgatattcgtaaaatccgtccagaggtgcatcgcgttggcccagttactagtcgagcagaacttccctgctatagcaatccacaggggtatgcctcaggaagaaagattgtctcgctaccagcaatttaaggactttcagcgccgaattctggtcgcgaccaacctttttggtcgaggaatggacatcgaacgtgtaaacatcgctttcaattacgatatgcctgaggattcagacacgtacctgcatagagtggcccgagccgggcgcttcgggaccaaagggttagctatcacattcgtatctgacgagaatgacgccaaaatcctgaacgacgtacaggatagattcgaggttaacatctctgagctacccgatgagattgacatttcttcttactag

SEQ ID NO: 184773 - DNA, 411 bp, Artificial Sequence
  Description of Artificial Sequence: Synthetic coding sequence
atgggcggcggccggcggccctacgacgtgttcttcagcaaggtgatggccgagaacgatgtggataacgagctactggattacgaggacgacgaggtagaaacagccgctgggggagacggggcggaggccccagcgaagaaggatgtcaaaggatcctatgttagtatccattcctctgggtttagagactttctcctcaagcctgagctcctccgggcgattgttgactgcggatttgagcatccgagcgaggtccagcacgagtgcatacctcaggcaatcttgggaatggacgtcctttgccaggccaaatctggcatggggaagactgccgtgttcgtgcttgcaactctccagcagttggagcctgtgacaggccaggtcagtgtccttgtcatgtgccattag

SEQ ID NO: 184774 - DNA, 411 bp, Artificial Sequence
  Description of Artificial Sequence: Synthetic coding sequence
atgggcggcggccggcggccctacgacgtgttcttcagcaaggtgatggctgagaacgacgtggacaatgagttgctggactatgaggatgatgaggtcgagacagcagccggtggggacggtgcagaggccccagccaaaaaagatgtgaagggcagctacgtgagcattcattcttctggcttcagagatttcctgttgaagcctgagctgctgagggccatcgtggactgtggattcgaacacccaagtgaggtccagcatgagtgcatcccccaggccattctgggaatggacgtgctctgtcaagctaaaagtggcatgggtaaaacggctgtatttgtgcttgcgacgctccaacagctcgaacctgtcactgggcaggttagcgttctggtgatgtgccattag

SEQ ID NO: 184775 - DNA, 399 bp, Artificial Sequence
  Description of Artificial Sequence: Synthetic coding sequence
atggccgagaacgacgtggacaacgagctgctggactacgaggacgatgaagtcgagacagctgccggcggagatggggctgaagctccagccaagaaggacgtgaagggcagctatgtgtctatccactcctcaggtttccgagatttcttgctgaagccggagctgctccgggccattgtggattgtggcttcgagcaccctagcgaggtgcagcacgagtgtatcccacaagctatcctgggtatggacgtgctgtgccaagcaaagagcgggatgggcaaaactgccgtttttgtgcttgccaccttacagcagttagagcccgttactggtcaggtgtgtttttgcgactcgcactttccgagaggggacaatgaggagctgcatcttccttag

SEQ ID NO: 184776 - DNA, 711 bp, Artificial Sequence
  Description of Artificial Sequence: Synthetic coding sequence
atggccgagaacgacgtggacaacgagctgctggactacgaggacgacgaggtggagactgcagcgggaggggatggtgctgaggctcccgctaagaaggacgtgaagggctcttacgtaagtatccattctagtggctttcgcgactttctcttgaagcctgagctgctacgagccatcgtggattgcggcttcgaacatcctagcgaggtgcagcatgaatgtatacctcaggctattcttggcatggacgttctctgccaggctaaaagcggcatgggtaaaacagccgtgtttgtactggcaacactgcagcaactcgaacccgtgacaggacaagtatctgtgctggtgatgtgccatacgcgggagctggcgttccagatcagcaaggagtacgagcggtttagcaagtacatgccaaacgtgaaagtcgctgtttttttcgggggtctgagtataaagaaagacgaggaggtgcttaaaaagaactgtccacacatcgtggtcggaacgcccggtcgtattttagctcttgcccggaacaaatcactcaatttaaagcatatcaaacactttatactggacgagtgcgacaaaatgctagagcaactcgacatgcggagggatgtgcaggagatcttccggatgactccacatgaaaaacaggtgatgatgtttagcgctaccctctccaaagaaatccgatag

SEQ ID NO: 184777 - DNA, 378 bp, Artificial Sequence
  Description of Artificial Sequence: Synthetic coding sequence
atggccgagaacgacgtggacaacgagctgctggactacgaggacgacgaggtagaaaccgcagccggcggtgatggcgcagaggcccccgccaaaaaagacgtaaagggcagctatgtgtctatacattcatctggtttcagggacttcttactcaaacctgaacttctgcgcgccatcgtggattgcggtttcgaacacccatctgaagtccagcatgagtgtatcccacaggcaatcctcggcatggacgtcctgtgccaggccaagagtggtatggggaaaaccgccgtgtttgttctcgctactttgcaacagctggagccagttactggccaggtttctgttttggtgatgtgtcacacaagggagctctag

SEQ ID NO: 184778 - DNA, 987 bp, Artificial Sequence
  Description of Artificial Sequence: Synthetic coding sequence
tgagccaccctgcagcagctggagcccgtgaccggccaggtgagcgttctggtcatgtgccatactcgcgaacttgccttccagattagcaaagagtatgaaaggtttagtaagtacatgccgaatgtcaaggtcgccgtttttttcggaggtctgtctattaaaaaggatgaagaggtcctaaaaaagaattgtccccatattgtcgtagggacccctggaaggattctggccctggcccgcaataagagcctgaacctcaagcatatcaaacatttcatcttggatgagtgtgacaagatgttagagcagctagacatgaggcgtgatgtgcaggagattttcaggatgacaccgcatgaaaagcaagtgatgatgtttagcgcaaccttatctaaggagataagacccgtgtgtcgcaagtttatgcaagatccaatggagatatttgtggacgacgaaacaaagctcacgttacacggtctccagcagtattacgtgaagcttaaggacaacgaaaagaataggaaactgtttgatcttctcgacgtgctagaattcaatcaggtggtgatctttgtgaaatctgttcagagatgcatagcattggctcaactcctcgtggagcagaactttcccgccattgcgattcatagaggtatgccacaagaggaacgattgagcaggtaccagcaattcaaagactttcagcgaaggattcttgtagctacaaacctctttggtagagggatggacattgagagagtaaacattgcatttaattatgacatgccagaagactccgacacataccttcatcgagtggctcgcgccggccgattcggaacaaagggactcgccattacatttgtgtcagatgagaacgacgcaaagatcctaaatgacgttcaggatagatttgaagtgaatatctctgagttacctgacgaaatcgacatttcaagttacatagagcaaacgaggtag

SEQ ID NO: 184779 - DNA, 711 bp, Artificial Sequence
  Description of Artificial Sequence: Synthetic coding sequence
atggccgagaacgacgtggacaacgagctgctggactacgaggacgacgaggtggaaacagcagccgggggagacggcgcggaagcgccggctaaaaaagatgtcaaagggtcctatgtgagtatccattcatccggttttagagatttcttactcaaacctgagcttctgagagccatcgtggattgcggctttgagcatccttccgaggtgcagcacgagtgcatcccgcaggccattctggggatggacgtgctgtgccaggctaaaagcgggatgggcaaaaccgctgttttcgtcttagccaccctgcagcagctcgagcccgttaccgggcaggttagtgtcctggtgatgtgtcacacaagagaactggcctttcagatctccaaagagtacgagaggttcagcaagtacatgccaaatgtgaaggtggctgtattttttggaggtctgtccatcaagaaggacgaggaagtactcaagaagaattgcccccatatcgtagtgggcacccctggacgtattctcgcattggccaggaataagtccctgaatctcaagcacattaagcacttcattttggacgagtgtgataaaatgttggaacagctcgacatgaggcgcgacgttcaggagatattccggatgacaccacacgaaaagcaagtgatgatgttcagtgcgacactttctaaggaaataagatag

SEQ ID NO: 184780 - DNA, 564 bp, Artificial Sequence
  Description of Artificial Sequence: Synthetic coding sequence
tgaagcgaggagcgggacatcggcaagcccatggagatcttcgtggacgatgaaacgaaactgacattgcacggactgcaacaatactacgtgaagctgaaagacaatgaaaagaataggaagctcttcgacctgctggacgttttggagttcaatcaggtcgtgatttttgttaaaagtgtacaacgatgtatcgcccttgcacagctgcttgtggaacagaactttcctgccattgctatccaccgcggcatgcctcaggaggagcggctctccaggtatcagcaattcaaagatttccagcggaggatacttgtcgcaacaaacctgtttggcagaggcatggatattgaaagggtcaatattgcctttaattacgacatgccagaagattctgacacatacctgcatcgcgtggccagagctgggcggtttgggacgaaagggctcgccataacctttgtgagtgatgagaacgacgccaagatcctaaacgacgtgcaggatcggtttgaagtgaacataagcgaacttccggatgaaattgacatatcttcttattag

SEQ ID NO: 184781 - DNA, 378 bp, Artificial Sequence
  Description of Artificial Sequence: Synthetic coding sequence
atggccgagaacgacgtggacaacgagctgctggactacgaggacgacgaggttgagacggctgctgggggcgacggtgccgaggcacccgctaagaaagacgtgaaagggtcttacgtgtccatacattcatctggatttcgggatttcttactgaagccggagttgctgcgagctattgttgactgtggcttcgagcatcccagcgaggttcagcatgagtgcataccccaggctatcctgggcatggatgtgctatgtcaggccaagtcagggatgggcaagacagcagttttcgtgcttgctacactgcagcaactggagccggtgacagggcaggtgagtgtcctcgtgatgtgccataccagagagctttag

SEQ ID NO: 184782 - DNA, 291 bp, Artificial Sequence
  Description of Artificial Sequence: Synthetic coding sequence
atggccgagaacgacgtggacaacgagctgctggactacgaggacgacgaagtcgaaacggctgccggcggcgacggagcagaagccccagccaagaaggacgtcaaaggcagttatgtcagcatccatagcagcggctttagagactttctcctgaagcctgaactgcttagggctatagtggactgtggatttgaacacccttccgaagtgcagcatgagtgtattcctcaagctatcctggggatggacgtgctgtgtcaagcgaaaagtggaatgggaaagacatag

SEQ ID NO: 184783 - DNA, 378 bp, Artificial Sequence
  Description of Artificial Sequence: Synthetic coding sequence
atggccgagaacgacgtggacaacgagctgctggactacgaggacgatgaggttgaaacagctgcgggtggagatggggctgaggcccctgccaagaaggacgtgaagggatcgtatgtgtctatccactcttcaggtttccgggattttctgcttaaacccgaactgctgagggccatcgtcgactgtggattcgagcatccgagtgaagtccagcacgaatgtattccccaggctatcctggggatggatgtgctctgtcaagctaagtccggcatgggcaaaactgctgtgtttgtgctggctactctgcaacagctcgagcccgttaccgggcaggttagcgtactggtgatgtgccacacgcgcgaactgtag

SEQ ID NO: 184784 - DNA, 987 bp, Artificial Sequence
  Description of Artificial Sequence: Synthetic coding sequence
tgagccaccctgcagcagctggagcccgtgaccggccaggtgagcgtactggttatgtgccacacacgcgaacttgcttttcaaatctctaaggagtatgagaggttcagtaagtacatgcccaatgtgaaggtggccgtctttttcggcggtttgtctatcaaaaaggatgaagaggtgctcaagaaaaattgtccgcacatcgtagtggggaccccgggccgcatcctggccttggcacgcaacaaaagcctaaatctcaaacacataaagcactttattctcgatgagtgtgataaaatgctggaacaattggatatgaggagagacgtgcaggagatctttcgcatgactccacacgagaagcaagtaatgatgttcagcgccaccttgagcaaggagattagacccgtgtgccggaagtttatgcaagacccgatggagatctttgttgacgacgagacaaagctaacactacacggtctgcagcagtactacgtgaaacttaaggataatgaaaagaatagaaaattgttcgacctgttagacgtgctcgagtttaaccaagtagttatcttcgttaaatcagtgcagcgatgcatcgcactagctcaattgcttgtcgagcagaattttccggctattgcaatccaccgtgggatgccccaggaggagcgattgtctcgataccaacagttcaaggatttccagcggcggattttggtcgcaacaaacctcttcggaaggggcatggacatcgagcgtgtgaacatcgctttcaactatgacatgcccgaggactcagatacctatttgcaccgtgtcgctagggcaggcaggtttggcacgaaaggcttagctatcacattcgtctctgatgaaaacgatgcaaagattctgaatgatgtgcaggatagattcgaagtgaatataagcgagttaccagatgaaatcgacatcagtagctatatagaacagaccaggtag

SEQ ID NO: 184785 - DNA, 870 bp, Artificial Sequence
  Description of Artificial Sequence: Synthetic coding sequence
atggccgagaacgacgtggacaacgagctgctggactacgaggacgatgaggttgagaccgccgcaggcggggatggggctgaagcccctgccaagaaggacgtgaaggggagctacgtatctatccactccagcgggttcagggatttcctcctgaaacccgagttgctccgagccatcgtggattgcggcttcgagcatcctagtgaagtgcagcatgagtgcatcccgcaggctatcctggggatggacgtactatgtcaggccaagtctgggatgggaaaaacagccgttttcgtactggcaacactgcagcaacttgagcccgtaaccggtcaggtcagtgtgttagtgatgtgccacacgagggaattggctttccagatcagtaaagaatacgagagattcagcaaatatatgcctaacgtgaaagtggccgtgtttttcggagggctgtctattaagaaagacgaggaagttttgaaaaagaactgtccacacatcgtggtgggcacaccagggcggatcctggccctggcacgcaataaatccctgaacctgaaacacattaagcattttattctcgatgaatgcgataaaatgctggagcagctcgatatgcgtcgagatgtgcaagaaatatttcgcatgaccccacacgaaaaacaggtcatgatgttctccgctactctctcaaaggaaattcgcccagtttgtagaaaatttatgcaggatcctatggagattttcgttgatgatgagaccaaactcactctacatggactgcagcagtattatgtaaagctaaaagataacgaaaaaaaccggaagctgtttgatctcctggacgtgctagagtttaaccagtag

SEQ ID NO: 184786 - DNA, 738 bp, Artificial Sequence
  Description of Artificial Sequence: Synthetic coding sequence
atgtggaccatgagcagctggaccatgaagatgatgcggtggcggcagcaacttggggagatgggtctgcggcccctccctcgacgcatgtcccgtgctcctatgtcaccatccactgccctagccttcgtaacgagctgctcatcccaatcgtgttccggtcccctgtcaactgtagccctgagcattcgccagaaggttgcggtttttttcgggggccttagcatcaaaaaggatgaagaagtcttaaaaaagaattgtccccacattgtcgtaggcactccaggacggatacttgcactggcacgcaataagtctctgaacctgaagcacattaaacactttatcctggacgaatgcgataaaatgcttgagcagctcgatatgagacgggacgtgcaggaaatctttaggatgacaccccacgaaaaacaggtaatgatgtttagtgcaacactgagcaaagagatcaggccagtctgccgcaaattcatgcaggatccaatggaaatcttcgtggacgacgaaaccaagctaacacttcatggcttgcagcagtactatgtaaaacttaaggataacgagaagaaccgaaagttatttgacctgctagatgtcttggagttcaaccaggttgttatctttgtgaagagcgtccaacgttgtatagccttagctcagttattggtggaacagaacttcccggcaattgctatacacaggggcatgcctcagtag

SEQ ID NO: 184787 - DNA, 738 bp, Artificial Sequence
  Description of Artificial Sequence: Synthetic coding sequence
atgtggaccatgagcagctggaccatgaagatgatgcggtggcggcaacaactcggagaaatgggcctgcggccacttccccgccgcatgagccgggccccaatgagcccaagcaccgctctagcattcgtgacttcttgtagctctcaaagctgctctggacccctgagcacggttgctctgagcatccggcagaaagttgctgttttcttcggagggctgtccattaagaaagacgaagaggtgctgaagaagaactgtccacatattgttgtcgggacgccaggcagaatattggccctagccagaaacaaatctctgaatctgaaacatattaaacactttatcctggacgagtgcgataagatgctagagcaactcgatatgcgccgcgatgtgcaggaaatttttaggatgaccccccacgaaaagcaggtaatgatgttttctgctacactgtccaaggagatacggcctgtgtgccggaagttcatgcaagacccaatggagatatttgttgatgatgagacaaaactgacattgcacggcctccagcagtattatgtgaagcttaaggataacgaaaaaaatcgcaagctgtttgatctgctagacgttttagagttcaaccaggtcgtcatcttcgtcaagtctgtgcagcgctgtatcgccttagcacagctcctggttgaacagaatttcccagccattgctatacacagggggatgcctcaatag

SEQ ID NO: 184788 - DNA, 396 bp, Artificial Sequence
  Description of Artificial Sequence: Synthetic coding sequence
tgagccaccctgcagcagctggagcccgtgaccggccaggtgagcgtgctggtgatgtgccacacccgggaactggcatttcaaatctctaaagagtacgagcggttctcaaagtatatgcctaatgtaaaagtggcggtgtttttcgggggtctgagcatcaagaaggacgaagaagtattgaaaaagaattgtcctcacattgtggtgggcacacccggacgaattcttgcgctcgcgcgcaataagagtctcaacttgaagcatataaaacatttcatactggatgaatgcgacaaaatgctggaacagctggacatgagaagggacgtgcaggaaatctttcggatgacccctcacgagaaacaagttatgatgtttagtgccactctttag

SEQ ID NO: 184789 - DNA, 411 bp, Artificial Sequence
  Description of Artificial Sequence: Synthetic coding sequence
tgagccaccctgcagcagctggagcccgtgaccggccaggtgagcgttctggtgatgtgtcatacaagggagttagcttttcagatttccaaggaatatgagaggttttcgaagtacatgcccaatgttaaggtggcagtgttcttcggtgggctgtccatcaaaaaggacgaagaggttcttaaaaaaaactgcccacatattgttgtaggaacccccgggagaatcttggcactggcacgtaacaagtccctaaatctgaagcatattaaacacttcatcttggatgaatgcgacaaaatgctggaacaactggacatgaggcgcgatgtccaagagatctttagaatgaccccgcacgaaaagcaagttatgatgttctcagcgactctgagcaaggaaattagatag

SEQ ID NO: 184790 - DNA, 717 bp, Artificial Sequence
  Description of Artificial Sequence: Synthetic coding sequence
atggccgagaacgacgtggacaacgagctgctggactacgaggacgatgaggttgaaaccgccgccggtggagacggcgcagaggcacccgctaagaaagacgtgaaaggaagctatgtgtcaatccactcttcaggtttcagagacttcctcctgaaacctgaactgctccgtgccatcgtagattgcggctttgagcaccccagcgaagtccagcatgagtgcattcctcaggcgatcttagggatggatgtcctatgccaggcaaagagcgggatggggaaaacagccgtatttgttttagcaaccctccagcaacttgagccggtcaccgggcaggtctctgtgcttgtaatgtgtcacactcgagaattggctttccagatcagtaaagagtatgagcgattctctaaatatatgcctaacgttaaggttgccgtcttttttgggggactgagcatcaaaaaggacgaagaagtcctgaagaaaaactgtcctcacatcgtggttggcactcccggtcgaattttggccctggctcgcaacaagtcgcttaacctcaaacatataaagcatttcattttagacgagtgtgataagatgttggaacagcttgatatgcgcagggatgtgcaggaaatctttcgcatgacacctcacgaaaaacaggtcatgatgttttccgccactctcagtaaagagataaggccagtgtag

SEQ ID NO: 184791 - DNA, 564 bp, Artificial Sequence
  Description of Artificial Sequence: Synthetic coding sequence
tgaagcgaggagcgggacatcggcaagcccatggagatcttcgtggatgatgaaaccaagttaacccttcatggattacaacaatactatgttaagctcaaggacaacgagaaaaaccgaaagctgttcgatctgctggacgtcctggaatttaaccaggttgtgattttcgtaaaaagcgtgcagcgctgtatcgctctcgcccagcttctcgtcgaacagaattttcctgccatcgccatccatagaggtatgccacaagaggaaagactgagtagatatcaacagttcaaagacttccagagacgcatcctcgtggccaccaacctttttggtaggggcatggatatcgagcgcgtcaacatcgcctttaattacgacatgcctgaagactctgacacatacctccatcgtgtggcaagagccgggcgctttggtactaaagggctggcaattacattcgtgtccgatgagaatgacgcgaagatcctgaatgacgtacaagaccgctttgaggttaacatttcagaactgcccgacgagattgatatcagctcctattag

SEQ ID NO: 184792 - DNA, 594 bp, Artificial Sequence
  Description of Artificial Sequence: Synthetic coding sequence
atggccgagaacgacgtggacaacgagctgctggactacgaggacgacgaggtggagaccgctgccggcggagacggagcggaggcccctgccaagaaggacgtcaaaggaagctatgtctccatccatagctctggatttcgtgatttcctgctgaaacccgaattgctacgggccatcgttgattgtggcttcgagcaccccagtgaggttcagcacgagtgcataccccaggcaattcttggcatggacgtgctgtgtcaggccaaatccggcatgggcaaaacagccgttttcgtgctggccaccttgcagcagctggagccggtcacggggcaggtgtgcttttgtgactcacatttccctagaggagacaatgaggagctccatctcccctacgtgtcagtctatttccttccaaaagtgtccgtgctggtgatgtgtcacacgcgcgaactcgccttccagatcagtaaagagtacgagcgcttctcaaaatatatgcctaatgtgaaagtagctgtcttcttcgggggcctctccataaagaaggacgaggaagtgctcaaaaaaaattgcccccatattgtttag

SEQ ID NO: 184793 - DNA, 594 bp, Artificial Sequence
  Description of Artificial Sequence: Synthetic coding sequence
atggccgagaacgacgtggacaacgagctgctggactacgaggacgacgaggtagaaacggccgccggcggcgatggtgccgaggccccagcaaagaaagacgtaaaaggaagctatgtcagtatccacagctctgggtttagggattttctgctgaagccggaactgctacgagctattgtggattgtggtttcgaacatccgagcgaagttcagcatgagtgcatcccgcaggctatcctgggcatggatgtgctgtgccaagctaaatccgggatgggcaagacagcagtctttgtgttggccactctgcagcaactcgagccagtgactggccaagtgtgtttctgtgactcccatttcccacgaggcgataacgaagagcttcacttgccatatgtgtcagtttacttcctccctaaggtgagcgtcctggtgatgtgccatactcgtgagttggcatttcagatcagtaaggaatatgagcgcttctccaaatatatgccaaatgtcaaagtggccgtcttcttcggcgggctgtccatcaaaaaagacgaagaagtgctcaagaagaattgcccccacatagtgtag

SEQ ID NO: 184794 - DNA, 411 bp, Artificial Sequence
  Description of Artificial Sequence: Synthetic coding sequence
atgggcggcggccggcggccctacgacgtgttcttcagcaaggtgatggccgaaaatgacgttgataatgagttattggactacgaggacgacgaagttgaaaccgctgcagggggggacggcgccgaggccccagccaagaaggatgttaaaggctcatatgtctccattcattcaagcgggtttagggacttcctgctgaagcccgagctgttgcgggccatcgttgattgcggatttgagcatccaagcgaggtgcagcacgagtgtatcccccaggccatcctgggaatggacgttctatgccaggcgaagtccggtatggggaagacagcggtgttcgtgcttgccacactccagcagctcgagcccgtgacgggacaggtaagcgtcttggtgatgtgccactag

SEQ ID NO: 184795 - DNA, 1278 bp, Artificial Sequence
  Description of Artificial Sequence: Synthetic coding sequence
atggccgagaacgacgtggacaacgagctgctggactacgaggacgatgaggtggagacggcggcaggaggggatggggccgaagcgcctgcaaaaaaggacgtcaaaggaagttatgtctctatccacagtagcgggttcagggactttttactcaaacccgaacttctgagggccatagtcgactgcgggtttgagcacccaagcgaggtacaacacgagtgtatcccccaggccatcttgggtatggacgtgctgtgccaggccaaatccggcatggggaagacagcggtcttcgtgctcgccactctgcaacagctggagcctgtaactgggcaggtatctgtactggtgatgtgtcacactcgggagttggcgttccagattagcaaagaatatgaacgattttctaaatacatgcctaatgtaaaagtggccgtgttcttcggtggattgagtatcaagaaggacgaggaagtgctgaaaaaaaattgcccgcacattgtggtgggcactcctggaagaatcctcgccctggcccggaacaaatccctgaacttaaagcacattaaacatttcattctggatgagtgcgacaaaatgctggaacagcttgatatgaggcgggacgtccaggagatcttcaggatgactccccatgaaaagcaggttatgatgttttcagctacactgtctaaagaaatccgtcccgtgtgccggaaattcatgcaggaccccatggagatcttcgtcgatgatgagacaaaactaactctgcacgggttacagcagtactacgtgaagctaaaagacaatgagaaaaatagaaaattatttgacctgcttgacgttcttgagtttaatcaagttgtaatattcgttaaatctgtgcagaggtgcattgcattggcacagctgctcgtggaacagaactttccagctatcgccatccacaggggcatgccccaggaggagaggctgtctcgttaccagcagttcaaagactttcagaggagaatcctggtggccacaaaccttttcggaagggggatggacatcgaaagagtaaatatcgcctttaattatgatatgcctgaagacagcgacacttatctccataggtgttacccgctttcaccctcaaggtggcccgaacaggccggactcgccccacgagcttggctctcacacctgtgtccaatgcgaatgatgcctcggtcatcaatgatgtgtaggatcgcgctgcgctcgatcctcgtgagttgcttgatgaggtag

SEQ ID NO: 184796 - DNA, 1287 bp, Artificial Sequence
  Description of Artificial Sequence: Synthetic coding sequence
atggccgagaacgacgtggacaacgagctgctggactacgaggacgacgaggtcgagaccgcagccggcggagacggcgccgaggcccccgccaagaaggatgttaagggctcctatgtaagtatccactcctctggctttcgtgatttcttactcaaacctgagctccttagggcgattgtagattgtggtttcgaacacccctctgaggtgcaacacgagtgcataccacaagcgatattaggcatggacgtgctctgtcaggcaaaaagcggaatggggaagactgccgtgtttgttctcgctacactgcaacagctcgaacccgttacgggacaggtgagcgtactcgtgatgtgccacacacgagagcttgcttttcagatctctaaagagtatgaaaggttcagcaagtacatgcccaacgtgaaagtcgccgtgttcttcggaggcctaagcatcaagaaggacgaagaggttctcaaaaaaaattgtccacacattgtggtggggactcctggaaggatcctggcattggcccggaacaagagcctgaacctgaaacacataaaacacttcatcctggatgaatgtgataagatgctggaacagctggatatgagacgcgacgtgcaggagatcttccgcatgaccccccacgaaaaacaggtgatgatgttctcagcgaccctgagcaaggagatcaggccagtctgtcgcaagttcatgcaggaccccatggaaatttttgtagatgatgagacaaaattgaccctccacggtttgcaacaatattacgtcaaactgaaggataacgaaaaaaaccgcaaattgttcgacctgttagacgtgctggagttcaaccaagtggttatcttcgtaaaatctgtgcagcgctgcattgccctggctcagctcctggtggaacaaaacttcccggccattgccatacaccgcgggatgcctcaggaggagaggctatccagataccagcagttcaaagacttccaacgacgcatcctagtcgctactaatcttttcggaaggggtatggatattgaacgggtcaacattgcttttaactatgacatgccagaagattccgatacttacctgcatcgtgtggccagggccgggagattcgggactaagggtctggctattacgttcgtctctgatgaaaatgatgctaaaattttgaacgatgtgcaggaccgatttgaggttaatatctcggaactgccagatgaaattgacatttcttcctacatagaacaaacaagatag

SEQ ID NO: 184797 - DNA, 1287 bp, Artificial Sequence
  Description of Artificial Sequence: Synthetic coding sequence
atggccgagaacgacgtggacaacgagctgctggactacgaggacgacgaagttgagaccgccgctgggggagatggcgcagaagcacccgccaaaaaggatgtcaaaggcagctacgtgtccatacacagcagtgggtttagggatttccttctcaagccagaactgcttagggccattgtggactgtgggttcgagcatccctccgaggtccagcacgagtgtattccccaggccatccttgggatggacgtgctctgccaagccaaatcggggatgggtaagaccgccgtgttcgtactggccacacttcaacagctcgaacccgttacagggcaggtaagtgtgttggtcatgtgccacacacgagaattagcgttccagatcagtaaggaatacgagcggttcagtaagtacatgccgaacgtcaaagtcgcagttttttttggggggctctcaattaagaaggacgaggaggtgttgaagaagaactgccctcatattgtggtgggtaccccaggtagaatcctggcactcgcacggaataagtctctcaacctgaaacacataaaacacttcattctcgacgagtgcgacaagatgctggagcaacttgacatgaggcgtgacgttcaggagattttcaggatgacaccgcacgaaaaacaagtgatgatgttcagtgcaacattatctaaggagataagaccagtgtgtcgtaagtttatgcaggaccctatggagatcttcgttgatgatgagaccaagctgacgctccatggtcttcagcagtactatgtgaaactgaaagataatgaaaagaatcgtaaactattcgatctattggacgtcctagaattcaaccaggttgtaatctttgtcaaaagcgtgcagagatgcatcgcccttgcccagctgctagttgagcagaattttccagctattgccatacatcgcggtatgccacaggaagaaaggcttagcagatatcagcagtttaaggatttccagcgccgaattttggtggcaacaaatctgttcggaaggggtatggacatcgagagagtcaacatcgcctttaactatgacatgccagaggactctgatacgtaccttcatcgagtggcccgggcaggccggttcggtacaaaagggcttgctatcacctttgtgtccgacgagaacgatgccaagatccttaacgacgtgcaggataggttcgaggttaacatcagcgaactgcccgatgagatcgatatttcatcctatattgaacaaactagatag

SEQ ID NO: 184798 - DNA, 738 bp, Artificial Sequence
  Description of Artificial Sequence: Synthetic coding sequence
atgtggaccatgagcagctggaccatgaagatgatgcggtggcggcagcaactgggagaaatggggctccggcctctcccgcggcggatgtctcgagccccaatgagtccctctactgccctagccttcgtgaccagttgctcctcacagtcatgcagtggaccactgtcaacagtcgccctgtcaatccgccagaaggtggcggtattttttggaggattgtcaattaagaaggacgaggaagtgttaaaaaaaaattgtccccatattgttgtgggcacacccggtcggatcctggccctggctcggaacaaatctctcaacctgaaacatatcaagcatttcatcctcgacgaatgcgacaagatgctggagcagctggacatgaggagggacgtgcaagaaatctttcggatgaccccgcatgagaagcaggtaatgatgtttagtgccacgctgtctaaagagatccgccccgtgtgccgaaagtttatgcaggatccaatggagatttttgtggacgacgagaccaagctcactctgcatggactgcagcagtactatgtgaaactgaaagacaatgaaaaaaataggaagctcttcgatctgctcgacgtcttggaatttaatcaggtggtgattttcgtgaaatctgttcaaagatgcattgctttggcacagcttctcgtcgagcagaatttccccgcaattgcaatacaccgcggaatgccccagtag

SEQ ID NO: 184799 - DNA, 696 bp, Artificial Sequence
  Description of Artificial Sequence: Synthetic coding sequence
atggccgagaacgacgtggacaacgagctgctggactacgaggacgacgaggtggaaactgccgcaggaggagacggcgcggaggcaccagccaagaaggacgtgaaaggatcgtatgtgtccatacactcaagtgggttccgggatttcctgctgaaacccgagttactccgagcaatcgtcgattgcggcttcgagcaccccagcgaggtccaacatgagtgcattcctcaggccatccttgggatggatgtcctatgccaggcgaagtccggcatgggcaagaccgcggtcttcgtgttggccacactccagcagctggaacccgtaacggggcaggtgtccgtactcgtgatgtgccacactcgggagctggccttccagatcagtaaggagtatgaacggttcagcaaatatatgccaaatgtgaaggttgcagttttttttggcggcctatcaattaaaaaggatgaagaggtactgaaaaaaaactgcccacacattgttgtcggcacccccggccggatccttgcgctcgccaggaacaagtccctgaacctgaagcacattaagcacttcatactggatgagtgtgataagatgttggagcagctggacatgcgccgcgacgtccaggagatctttcggatgactccgcatgagaaacaggtcatgatgttcagcgccacattgtag

SEQ ID NO: 184800 - DNA, 594 bp, Artificial Sequence
  Description of Artificial Sequence: Synthetic coding sequence
atggccgagaacgacgtggacaacgagctgctggactacgaggacgacgaggtagaaacggctgccgggggagatggtgcagaggctccagcaaagaaggatgtgaagggaagttatgtcagcattcattcatcggggttcagggacttcttactaaagcccgaattgttgcgggccatagttgactgcggattcgaacatccttctgaagtgcagcatgagtgtatcccccaggccatcctaggcatggacgtcctctgccaagccaaaagtgggatgggtaagacagccgtattcgtgttggccactctgcagcagcttgaaccagtgacaggccaggtgtgcttttgcgactcacatttcccaagaggggacaatgaggaactgcatttgccctatgttagtgtgtacttcctaccaaaagtgagcgtgctggttatgtgccatactagagagttggccttccagatctcgaaggagtatgagcgattttctaagtacatgccgaacgtgaaggttgcggtattcttcggggggctctctattaaaaaggatgaagaggttttgaagaagaactgcccacacatcgtttag

SEQ ID NO: 184801 - DNA, 594 bp, Artificial Sequence
  Description of Artificial Sequence: Synthetic coding sequence
atggccgagaacgacgtggacaacgagctgctggactacgaggacgatgaggtggagaccgcagctggcggtgatggagccgaagccccagccaaaaaggatgtgaaagggagctatgtatccatccactcctcaggcttccgcgactttctcttgaagcccgaattgctgcgcgcaatagtggactgtgggtttgagcacccttcagaagtacaacacgagtgtatcccacaggccattctggggatggatgtcctgtgccaggctaagagcggcatgggaaaaacagctgtattcgttctcgcaaccctgcagcagctggagcccgttactggccaggtctgtttctgcgactcacacttcccgcggggggacaatgaagagctgcaccttccctacgtatctgtgtactttctgcccaaagtgtcggtcttggtaatgtgccatacgcgtgagctggcattccagatttctaaggaatacgagcgattctcgaagtatatgccaaatgttaaggtggccgtcttctttggtggcctgagcatcaaaaaggatgaggaggttctgaaaaagaattgcccgcatatcgtctag

SEQ ID NO: 184802 - DNA, 540 bp, Artificial Sequence
  Description of Artificial Sequence: Synthetic coding sequence
gtggccgtgttcttcggcggcctgagcatcaagaaggacgaggaggtgcttaaaaagaattgtccccatatcgttgtggggactcctggtagaatcctggctttggcacgcaataagtcacttaacctgaaacacatcaaacacttcatccttgatgaatgcgataaaatgctggaacaacttgacatgagacgcgacgtgcaggaaatcttccggatgacgcctcacgagaaacaagtaatgatgttcagcgccacgctgtccaaggaaatccgccccgtctgccgcaagttcatgcaggatcccatggagatatttgttgacgacgaaactaaactgacgttgcacggtctacaacagtattatgtaaagctgaaggacaacgaaaaaaatcgaaagctgttcgacctgttagacgtgctcgaattcaaccaagtggtaattttcgtgaagagcgtccagcgctgtattgccttggcacagctgttggttgaacagaactttccggcgatagcaatacatcgcgggatgccacagtag

SEQ ID NO: 184803 - DNA, 594 bp, Artificial Sequence
  Description of Artificial Sequence: Synthetic coding sequence
atggccgagaacgacgtggacaacgagctgctggactacgaggacgacgaggttgagacagctgctggcggggatggcgccgaggcaccagccaaaaaggatgtgaaggggtcgtatgtctccatccactccagtggattccgagacttccttctgaaacccgaactccttagagctattgtggattgcggttttgaacatccatcggaagtacagcatgaatgcatcccccaggccatccttgggatggacgtattatgccaagctaagtcgggaatggggaaaacagccgtatttgtgctcgctactcttcaacagctcgaaccagtcacgggacaggtgtgtttctgcgacagtcatttccctcgcggtgacaacgaggagctgcacctgccctatgtgtcagtttacttcttacccaaagtgtccgtgctggtgatgtgccacactcgtgaactggcttttcagatttcgaaggagtacgagcgattctcgaaatatatgcctaatgtgaaagtagctgtgtttttcggaggtctctctataaaaaaggatgaggaggtgttgaagaagaattgcccccacatagtgtag

SEQ ID NO: 184804 - DNA, 564 bp, Artificial Sequence
  Description of Artificial Sequence: Synthetic coding sequence
tgaagcgaggagcgggacatcggcaagcccatggagatcttcgtggatgacgaaaccaagctcaccctgcacggactacagcagtattatgtcaagctcaaggataacgagaagaatcgaaagttatttgatctgctggatgtgctggagttcaatcaggtggtgatttttgtgaagtccgtgcaacggtgcattgcgctggcacaattattggttgagcagaactttccggctatcgcaattcacagaggaatgccgcaggaggaacgcctgagcagatatcagcaatttaaggactttcagagacgcatactggtagcaaccaatctgttcggccgcggaatggatatagagagagtgaatatagctttcaattacgatatgcctgaggacagcgacacctacctgcacagagtcgcaagagctggacgattcggtaccaaaggcttagctatcacgtttgtgtcggacgaaaatgacgcaaagatccttaacgacgtgcaggacagattcgaagttaacataagtgagctgcctgatgaaatcgacataagttcatactag

SEQ ID NO: 184805 - DNA, 195 bp, Artificial Sequence
  Description of Artificial Sequence: Synthetic coding sequence
tgagccaccctgcagcagctggagcccgtgaccggccaggtgagcgtgcttgtcatgtgtcacacacgtgagctggccttccagataagcaaggagtacgagcgtttcagcaagtatatgcctaacgtaaaagtcgctgttttcttcggcggccttagcataaagaaggatgaggaagttctgaagaaaaactag

SEQ ID NO: 184806 - DNA, 78 bp, Artificial Sequence
  Description of Artificial Sequence: Synthetic coding sequence
tgagccaccctgcagcagctggagcccgtgaccggccaggtgagcgtgctggtcatgtgccataccagagagctatag

SEQ ID NO: 184807 - DNA, 66 bp, Artificial Sequence
  Description of Artificial Sequence: Synthetic coding sequence
tgagccaccctgcagcagctggagcccgtgaccggccaggtgagcgtgctggttatgtgccactag

SEQ ID NO: 184808 - DNA, 870 bp, Artificial Sequence
  Description of Artificial Sequence: Synthetic coding sequence
atggccgagaacgacgtggacaacgagctgctggactacgaggacgatgaggttgaaacagccgctggcggagacggggcagaagccccggctaaaaaggatgtgaaggggtcctatgtcagtatacattccagtgggttccgcgattttttgctgaagcccgagctccttcgagctatcgtggactgcggatttgagcacccatctgaggttcaacacgaatgtatcccccaggctatactgggcatggatgtgctttgtcaggctaaatccggcatgggtaaaacagcagtgttcgtgctagctaccctgcagcagttggaacctgttacagggcaggtgtctgtgctggtgatgtgccacactcgggaattggcgttccaaattagcaaagagtacgaacgcttctcaaaatacatgcccaatgtgaaggtggctgtgtttttcggcggtctgagcattaagaaagatgaagaggttctcaaaaagaattgccctcacatcgtggtaggcaccccaggcaggatcctggctctcgcccggaataagtcacttaaccttaaacacatcaagcactttatcttggatgaatgcgataagatgctcgagcagctggatatgaggagagatgtccaggaaatcttcaggatgaccccccatgagaaacaggtgatgatgttctctgcaactctgtctaaggagatcagaccagtgtgcaggaaattcatgcaggatcctatggagattttcgtggacgatgaaacgaaattgactctgcatggcctccagcaatattacgtcaagttaaaagacaatgagaagaaccgaaaactgttcgatctgctggatgtcctggagttcaaccagtag

SEQ ID NO: 184809 - DNA, 711 bp, Artificial Sequence
  Description of Artificial Sequence: Synthetic coding sequence
atggccgagaacgacgtggacaacgagctgctggactacgaggacgatgaggtggaaacagccgccggcggtgacggagccgaagctcctgcaaagaaggatgtgaaagggagctacgtgtcaatacacagttcaggcttccgagactttctgctgaaaccggagctgttgcgtgcaatcgtggattgcgggtttgagcacccgtccgaggtccagcacgagtgtatcccccaggccatcttaggaatggatgtcttgtgccaagctaaatcaggaatgggcaagaccgctgtctttgtgttggccactctacagcagctcgagccggtcaccgggcaagtcagcgtgctggtgatgtgccacacaagagaactggcttttcagatcagcaaggagtacgaaagattctctaaatatatgcccaatgtgaaggtggccgtgttcttcggaggcttatctatcaaaaaggacgaggaagtgctgaaaaaaaactgtcctcacatcgtggtcgggacgcctgggagaatccttgccttggccaggaataaaagcttgaatttgaagcacattaaacattttattttggacgagtgtgacaaaatgttggaacagctcgatatgagacgggatgtacaggagatctttagaatgacccctcatgagaagcaggtgatgatgttcagtgccaccctttcaaaagaaatacggtag

SEQ ID NO: 184810 - DNA, 711 bp, Artificial Sequence
  Description of Artificial Sequence: Synthetic coding sequence
atggccgagaacgacgtggacaacgagctgctggactacgaggacgacgaggtggagacagccgctggcggcgatggtgctgaagcccccgccaagaaagatgttaaaggtagttacgtgtccattcacagcagtggctttagggatttcctgctgaaaccggagctcctgcgggctatcgtggactgtgggtttgagcatcctagtgaagtgcagcacgaatgcattccgcaggctatcctaggcatggatgtcctttgtcaggctaaatcgggaatgggtaagaccgcagtcttcgtgctggctacattacagcaactggagccagtgaccggacaagtaagcgtactggtgatgtgccacactagagaactagctttccagatctcaaaggagtatgagcgttttagtaagtatatgcccaacgtgaaggtggctgttttttttggcgggctctccatcaagaaggacgaggaagtacttaagaagaattgtccacacattgttgttggaactccaggtcgcatactcgcccttgccaggaacaagtctctgaacctgaaacacatcaagcatttcattctggacgaatgtgacaagatgcttgagcagctcgacatgcgacgagacgtgcaggaaatcttccggatgacacctcatgaaaagcaagtcatgatgttctccgccaccttgagtaaagaaattcgctag

SEQ ID NO: 184811 - DNA, 978 bp, Artificial Sequence
  Description of Artificial Sequence: Synthetic coding sequence
tgagccaccctgcagcagctggagcccgtgaccggccaggtgagcgtgttggtaatgtgccatactagggagctggcgtttcagatctctaaggaatacgaacggttctccaaatacatgcccaatgtaaaggttgcagtgttctttggaggactatccattaagaaggatgaggaggtgctgaaaaaaaattgtcctcacatcgtggtcgggacacctgggcgtatcctggctctggctcgcaacaaatctctcaacctgaagcacatcaaacacttcatattagacgaatgcgataagatgttagaacagctggacatgagaagagatgttcaagagattttccgcatgactcctcatgagaaacaggtgatgatgttttccgcaacacttagtaaggaaatccgcccggtttgcagaaagttcatgcaggaccctatggaaatttttgtggatgacgagactaagctgacacttcacgggctgcaacaatattatgtcaagttgaaagacaatgaaaagaaccggaaattgttcgacctgctcgacgtgctggaatttaatcaagtcgttatttttgttaaaagcgtgcagcgctgcatagccctggctcaattactggtggagcagaactttcccgcaatcgctatccatcggggcatgccccaggaggagcgactctctagataccagcagttcaaggacttccagcggcggatactggtggccaccaatttgttcggtcgcggaatggatattgagagggtcaacatcgccttcaactacgacatgcccgaagattccgacacttacctgcatcgatgttaccctctgagcccatctagatggccagagcaagccgggctcgccccaagggcttggctctcccacttgtgtcccatgcgtatgatgcctaggtccagcatgatgtgcagaatcgcacttaggagcattttagtgagttgtctgatgcggtag

SEQ ID NO: 184812 - DNA, 717 bp, Artificial Sequence
  Description of Artificial Sequence: Synthetic coding sequence
atggccgagaacgacgtggacaacgagctgctggactacgaggacgacgaggtggagacagcagccggaggcgatggagccgaggcacccgcaaaaaaagacgtcaaaggatcctacgtgagcatccattcctcaggctttagagacttcctgttaaaacctgaactactgcgggctatcgtcgactgcggctttgaacaccctagcgaagtgcagcacgaatgcataccacaggctatcctggggatggatgtgctgtgccaggctaaatctggtatgggcaagacagccgtttttgtcctggcaaccctgcaacagctcgaacctgttacgggccaggtgtccgttctggtcatgtgccatactcgagagctcgcatttcagatttccaaagaatatgagagattcagcaagtacatgcccaatgtgaaggtggcagttttctttggcggactcagcataaagaaggatgaggaggttctgaaaaaaaattgtccgcacatagtagtgggaactcctgggcgcattctggcgctggcacggaataagtcgttgaatctaaagcacattaaacactttattctggatgagtgcgataagatgctggaacagctcgacatgagaagagatgtccaagagatatttagaatgacgccgcatgagaagcaggttatgatgttttccgcaaccctttcgaaggaaatccgccctgtttag

SEQ ID NO: 184813 - DNA, 717 bp, Artificial Sequence
  Description of Artificial Sequence: Synthetic coding sequence
atggccgagaacgacgtggacaacgagctgctggactacgaggacgacgaggtggaaacggcggctggcggagatggagcagaagcgccggccaagaaagacgtgaagggctcttatgtgtccatacacagctctggcttccgggattttctgctgaaacccgaactgctgcgcgctatcgtcgattgtggattcgaacacccttctgaagtacaacatgagtgtatcccccaggctatcttaggtatggatgtgctctgtcaggcaaaatccggaatgggaaagacggccgtgtttgtgcttgcaactcttcaacaattagagcctgtgacaggtcaggtgtctgtgttggtcatgtgtcatacccgggaattagcattccagattagtaaagagtacgaacggttttcaaaatacatgcccaatgtgaaggtggccgtgttcttcggtggacttagcataaagaaggatgaggaagtgctgaagaagaactgtccacacatcgtcgttgggactcctggacggattctggcactagcacgaaacaaatcattaaacctaaagcacatcaaacactttatattagatgagtgtgataaaatgcttgagcagctcgatatgaggcgggatgtgcaggaaattttccgaatgacaccgcatgaaaagcaggtgatgatgttctccgctaccctgtctaaagagatcagacccgtctag

SEQ ID NO: 184814 - DNA, 870 bp, Artificial Sequence
  Description of Artificial Sequence: Synthetic coding sequence
atggccgagaacgacgtggacaacgagctgctggactacgaggacgatgaggtcgaaactgcagccggcggcgacggtgcggaagcgccagccaaaaaggacgtgaaagggagttatgtcagtatccatagctcaggattccgcgactttctgttgaagcccgagctgctgagggcaattgtcgactgtggctttgagcatccatccgaagtccagcacgagtgcataccgcaggcaattttgggaatggacgtgctatgccaggcgaagagcggaatgggcaaaaccgctgtgtttgtgctagctactttgcagcagcttgagcccgtgactgggcaggtgagtgttttagttatgtgccatactcgggagctagcatttcagatatccaaggaatatgaacgcttttcaaagtacatgcccaacgtgaaagttgccgtgttctttgggggcctgtccatcaaaaaagacgaggaggtgctgaaaaaaaactgtcctcacatcgtagttggaaccccagggcggatcttggccctcgcgcggaacaagtccttgaatctgaagcacattaagcacttcatcctggacgagtgcgacaagatgttggagcagctcgatatgaggcgagacgtgcaggaaatcttcaggatgaccccccatgagaagcaggtcatgatgttttcagctacgctgagcaaggaaattcgccccgtgtgcagaaaattcatgcaggatccaatggaaattttcgttgacgatgagacaaagctcacattacatggtctgcagcaatattacgtgaaactgaaagataacgaaaagaacaggaaattgttcgatttactggacgtactggaattcaaccagtag

SEQ ID NO: 184815 - DNA, 1278 bp, Artificial Sequence
  Description of Artificial Sequence: Synthetic coding sequence
atggccgagaacgacgtggacaacgagctgctggactacgaggacgacgaggtggagactgctgccggaggagacggcgccgaagctcccgctaagaaggatgtgaagggatcttacgtgtctatccactcctccggattccgggattttctgctcaagccggaattgctcagggccatcgtggactgcgggttcgaacacccttccgaggttcaacacgagtgcatcccgcaggcgatccttggtatggacgtcttgtgccaggccaagagcgggatgggcaaaacggcagtgttcgtgctggccaccctccagcagctggagcctgtgacaggccaggtcagtgtccttgtgatgtgccatacccgcgagttggcatttcagataagtaaggagtacgagcgattttctaagtatatgcccaacgtcaaggtggcagtctttttcggcggtttgagcattaagaaagacgaggaggtgctcaaaaagaattgtccacacatcgttgtggggacacccggacggatcctagccctcgctagaaataagtccctgaatctgaagcatattaagcactttatcctagacgagtgtgacaagatgcttgagcagctggacatgagaagggacgtccaggaaatcttccgcatgacacctcacgagaaacaggtcatgatgttttcagccacactgtccaaggagatcagacctgtatgtcgtaagtttatgcaggatcctatggagatcttcgtcgatgatgaaaccaaactgaccctacacgggctgcagcaatactatgtgaagttaaaggataatgaaaagaatagaaaactattcgacctcctggacgtcctggagttcaaccaggtagtaatttttgtcaagtccgtgcagagatgtatagcactggcacaactgctagtggagcaaaatttccccgctattgccatccaccggggcatgccccaggaggagcgcttaagcaggtatcagcaattcaaggactttcagagaagaatcctggttgctactaacctgttcgggagaggaatggacatcgagcgggtgaacatagccttcaactatgacatgccggaggacagtgatacctatctccaccggtgctacccgctgtctccttccaggtggccagaacaggccggcctggccccacgggcttggctgagtcacctctgccccatgcgcatgatgccgcgtagctccatgatgtgtcggatcgctttgcgcagcattttggtgtcctgtttaatgcgctag

SEQ ID NO: 184816 - DNA, 411 bp, Artificial Sequence
  Description of Artificial Sequence: Synthetic coding sequence
atgggcggcggccggcggccctacgacgtgttcttcagcaaggtgatggccgaaaacgatgtggacaacgaattgctggactacgaggatgacgaggtggagaccgccgctgggggcgacggagcagaggcacctgccaagaaggacgtgaaggggagttacgtgtctatacacagcagcggctttagggacttccttctcaagcctgaactgctgcgtgccatcgtggattgcggattcgagcatcccagtgaggtgcaacacgaatgtatcccccaggcaatcctcggaatggacgttctatgccaggctaagtctgggatgggaaagacagcggtttttgttctcgctacccttcagcagctggaacccgtgactggacaggtgtcggttctggtcatgtgccactag

SEQ ID NO: 184817 - DNA, 564 bp, Artificial Sequence
  Description of Artificial Sequence: Synthetic coding sequence
atgggcagcagccacatcggcggcctgagcatcaacgagcggcggtgttcagcttcactcggacttgttatggccgaaaacgacgttgataacgagctccttgactatgaggatgacgaggtagagacagctgcaggtggggatggcgctgaggcgccagcaaagaaagacgttaagggctcttatgtgtctatccacagctccggcttcagggatttcctgcttaaaccagagcttctcagagcaatcgtggattgcggattcgagcacccctctgaggtgcaacatgagtgcattccacaagctatcctgggcatggacgtcctgtgtcaggccaaatccggtatgggaaagaccgccgtatttgtcctagctacactccagcagctcgagcccgtgactgggcaggtgagtgtactcgtcatgtgccatactagggaactggcctttcagataagcaaagagtatgaaagatttagcaaatacatgcccaacgtgaaggtggccgtgtttttcggcggtctgagtattaaaaaagacgaggaggtccttaaaaagaattag

SEQ ID NO: 184818 - DNA, 399 bp, Artificial Sequence
  Description of Artificial Sequence: Synthetic coding sequence
atggccgagaacgacgtggacaacgagctgctggactacgaggacgatgaagttgagactgccgcagggggggacggggcagaagcccccgcaaaaaaagatgtgaagggctcatatgtgagcatacactcctccggattccgcgattttctactgaagcctgagcttttacgtgctatcgtggactgtggattcgagcacccctcggaggtccagcatgaatgcatcccccaggccattctggggatggatgtgctctgtcaggctaagtctggtatgggcaagacagctgtttttgtcctggccaccctgcagcaacttgaacccgtgactggacaagtctgtttctgcgacagccattttccacggggcgataacgaggaacttcatctaccctag

SEQ ID NO: 184819 - DNA, 870 bp, Artificial Sequence
  Description of Artificial Sequence: Synthetic coding sequence
atggccgagaacgacgtggacaacgagctgctggactacgaggacgatgaagtggaaacagccgctgggggagacggggcagaagctcctgctaaaaaggacgtgaagggatcatatgtgagcatacattcatctgggtttcgcgatttcctacttaaacctgaattgttgagggccatcgtcgactgcgggttcgagcacccttcagaagtgcagcacgaatgtataccccaagcaatcctgggaatggacgtgctctgtcaggccaaatccggaatggggaagacggccgtgttcgttctggccactctccaacagctagagccagtgacaggtcaggtgagcgttctggtgatgtgtcatacgcgtgagctggccttccagatctccaaggagtatgagcggttttccaaatacatgcccaatgtgaaggtggcagtattcttcggaggactgagtataaagaaggacgaggaagtcttaaagaaaaactgcccacacatcgtggttggaactcccggccgcattctggctcttgcacggaataagagtctcaacctgaagcatataaagcatttcattttggatgagtgtgacaaaatgctggagcagcttgacatgcgtcgggatgtgcaggaaatatttcggatgactccccacgagaaacaggttatgatgtttagcgctaccctttcgaaagagatacggccagtgtgcaggaagttcatgcaggatccaatggagatttttgtcgatgatgaaacaaaactgactctgcacggactccagcagtactatgtgaaactaaaagacaacgagaagaatagaaagttgtttgacctgttagacgtgctggaattcaaccagtag

SEQ ID NO: 184820 - DNA, 1287 bp, Artificial Sequence
  Description of Artificial Sequence: Synthetic coding sequence
atggccgagaacgacgtggacaacgagctgctggactacgaggacgacgaggtcgagaccgcagctgggggcgacggcgccgaggctcccgccaaaaaagacgttaagggtagctatgtgagcatccactccagcggcttcagggatttcctgctgaagccagaactgttgcgcgcaatcgtggattgcggatttgaacatcctagtgaagtgcagcacgagtgcataccccaggctatactcggaatggacgttctctgtcaggctaagagcggtatggggaagacggcagtctttgtgctggcgaccctgcaacagttagagccagtcacaggccaagtgtctgtgctggtgatgtgccacacaagagaactggccttccagatcagcaaagagtatgagaggttttccaaatacatgcccaatgttaaagtcgccgtgtttttcgggggactgagcattaagaaggatgaggaagtgctgaagaaaaactgtccacacatagtggtcggaacacctggaagaatattagcattggcaaggaataagagtctgaacctcaagcacataaaacactttatacttgacgaatgcgacaaaatgttagaacagcttgacatgcggcgcgatgtacaagagatattccggatgaccccccacgaaaagcaggtcatgatgttttcggctacactctctaaagagattcggccagtgtgtaggaagtttatgcaggaccctatggagatttttgttgatgacgagaccaagttgacactgcacggattgcagcaatactatgtgaagctgaaggataacgaaaagaaccggaagcttttcgaccttttggatgtcctggagttcaatcaggtggtcatcttcgtcaagtcagtgcaaagatgtatcgctcttgcacagctgttggtggagcagaatttcccagctatcgccatacatagggggatgccccaggaagagagactctccaggtatcaacagttcaaagacttccaaaggaggattctggtcgctaccaacctgttcggcagaggtatggacattgagagggttaatatcgcttttaattacgacatgccagaagacagcgacacgtaccttcatagagtggcacgggctggacgcttcggcactaaggggcttgctattactttcgttagtgatgaaaacgacgcaaagatcttaaacgatgtgcaagatcggttcgaggttaacatatccgagctgccagacgaaatcgatattagttcatacatagagcagaccagatag

SEQ ID NO: 184821 - DNA, 564 bp, Artificial Sequence
  Description of Artificial Sequence: Synthetic coding sequence
atgggcagcagccacatcggcggcctgagcatcaacgagcggcggtgcagcgcgtcgctgggtttggttatggcggagaatgatgtggacaacgaactgctggactacgaggacgacgaggttgagacagccgccggaggcgatggcgctgaggctccagcgaagaaagatgtcaagggctcgtacgtgtcaattcacagctccggattccgagacttcctgttgaagcctgaacttctcagggccatcgtggactgtggattcgagcacccttcggaagtgcagcacgaatgcattcctcaggctattctcggcatggatgtcctttgtcaggctaaatctgggatgggtaaaaccgcagtgtttgttctcgccacgcttcagcagctcgagccagtgactgggcaagtgtccgtgctagtcatgtgccatacaagggaactggcctttcagatatctaaggaatacgagcgcttctccaagtatatgcccaatgtcaaggtggccgtattcttcggtggcctctccattaaaaaggacgaggaagtcttgaaaaagaattag

SEQ ID NO: 184822 - DNA, 291 bp, Artificial Sequence
  Description of Artificial Sequence: Synthetic coding sequence
atggccgagaacgacgtggacaacgagctgctggactacgaggacgacgaagtggaaactgccgccgggggggacggtgctgaagctccagcaaaaaaggatgtaaagggttcttatgtgtctattcactcatccggatttagagatttccttctgaagccagagctactccgcgccatagtggattgcggcttcgaacatccaagcgaggtccagcatgagtgcatcccgcaggccattttaggaatggatgtactctgccaagctaaatcagggatgggaaaaacgtag

SEQ ID NO: 184823 - DNA, 564 bp, Artificial Sequence
  Description of Artificial Sequence: Synthetic coding sequence
atgggcagcagccacatcggcggcctgagcatcaacgagcggcggtgcagtgcctcactcggtctggtcatggccgagaacgacgtggataatgagctcttggattatgaggacgacgaggtcgaaactgcggcgggaggcgacggcgctgaggcgcccgcaaagaaagatgttaaaggctcctatgtttctatccattcgtcagggttccgtgacttcttgctaaagccagagctgttacgagcaattgtcgactgtgggttcgagcaccccagtgaagtgcagcacgaatgcattcctcaggccattctaggcatggatgtgttgtgtcaggcaaagtccggcatggggaaaaccgcagtatttgtcctcgccacgctccagcagttagagcctgttactggacaagttagtgtgctggtgatgtgccacacacgtgagctggctttccagatttcaaaggaatacgagcggttctcaaagtatatgcccaatgtgaaggttgccgttttcttcggtggactttctatcaagaaggatgaggaagtgcttaaaaaaaattag

SEQ ID NO: 184824 - DNA, 594 bp, Artificial Sequence
  Description of Artificial Sequence: Synthetic coding sequence
atggccgagaacgacgtggacaacgagctgctggactacgaggacgacgaagttgaaaccgccgcaggcggcgatggagctgaggcccctgcaaagaaggacgtgaaaggtagctatgtgtccatccacagtagcggctttcgggacttcctgcttaagcctgaactgctaagagccatcgtcgattgtggtttcgagcatccaagcgaagtccaacatgaatgcatcccccaggcaattctcgggatggacgtgctgtgccaggcgaaatccggaatgggtaagaccgctgtgtttgtgttggccactcttcaacaactcgaaccagttaccggccaggtatgtttttgtgattctcacttcccccggggagacaacgaggagctccacctgccatacgtttctgtttactttctgccaaaagtatctgttcttgtaatgtgtcacacacgcgagctcgcctttcagatctctaaagagtatgagcgattctccaagtatatgccaaacgtcaaggtggcagtgttctttggaggcttaagcatcaagaaggacgaggaagtattgaaaaagaattgtccacatatagtttag

SEQ ID NO: 184825 - DNA, 291 bp, Artificial Sequence
  Description of Artificial Sequence: Synthetic coding sequence
atggccgagaacgacgtggacaacgagctgctggactacgaggacgatgaagttgagacagccgccggaggagacggcgctgaagccccggcaaaaaaagacgtcaagggtagctatgtgtcgattcattctagtggttttagagatttcctgctgaaacccgagctcttacgcgccatagtcgactgtggcttcgagcatccgagcgaggtccaacatgagtgcattccacaagcaattcttggaatggacgtgctgtgccaagccaagtcagggatgggtaagacctag

SEQ ID NO: 184826 - DNA, 696 bp, Artificial Sequence
  Description of Artificial Sequence: Synthetic coding sequence
atggccgagaacgacgtggacaacgagctgctggactacgaggacgatgaggtggagaccgcagcaggcggggacggggcggaggctccagccaagaaagacgtaaaggggtcctatgtgtctattcactcctctggattccgcgacttcctcctgaagccagagctcctcagagctattgtcgactgcggttttgagcacccaagcgaagttcagcatgagtgtatcccacaggcaatcctggggatggacgtcctttgccaagccaaatcaggtatggggaagacagcggtgttcgtactcgctaccctccaacagcttgagcccgtaacaggacaggtaagcgttctcgtgatgtgccacacgagagaactcgcgtttcaaatttcaaaagagtacgaacgattctcaaaatacatgcccaacgtgaaggtagcggtttttttcgggggcttgtccattaaaaaagatgaagaggtgctgaagaaaaactgtccccacattgtagtaggcaccccagggagaatactcgccctggcgaggaacaagagcctcaatctcaaacacattaaacacttcatcttagacgagtgcgataagatgctggagcagttggacatgcggcgtgatgtacaggaaatttttcgtatgacccctcacgaaaagcaggtgatgatgttttccgccaccctgtag

SEQ ID NO: 184827 - DNA, 696 bp, Artificial Sequence
  Description of Artificial Sequence: Synthetic coding sequence
atggccgagaacgacgtggacaacgagctgctggactacgaggacgatgaggtggagacagccgcgggcggggatggagccgaagctcccgccaagaaggatgtgaaaggcagctacgtgagcatacactccagcggtttccgagattttctcctcaagcccgagctgttgagagccatcgtggattgtggattcgagcatccctcagaggttcaacacgagtgcatccctcaggcaatccttggaatggatgtgctgtgccaggcgaagagcggcatgggcaagacagcggttttcgtgctggccacgctacaacaactagagccagttacgggccaagtgtcagttcttgttatgtgccacacacgcgaacttgctttccagataagcaaggagtatgagcgcttcagtaagtacatgccaaacgtgaaggtggcagtgttcttcgggggactgagcatcaaaaaggatgaagaggtattgaagaaaaactgtccgcacattgtcgtgggcacaccagggcgcatcctggccctggcacgcaacaagtcgctcaacctgaaacacataaaacattttatcctggatgaatgcgataaaatgctggagcagctggatatgcgtagagatgtccaggagattttccggatgacaccacacgagaagcaagtgatgatgttttccgcgaccttgtag

SEQ ID NO: 184828 - DNA, 717 bp, Artificial Sequence
  Description of Artificial Sequence: Synthetic coding sequence
atggccgagaacgacgtggacaacgagctgctggactacgaggacgacgaagttgaaacagccgccgggggggatggcgccgaagcgcctgcaaagaaagacgtaaagggaagctacgtcagcattcatagttccggctttagagactttttactgaagccagagctgctcagagctatcgtagattgtggattcgagcacccctccgaggtgcagcacgagtgtatccctcaggccatactaggcatggatgtgctgtgtcaagcaaaaagcggaatgggaaagacagccgttttcgtccttgctaccctccagcagctggaacctgtcactggccaggtctctgtgctggtaatgtgtcatacgcgggaactcgcttttcagatcagcaaggaatacgaacgtttttccaaatacatgcctaacgtgaaggtggccgtgttttttggcggactgagtattaagaaggacgaagaggtgctgaagaagaattgcccgcacatcgtggtcggaactcccgggagaatactcgcacttgcaaggaacaaatctctcaatctgaagcacattaagcattttatactagacgagtgtgacaaaatgctcgaacaactagacatgcgcagggatgtgcaagaaattttcaggatgacaccgcacgagaaacaggtgatgatgttcagcgctacgctgtcaaaggaaataaggccagtctag

SEQ ID NO: 184829 - DNA, 1287 bp, Artificial Sequence
  Description of Artificial Sequence: Synthetic coding sequence
atggccgagaacgacgtggacaacgagctgctggactacgaggacgacgaggtggaaactgccgctggcggcgacggggccgaagcgccggctaagaaggatgtgaaaggctcctacgtttctattcattcttctggtttccgggacttcttgctcaaacccgagctcctccgagcaatagttgattgtggttttgaacacccctccgaggtccagcacgagtgtatcccacaggctattctcgggatggacgtgctctgccaggctaaaagcgggatgggtaagactgctgtctttgtcctggccacactgcagcagcttgagcccgtgacaggtcaggtgtccgtgcttgttatgtgtcacactagggagctggcgttccaaattagcaaagagtatgagaggtttagcaaatacatgcctaatgttaaagtcgccgttttcttcggaggcctgagtataaaaaaggacgaagaagtgttgaagaaaaattgtccccacatcgttgtggggactcccggcaggatactggctctcgccaggaataagtctctcaaccttaaacacatcaagcacttcatcctggatgaatgtgataagatgctggagcagttagacatgcgcagagacgtccaggagatcttccgaatgacaccccatgaaaaacaagtaatgatgttcagtgctaccctctccaaagaaattaggcctgtgtgtaggaagttcatgcaggatcccatggaaatctttgtcgatgacgaaacgaagttaacactgcatgggctgcaacagtattacgtgaaacttaaagacaacgagaaaaacagaaagctttttgatctcctggatgtactggagtttaaccaagtggtgatctttgttaagtcagttcagaggtgcattgccctcgcccagctgctagtcgagcaaaactttcccgctattgcaatccacagagggatgccccaggaggagaggctgtccagatatcagcagttcaaggacttccaaagacgcattctagtggccacaaatttattcgggagaggcatggatatcgagagggtaaacattgcctttaactacgacatgcccgaggattccgacacttacctccaccgtgtcgcccgtgccggacgattcggaaccaaaggcctcgcaattacattcgtgtccgacgaaaatgatgccaagattctgaacgacgtgcaggaccgcttcgaggtcaacatcagcgagcttcccgacgagattgacataagttcatatatcgagcagactaggtag

SEQ ID NO: 184830 - DNA, 564 bp, Artificial Sequence
  Description of Artificial Sequence: Synthetic coding sequence
tgaagcgaggagcgggacatcggcaagcccatggagatcttcgtggacgacgagacaaagcttaccttacacggtctccagcagtattatgtgaaacttaaagacaacgaaaaaaaccggaaactctttgatctcttggatgttctggagtttaatcaggtggtgattttcgtgaaatcagttcaaaggtgcatcgctttagcacagctgttggtggagcaaaatttccccgcaatcgccatccacagggggatgccccaggaggagaggctcagccggtatcagcagttcaaagatttccagaggcggatacttgtagctaccaacctctttgggcgaggcatggacatcgagcgggtcaatattgcctttaattatgacatgccagaggactcagacacctacctgcatagagtagcaagagctgggagatttggcacgaagggcctggctattacttttgtgtctgacgaaaacgacgccaagattctgaacgatgttcaggatcggttcgaggttaacatatcggaattacctgatgaaatagacattagttcctattag

SEQ ID NO: 184831 - DNA, 564 bp, Artificial Sequence
  Description of Artificial Sequence: Synthetic coding sequence
atgggcagcagccacatcggcggcctgagcatcaacgagcggcggtgctccgcttctctgggactggtaatggccgaaaatgatgtagataacgaacttttggattatgaagacgatgaagtggaaacagccgctggaggagatggggcagaggctccagccaaaaaagacgtcaagggaagctacgtgtccattcactctagtggtttcagagactttctgctcaaaccagaactactgcgggccattgtcgattgcggtttcgaacaccctagcgaagtccagcacgagtgtatcccacaggctattctaggtatggacgtactctgccaggcgaagtcggggatggggaagactgccgtgttcgtgcttgctaccctgcagcagctggagcctgtcaccggacaggtgagtgtgctcgtcatgtgccacacaagagaacttgcctttcagatctcaaaagagtacgagaggttttcgaagtatatgcctaacgtgaaagtggccgtcttttttgggggcctctccataaaaaaggatgaagaagtgcttaaaaagaactag

SEQ ID NO: 184832 - DNA, 717 bp, Artificial Sequence
  Description of Artificial Sequence: Synthetic coding sequence
atggccgagaacgacgtggacaacgagctgctggactacgaggacgacgaggttgagaccgccgcagggggtgacggcgcagaggcaccagcaaagaaggacgtgaagggctcatatgtgtccatacattcatctggtttccgggatttcctgctcaagcccgaactcctaagagccatagtcgactgtgggtttgaacacccttcggaggttcagcacgagtgcatcccacaggccatcctggggatggacgttctgtgccaggccaagtctggtatggggaagacagctgtttttgtcctcgctacactccagcaactcgaaccagtgaccggccaggtttctgtccttgtgatgtgccacacccgcgaactggcttttcagattagcaaagagtacgaaaggttctccaaatacatgccgaacgtcaaggtagcagttttttttgggggcctgagcattaaaaaggacgaagaagtgctaaagaagaactgcccccatatcgtggttggaactccaggcagaattctcgcccttgccagaaataagtccctgaatctgaaacacatcaaacacttcattttggatgaatgtgacaaaatgctggagcagctcgacatgcgaagagatgtgcaggaaattttccgcatgaccccacacgaaaaacaggtgatgatgtttagtgcaacactcagtaaggagattagaccagtttag

SEQ ID NO: 184833 - DNA, 738 bp, Artificial Sequence
  Description of Artificial Sequence: Synthetic coding sequence
atgtggaccatgagcagctggaccatgaagatgatgcggtggcggcagcagctaggcgagatgggcctcagaccgttgccacgaaggatgtccagggccccaatgagcccgagcaccgctctcgcttttgttacttcttgctcctcccaatcgtgctccggaccgctctccacagtagccctgtccattaggcaaaaagtggccgtattcttcggcggtctgagtatcaagaaagatgaggaggtgctgaagaaaaattgtccccacatcgtggtgggcactccagggcgaattttagccctggccaggaacaagagcttgaatcttaaacacattaaacactttattctggacgagtgtgataagatgctggagcagctagacatgcggagggatgtgcaggagatctttcggatgacccctcacgagaagcaagtgatgatgttcagcgctactctgtcaaaggaaatcaggccagtctgccggaagttcatgcaagatccaatggaaatctttgtagatgatgaaacaaagctcacccttcacggcttacagcagtattatgttaagctgaaggacaacgagaaaaatagaaagctgttcgacctgctcgacgtactcgagtttaaccaggttgttattttcgtcaagtctgtccagcggtgtatagcactagcccagctactagtggaacagaacttccctgcgatagccattcatcggggaatgccccaatag

SEQ ID NO: 184834 - DNA, 1278 bp, Artificial Sequence
  Description of Artificial Sequence: Synthetic coding sequence
atggccgagaacgacgtggacaacgagctgctggactacgaggacgatgaggtggagactgctgcgggcggtgacggcgctgaggcacccgcaaagaaagatgtcaaggggtcctacgtgtccattcatagctccggtttcagagacttcttgcttaagccagaactgctgagggccatagtcgattgcggttttgagcatccatccgaggttcaacatgagtgcataccccaggctatcctcgggatggacgtattgtgccaagcaaagtccgggatgggtaaaactgctgtattcgttctggcaacactgcagcagttggagcccgtcaccggacaggtatccgtcctagttatgtgtcacaccagagaactagccttccagataagtaaggagtatgagcggttctccaagtatatgcctaatgtgaaggtggcagtgttttttgggggtcttagcatcaagaaggatgaggaagtgctgaagaagaactgtccccacatagtggtggggacaccgggtagaatcctggcactagccagaaacaaatctctgaacctgaaacatatcaaacatttcatccttgatgaatgtgacaagatgttagagcagcttgatatgagaagagatgttcaggaaattttcaggatgacaccccatgagaagcaggtgatgatgttctccgctacactgagcaaggagattcggccagtgtgtcgaaagtttatgcaggaccctatggagatctttgtagatgacgaaacaaagctgactctgcacgggctgcaacaatattacgttaagctcaaggacaacgaaaagaatagaaagctgtttgacctgctcgatgtcctggaattcaatcaggttgtgatattcgtcaaatcggtacagcgctgcatagcactcgctcaacttcttgtcgaacagaatttccctgccatagcaatccatagagggatgcctcaggaggagcggctttcccgataccaacagtttaaagacttccagcgcagaatcttagtggccaccaacctctttgggaggggcatggacatcgagagagtgaacatcgccttcaattacgacatgcccgaggatagcgacacttacctgcataggtgttacccgctctcaccctcgcggtggcctgagcaggccggtcttgcccccagagcatggctctctcacctgtgtcctatgcgaatgatgccccgttccagtatgatgtgccgcatcgcactgcgctcgattctggttagctgcttaatgaggtag

SEQ ID NO: 184835 - DNA, 711 bp, Artificial Sequence
  Description of Artificial Sequence: Synthetic coding sequence
atggccgagaacgacgtggacaacgagctgctggactacgaggacgatgaggtcgaaacagccgctggcggagacggtgccgaggcccctgccaagaaggatgtgaaggggtcctacgtctcaatacattcctctggctttagagacttccttttgaaaccggaacttctgagggccatcgtggactgcggattcgagcaccccagtgaggtgcagcacgagtgcataccacaagcaatactcgggatggacgtgctgtgccaggcgaaatcaggcatgggtaaaacggcagtctttgtgttggctaccctgcaacagttggagcccgtaactggccaggtctctgtgctcgtgatgtgtcacactagggaactagctttccagatatccaaggaatatgagagattttctaagtacatgcccaatgtgaaagtggcagtcttcttcggcggtctaagcatcaagaaagacgaggaagtactgaaaaagaactgtccccatatcgttgtcggcactccgggaagaattttggccctggcccgaaacaagtccttgaacctgaaacacatcaaacactttatcctggacgaatgtgacaaaatgctggagcagcttgacatgcggcgtgatgtacaggagatctttcggatgactccacatgagaagcaagtgatgatgtttagcgcgacactgagtaaagagattcgctag

SEQ ID NO: 184836 - DNA, 738 bp, Artificial Sequence
  Description of Artificial Sequence: Synthetic coding sequence
atgtggaccatgagcagctggaccatgaagatgatgcggtggcggcagcagcttggtgaaatggggctgcggccgctaccaagacgaatgtctcgggccccgatgagtcccagcacagccctcgcatttgtcacctcatgctcttctcagagttgctctggcccactgtcgactgtagccttaagcattcgccagaaagttgccgtgtttttcgggggcctctccatcaagaaagacgaggaagtcctcaagaagaattgcccccatatagtcgttggaactccaggccggatcctcgcactggcaaggaacaagtctctgaatttaaaacatataaaacactttatactggacgagtgcgataaaatgcttgaacagctggatatgaggcgcgacgtgcaagagatatttcgaatgaccccgcacgagaagcaagtgatgatgtttagcgctaccctatctaaagaaatccggcccgtctgccggaagttcatgcaggacccgatggaaatcttcgtcgacgatgagaccaagctcacattgcacgggttacagcagtattatgtgaagcttaaggacaacgagaaaaacaggaagttgttcgacttgttagacgtgctggaattcaaccaggtggtgatatttgtcaagtcggttcagaggtgtattgccctcgcccaacttcttgtggagcagaacttccctgctattgccattcatcggggcatgccacagtag

SEQ ID NO: 184837 - DNA, 1287 bp, Artificial Sequence
  Description of Artificial Sequence: Synthetic coding sequence
atggccgagaacgacgtggacaacgagctgctggactacgaggacgacgaggtggaaactgccgccggcggagatggtgcagaagctcctgccaagaaggatgtcaagggaagctatgttagtatccattcaagcggcttcagagactttctgctaaaacctgagttacttcgggcaatcgtagattgcggctttgaacatcctagcgaagttcaacacgagtgcatcccccaggcaattttaggaatggatgtgctctgtcaggctaaaagcgggatggggaagactgcggtttttgtgctggcgaccctccaacaactggagccagtgacagggcaagtttctgtcctggtaatgtgtcacacacgagaactggcatttcagattagcaaagagtacgagcgcttcagcaagtacatgcctaatgtaaaggtggctgtgtttttcggtggcttatcaatcaagaaggatgaagaagtgctcaagaaaaattgcccacacattgtcgtgggtacgcccggcagaattctcgctctggcccgcaataagtccctgaatttgaagcatatcaaacatttcatattggacgaatgtgataaaatgctggaacaactggatatgagacgtgatgtgcaggaaatattccgaatgacacctcacgagaaacaggtcatgatgtttagcgctacgctcagcaaagaaataagacctgtgtgcaggaaatttatgcaggatccaatggagatctttgtggacgatgagacgaagcttaccctgcacggacttcagcaatactacgtaaagttgaaggacaatgaaaagaaccgcaagctattcgatctcctggatgtcctggagttcaatcaggtggtcatattcgtgaagtcagtgcaacgctgcatcgcactggcccagttgctagtcgaacagaattttcctgcaatcgctattcatagaggaatgccccaggaagaacggttgtcaagataccagcagtttaaagactttcagagacgcatcctcgtcgctacgaatctctttggtaggggcatggacatagagagggttaatatagcctttaattatgacatgcctgaggattccgatacttacctccatagggttgctcgcgcaggtaggtttggtacgaaggggctcgctataacattcgtttccgatgagaatgacgccaaaattctgaatgacgtacaggaccgctttgaggtaaacatcagtgaactccccgatgaaattgacatttcctcttatatcgaacagacaaggtag

SEQ ID NO: 184838 - DNA, 411 bp, Artificial Sequence
  Description of Artificial Sequence: Synthetic coding sequence
atgggcggcggccggcggccctacgacgtgttcttcagcaaggtgatggccgagaatgacgtcgacaacgaactgctggactatgaggacgacgaggtcgagaccgcggcaggcggcgacggcgccgaagctccggccaaaaaggatgtgaaggggtcatacgtcagcattcactccagtggctttagggacttcttactgaagcccgagctgctgcgcgcgatcgtggattgtggttttgaacatccaagtgaggtccaacacgaatgtatccctcaggcaatcctgggcatggatgtcctgtgccaggctaaatccggaatgggcaagactgccgtgtttgtcctggccaccctgcagcagttggaacccgttacaggtcaggtgtccgtgctggtaatgtgccattag

SEQ ID NO: 184839 - DNA, 987 bp, Artificial Sequence
  Description of Artificial Sequence: Synthetic coding sequence
tgagccaccctgcagcagctggagcccgtgaccggccaggtgagcgtactggtgatgtgtcacactagggaactggcattccagatctctaaggaatatgagcgcttctctaagtacatgcctaatgtcaaggtagctgttttttttggaggtctgtctattaaaaaagatgaagaagtactgaagaagaactgcccgcacattgttgtcgggacccccggaaggatcctcgcactggccaggaacaaaagcctcaatctgaaacacattaagcatttcatcttggatgagtgtgacaagatgttggagcaactggatatgaggcgggatgtgcaggagatttttcgcatgacccctcacgagaaacaggttatgatgttcagcgctaccctctctaaggaaatcaggccggtttgcaggaagttcatgcaggatccaatggagatttttgtggacgacgagaccaagctaacacttcatggactccagcagtactacgtgaagctcaaggataatgagaaaaatcggaagctcttcgacttgttggatgtgctagagtttaaccaggtggttatcttcgtgaagagcgtacaacggtgcatcgcattggctcagcttctggtcgagcagaattttcctgctattgctatccaccgaggaatgcctcaggaagaacgtctgagtcggtaccagcaatttaaggacttccagcggcgtattttagttgcgaccaatctgtttggtagaggaatggatatcgaaagagtgaatatcgccttcaattacgatatgcctgaagactcagacacttacctccacagagtggcaagggcaggacggttcgggaccaaagggctggcgatcacttttgtctcggacgaaaatgatgctaaaattttgaacgatgttcaggacagattcgaggtgaatatttcggagctcccagacgagatcgacatctcatcctatatagagcagacccgctag

SEQ ID NO: 184840 - DNA, 399 bp, Artificial Sequence
  Description of Artificial Sequence: Synthetic coding sequence
atggccgagaacgacgtggacaacgagctgctggactacgaggacgacgaggtagaaactgcagctggcggcgacggagcggaagcccctgccaaaaaagatgtcaaaggtagttatgtaagtattcactctagcggctttcgcgactttctcctcaagcctgaattactgagagccatagttgactgcggcttcgagcaccccagtgaagtccagcatgaatgcatcccgcaagccattttgggcatggatgtgctatgtcaggcaaagagcggtatgggaaagaccgctgtatttgtcctggcgacactgcagcagctggagcccgtgaccggccaagtctgcttttgcgatagtcatttccctcggggtgataacgaagagttacacctaccatag

SEQ ID NO: 184841 - DNA, 420 bp, Artificial Sequence
  Description of Artificial Sequence: Synthetic coding sequence
atggccgagaacgacgtggacaacgagctgctggactacgaggacgatgaagtggagactgctgccggtggggatggcgcagaagctccggccaaaaaggacgtgaaggggtcatacgtctcaattcacagttctggcttccgggacttcctgctaaagccggagcttttaagggctattgtggattgcggatttgagcaccccagtgaggtgcagcatgaatgtattcctcaggccatcttaggcatggacgttttatgtcaggccaagagcggcatgggaaagactgctgtatttgttctggcgactctccagcagttggagcccgtgacaggacagtcgcacgagcacatgacaagcgttacattagacaacttgaccgctgtgggcgatgtgctgtcccaagcatgggggagctag

SEQ ID NO: 184842 - DNA, 717 bp, Artificial Sequence
  Description of Artificial Sequence: Synthetic coding sequence
atggccgagaacgacgtggacaacgagctgctggactacgaggacgatgaggttgagaccgccgctggtggggacggagccgaagcccccgcgaagaaggatgtgaaaggaagttacgtttccatccactcatccggcttccgtgatttcctactgaagcctgagctgcttagggcgatagtggactgcggttttgagcacccatccgaggtccagcacgagtgcataccccaagctatccttggcatggatgtactctgtcaggccaagtcggggatgggaaagactgccgtgtttgtgctagcaacacttcaacagttagagccagtgactggtcaggtgagcgtgctagttatgtgccatacgcgcgaactggcattccagatatccaaagaatatgaacgatttagcaaatacatgccaaatgtcaaagtagctgtattcttcggaggcctcagcatcaagaaggatgaggaagtgctcaaaaaaaactgcccccacattgtcgtgggaacccctggcaggattctggcactcgctaggaacaagtcactgaacctgaaacacatcaaacacttcatactcgacgagtgtgataaaatgttggaacagttggacatgcgaagggatgtgcaggagatttttagaatgactccgcatgagaagcaagtgatgatgttctctgctaccctatccaaagagatccgccctgtgtag

SEQ ID NO: 184843 - DNA, 564 bp, Artificial Sequence
  Description of Artificial Sequence: Synthetic coding sequence
atgggcagcagccacatcggcggcctgagcatcaacgagcggcggcgatcagcttcactgggccttgtgatggcagagaacgacgtcgataacgagctgctggactacgaagatgacgaggtagagacggcagcgggtggcgacggggctgaagcacccgctaagaaagatgtgaagggatcttacgtatcaatccatagcagcggtttcagagacttccttcttaagcccgaactgctgcgggcaattgtggactgcggttttgaacacccttccgaagttcaacatgagtgtataccacaagctattctgggcatggacgttttgtgccaagccaagtcgggaatggggaaaacggctgtctttgtgctggctacgctgcagcaacttgaacccgtgactggccaagtgtccgtcctggtgatgtgccacactcgggagctggcattccaaatttcaaaggagtatgaacgctttagcaaatatatgccaaatgtcaaggtagccgtatttttcggtggtctgagcataaagaaagatgaggaagttctcaagaaaaattag

SEQ ID NO: 184844 - DNA, 711 bp, Artificial Sequence
  Description of Artificial Sequence: Synthetic coding sequence
atggccgagaacgacgtggacaacgagctgctggactacgaggacgacgaggtcgagaccgccgcgggcggagatggggccgaggctcctgcaaaaaaggacgtaaaagggtcatacgtaagcattcatagctctggctttagggacttcctattgaaaccggagctgctgagggctatagttgactgcgggtttgagcatccctccgaggtgcagcacgagtgtattccacaggcgatcttaggtatggatgtgttgtgtcaggcgaagagcggcatgggaaagaccgccgtcttcgtgctggcgacacttcaacaacttgagccagtgacaggccaggtctcggtcctcgtcatgtgtcacacgcgcgagttggcttttcagatttcaaaagaatacgagcgtttctccaagtatatgccaaacgtgaaagtggccgtattttttgggggactgtcgattaaaaaggatgaagaagtgctcaaaaagaactgcccccatatcgtggtcggtacccccgggaggatactggcgctggcgcgcaacaagagtcttaatcttaagcatatcaaacatttcatactggacgaatgcgacaaaatgctggaacagctcgatatgcggcgggacgtccaagagatctttcgcatgacacctcatgagaagcaggtaatgatgttctccgctactctgtctaaggagatcaggtag

SEQ ID NO: 184845 - DNA, 1278 bp, Artificial Sequence
  Description of Artificial Sequence: Synthetic coding sequence
atggccgagaacgacgtggacaacgagctgctggactacgaggacgacgaagtggagactgcagctggcggtgatggtgcagaagcccccgccaagaaagatgtcaaagggtcatatgtgtccatccactccagcggtttccgggactttctgctgaagccagagctgctccgcgccatcgtggactgcggcttcgagcatccaagtgaagtccagcacgaatgcatcccacaggccatcctgggtatggacgtgctctgtcaggcgaaatcaggtatgggaaaaacagccgtgttcgtgctggccacattgcagcagctggagcccgtgaccggccaggtgtctgttcttgtcatgtgtcatacacgagaacttgctttccaaattagcaaagaatacgaacgtttctccaagtatatgcccaatgttaaggtcgcggtgttctttggcggcctctctattaagaaggatgaggaggtgctcaaaaagaactgtccacatatcgtggtcggcacccctggcaggatactggccttagccagaaacaaatccctgaacctgaagcacatcaagcacttcattctagatgagtgcgacaagatgctggaacaactcgatatgagaagagacgtgcaggagattttcagaatgaccccccacgaaaagcaggtgatgatgttctccgccactctgagcaaggagatccgccccgtttgccgcaaattcatgcaagatcctatggagatttttgttgatgatgaaacaaagctgaccctccatggattgcagcaatattatgttaagctgaaagataatgaaaaaaatcgcaaactgttcgacctcctcgacgtcctggaatttaaccaggttgtaattttcgtgaagagcgtgcagaggtgcatcgctttagcccaactgctcgtcgaacagaacttccctgctattgcaatacacaggggaatgccacaggaggagcggctcagtcgctaccagcagttcaaagattttcagcgtcgaatccttgttgccacaaatcttttcggcagaggcatggatatagaaagggtgaacatcgcgttcaactatgacatgccagaggattcggacacgtacttacataggtgctatccactgtctccttctcggtggcctgaacaggctggactggctcccagagcctggctcagccatctgtgtcccatgaggatgatgcctaggtccagcatgatgtgcaggatagctttgagaagcatcctcgtgagctgccttatgcggtag

SEQ ID NO: 184846 - DNA, 696 bp, Artificial Sequence
  Description of Artificial Sequence: Synthetic coding sequence
atggccgagaacgacgtggacaacgagctgctggactacgaggacgatgaggttgagaccgctgccggcggtgacggggctgaggcccccgcaaagaaggatgtgaaaggttcttatgtatcgatccactcttcaggttttagagatttccttctaaaacctgaactgctccgtgctatcgtggactgtggattcgagcatccgtcggaagtacagcacgagtgtattccacaggcaatactgggaatggacgttctttgtcaggccaagagcggcatgggcaaaacagccgttttcgtgttagccaccttacagcaattagagccagtcaccggccaagtgtcagtactcgtgatgtgccacacccgagaacttgccttccagatttccaaggaatacgagaggttttctaaatacatgcctaacgtgaaagtggccgtattttttggtggactgagtatcaaaaaggatgaggaagtactcaagaagaactgcccacacatcgttgtcggtacgcccggcagaattcttgccctggcgagaaataaaagcctaaatctgaaacacataaagcattttatcctcgacgaatgtgataagatgctcgaacagctcgacatgcggcgggatgttcaggaaatctttagaatgactccccacgagaagcaggtaatgatgttctctgcaactctgtag

SEQ ID NO: 184847 - DNA, 99 bp, Artificial Sequence
  Description of Artificial Sequence: Synthetic coding sequence
tgagccaccctgcagcagctggagcccgtgaccggccaggtgtgcttctgcgactctcacttcccgaggggggacaatgaggagctgcatcttccctag

SEQ ID NO: 184848 - DNA, 399 bp, Artificial Sequence
  Description of Artificial Sequence: Synthetic coding sequence
atggccgagaacgacgtggacaacgagctgctggactacgaggacgacgaagtggaaaccgctgccggaggggatggagcagaggctcctgctaagaaggacgttaaggggtcctacgttagtatccactcctccggcttccgcgacttcctgttaaagcctgagctgctgagagctatcgtggattgcggatttgagcacccctcagaggtccaacatgaatgcatcccgcaggcaatcttaggcatggatgtcctttgtcaggcgaaatctgggatgggtaagactgccgtgttcgtgctggctaccctgcagcagctggaacctgtgacaggccaggtctgcttctgcgattctcatttcccacgtggcgacaatgaagaattgcatcttccctag

SEQ ID NO: 184849 - DNA, 399 bp, Artificial Sequence
  Description of Artificial Sequence: Synthetic coding sequence
atggccgagaacgacgtggacaacgagctgctggactacgaggacgatgaagtagagaccgccgcggggggagacggtgccgaggccccggctaaaaaagacgtgaagggaagttacgtgtccatccattcgtcaggattcagggacttcctgctcaaaccagaactgttgagggctatcgtggattgtggtttcgaacacccctcggaagtgcagcatgaatgcatcccccaggccattctgggcatggatgtcctatgtcaggctaagtcaggaatgggcaaaacggcagtatttgtgcttgctacacttcagcaactcgagccagttactgggcaggtgtgcttctgcgattcccatttccctcgcggcgataacgaagagcttcacttgccatag

SEQ ID NO: 184850 - DNA, 738 bp, Artificial Sequence
  Description of Artificial Sequence: Synthetic coding sequence
atgtggaccatgagcagctggaccatgaagatgatgcggtggcggcagcagctgggtgagatgggattgagacctctccctaggcggatgtcacgtgcaccaatgtctccctcaacagctctggcgttcgtgacttcatgttcatctcagagctgcagtgggccccttagcacggtggctctctccattcgccagaaggtggccgtgttcttcggcggcctcagcatcaagaaggatgaggaggtgctgaagaagaactgccctcacattgtggtgggcacccccggcagaatcctcgccctggcacgaaacaaaagcttgaatttaaaacacattaaacacttcatcctcgatgagtgcgacaaaatgctcgaacaattagacatgcggagagacgtgcaggagatctttcgcatgactccacacgagaagcaggtgatgatgtttagcgcgactcttagcaaggagattcgacctgtgtgcagaaagttcatgcaagatcctatggaaatttttgtggacgacgaaacgaagctgacgctccacgggctccagcaatattacgtaaagttgaaggacaacgaaaagaaccggaaactcttcgacctgctggacgtcctcgaatttaaccaggtcgtcatttttgtcaaaagcgttcagcgctgtatcgccctggcacaactccttgtcgagcaaaattttcctgccatcgccattcataggggaatgccacagtag

SEQ ID NO: 184851 - DNA, 696 bp, Artificial Sequence
  Description of Artificial Sequence: Synthetic coding sequence
atggccgagaacgacgtggacaacgagctgctggactacgaggacgacgaggtggaaaccgcagccggaggggacggggcagaagcaccagccaaaaaagatgtgaagggaagctatgtttctatacattcctcaggtttcagagacttcctcctcaagcccgagctgctgcgggccatcgtggattgcggattcgaacatccaagtgaagtgcaacacgaatgtatcccacaggctatcctcggcatggacgtgctgtgccaggccaaaagtggcatgggcaaaaccgcagtgttcgtgctggcaacactccagcaactcgaaccagtgacgggacaggtctcggttttagtgatgtgccacactagggagttagcatttcagatcagtaaagagtacgagaggttttctaagtacatgcccaacgtcaaggtggcagtctttttcggcggactatccatcaagaaggacgaggaagtattaaagaaaaactgcccacatattgttgtggggacccctggccgcatcctggctcttgcccgaaacaagtctctgaatctgaaacacattaaacatttcatcctggacgaatgtgataaaatgttagagcagctggatatgagacgcgatgtccaggagatcttccgcatgaccccccatgaaaagcaggttatgatgttttcggctacactgtag

SEQ ID NO: 184852 - DNA, 732 bp, Artificial Sequence
  Description of Artificial Sequence: Synthetic coding sequence
atgtggaccatgagcagctggaccatgaagatgatgcggtggcggcagcagctcggcgagatgggcctaagacctctgcctaggaggatgtcgcgcgctcccatgtcaccaagcacggctctggccttcgttacatcttgttcctcacagagctgttctggaccactgagcactgtagccctgtctatccgacagaaggtctcagttctcgtgatgtgccacaccagagaacttgcattccaaatatccaaggagtacgaacggttttcaaaatacatgcccaacgttaaggtggcggtcttttttggtgggctcagtattaaaaaagatgaggaagtcctgaaaaaaaattgcccccacatagtggtcggcacacccggccgcattctggcgttggccaggaacaaaagcttgaatctgaagcacataaagcactttattcttgacgagtgcgacaagatgctggaacagctcgacatgagacgggatgtgcaggagatcttccgaatgacaccccacgaaaagcaggttatgatgttttccgctactctgtcaaaggagatacggcctgtctgtcgcaagttcatgcaggatgtgaacaccctgctcccctctctgcctcctctcccagccaggtgccttctacctttcctagcgctcttcttacggcttccctgtcactccagcgctaagaaagccgcatgcgctcaactaggagtcatgactccgtag

SEQ ID NO: 184853 - DNA, 1287 bp, Artificial Sequence
  Description of Artificial Sequence: Synthetic coding sequence
atggccgagaacgacgtggacaacgagctgctggactacgaggacgatgaagtggaaactgcagctggaggagatggcgccgaggcccccgcaaagaaagacgtgaagggtagctacgtttcaatccatagcagcggttttagggactttctgctgaaaccggaactactacgagccattgttgattgcgggttcgaacatccctctgaagtgcagcacgagtgcataccgcaggcgattctcggaatggatgttctgtgtcaggccaagagtgggatggggaagacagctgtcttcgtgctggccacgctgcagcagctcgagccggttacaggtcaggtgtcagttttggttatgtgtcataccagggagctggccttccagatctccaaagagtacgaaagattctcaaagtacatgcctaacgtaaaagttgctgtttttttcggcggcctctcaatcaagaaggatgaggaagtcttgaagaagaattgtcctcacatcgtcgtcggcaccccaggccggattctggcactagcacgcaataagtcactaaacctgaagcatatcaagcactttatcctcgacgagtgcgataaaatgctcgagcagttagacatgcggagagacgtccaggagatctttcgtatgacaccccacgaaaagcaggtgatgatgttttccgcaaccctcagtaaggagataagacccgtgtgtagaaagtttatgcaggatcccatggaaatcttcgtagatgatgaaactaaattgaccctacacgggctgcagcaatattatgtcaagttgaaagataatgagaagaatagaaagctcttcgacctccttgacgtcctcgaatttaatcaggtcgttattttcgtgaaatccgtacagagatgcattgcgctggcacagttactcgtggagcagaattttcctgcaatcgcaatccaccgaggtatgccacaggaggaacggcttagtaggtaccaacagtttaaggacttccagcgccgaatcctggtcgccacgaatctctttggccgcggcatggatatcgagcgcgtgaacatagcatttaactacgacatgcccgaagatagtgatacttatctccatcgcgtggcccgggccggacgcttcgggaccaagggacttgctatcacatttgtgagtgacgagaacgatgccaagattctgaacgatgtccaggataggtttgaggtcaatatttctgaacttccagacgagattgacatcagctcgtacatcgagcaaactaggtag

SEQ ID NO: 184854 - DNA, 1278 bp, Artificial Sequence
  Description of Artificial Sequence: Synthetic coding sequence
atggccgagaacgacgtggacaacgagctgctggactacgaggacgacgaagtggaaaccgccgctggtggggatggggccgaggccccggcaaaaaaagacgtgaagggcagttacgtgagcattcactctagcgggttcagggactttctccttaagccagaattactgcgtgcaatcgtggactgcgggtttgaacatccttccgaagtacagcacgagtgcattccacaagccatactgggtatggacgtcttgtgtcaggccaagtctgggatggggaagacagccgtgttcgtgttggcaactctgcaacagctggagccagtgacgggtcaggtgagtgtactcgtcatgtgccacacccgcgaactggcgttccaaataagcaaggaatacgagaggtttagtaaatacatgcctaacgtgaaggtcgccgtctttttcgggggtctttccatcaaaaaggacgaagaagtgcttaaaaagaactgtccccatatcgtggtggggacaccagggcggattctagcgctcgctcgaaataagagccttaatcttaaacatattaagcactttattttagatgaatgtgacaagatgttggaacagctggacatgaggcgagatgttcaagagatttttagaatgactcctcacgaaaagcaagtgatgatgttctccgcaaccctcagcaaggaaattagacctgtttgtaggaagtttatgcaagacccaatggaaattttcgtggacgatgaaactaagctgaccctgcatgggctacagcaatattatgtcaagttgaaggacaacgaaaagaataggaaactcttcgacctcctggacgtgctcgaattcaatcaagtcgtgatctttgttaaaagcgtgcagcggtgcatcgccctagcccaattactggttgagcagaacttcccagccattgccattcatcgtgggatgccacaggaggagagattaagccgataccaacagttcaaggatttccagcggcgcatcctcgtcgctacaaacctgttcggtagggggatggatattgagcgggtcaacatcgccttcaattacgatatgccagaagattcggatacatacttgcataggtgttaccccctttcaccttcccggtggccggagcaggccgggcttgcgccacgcgcctggctgagccatctgtgtcccatgaggatgatgccaagatcttctatgatgtgccggattgctctgagaagtatcctcgtctcctgtttaatgaggtag

SEQ ID NO: 184855 - DNA, 291 bp, Artificial Sequence
  Description of Artificial Sequence: Synthetic coding sequence
atggccgagaacgacgtggacaacgagctgctggactacgaggacgacgaagtggagaccgcagcagggggggatggggccgaagctcctgctaagaaagatgttaaggggagctatgtgagcattcattcaagtggtttcagggactttctgttgaaacccgagttactgcgtgctattgtagactgtggattcgaacacccttctgaagtccagcacgagtgcattccacaggccattctgggaatggatgttctatgccaggccaagtctgggatgggtaagacttag

SEQ ID NO: 184856 - DNA, 411 bp, Artificial Sequence
  Description of Artificial Sequence: Synthetic coding sequence
atgggcggcggccggcggccctacgacgtgttcttcagcaaggtgatggctgagaatgatgtcgacaacgaacttctcgattatgaagatgatgaggtggagaccgctgcaggcggcgatggcgctgaggctcccgccaaaaaagatgtgaagggcagttacgtctcaatccattccagtggcttccgggatttcttactaaagcctgaacttctcagggccatcgtggactgcggatttgagcatcccagcgaagtgcagcacgaatgtataccacaagccatactgggtatggatgtcttgtgccaggcaaagagtggtatggggaagaccgccgtgttcgtgctagctaccttacagcaactcgaacccgtcacaggccaagtgtccgtattagtgatgtgccattag

SEQ ID NO: 184857 - DNA, 564 bp, Artificial Sequence
  Description of Artificial Sequence: Synthetic coding sequence
tgaagcgaggagcgggacatcggcaagcccatggagatcttcgtggatgacgaaaccaagcttaccctgcatggcctccagcagtactacgttaaactcaaggacaatgagaaaaacaggaaactattcgacctgttagatgtcctggagttcaatcaggttgtgatcttcgttaagagtgtccagagatgcattgcactggctcaactgctggtggaacagaatttccccgccatcgctatccataggggcatgccgcaggaggagcgattatctcgttatcagcagttcaaggatttccagcggcgaattctggtggcaactaacctgttcggtcggggcatggacatcgagagggtcaatatcgcttttaactacgatatgcctgaggattcagatacatatcttcaccgggtggcgcgcgctggcaggttcggcactaagggcttggccatcacctttgtgtcagacgagaacgacgcgaaaatcctgaatgacgtgcaggacagattcgaagttaacatcagcgagctaccagacgagatcgacatcagctcttactag

SEQ ID NO: 184858 - DNA, 717 bp, Artificial Sequence
  Description of Artificial Sequence: Synthetic coding sequence
atggccgagaacgacgtggacaacgagctgctggactacgaggacgacgaagtggagactgccgccggaggcgacggagctgaagctccagcaaagaaggatgtgaagggatcctatgtttccatacattcatctggttttagagatttcctgctgaagcccgaattgctccgggcgattgtggattgtggcttcgaacaccccagcgaagtgcagcacgagtgtatcccacaggccattctcggaatggatgtgctttgccaggcaaagtccggtatggggaaaacggccgtttttgtgcttgcgacactccagcagcttgagcccgtgacgggacaagtgtccgtgctggtgatgtgccacacacgtgagctggcctttcagataagtaaggagtacgaaagattttcgaagtacatgcccaatgtgaaggtcgctgtcttcttcggcgggttgtccattaagaaagacgaggaagttcttaagaagaattgcccccacatagtagtaggcaccccaggaagaatcctggctttagcccggaacaaaagtcttaatctaaagcatattaagcactttatcttggatgaatgcgacaaaatgctggaacagttggatatgcgaagagatgtgcaggagatctttaggatgacaccacacgagaaacaggttatgatgtttagtgccaccctgtccaaggagataagacctgtgtag

SEQ ID NO: 184859 - DNA, 417 bp, Artificial Sequence
  Description of Artificial Sequence: Synthetic coding sequence
tgagccaccctgcagcagctggagcccgtgaccggccaggtgagcgtcctcgtgatgtgtcacactcgagaactggcctttcaaatctctaaggaatacgaacgtttctctaagtacatgccaaatgtaaaggtggctgttttctttgggggactgagtataaaaaaggatgaggaagtgttgaagaagaattgtccacatattgtggtggggactcccggccggatcctggccttggctaggaacaagtcgttgaacctgaaacacataaaacactttatcctggatgagtgcgacaagatgctcgaacagctggacatgcgacgggatgtccaggaaatctttcggatgacaccccatgagaagcaagtcatgatgtttagcgctacgttgtcaaaggagattaggccggtctag

SEQ ID NO: 184860 - DNA, 870 bp, Artificial Sequence
  Description of Artificial Sequence: Synthetic coding sequence
atggccgagaacgacgtggacaacgagctgctggactacgaggacgacgaggtggaaactgctgccggaggcgatggcgccgaagctcctgcgaaaaaggacgtgaaaggcagctacgtatctatccacagttctggctttagggacttccttcttaaacccgagctgctgcgggccatcgtggattgtgggtttgagcatcccagtgaggttcagcatgagtgcataccacaggccatactgggaatggatgtgctgtgccaagcaaagtctgggatgggcaagaccgccgtttttgtcctggcgaccctccagcagctggagcctgtgacgggacaagtatccgttctggtcatgtgtcatacccgagaactcgctttccagatttctaaggaatatgagcgatttagcaagtacatgcctaatgttaaggtagctgtcttttttggagggctttcaatcaagaaggatgaggaagtcctgaaaaagaattgcccacacattgtagttggaacacctggccggatcttagcactagcgcggaacaagagtcttaacctaaagcatatcaaacatttcatactggacgagtgcgataagatgttggagcagcttgatatgagaagagatgtccaagaaatctttagaatgacaccgcatgaaaagcaggtcatgatgttctcggcaaccctctctaaggaaatcagacccgtctgcagaaaattcatgcaggaccccatggagattttcgtcgacgatgaaacgaaactcactctgcacggtctccagcagtattatgtgaaactgaaagataacgaaaaaaaccgaaagttgttcgacctgctggacgtcctggagttcaaccaatag

SEQ ID NO: 184861 - DNA, 1287 bp, Artificial Sequence
  Description of Artificial Sequence: Synthetic coding sequence
atggccgagaacgacgtggacaacgagctgctggactacgaggacgatgaagtcgagacagccgctggaggggatggggcggaggcgccagccaagaaggacgttaaaggttcgtacgtgtctatccacagcagtggatttcgtgatttcctccttaaaccagagctgctgagggcaatcgtggactgcggtttcgagcacccttctgaagtgcagcatgaatgtatcccgcaggccatcctcggtatggatgtcctttgccaagcgaaaagcggtatgggcaagaccgccgtgtttgtccttgccacactccaacagctcgagcctgttacaggacaggtaagtgttctcgttatgtgtcacacgcgggagttggcattccagatcagcaaggagtatgaaagattttccaaatacatgcccaacgttaaggtggccgtgttcttcggaggcctgagtattaagaaggatgaagaagtgctgaaaaagaattgtccacacatcgtcgtcggcactcctgggcgaatcctggcactggctcgcaacaaaagcctgaatctgaagcatatcaaacatttcatcttggatgagtgcgacaagatgctggagcagttagacatgcgaagggacgtgcaggagatctttagaatgaccccacacgaaaagcaggttatgatgttttccgccacgctctccaaggagattcggcccgtgtgtaggaaattcatgcaggatccaatggagattttcgtggatgacgaaacaaagttaacccttcacggacttcaacagtactacgttaaactcaaagataacgaaaagaaccgcaagttattcgatctcctggacgttctagaattcaatcaagtggtgatcttcgtgaagtccgtgcaacgctgtattgcccttgcacagctgcttgtcgaacaaaacttccctgctattgccatccataggggcatgcctcaggaggagcggctttctagataccagcagtttaaagatttccagcggcgcatcctggtagccacaaatctattcgggcgcggaatggatatcgaacgcgtcaacatagccttcaactatgacatgcctgaagactcggatacctacctgcacagggtggcccgcgcaggaagatttgggacgaagggcctcgcaattacattcgtgtccgatgaaaatgacgccaagattctaaacgatgtacaagataggtttgaagtgaatatctcagaactgccagacgaaatcgacatctccagttacatcgagcagacccggtag

SEQ ID NO: 184862 - DNA, 696 bp, Artificial Sequence
  Description of Artificial Sequence: Synthetic coding sequence
atggccgagaacgacgtggacaacgagctgctggactacgaggacgacgaagtggagactgcggctggaggggatggcgccgaggcaccagcgaaaaaggatgtgaaaggtagctacgtgtcgattcattcatctgggttccgggatttcctgctgaaacctgagctcttgcgcgcaatcgttgactgtgggttcgagcacccatctgaagtgcagcatgaatgtataccacaggctatactgggaatggacgttctctgtcaagccaagtctgggatggggaaaacagccgttttcgtgctcgctaccttgcagcagctggagcccgtgactgggcaggtgagtgtcctggttatgtgccacacccgagaactcgcatttcagatctccaaggagtatgagcgctttagcaagtacatgccaaacgttaaggtggctgtttttttcggaggcctcagtattaagaaggatgaagaagtactgaaaaagaattgtccccatattgtcgtgggcacgcccggacggattttggcgctggccagaaataaaagtcttaacctgaagcacattaagcacttcatcctcgacgaatgcgacaagatgctggaacaacttgacatgaggagagatgtgcaggagatcttccgaatgacccctcacgaaaaacaagtgatgatgttctcggccaccttatag

SEQ ID NO: 184863 - DNA, 1287 bp, Artificial Sequence
  Description of Artificial Sequence: Synthetic coding sequence
atggccgagaacgacgtggacaacgagctgctggactacgaggacgacgaggtagagaccgctgcaggcggggatggagctgaggctcctgccaaaaaggacgtgaagggaagttatgtgtcaatccactcctctggcttcagagattttctgctgaaaccggagctattaagagcaattgttgactgcggttttgagcacccaagtgaggtgcagcacgagtgtatacctcaggccattctcggaatggatgtgttgtgtcaagccaaaagtggaatgggcaagaccgcggtgtttgtgctggcaaccttacagcagcttgagccagttactggacaggtatctgtgctagtgatgtgtcacacacgggagctggcatttcagattagtaaggagtatgagcggttctctaaatatatgccaaatgtgaaagtagctgtcttcttcggaggcttatcaatcaaaaaggacgaggaagtcctgaaaaaaaactgccctcatatcgtcgtaggcactccaggtagaattctggctctggcacgcaacaaaagtttaaacctgaagcacataaaacatttcatcctcgacgagtgcgacaagatgctcgagcagcttgatatgcgaagagatgtgcaagaaatattcagaatgactccccatgaaaagcaggtgatgatgttcagtgccactctaagtaaggagattcgccccgtgtgccgaaagttcatgcaggatcctatggagattttcgtggatgacgaaactaagctaacactgcatgggctccagcagtattacgttaaactgaaggataatgagaaaaacagaaagttatttgatctcctggacgtcctggagttcaatcaagtggtgatttttgtgaaaagcgtccagcgctgcattgccctggcccaactgctggttgagcagaactttcctgctatcgcaattcaccgtggaatgccacaggaagaacgcctctctagataccaacagttcaaggatttccaacgccggattctagtggctacgaacctgttcggacggggtatggacatagagcgggtaaacattgctttcaattatgatatgcccgaggattctgatacttacttacacagagtggcccgagctggaagatttggtaccaagggtctagccataacgtttgtatccgatgagaacgacgctaagatcctaaatgatgtccaagaccgctttgaggtgaatatcagtgaactgccagacgagatcgacatatcgtcttacatcgagcaaacacggtag

SEQ ID NO: 184864 - DNA, 378 bp, Artificial Sequence
  Description of Artificial Sequence: Synthetic coding sequence
atggccgagaacgacgtggacaacgagctgctggactacgaggacgacgaagtggagactgccgctgggggagacggtgcagaggctcccgctaaaaaggatgttaaaggaagctatgtatcaattcattcaagtggcttccgagattttttactgaagccagagcttctgagggccatcgtcgactgcggtttcgagcatccatccgaagttcagcatgaatgcattccccaggccatcctcgggatggacgttctgtgccaggccaagagcggcatgggcaagaccgccgtgtttgtccttgccaccctgcaacagctggagccagtaaccggccaggtgtcagttctggtcatgtgtcacacgagagagttgtag

SEQ ID NO: 184865 - DNA, 294 bp, Artificial Sequence
  Description of Artificial Sequence: Synthetic coding sequence
tgagccaccctgcagcagctggagcccgtgaccggccaggtgtgcttctgcgactctcacttcccacggggggataatgaggagcttcacctcccatacgtctctgtttactttctcccaaaggtctctgttttagtaatgtgccatactcgggagctggccttccagattagcaaagagtacgaacgattctctaagtacatgcctaacgttaaggtggcagtttttttcggtggcctgtcgataaaaaaggacgaggaggtgttgaaaaagaattgcccccacatcgtgtag

SEQ ID NO: 184866 - DNA, 291 bp, Artificial Sequence
  Description of Artificial Sequence: Synthetic coding sequence
atggccgagaacgacgtggacaacgagctgctggactacgaggacgacgaggttgaaactgctgcaggcggcgacggtgccgaggcacctgctaagaaagatgtcaagggatcatatgtgtcaatccattcgtccggatttcgagatttcctactaaaacctgaacttttgcgtgctatagtcgactgcgggttcgagcatccttctgaggtccagcatgaatgtatccctcaggctatcttgggaatggacgtgttgtgccaagccaaaagcggtatgggcaaaacttag

SEQ ID NO: 184867 - DNA, 291 bp, Artificial Sequence
  Description of Artificial Sequence: Synthetic coding sequence
atggccgagaacgacgtggacaacgagctgctggactacgaggacgacgaagttgaaaccgcagcaggcggcgatggcgcagaggcccccgcaaaaaaagacgtgaagggctcatacgtctctatccacagctccggctttagagactttctactgaagcctgagctcttaagggctatagtcgattgcggattcgagcacccctcggaagttcagcacgagtgtatccctcaagccatccttggaatggatgtcctctgtcaggctaagtctggcatggggaaaacctag

SEQ ID NO: 184868 - DNA, 1287 bp, Artificial Sequence
  Description of Artificial Sequence: Synthetic coding sequence
atggccgagaacgacgtggacaacgagctgctggactacgaggacgacgaagtggagactgctgctggtggagacggtgctgaagcccccgccaagaaagacgttaaggggagttacgtctcaattcacagtagcggattcagggactttctgctgaaacctgagctgctgagggccatagtggattgcggttttgaacatcccagcgaggtgcagcatgagtgtattccccaggcaatcctaggtatggatgtgctatgtcaggctaaatcaggtatgggtaagaccgctgtttttgtgctggccacccttcagcagctcgaacccgtaaccggccaggtttctgtcctggttatgtgccacacacgggagctagcctttcagataagtaaggagtatgagcggttttcgaaatatatgccaaatgtaaaagttgcagtcttctttggcgggctgagtataaagaaggatgaggaagtgctgaagaagaattgtccacacatcgtggtgggcacaccaggaaggattttggccctggcacgaaacaaaagcttaaatttaaagcatataaagcatttcatcttagacgaatgtgataaaatgctggaacagctcgatatgagacgtgacgttcaggaaatctttcgcatgacccctcacgaaaagcaggttatgatgttttctgcaacgctgtctaaggagatcaggcctgtgtgtaggaaattcatgcaagatccaatggaaatctttgtagatgatgagactaaactgactctgcatggcctgcagcagtactacgtgaagctaaaagataatgagaagaataggaagctttttgacttacttgacgtgctggagtttaatcaggtggtaatcttcgttaaatccgtgcagaggtgtattgccctggctcagttactggtcgagcagaatttcccagcaattgccatccaccgaggaatgccccaggaggaaagactcagcagataccaacagtttaaggattttcagcgtcgcatactcgttgccaccaacctgttcggccgcggaatggacatagaacgcgtgaacatcgctttcaattacgatatgcctgaggattctgacacatacctgcacagggtggcacgagccggccgcttcggcactaaagggctggcaatcaccttcgtgtcagatgaaaacgacgccaagattctgaacgatgtgcaggatcggttcgaggtgaacatttcagagcttccagatgagattgatatatcatcctacatcgagcagactcgatag

SEQ ID NO: 184869 - DNA, 732 bp, Artificial Sequence
  Description of Artificial Sequence: Synthetic coding sequence
atgtggaccatgagcagctggaccatgaagatgatgcggtggcggcaacagctcggtgagatgggcctgcggccattgccaagacggatgtctcgggcgccaatgtcacccagtaccgccctggcttttgtgacatcctgctcatcgcaatcatgcagcggaccactttctaccgttgccctgtctatcagacaaaaggtgtctgttcttgtcatgtgccatacacgagaactggcttttcagatttcaaaagaatacgaaagattctccaagtatatgccaaatgtgaaggtagctgtgttctttgggggcctgtctattaaaaaggatgaggaggtgctcaaaaagaactgtcctcacattgttgtcggaacacccgggagaattttggctctggcacggaataagagcctgaatcttaaacacataaagcactttatactggacgaatgcgacaaaatgctggaacagttggatatgagaagggacgtgcaggagatattcagaatgacacctcatgagaaacaggtaatgatgttttcggccaccttgagcaaagagattcgcccagtatgccggaagtttatgcaggatgtcaatactctgctcccatcactccctcctctccctgccaggtgtttgcttccatttttggcactgttcttaaggctgccctgccacagttccgcaaaaaaggccgcttgcgcccagttgggcgtgatgaccccctag

SEQ ID NO: 184870 - DNA, 972 bp, Artificial Sequence
  Description of Artificial Sequence: Synthetic coding sequence
atggccgagaacgacgtggacaacgagctgctggactacgaggacgatgaggtggagacagccgcaggtggagacggagctgaggctcctgctaagaaagacgtgaaaggcagctatgtgtccatccactccagcggattcagggacttcctgttaaagcccgagctcttacgagccatcgtcgactgtgggttcgagcaccctagcgaggtgcagcacgagtgtatcccacaggcaattctcggaatggacgttctttgtcaggcaaaatctggcatggggaaaaccgccgtcttcgttctagcgactctgcagcagctcgagcctgtgacaggacaggtgtcagtgctagtgatgtgtcatacccgtgagcttgcatttcagatcagcaaggagtatgaacggttctctaagtacatgccaaacgtcaaggtcgcagtgttctttggcggcctgagcattaaaaaagatgaagaggtcctcaaaaagaactgccctcatatagttgtgggcacacctggtaggattctggctcttgctcggaacaagagtctcaatttgaaacacattaagcattttatcctggatgaatgcgacaagatgctcgagcagttagatatgcgtagggatgtgcaggagattttccggatgaccccacacgaaaaacaagtgatgatgttctcagctacattatccaaggaaatccgacccgtgtgcagaaagttcatgcaggacccaatggagatctttgttgacgacgagaccaagctgacactccatggcctgcagcagtattatgtgaaattgaaggacaatgagaagaaccggaaattgtttgacctgctggacgtgctagagttcaatcaggagatcacctgcaaatccgtgcagcggttctctacgaccaacagctgtggctaccagcctatctggccgaggcacggccatcgcgcgggagaacactgcttctag

SEQ ID NO: 184871 - DNA, 972 bp, Artificial Sequence
  Description of Artificial Sequence: Synthetic coding sequence
atggccgagaacgacgtggacaacgagctgctggactacgaggacgacgaggtggaaaccgcagctggcggagatggcgccgaagcccctgcaaagaaggacgtaaagggatcatacgtcagcattcactctagtggatttagagacttcttactcaagcccgagctcctgcgagccatcgtggactgcggattcgagcaccctagcgaggtgcaacacgagtgcattccacaggccatcttgggcatggatgtcttgtgccaggccaagtcagggatggggaaaacagccgtgtttgtgcttgcaactttgcagcagctggagcccgtcaccggacaagtgtcggtcctggtaatgtgccacacaagagagctggctttccaaatcagcaaagaatatgagcggttttcaaaatatatgcccaatgtcaaggtcgccgttttttttggtggcctgtctatcaagaaggacgaagaggttctaaagaagaactgccctcacatcgtggtaggaacgccggggaggattttggcactggcccggaataaaagtctaaacctgaaacacatcaagcatttcatcttagatgagtgcgataaaatgctggaacaactggacatgagacgcgacgtgcaggaaatcttccgtatgactccacacgagaaacaggtaatgatgtttagtgccacactcagtaaagagattcggcctgtgtgtcgaaagtttatgcaggatccaatggagattttcgtcgacgatgaaactaagctgaccctacatggcttgcagcagtattatgtgaaactaaaagataatgagaaaaatcgcaagctgttcgacctcctagacgtgttagaattcaatcaggaaataacctgtaaaagcgtgcagaggttttctaccaccaattcatgcgggtaccagccaatttggccccgacacggacatcgggcaggggaacattgcttctag

SEQ ID NO: 184872 - DNA, 1332 bp, Artificial Sequence
  Description of Artificial Sequence: Synthetic coding sequence
atggccgagaacgacgtggacaacgagctgctggactacgaggacgatgaggtcgagactgcagctggaggcgacggggccgaagcacccgccaagaaggatgtaaagggctcctacgtgagtatccatagcagcggatttagggatttcctcctcaagccggagcttctcagggcgatagtggactgcgggttcgaacatcctagcgaggtacagcatgaatgcattccccaagcaatcctaggaatggatgtcttgtgccaggccaagagcggcatggggaagactgcagtgttcgtgctcgccacactgcaacagctagaaccagtcaccggacaagtttatctgggtagggtcctcggccgtggattttggtgcgtgttcgtgagcgtgctggtgatgtgccatacacgcgagcttgcattccaaatatccaaggagtatgaaagattcagtaagtacatgccaaacgtcaaagtagcagtgtttttcggtggcctttccataaagaaagacgaagaggttcttaaaaagaattgtccgcacatcgtggttgggaccccaggacgcatcctggccttagcacgcaataagagccttaatctcaaacacatcaaacacttcatattggatgaatgtgacaaaatgctagagcagctggacatgcggcgcgatgttcaggagatttttcgcatgacaccccatgaaaagcaagtaatgatgttcagtgcaaccttatccaaggaaataagacccgtatgtagaaaatttatgcaggatcccatggagattttcgtggacgatgaaacgaagctcacactgcacggcctgcaacagtactacgttaagctaaaggataatgaaaaaaatcgtaagctttttgatctgctcgacgtgttagagtttaatcaggtggtgatttttgtgaagtccgtccaacgctgcattgccttagcccagctgctggtcgaacaaaattttccagcaatagcaattcaccgcggcatgcctcaggaggaaaggctctcccggtatcagcagttcaaagactttcaacgaaggattttggtggccacaaatctgtttggtagaggaatggacatagaacgtgttaacatcgcattcaactacgatatgccggaggacagtgatacttaccttcaccgggtggccagggccggcaggttcgggactaaggggctggctatcacctttgtttcggatgagaacgacgcgaagattttgaacgatgtccaagaccggttcgaagtgaacatcagtgagctgcccgacgagatagacattagctcctacatcgagcagacccgctag

SEQ ID NO: 184873 - DNA, 732 bp, Artificial Sequence
  Description of Artificial Sequence: Synthetic coding sequence
atgtggaccatgagcagctggaccatgaagatgatgcggtggcggcaacagctgggcgaaatgggactcagaccactcccacgccgcatgtcacgcgctcctatgagtccctccacggccctcgcctttgtgacgagctgttcttcacagtcatgcagcggccctcttagcactgttgctctaagcatccgtcagaaagtatctgtgctagtgatgtgccacacacgcgaacttgcttttcaaatctccaaggaatatgaaaggtttagtaagtacatgcccaatgtgaaagtcgccgtcttcttcggtggcctgagtatcaagaaggatgaagaggtcctgaagaaaaactgtccccacatcgtggtcggtacaccgggacgcatcctcgccctggcccgaaataagagcctaaacctgaaacatattaagcatttcatcttagacgaatgcgacaagatgctggaacagctcgacatgaggagggacgtccaggaaatctttaggatgaccccccacgaaaagcaagtaatgatgttttccgctacattgagcaaagagatccgacccgtttgccgaaagtttatgcaggatgtgaatactctactgcccagccttccgccccttccagcgcggtgccttttacctttcttagctctgttcctgcggctgccctgtcactcatccgctaagaaagcagcctgcgcccagttgggtgtgatgacaccctag

SEQ ID NO: 184874 - DNA, 1332 bp, Artificial Sequence
  Description of Artificial Sequence: Synthetic coding sequence
atggccgagaacgacgtggacaacgagctgctggactacgaggacgatgaggtcgagaccgctgctggtggagatggggctgaagcccccgctaagaaggatgtgaaggggtcttacgtttcaattcacagcagcggcttcagagactttttgctgaagccggagcttcttagggctatcgtagactgcggatttgaacatccatctgaggtccagcatgagtgcatcccacaggctatcctgggcatggacgtactgtgccaggctaagtccggcatgggcaagacagctgtcttcgttctcgctacccttcagcagctcgagcccgtcactggtcaggtctatctgggcagggtgctgggtagagggttctggtgcgtgttcgttagcgtgcttgtaatgtgtcatacccgggaactggcttttcagatctccaaagagtatgaacgtttctccaaatatatgcccaacgtgaaggtggcggtgttctttggcggactgagcataaaaaaggatgaggaagtgttgaaaaaaaactgtccacacatcgtcgtgggaacgcccggcagaatcctggccctggctcgtaacaagtcacttaacctcaagcatattaaacacttcattcttgatgaatgcgacaagatgctggaacagctcgacatgaggagagatgtccaagagatatttcggatgactcctcacgaaaaacaggttatgatgttttccgctacactctcaaaggagatcaggcccgtgtgccgcaagttcatgcaagatccaatggagatctttgttgatgacgagactaagttaactctgcacgggctccagcaatactacgtgaagttaaaggacaacgagaagaatagaaagctgttcgacttattggacgtactcgagttcaaccaggtagttatttttgttaagtccgtgcagagatgcattgctctggctcagctgctggtggaacaaaatttcccggcaatcgcaatccataggggaatgcctcaggaggaacgcctttctcgatatcagcagtttaaagactttcagcggagaatcctcgtggctactaacctgttcggccggggaatggacatcgaaagggtgaacatcgccttcaattacgatatgcctgaagactctgatacttacttgcacagagtggcccgagcaggcaggtttggaaccaaagggctggcaatcacttttgtgagcgatgaaaacgacgccaaaatccttaacgacgtgcaggacaggttcgaagttaacatcagcgagcttcctgatgaaattgatatctcaagttacatagaacagactcgatag

SEQ ID NO: 184875 - DNA, 420 bp, Artificial Sequence
  Description of Artificial Sequence: Synthetic coding sequence
atggccgagaacgacgtggacaacgagctgctggactacgaggacgatgaggtggagaccgccgcaggaggagatggagcggaagccccagctaagaaggacgtcaagggatcatacgtctctatccattcaagcggttttcgcgactttctacttaaacccgaattgttaagagccatcgtggattgcgggtttgagcacccatcagaggtccagcacgagtgtatccctcaagcaatcctggggatggatgtcctatgtcaggcaaaatctgggatgggaaaaaccgctgtgtttgtacttgcaaccttgcaacagctcgagcccgtgacaggacagagccatgagcatatgacatctgtcactctggacaacttaaccgccgttggggacgtattgtcccaagcttggggttcctag

SEQ ID NO: 184876 - DNA, 732 bp, Artificial Sequence
  Description of Artificial Sequence: Synthetic coding sequence
atgtggaccatgagcagctggaccatgaagatgatgcggtggcggcaacaactgggggagatgggcctgaggcccctgccccgcaggatgtctcgggctcccatgagcccgagcactgccttggcctttgtcacatcctgtagcagccagtcgtgctccggccctctttcaaccgtcgccctctcaattcgacagaaggtctcagtactagtgatgtgccatacaagagaactggcctttcagatttccaaagagtacgaacggttctccaaatacatgcccaacgtgaaagtagctgtgttcttcggagggctgagcattaagaaggatgaggaggtcctaaagaagaattgtccacacatcgtggtggggacaccaggaagaatcttggctcttgcccgaaataaaagccttaacctcaagcacataaaacacttcatactagatgaatgtgacaaaatgctggaacagctggacatgagacgggatgtgcaggaaatatttcggatgacaccccatgagaaacaggtgatgatgtttagtgccactctgtctaaggagatcaggccagtgtgcaggaagttcatgcaggacgttaacactctattgccaagcttgcctccccttcctgctaggtgcctacttcccttcctagccttgttccttcggctcccatgtcacagctccgcgaaaaaagcagcttgcgcgcaacttggagttatgactccgtag

SEQ ID NO: 184877 - DNA, 732 bp, Artificial Sequence
  Description of Artificial Sequence: Synthetic coding sequence
atgtggaccatgagcagctggaccatgaagatgatgcggtggcggcaacagttgggggaaatgggattaaggcccctcccaagacgcatgtctcgtgctcctatgtccccctccaccgccctggcttttgtaacctcttgcagtagccagtcttgcagcgggccccttagtaccgttgcactcagcatcagacagaaagtcagcgttttggtgatgtgtcacacccgggagcttgcgtttcagatttccaaggaatatgaaaggttctccaaatatatgccaaatgtcaaagtcgccgtcttctttggaggactcagcatcaaaaaggacgaggaggtcttaaaaaaaaactgtccgcatatcgtagtgggcacacccggtagaatcctggctctcgcccgaaataagtcccttaatctgaaacatattaaacatttcatattggacgagtgtgacaagatgcttgagcaactggatatgcggcgggacgttcaggagatattccgtatgactccccatgagaaacaggtgatgatgttttccgctacactgtccaaggagatcagacccgtctgccgaaaatttatgcaggacgttaatactttactgccatccttgccccctctgccggcacggtgcctgctgcccttcctggcacttttccttcgactgccctgccattcgagtgcaaagaaggcagcgtgcgcccagttaggtgtcatgacaccttag

SEQ ID NO: 184878 - DNA, 420 bp, Artificial Sequence
  Description of Artificial Sequence: Synthetic coding sequence
atggccgagaacgacgtggacaacgagctgctggactacgaggacgatgaagtggaaactgccgcaggcggtgatggggcagaagcccccgcaaaaaaagacgttaaaggaagctacgtgtcaattcacagtagcggatttcgtgatttcctgctgaaacccgaactgctgcgcgctattgtagattgcggatttgaacacccctcggaagttcaacacgaatgtattccacaggccatactggggatggatgtactttgccaagcaaagtctggaatgggtaagactgctgtcttcgttctggcaactcttcagcaactcgaaccggtaactgggcagtcacacgagcacatgacatccgtcactctcgacaatttaacagccgtcggggacgtcctctctcaggcatggggctcttag

SEQ ID NO: 184879 - DNA, 972 bp, Artificial Sequence
  Description of Artificial Sequence: Synthetic coding sequence
atggccgagaacgacgtggacaacgagctgctggactacgaggacgatgaggtcgagactgctgcgggaggtgatggggccgaagcacccgcaaagaaagatgtcaaggggtcttacgtgagcatccattcctcggggtttagagattttcttctgaaacctgaactgctgcgcgcaattgtggactgcggatttgagcacccctcagaagtccagcacgaatgcattccccaggcaatcctggggatggatgtcctgtgccaagctaagagtggtatgggtaaaactgctgtgtttgtgcttgccacactgcagcagctagagcctgtcactgggcaagtgagcgttcttgtaatgtgccacacaagagaactggctttccagatttccaaagagtatgagagatttagcaagtacatgcctaacgtgaaagtagcagtgttcttcgggggactgagcatcaaaaaggatgaggaggtactgaagaagaactgtccccacatagtggtgggtaccccaggacggattctggctctggctaggaacaagagcctgaacctaaagcacatcaaacactttatcctcgatgaatgtgataagatgctcgagcagctcgacatgaggagagacgtgcaggaaatcttcagaatgactcctcatgagaagcaagtgatgatgtttagtgccaccctttctaaagagattcggccagtgtgccgaaagttcatgcaggatcctatggaaatctttgtggatgacgagaccaaactgacactgcatggcctccagcagtactatgtgaagttgaaggacaacgagaaaaacaggaaactgtttgatctgctggatgttctggagttcaaccaagaaattacctgcaaatctgttcagcgattttctaccaccaactcctgcggctaccagcccatctggccccggcacggccaccgagccggcgagcattgcttttag

SEQ ID NO: 184880 - DNA, 1332 bp, Artificial Sequence
  Description of Artificial Sequence: Synthetic coding sequence
atggccgagaacgacgtggacaacgagctgctggactacgaggacgatgaggtcgaaaccgcggccggcggggatggtgccgaggccccagcaaagaaggatgtgaaaggctcctatgtctctattcactccagcgggttccgggactttctacttaagccagagctccttcgagctatcgttgactgtggattcgagcatccaagcgaagtgcagcatgagtgtatcccacaagccatcctggggatggacgtgctgtgccaggccaagagcggaatggggaaaactgcagtgttcgtgcttgcgacacttcagcagttggaacctgtcaccggccaggtctatctgggaagagttttgggacgggggttctggtgcgtgtttgtttcagtccttgtgatgtgccatacccgagaactggcatttcaaatatccaaagagtatgagcgtttcagcaagtacatgcccaacgtaaaagttgcagtctttttcggtggcctcagtatcaaaaaagatgaagaagttttgaaaaaaaattgtcctcacatcgtggtggggacacctggtaggatcttggctcttgcgcgtaacaagtcattaaatcttaaacacatcaaacactttatcttagacgagtgtgacaaaatgctggaacaactggacatgcgaagagacgtccaggagatatttaggatgacaccccacgagaagcaggttatgatgttttctgccacgctgagtaaggaaattagacccgtgtgccgcaaattcatgcaggatcccatggagatctttgtggacgacgagaccaagttaactcttcacggtcttcaacaatattatgtgaagctcaaagataatgagaaaaaccgcaaactctttgacctgctggatgtgctggaatttaatcaggtggtcattttcgtgaaaagtgtacagagatgcatcgcactggctcagctcttggtcgaacagaacttcccggcaattgctatacatagaggtatgccccaggaggaaaggctctctcgctatcagcaattcaaggactttcaaagacggatcttagttgcaacgaacctgtttggtcgaggcatggacatcgaaagagtgaacatcgcctttaactacgatatgcccgaggattctgatacctatctgcacagggtcgctcgcgccggtaggtttggaactaaaggcctagcaatcacgttcgtatcagacgagaacgatgctaaaatcttaaacgatgtgcaggatcgattcgaggttaatatctccgaactccccgatgagatcgatattagctcttatatcgaacagacacgatag

SEQ ID NO: 184881 - DNA, 732 bp, Artificial Sequence
  Description of Artificial Sequence: Synthetic coding sequence
atgtggaccatgagcagctggaccatgaagatgatgcggtggcggcaacagttaggagagatgggacttaggccattgccacgaagaatgtccagggcccccatgagtccctctacagcactcgcttttgtcacgagttgcagctcgcagtcctgttctggacctctgagtactgtggcactatcaattcgccagaaggtgtctgtcttagtcatgtgtcacacccgcgaactcgccttccaaataagtaaagagtatgagagattctcaaaatatatgcccaatgttaaagtggccgtatttttcgggggactttccattaagaaagacgaggaggttcttaaaaagaattgccctcatattgtggtcgggacccccggccgaatcttggcactcgcccgaaacaaatctctgaatctcaagcacatcaaacactttattcttgatgaatgcgacaagatgctcgaacagttggacatgcgacgcgatgtgcaagagatattccgcatgaccccacatgaaaagcaggtgatgatgttctccgcgaccctttccaaggagattaggcccgtgtgtaggaagttcatgcaggacgtaaacaccttactgccgtcactgccacctttgcccgcccgatgtctgctcccattcttggctctgttcctacgcttgccctgccattctagcgcaaagaaggcagcgtgcgcccagctcggagtgatgacaccttag

SEQ ID NO: 184882 - DNA, 1053 bp, Artificial Sequence
  Description of Artificial Sequence: Synthetic coding sequence
atgtggaccatgagcagctggaccatgaagatgatgcggtggcggcagcaactcggcgaaatgggcctccgaccactgcctcgccggatgagccgcgcgcccatgagtccttcaacagcgctggcctttgttacaagttgcagcagtcagtcatgttcaggaccgctgagcaccgttgcgctgtccattcgccagaaggtcgctgtgttctttggaggcttgtcaatcaagaaagatgaagaggttttgaaaaaaaactgtccacacatcgttgtgggcacccccggtcgaatacttgccctggcacgaaacaagtcactgaacctgaaacacattaaacactttattctggacgagtgtgacaaaatgctggaacagctggacatgcgaagggacgttcaggagatattcagaatgacaccacacgagaaacaggtcatgatgtttagcgccactctatcgaaggagattcggccggtttgtcgcaaatttatgcaggacccaatggagatatttgtcgacgacgagaccaagctgaccctgcatgggctgcagcagtactatgtcaagttgaaggataacgaaaagaatcgtaagctcttcgaccttttggacgtgctggagttcaatcaagtggtgatcttcgttaagtctgttcaaagatgtatcgctctcgctcagctgctagtggagcagaatttcccagctatcgcaatccatcggggcatgccccaggaggagcggctgagtcgctatcagcagttcaaggacttccaacgtcgtatattagtcgccaccaatctgtttgggcgagggatggatatagaaagggtgaacatcgcttttaattacgacatgccggaggattctgacacatacttgcaccgagtcgccagagccgggaggttcggaaccaaaggcctcgcaatcactttcgtgtccgatgagaatgacgcaaagattttaaatgatgtgcaagacaggttcgaagtgaacatctccgagctgcctgacgagattgacatctcctcctatattgagcagactcgctag

SEQ ID NO: 184883 - DNA, 1332 bp, Artificial Sequence
  Description of Artificial Sequence: Synthetic coding sequence
atggccgagaacgacgtggacaacgagctgctggactacgaggacgatgaggtagaaacggcagctggaggcgacggggccgaggctcccgccaagaaggacgtcaagggaagctatgtgagtattcattcttccgggtttagggactttctgttgaaaccagaactgctgcgtgccatcgtggattgcggattcgaacaccccagcgaggttcagcatgagtgcatacctcaagctatcttggggatggacgtcctatgtcaggccaaatctggcatggggaagaccgccgtctttgtgttagccacgctgcagcagctggaacccgtaaccggtcaggtgtatttgggaagggttctcgggcggggattctggtgtgtgttcgtttccgtgctggttatgtgccacactagagaactcgccttccaaatcagcaaagagtatgaaaggttttccaagtatatgccgaacgtaaaagtggcagtcttcttcggagggttgtccatcaaaaaggatgaggaggtactaaaaaagaattgccctcatatcgtggtggggactccaggtcggatccttgccctagccaggaataagtctcttaacttgaaacatatcaagcattttatactggacgaatgtgataaaatgctagagcagctcgacatgaggcgcgatgtgcaggagatattccggatgaccccccacgagaaacaggtgatgatgttctctgccactcttagcaaggagattaggcctgtgtgccgtaagtttatgcaagatcctatggaaattttcgtcgatgatgagacaaagttgaccttacacggtctgcaacaatattacgtaaagctcaaagataatgagaagaaccgcaagcttttcgacttattggatgtcttagagttcaatcaagtggtgattttcgtgaagtccgtacagcgctgtattgcccttgcccaactgctcgtggaacagaacttccccgccattgccatccacaggggcatgccccaagaggagcgtctgtccagataccagcaatttaaggattttcaacgtcgtattctggtagccactaacctgttcggacgagggatggacattgagcgcgtgaacattgccttcaattacgatatgcctgaagatagcgacacctacctccatagagtcgccagagccggacggttcggcacgaagggcctcgccatcacctttgtgtcagatgaaaacgacgctaagatcctcaatgatgtccaggatcgcttcgaggtgaacatcagcgagctgccagatgaaatcgacatctctagttacatagaacagaccaggtag

SEQ ID NO: 184884 - DNA, 1053 bp, Artificial Sequence
  Description of Artificial Sequence: Synthetic coding sequence
atgtggaccatgagcagctggaccatgaagatgatgcggtggcggcagcaactgggagagatgggcttaaggcctctgccaagacgtatgtctagggcacctatgagcccgagtaccgccctcgcctttgttacgtcctgctcttcacagtcatgttccggccccctgagtactgtggccctcagcatcaggcagaaggttgccgttttcttcggagggttgagtattaaaaaggatgaagaggtgcttaaaaagaattgtccgcatatcgtggtggggactcctggtcgaattctggccctggcccgcaacaagtcactcaatctaaaacatatcaagcatttcattctcgacgagtgtgataaaatgttggagcagctagatatgcggagggatgtgcaggaaattttccgaatgaccccccacgaaaaacaggtgatgatgttctctgctaccctgtctaaggagatcaggcccgtttgtagaaagtttatgcaggaccctatggaaatcttcgtggacgacgagaccaaattgactcttcacggcctccagcagtattatgtaaagctcaaggataacgagaagaaccggaagctgttcgacctcctcgacgttctcgagttcaaccaggtggtcatttttgtgaagtccgtgcagcggtgtatcgcgctcgcccaactcctagtagagcagaacttccctgccatcgccatccacagggggatgccccaggaggaacgactatcccgctaccagcagtttaaagattttcaacggcggatacttgttgccaccaacctattcggcaggggtatggatatagagagagtgaacattgccttcaattacgacatgcctgaggactctgacacctacttgcatcgtgtagccagagctggccgcttcggtacaaagggattggcaattacctttgtgtcagacgagaatgacgctaagatactgaatgatgtgcaggatcgcttcgaggtgaacatcagtgagcttcccgacgagattgatatcagttcttacatcgagcagacacgttag

SEQ ID NO: 184885 - DNA, 732 bp, Artificial Sequence
  Description of Artificial Sequence: Synthetic coding sequence
atgtggaccatgagcagctggaccatgaagatgatgcggtggcggcaacaattaggggagatgggattgagaccattaccgcggcgcatgtcacgagcgccaatgtcgccatccaccgctctggcattcgtcactagctgtagcagccagagctgtagcggaccgctatctactgtggccctttcaattcgccagaaggtgagcgtactggtgatgtgtcataccagagagctcgctttccagattagcaaggagtatgagcgattctcgaagtacatgccgaacgtgaaagtagcagtcttcttcggtggattatctattaaaaaggatgaagaggtgcttaaaaagaactgcccacatatcgtcgtgggaacccctggcaggattctggcgctggccaggaataaaagtctaaacctgaaacacatcaagcatttcatcctggatgaatgcgacaagatgctggagcagctggacatgcgccgggatgttcaggaaatttttagaatgaccccccatgagaagcaggtgatgatgttttccgcaacgctcagcaaggagattagaccagtgtgtcgtaaatttatgcaagatgtgaacactttgctgccctcattaccacccctgccggcccgctgtctgctgccattcctggcccttttcctgcggctcccctgtcattcctctgcaaaaaaagccgcctgtgcccaactaggggtgatgactccatag

SEQ ID NO: 184886 - DNA, 420 bp, Artificial Sequence
  Description of Artificial Sequence: Synthetic coding sequence
atggccgagaacgacgtggacaacgagctgctggactacgaggacgacgaagtggagactgcagcagggggcgacggcgccgaagcgcccgcaaagaaggacgtgaagggcagttatgtcagtatccactcaagtgggttccgtgactttttgctcaagcccgagctcctgcgcgccattgtcgactgcggcttcgaacacccttctgaggtccagcatgaatgcatcccacaggcgattctcgggatggacgtcctatgccaagccaagtccggtatgggtaagacagccgtttttgtgctggcgaccctccaacagctggaacctgtgacggggcaatctcacgaacatatgactagcgtgactctggacaacctgactgccgtgggagacgtgctgagtcaggcgtgggggtcctag

SEQ ID NO: 184887 - DNA, 1053 bp, Artificial Sequence
  Description of Artificial Sequence: Synthetic coding sequence
atgtggaccatgagcagctggaccatgaagatgatgcggtggcggcagcagctgggggagatggggctgcggccccttcccaggcgcatgtccagggcaccaatgtcaccctctacggccctcgcctttgtgacttcttgcagctcccagagctgctctgggccactctctacagtggccttgtcaattcgccagaaagtagcagtcttttttggggggctgtcaattaagaaagacgaggaggtattaaaaaagaattgtccacacatcgtcgtgggaacccccggcaggatactggctttagccaggaacaagtcattgaatctgaaacatattaagcacttcatcctcgatgagtgtgacaaaatgcttgagcaactggacatgcggagggacgtccaggagatctttaggatgactccgcatgagaaacaggtcatgatgttctctgcaaccctctcgaaggagatccgtccggtctgtcgcaaatttatgcaggatccgatggaaatcttcgtagacgacgagactaagctgacactccacggactgcagcagtactacgtaaaactgaaagacaacgagaaaaacagaaagctgttcgacctgctggatgtgctggagtttaaccaggtggtgatattcgtcaaatcggtccagcgatgcatagctctcgcccaactgctggtcgaacagaattttccagcgatagccatccacagaggaatgcctcaagaggagagactgagtcggtatcagcagttcaaggacttccagagacgaatcttggtcgcaactaatttattcggacggggcatggatattgagcgggtgaatattgctttcaactatgacatgcctgaagattcagacacctacctgcaccgcgtggctcgagccggccggtttggcaccaaaggactggcaattactttcgtgagtgatgaaaatgatgctaagatccttaacgacgtccaagatcgtttcgaggtcaatatttccgagctcccggatgagattgacatcagcagttatatcgagcagacacgctag

SEQ ID NO: 184888 - DNA, 972 bp, Artificial Sequence
  Description of Artificial Sequence: Synthetic coding sequence
atggccgagaacgacgtggacaacgagctgctggactacgaggacgacgaggtggaaacagccgccggaggggatggggcagaggcacccgcgaagaaagatgtgaaaggatcctatgttagcatccattcatcagggttcagagactttctgctcaaaccagaactactgcgcgcaattgtcgactgtgggtttgaacatccgtctgaagtgcagcatgagtgcatcccacaagctatcctggggatggatgtgctctgccaggccaagtccgggatgggcaagacagcagtttttgtactggccaccttgcagcagttggagccagttactggtcaggtgtccgtcctggtcatgtgtcataccagggagctggcattccagatctcaaaggagtacgagaggttctcaaagtacatgccaaatgtgaaggtcgccgtcttttttggtggcctgagcattaaaaaggacgaggaggtgcttaagaaaaactgcccacacatcgtggtggggacaccaggccggattctcgccctggccagaaacaagtccttgaatctgaagcatattaaacactttatcctggacgaatgtgataaaatgctggaacaattagatatgcgacgggatgtgcaggagatttttcggatgacgccccacgaaaagcaagtaatgatgttttcagctactctctccaaagagataagaccggtctgcagaaaattcatgcaggatcccatggagatttttgtagacgacgagactaaactgaccctccatgggctccagcagtattatgtcaagcttaaggacaatgagaaaaatagaaagctttttgacctactcgacgttttagagttcaaccaggagattacatgcaaaagcgtgcagcgattctccacaaccaacagttgcgggtatcagccaatttggccgcgacacgggcacagggctggcgagcactgtttttag

SEQ ID NO: 184889 - DNA, 1053 bp, Artificial Sequence
  Description of Artificial Sequence: Synthetic coding sequence
atgtggaccatgagcagctggaccatgaagatgatgcggtggcggcagcagctgggcgagatgggtctgagacctctacctcgcaggatgagcagagcgcccatgtccccaagcaccgcactagccttcgtgacttcctgctcatcacaatcctgtagtgggccattgagcacagtggcccttagcattcgacagaaggttgctgtctttttcggcgggctgagcatcaagaaggacgaagaggtcctgaaaaaaaattgtccgcatatcgtggtggggaccccaggtagaatccttgctctcgcacggaataagtcccttaatctgaagcatatcaaacacttcatactcgatgagtgtgacaagatgttagaacagttagatatgaggcgtgacgtgcaggagatatttcgcatgactcctcacgagaaacaagttatgatgttctcggcaaccctgtctaaagagataagacctgtgtgcagaaagttcatgcaggacccaatggaaatattcgtggacgacgagactaagctgactctacatggcttgcagcagtactacgttaagctgaaggacaatgagaagaaccgcaagctgttcgacctcctggacgtcctggagtttaaccaagtggtgatattcgtaaaaagtgtgcagcggtgcatcgctttggcccaacttctggtggagcagaatttcccagccatcgccatacatagggggatgccccaggaagagcgcctgtcacggtaccagcagtttaaagatttccaaagacgcattctggtggcaacgaacctgtttggacgtgggatggatattgagcgcgtgaatatcgcattcaactacgacatgccagaggatagcgatacctatttgcatcgggtggctcgggccgggagatttggaacaaagggacttgctatcactttcgtctccgacgagaatgacgccaaaatcttaaatgatgttcaggatagatttgaggtgaacatcagcgaactcccagatgagattgacattagcagttacatagagcagaccaggtag

SEQ ID NO: 184890 - DNA, 420 bp, Artificial Sequence
  Description of Artificial Sequence: Synthetic coding sequence
atggccgagaacgacgtggacaacgagctgctggactacgaggacgacgaggtggagacggctgccggaggcgatggagcagaagccccagctaagaaggatgtgaagggttcgtatgtgtccatacattcctctggcttcagagactttctcttgaaacctgaactgctccgggcaatagtggactgcggcttcgagcatcccagtgaagtgcagcacgagtgtatacctcaagcaatcctgggcatggatgtcctttgccaggctaagtcaggcatgggaaagactgcagtatttgtgctagccaccttgcaacagctcgagcctgtgacgggtcagtctcacgaacatatgacatcagtgacccttgacaatctcactgccgttggggacgtgctttcacaggcttggggatcttag

SEQ ID NO: 184891 - DNA, 1332 bp, Artificial Sequence
  Description of Artificial Sequence: Synthetic coding sequence
atggccgagaacgacgtggacaacgagctgctggactacgaggacgatgaagtggaaactgccgcggggggggatggcgcggaggctcctgccaagaaggacgtcaagggatcctacgtttctattcacagctcgggcttcagagacttcctactcaaacctgaactccttagggccatcgtggactgtggtttcgaacacccatccgaagtgcagcatgagtgcattccccaggcaatcttaggcatggacgtgctttgccaggcgaagtccgggatgggaaaaacagcagtctttgtgttagcaactctgcagcagctggaacccgtaactggacaggtatatctaggtcgcgtgctcggcaggggcttctggtgcgtcttcgtctctgtgctggtcatgtgccacacccgggagctggctttccagatttcaaaagagtacgaaaggttttctaagtatatgcccaacgtgaaagtcgccgtgttttttggaggccttagcattaagaaagacgaagaggttctaaagaagaattgccctcacatcgtggtgggtacacctggacgcatcctggcactggccaggaacaaaagtttgaatctcaaacatattaagcatttcatcctcgacgaatgcgataaaatgctggaacagctggacatgaggagagacgtgcaggaaatctttcgcatgactcctcacgaaaagcaggtgatgatgttcagtgccacactgtctaaggaaatccgccctgtctgccgaaaattcatgcaagatcccatggagatatttgttgacgatgaaactaagctgactctgcatggcctccagcagtactacgtgaaactgaaggacaacgagaagaaccgcaaactttttgacctgttggatgtgctagagttcaaccaggtggtgatttttgtgaaatccgtccagcgttgcattgctctggcacagctattggttgagcagaactttcctgcaatcgccattcacagagggatgcctcaagaggagcggctgagccggtatcaacagtttaaagatttccagcgccgtatcctcgtggccacaaatttgtttgggcgcggcatggatatcgagcgcgtcaacatagccttcaattatgacatgccggaggattctgacacctacctgcaccgagtggcccgcgccgggcgatttggcacaaaaggtttggccattaccttcgtgtctgacgagaacgatgctaaaatcctcaacgacgtgcaggatcggtttgaggtcaatatctccgagctacccgatgaaatcgatatcagctcttatattgaacaaacacgctag

SEQ ID NO: 184892 - DNA, 972 bp, Artificial Sequence
  Description of Artificial Sequence: Synthetic coding sequence
atggccgagaacgacgtggacaacgagctgctggactacgaggacgatgaggtggaaacagcggcgggaggagacggggcggaggcccctgccaagaaagacgtgaagggatcttacgtctccattcattcaagcgggtttagggatttcctcctcaaaccagagttgttacgggccatcgttgattgtggattcgagcatccctccgaagtccagcacgagtgcatacctcaagccatccttgggatggatgttctatgtcaggctaagagcggcatgggcaagactgccgtgttcgttctcgccacactccagcaactggagcctgtgactggccaagtgagcgttctagtcatgtgtcacacacgcgagctggcttttcagatttcaaaagagtacgagagattttccaagtacatgcctaatgttaaagtggccgtttttttcgggggattatctataaaaaaggacgaggaggttttgaagaaaaattgcccccacatcgtcgttggcactcccggtcgcatcctagccctggccaggaacaaaagcctaaatctgaagcacataaagcattttatcctcgatgagtgcgataaaatgctcgagcagctggacatgcgacgagatgtgcaggaaattttcagaatgacgccacacgagaagcaagtcatgatgtttagcgccaccctgtccaaggagatccgacctgtttgtcgaaaattcatgcaagaccctatggagattttcgttgatgatgagacaaagcttacactgcacggtcttcagcagtactacgttaagctgaaggataacgaaaagaaccgtaaacttttcgacttgctggacgtgctagagtttaaccaagagatcacatgtaaatcggtacagaggttctccacaaccaacagctgtggataccagcccatttggccacgccacggtcatcgtgcaggggagcactgtttttag

SEQ ID NO: 184893 - DNA, 972 bp, Artificial Sequence
  Description of Artificial Sequence: Synthetic coding sequence
atggccgagaacgacgtggacaacgagctgctggactacgaggacgacgaggtggagactgccgccggcggtgatggggcagaagctccagccaagaaggacgtgaagggaagctatgtgtccatccactcgtccggtttcagagattttctcctgaaacctgaactactgagggctatcgtggactgtggctttgagcatccaagtgaagtgcagcatgaatgcattccccaggccatcttgggtatggacgtgctctgtcaggctaaaagcggcatgggaaagaccgccgtcttcgttctggcaacattgcagcagctggagccagtgaccggccaagtctctgtattggtgatgtgtcacaccagggagttagctttccaaatctcaaaagagtacgagaggttctccaagtacatgccaaacgtgaaggtcgccgtgttttttgggggactgtcgattaaaaaggacgaagaagtgttaaaaaagaactgccctcatatcgtagtcgggacccccggtcgcattcttgctctggcccggaataagtcactgaatttgaagcatatcaagcacttcattctggatgagtgcgataaaatgctagagcaactagacatgcgacgggacgtccaggaaatttttagaatgaccccccacgagaagcaggtcatgatgttttcagcaaccctctccaaagagatccgacccgtgtgcagaaaatttatgcaggatcccatggagatcttcgtcgatgacgagacgaaattgaccctccacggattgcagcagtattatgtgaagctgaaggacaacgagaaaaaccggaagctgtttgacctcttagatgtactggagttcaaccaggaaatcacgtgcaagtcagttcaaagattttcaacaactaatagctgtggctaccaacccatttggcccaggcatgggcacagggcaggcgagcactgcttttag

SEQ ID NO: 184894 - DNA, 1053 bp, Artificial Sequence
  Description of Artificial Sequence: Synthetic coding sequence
atgtggaccatgagcagctggaccatgaagatgatgcggtggcggcagcaactcggcgagatgggcctacgtcctctcccgcgacgcatgtcccgggctccaatgagccctagcaccgccttggctttcgtgaccagctgcagcagtcagtcctgcagcggccctttgagcaccgtcgccctgtcaatccgacaaaaagttgctgtgttcttcgggggattgagcattaaaaaagatgaggaggtgctgaagaagaactgtccacatatcgttgttggtaccccagggcggatcctggccctcgcacggaacaaaagtttgaatctaaaacacatcaagcacttcatactcgacgaatgtgacaaaatgctcgaacagctcgacatgcgtcgagatgtgcaggaaatctttaggatgaccccgcatgaaaagcaagtgatgatgtttagcgctacattgagtaaggagatcagacctgtgtgtcgtaagtttatgcaggaccccatggagatctttgtggatgacgaaacaaagctgaccctacatggtctgcaacaatactacgtgaaattgaaggataacgaaaagaatcgcaaactgttcgacctattggacgtccttgaattcaatcaggtggtgatctttgtcaaatctgtccagcgatgtatagctcttgctcagctgttggtggagcagaatttccccgccatagctatccaccgaggcatgccccaggaagaaagacttagtagataccagcaattcaaggatttccagaggaggatcttggttgctaccaacttatttgggagggggatggatattgaacgggtaaacatcgcgtttaattacgacatgccagaagactctgacacatacctgcaccgggtggctagagcagggcggttcgggacaaaagggctggccataaccttcgtcagcgacgagaatgatgcgaagatactcaacgatgtgcaggatagatttgaagtgaatatctctgagttgcccgatgaaatcgatattagctcatacatcgaacagacacgatag

SEQ ID NO: 184895 - DNA, 420 bp, Artificial Sequence
  Description of Artificial Sequence: Synthetic coding sequence
atggccgagaacgacgtggacaacgagctgctggactacgaggacgacgaggtcgagacagcagccggaggggacggcgcggaggcgccagctaaaaaggacgtaaagggatcctacgtgtcgattcattctagtggcttccgcgactttctgttaaaacccgaacttttgagggccattgttgattgcggatttgagcaccccagtgaagtgcagcatgaatgcattcctcaggctatattaggcatggacgtcctttgccaagcgaaatcgggcatgggaaagactgccgttttcgtgttagcaaccttgcagcagctggaacctgttacgggccaatcccacgaacacatgacgagcgtcacattggacaacctgacggctgtgggtgacgtcttgtcgcaggcctgggggagttag

SEQ ID NO: 184896 - DNA, 1053 bp, Artificial Sequence
  Description of Artificial Sequence: Synthetic coding sequence
atgtggaccatgagcagctggaccatgaagatgatgcggtggcggcagcaactaggcgagatgggcctcaggccacttccaagacgcatgagccgtgccccgatgtcaccaagcacagcgctcgcctttgtgacctcatgctcttcccagtcttgcagcggcccactctccaccgtggccctgtccattagacagaaggtggcagtcttctttgggggcttgagcattaagaaggatgaagaggttctgaagaagaactgcccgcatattgtggtgggtactcccggccgtattctggctctggccagaaataaatctctgaaccttaagcacatcaagcattttattcttgatgaatgtgataagatgctggagcagctggacatgcgccgcgacgtgcaggaaatattccggatgacaccacatgagaagcaagtcatgatgttctcggcgacactttcaaaagagattcgccctgtgtgtcggaaatttatgcaagatccgatggagattttcgtggacgatgagaccaagctcacgctacacggtctgcagcagtattatgttaaattgaaagataatgagaagaacagaaaacttttcgatttgcttgatgtgctcgaattcaaccaggttgtgatttttgtcaagagcgtgcagcgatgcattgctctggcccagctgctagttgagcagaatttcccggctatcgcgatccaccgcgggatgccacaggaggagaggctgtccaggtaccaacagttcaaggacttccagaggcggattctggtcgctaccaatctcttcggacgggggatggacattgagcgtgttaatattgcattcaactacgacatgccggaagactctgatacttacctgcaccgcgtcgcgcgggccggaaggttcggaaccaaggggctcgctattacttttgtatccgatgaaaatgatgcaaagatcctcaacgatgtgcaggatcgcttcgaagtcaacattagtgaactgccagacgagatcgatatcagttcttacatcgaacagacacgctag

SEQ ID NO: 184897 - DNA, 420 bp, Artificial Sequence
  Description of Artificial Sequence: Synthetic coding sequence
atggccgagaacgacgtggacaacgagctgctggactacgaggacgatgaggtggaaacggccgcgggcggtgacggcgccgaggctcctgccaaaaaggacgtaaagggaagctatgtcagcatccattcttctggttttcgcgactttctgctaaagcctgaattgctgagggccatagtggattgtgggttcgaacacccatctgaagtgcagcacgaatgtatcccacaggctattctggggatggatgtgctatgtcaggcgaagtccggtatggggaagactgccgtgttcgtgctggccactctgcagcagctggagccagtcacaggtcagtcccacgagcacatgacaagcgttactctggataacctgaccgcggtgggcgacgtattatcacaggcttggggatcgtag

SEQ ID NO: 184898 - DNA, 1332 bp, Artificial Sequence
  Description of Artificial Sequence: Synthetic coding sequence
atggccgagaacgacgtggacaacgagctgctggactacgaggacgacgaagtggagactgccgccggaggagatggggccgaagctcctgctaagaaggacgttaaaggctcctatgtatcgattcatagctctggattcagagactttcttcttaagcctgagctgctgcgcgccatcgtggactgcggcttcgagcacccttctgaagtccaacatgagtgcatcccacaggcaatcttaggaatggatgttctgtgtcaggccaagtcagggatgggcaagaccgcagtctttgtgcttgctaccttgcaacagctggaacctgtcacaggccaggtatacctgggaagagtgctcgggcgtgggttctggtgcgtgtttgtgagtgttttagtgatgtgccacacacgagaactggcattccagattagtaaggagtacgagaggttcagcaaatacatgcctaatgtgaaagtcgccgtcttcttcggagggctctccataaaaaaggacgaggaagtgctcaagaaaaactgcccacacattgtggtgggtacacccggccgcatcctcgctctggcccgaaacaagagcctaaacctgaagcacattaaacacttcattcttgatgagtgtgacaaaatgctggaacagttggatatgcgacgggatgtgcaggagatcttccgcatgacccctcacgaaaagcaggtgatgatgtttagcgccacactctccaaagaaatccggccggtgtgtagaaagttcatgcaagatccaatggagatcttcgtcgacgatgaaaccaagctcactttacacggcctgcaacagtattatgtaaaattgaaggacaatgagaaaaatcgaaagctgtttgacctgctcgacgtgctggaattcaatcaagtggtgattttcgtcaagtcggtacagaggtgtatcgcgctggcccagctgctcgtggagcagaatttccccgccatcgccattcataggggcatgcctcaggaggaaagactgtcgcggtaccaacaatttaaagattttcagcgaagaatattagtcgcaaccaatcttttcggaaggggaatggacatagaaagagttaatatcgccttcaactacgacatgcctgaggactccgacacttatctgcatcgggtcgcccgcgcgggacggttcggaacgaagggactggccatcacctttgtgtccgacgagaacgatgccaagatcctcaatgatgttcaggatagattcgaggtgaacatctccgaactgcctgacgagatagacatcagcagttacatcgagcagactaggtag

SEQ ID NO: 184899 - DNA, 552 bp, Artificial Sequence
  Description of Artificial Sequence: Synthetic coding sequence
atggagatcttcgtggacgacgagaccaagctgaccctgcacggcctgcagcagtactatgttaagctgaaggataacgaaaagaatagaaaactgttcgacttgcttgacgtgctggagttcaaccaagtggtcattttcgtgaagagcgtccaacgatgcatcgcactcgcccagctgctggtggaacagaactttccagccatcgcaatacaccgtggcatgccccaggaagagaggtggttgagcagataccagcagtttaaagatttccagcgacgtatcctcgtcgcaacaaacttattcggacggggtatggacatagaaagggtcaatattgctttcaactacgacatgcctgaagactccgacacctatctgcatagggtggctcgggccgggagattcggtactaagggactggcaattacttttgtcagcgatgagaacgatgccaaaatcttgaatgacgtgcaggaccggttcgaagttaatatctccgagcttcccgacgagattgatatatcatcctatattgagcagacccggtag

SEQ ID NO: 184900 - DNA, 2073 bp, Artificial Sequence
  Description of Artificial Sequence: Synthetic coding sequence
atgggcgacgaggactgggaggccgagatcaacccccacatgagcagctacgttccgatattcgagaaggacagatacagtggagaaaatggagataatttcaacagaactcctgcttcgtcctctgagatggacgatgggccatccagacgcgaccacttcatgaagtcggggttcgcttccggaaggaactttggaaatcgcgatgctggagaatgtaataaaagggataatacatcaaccatgggggggttcggggtcgggaaatcatttggaaaccgcggcttttcaaattcacgctttgaagacggcgattctagcggtttctggcgggaatcatccaatgactgcgaggacaacccaactcgaaaccggggcttcagtaaacggggcgataacgatttggaccctgacgagtgtatgcaacggactggtggcctgtttggttccaggcgcccagtgctgagtggaacgggcaacggagatacttcccagtctaggtcaggctcaggatctgaaagaggaggatacaagggactgaacgaagaggtaatcaccggatccgggaagaactcttggaaatccgaggcagagggaggggaaagcagcgacacccaaggccccaaagtgacatacatcccaccgccccccccagaagacgaagactcaattttcgcccactatcagacggggatcaacttcgataaatacgatacaatcctcgtggaggtgagcggacacgacgcaccccctgccatactaacattcgaggaggcaaatttgtgtcagaccttgaataacaatatcgctaaggccgggtacaccaagctgacccctgtccagaagtacagcattccgatcatattggcaggccgcgacctcatggcttgtgcccagacaggcagcggaaagacggccgcttttctcttgcccatcttggcgcacatgatgcacgatggcatcaccgctagcaggtttaaggagctgcaggaacctgaatgcataattgtggcccccacaagggaactcgttaatcagatctatctggaggcaaggaaatttagttttggcacatgcgtgagggccgtggtgatttacggcggaacccagttgggacatagcattcggcagattgtccaagggtgtaacatattgtgtgccacccctggccgcctgatggacatcatcggcaaggagaagataggccttaaacagatcaaatatctagtgctcgatgaagcagaccgcatgttggatatggggtttggaccagaaatgaaaaagctcatttcctgccctgggatgccctctaaagaacagcgacaaaccttgatgttctcggcaacctttcccgaagaaattcaaagactggccgccgaatttctcaagagtaactatctgtttgttgccgtcgggcaggtgggcggggcttgtagggatgtacagcagacggtactccaggtgggccagtttagcaaacgggagaaactggtggaaatactcagaaacatcggtgatgagcgcacaatggttttcgtagagacaaagaagaaagcagacttcatagccacctttctgtgtcaggagaagatatccacaacatctatccacggagacagagaacagcgcgagcgggaacaagccttaggcgacttcagatttggcaaatgcccggttctcgtagccacatcagtggccgcgcgaggtctggacatcgagaacgtccagcacgtaatcaattttgatctgccctcaacgatcgacgagtacgtgcacaggatcggtcgaacaggccggtgtggcaatacaggaagagctatcagcttttttgatttggaatctgataaccatctggcccagccattagtgaaagtgctgactgacgcacagcaggatgtccccgcatggctcgaggagatcgccttcagcacttatatccctggtttttcggggtccactagaggcaacgtgttcgccagcgtcgatacaaggaaaggaaagtccacgttgaacacggccgggtttagttcctcccaggcacccaatcctgttgacgacgagtcatgggattag

SEQ ID NO: 184901 - DNA, 2073 bp, Artificial Sequence
  Description of Artificial Sequence: Synthetic coding sequence
atgggcgacgaggactgggaggccgagatcaacccccacatgagctcatatgtgccaatcttcgaaaaagatagatactcaggagagaatggcgataactttaatcgcactccagcctcttcttccgaaatggacgatgggcctagccgtcgggatcatttcatgaagtctggctttgcctcaggcaggaacttcggcaatcgagacgctggggagtgtaataaacgggataatacaagcaccatggggggctttggagttgggaaaagttttggcaaccgtggtttttccaatagccgcttcgaagatggcgacagttctgggttctggcgggagtcctcaaatgactgtgaagacaatccaacccggaataggggtttttcgaagcgtggggataacgacctggatcccgacgagtgcatgcaacgcacaggcggtttattcggctccaggagacctgtgctgagcgggaccggcaacggggacacttcccagtcccgctcaggatcaggaagtgagcgggggggttataaggggcttaatgaggaggtgatcacaggttcggggaaaaatagctggaaatccgaagctgaaggaggagagagctccgatacccaaggcccgaaggtaacatatattcccccaccgcctcctgaggatgaagatagtatcttcgcacattaccaaacaggcatcaacttcgacaaatatgataccattcttgtcgaggtttcgggccatgatgctccgcccgctattctgacgtttgaggaagccaacctgtgccaaacacttaacaacaatattgcgaaggccggctacacaaaactcaccccagttcagaagtattccatcccaattattctggccggtcgggacctcatggcttgtgcccagaccggctctggaaaaaccgcagctttcctgctgcccattcttgcgcacatgatgcatgacggaattacggcttccagattcaaagagttgcaggagccggagtgcatcatcgtggcccccacccgggagctcgtgaatcaaatctatctagaagccagaaaattctcgttcggcacatgcgtgagggccgtggtgatatacggcggaacacagcttggccactctatcaggcaaatcgtccaaggttgtaatattctgtgcgccacccccggaaggcttatggacatcattgggaaggaaaagatcgggctcaaacaaataaaataccttgtgctcgacgaagctgaccgcatgttagacatgggctttggacctgaaatgaagaaactgataagttgtcctgggatgccctccaaggagcagcgacaaactctcatgttctctgcaacatttcccgaggagatacaacggttagccgcagagtttctgaaatccaattacctgttcgtcgcagttggccaagtagggggtgcctgtagggatgttcagcagacagtactgcaagtgggacaatttagcaaaagggagaagttggtcgagattttacggaacataggagatgagagaaccatggtgttcgtggaaaccaagaagaaagccgattttatagccacattcctttgtcaagagaaaatcagtaccacctccatccatggtgatagggagcagagggaaagagagcaggctctgggcgatttcagatttggcaagtgtcccgtattagtagcaaccagcgtggctgcaaggggactggacatcgagaacgttcagcacgtgataaacttcgacttgccatctacgatcgacgaatatgtgcaccgcattggaaggaccggccgctgtggaaacactggacgggccatttcctttttcgacttagaatccgataaccacctcgcacagcccctggtgaaagtcctgaccgatgctcaacaagatgtgccagcctggctggaggaaatcgcattttctacatatatcccgggctttagcggctcaacaaggggaaacgtcttcgcctcagtcgatacccgtaaggggaaaagcaccctgaatactgcgggcttctccagctcccaggcgcctaatcccgtcgacgatgagagctgggactag

SEQ ID NO: 184902 - DNA, 2175 bp, Artificial Sequence
  Description of Artificial Sequence: Synthetic coding sequence
atgggcgacgaggactgggaggccgagatcaacccccacatgagcagttatgtccctatctttgagaaggaccgttattccggagaaaatggagataacttcaaccggactcccgcctcatcaagcgaaatggacgacggccctagcagacgcgatcattttatgaagagcggctttgccagcggtcgcaacttcggcaaccgggatgccggggaatgtaataaacgcgataataccagtactatgggtgggttcggggtgggtaagagcttcggaaatcggggcttcagcaattcccggtttgaagatggggactcctctggcttttggcgggaaagctctaacgactgtgaagacaacccaactagaaatcggggattcagcaaacgcggaggatacagagacggcaacaattccgaggcgtctgggccttatagacgcggtggaagagggtcgtttcgaggctgcagaggagggtttggtctgggatctccaaacaacgatctagatccagatgagtgcatgcagcggactggtgggctcttcggtagccgccgtccagtgctgtccggcaccggcaatggggacaccagccagtctcggagtggctcaggctccgagagaggcggctacaagggcctcaatgaggaggtaataacgggatccggcaaaaattcctggaaatccgaggctgaggggggagagtcgagcgatacccaaggacccaaagtgacatacattcctccgccgccacctgaggacgaggacagtattttcgcccactatcagaccgggattaactttgacaagtacgatacaattctggtggaggtctccggccatgatgccccccccgctattctgaccttcgaagaagcaaatctctgccagacgcttaacaataacatcgcaaaggccgggtacaccaagttaacccctgtacagaagtatagcattcccatcatcctggctggcagagaccttatggcctgtgcacaaactggctcagggaagaccgcagccttcctcctgcctattctggcccacatgatgcatgacggaataacagcctcccggttcaaagagctccaggaaccagagtgcataatcgtggcccccactcgggagctggtcaaccagatatatttggaggcaaggaagtttagcttcgggacgtgtgtcagagcggtggtaatctatggaggtacacagctcggccactccattagacagatcgtgcagggctgcaacatattgtgcgcaacacccggtcgattaatggacatcataggaaaagaaaaaattggccttaaacagatcaagtacttagtcctggacgaggcagatagaatgttggacatggggtttggcccggagatgaaaaagcttattagttgtccaggaatgccgagcaaggagcagaggcagacgctgatgttcagtgcgacatttccggaagaaattcagcgcctcgcagccgagtttctgaagtcaaactatttgttcgtggctgtgggacaggtgggcggagcctgccgtgacgtccagcagactgttctgcaggtaggacaatttagcaaaagagagaaattggtcgagatcctccgcaacataggtgacgagcgcactatggtctttgtggaaacaaaaaagaaagctgacttcatcgcgacatttctgtgccaggagaagataagtacaacttctatccatggcgaccgagagcaaagggagcgcgagcaggccttgggcgacttccgctttggtaaatgtccggttcttgtggcaaccagcgttgctgcgcgcggcctggacattgaaaacgtgcagcatgtgatcaatttcgaccttccttccaccatcgacgagtacgttcacagaatcgggcgaaccggtcggtgcgggaatacaggccgcgcaattagtttctttgacctggagtctgataaccacctggcccaacctctggtcaaggtcctaactgacgcgcaacaagatgtccctgcctggttggaggaaatcgccttctctacctacattccaggcttcagtgggtcaacaaggggtaacgtcttcgccagcgtggatacccgcaagggtaagtccactctcaacaccgcgggcttctcatcttcccaggccccgaatccggtggacgatgagtcctgggattag

SEQ ID NO: 184903 - DNA, 318 bp, Artificial Sequence
  Description of Artificial Sequence: Synthetic coding sequence
atgggcgacgaggactgggaggccgagatcaacccccacatgagctcttacgtgccaatctttgaaaaggatagatatagcggagaaaacggcgataacttcaacagaacccccgcttcgtccagtgagatggatgatggcccttctcgacgagaccatttcatgaaaagtgggtttgcctccggccgcaatttcggaaatcgagatgctggcgaatgtaacaagcgggacaacacgagcacaatgggtggcttcggcgttggaaagtcttttggaaatagaggattctccaattcccgcttcgaggatggagactag

SEQ ID NO: 184904 - DNA, 2115 bp, Artificial Sequence
  Description of Artificial Sequence: Synthetic coding sequence
atgggcgacgaggactgggaggccgagatcaacccccacatgagctcctatgtccccatttttgagaaggatagatatagcggggaaaatggggataatttcaatagaacacctgcttcctcttccgagatggatgatggccctagccgacgtgaccacttcatgaaatccggtttcgcaagcggtcgtaatttcggtaacagggacgctggggagtgcaacaaacgggataatacttcaacaatggggggctttggcgtcgggaagtctttcggcaatagaggtttctctaatagtaggttcgaagacggggatagttcaggattctggcgcgggtatcgagacggcaataactccgaggctagcggcccttaccgtcgtggcggaaggggcagtttccggggctgtcgggggggatttggtctgggatcccctaataatgacctggatccagacgagtgcatgcagaggaccggcgggctcttcggatctcggcgccccgtgctctcaggcaccggaaacggggacacctcacagagtcggtccgggtctgggagcgagagagggggctacaaagggctcaatgaagaagtcattacgggtagtgggaagaactcttggaaaagcgaagcagaagggggggaatcatctgatactcaggggcccaaggtaacatatatccccccaccaccccctgaggacgaagattccatctttgcacactaccagaccggaatcaacttcgacaagtatgacactatattggtggaggttagcggtcacgacgcccctcccgcgattctgacatttgaagaggccaatctgtgccagaccctcaataacaacattgccaaggccgggtacaccaaactgactcctgttcagaagtactccatacccatcatcttagccggacgagacctcatggcttgtgcccagacgggatctgggaagacagcagccttcctgctccccattttggctcacatgatgcatgatggcattaccgcttcaagattcaaagaattacaagagcctgagtgcatcattgtcgctcctacacgcgaactcgtgaatcaaatctatctggaggctcggaaatttagttttgggacatgcgtgcgggccgtagtgatttacgggggcacccagttggggcactcaatccgccagattgtccaaggctgcaatatcctgtgtgccacaccggggcggttaatggacataatcgggaaggaaaaaataggcttaaagcagatcaagtatctagtcttggatgaggccgaccgaatgttagatatggggttcggccctgagatgaagaagctgatctcatgtccaggcatgccatctaaagaacagagacaaacgttgatgtttagcgccaccttccctgaggagatacaacggctggctgccgaatttctgaagagtaactatctcttcgtcgctgtagggcaagtgggcggagcatgccgggacgtgcagcaaactgtgctgcaggtcggccagttcagcaagagggagaagctcgtggaaattttgcgaaatattggtgacgagagaaccatggtgtttgttgaaacaaagaaaaaggcggattttatcgccacatttctgtgtcaggaaaaaatctctaccacatcgatacacggcgatcgtgaacagagggagcgcgaacaagctctgggcgacttcagattcggtaaatgtccagtgcttgtggccacaagcgttgccgccagggggttggacattgagaacgtgcaacacgtaatcaactttgatttgcctagcacgattgatgaatacgtacacaggattggccggactgggcgctgcgggaacactggacgagccattagtttctttgacctcgaaagcgacaaccacctggctcaaccactagtaaaggtgttaactgatgcccagcaggacgtacctgcgtggctggaggaaatcgcatttagtacatacatccccggcttctcaggcagcacccgcggaaacgtctttgcgagcgtggacacaagaaagggaaaatcaactttaaatacggccgggtttagttctagtcaagcacccaatccagttgacgatgagtcatgggattag

SEQ ID NO: 184905 - DNA, 480 bp, Artificial Sequence
  Description of Artificial Sequence: Synthetic coding sequence
atgggcgacgaggactgggaggccgagatcaacccccacatgagctcctatgtgccaatcttcgagaaagatcggtactccggtgagaacggggacaatttcaacagaaccccggcatcctcctcagagatggatgacggacccagcaggcgcgatcatttcatgaagagtgggttcgctagcggcagaaactttggaaaccgggatgcaggcgagtgtaataaaagagataacacgagcactatggggggcttcggcgtcggaaagagctttggtaatcgagggtttagcaacagcagattcgaggacggagactcttccggcttctggcgggagtctagcaatgactgcgaggacaatcccactcgtaataggggcttctctaaaaggggggggtaccgcgatgggaataatagtgaggcttctggcccttacagacgtggtggccgcgggtcttttaggggttgtcgtggcggctag

SEQ ID NO: 184906 - DNA, 1728 bp, Artificial Sequence
  Description of Artificial Sequence: Synthetic coding sequence
atgggcagccggaacctgttcctgaccaacagccccgagagcagcaacgactgtgaggacaatcccactagaaaccggggtttcagcaaaagaggggataacgaccttgacccagatgaatgcatgcagcggacaggggggctctttgggagccggcgccctgtcctgagcggcaccggtaacggcgacacaagccaaagtaggtctggctctggaagtgagcgggactcatggaagtctgaggctgagggcggcgaatctagtgacacccagggaccgaaggtcacctacatccctccaccaccgccagaggacgaggatagcatttttgcacattatcagacagggattaacttcgataagtacgacaccattttggttgaagtctcaggtcatgatgcccctcctgcgatactgacctttgaagaagctaatctgtgtcagactctgaacaataacatcgccaaggcaggctataccaaactgacccccgtccagaaatatagtatcccaattatccttgcggggagagaccttatggcatgcgcgcagacggggtccggcaagaccgccgcttttctcctgcccatccttgcacacatgatgcacgacggcattacagccagccggttcaaagaacttcaggaaccagaatgcatcattgtggcaccaactagggagctcgtgaaccagatctatttggaggccagaaaattttcattcggaacctgcgtcagggctgtagtgatctacggggggacacaactcgggcacagcatcagacagatcgtgcagggctgcaatatcctctgcgcaactcctgggcgtttaatggatattatcggaaaggaaaagatcggtctgaagcagattaaatatctggtcctggacgaggctgatcgcatgctggatatggggtttggccccgagatgaaaaaactaatcagctgtcccggcatgccatcgaaagagcagagacagacgctgatgttcagcgcgacatttcccgaggagatccagcggcttgctgctgagtttctgaaaagcaattacctgtttgtggccgtgggccaggttggcggtgcatgtcgagacgtacagcagacggtactccaagtcgggcaattctctaaaagggagaagctggttgagatcttacgcaatataggcgacgagcgtaccatggtctttgtcgaaacaaagaaaaaagccgactttattgctacctttctgtgccaggaaaagattagcaccacctctatacacggtgatagagaacaaagggagcgggagcaggcactgggggacttcaggtttggcaagtgccccgttctggtagcaacctccgtcgccgctcgtggtctggatatcgaaaacgtccagcatgtgattaattttgacctgccaagcacaattgacgagtacgtgcaccgcataggaaggactgggcgctgtggaaacacaggcagggctatatcattctttgacctggagagtgacaaccacctggcccagccccttgtgaaggtcctgacagatgcgcagcaggacgtgcccgcctggctagaggagatcgccttttcaacttacatccctggatttagcggaagcacccgcgggaacgtattcgccagcgtggacaccaggaaaggtaaatcaacgttgaatactgcaggcttctcttcatctcaggcccccaatcctgtggacgacgaaagctgggattag

SEQ ID NO: 184907 - DNA, 1869 bp, Artificial Sequence
  Description of Artificial Sequence: Synthetic coding sequence
atggaggagagcgagcccgagcggaagcgggcccggaccgacgaggtaccagcagggggcagccgctcggaggccgaagacgaggatgacgaagattatgtcccatatgtaccactaagacagcgccgccaactcctgttgcagaagttactgcagcggcggagaaagggagccgccgaggaggagcaacaagactccgggtccgagcccaggggcgacgaagacgacattcccttaggtccccagtcgaacgtctctcttctcgatcagcaccagcacttaaaagagaaggccgaagccagaaaagaatccgcgaaagaaaagcaattgaaagaagaggaaaagattttggagtcagtggctgaagggagggcactcatgtccgtgaaagaaatggcaaaggggattacatacgacgaccctataaaaacaagttggactccaccccgatacgtgttatccatgagtgaggagcgacatgaaagagttagaaagaagtaccatatcctggtagagggcgacgggattcctcctccaattaaatccttcaaagagatgaaattcccagctgctatactgagaggactgaagaaaaaaggcatccatcatcctaccccaatacaaatccaaggcatcccaacaattctttccggtcgggatatgatcggaatagccttcacgggttcaggcaagactctggtgtttacgctgcccgtgatcatgttctgtctggaacaggaaaagagactgcctttctccaagcgcgagggaccatatggcttgatcatttgtccaagtagggaacttgctcgccaaacacacggaattcttgagtattattgtcggctgcttcaggaagacagcagtcccttactgaggtgtgcgctctgcatcgggggaatgtcagtcaaagagcaaatggagaccatccggcatggcgtgcacatgatggtggctactccagggcggcttatggatctgttgcagaagaaaatggtgtctcttgatatttgccgctacctagccctggatgaggcggaccgcatgatcgacatgggtttcgaaggggacatccggactatcttttcttactttaaggggcaaaggcagactctgctgttctcagccacaatgcctaagaagatccagaactttgcaaaaagtgctttagtgaaaccagtgaccatcaacgtggggagggcgggggcagcttcacttgacgtaatacaagaggtcgagtacgttaaggaagaagccaaaatggtgtatctgctggagtgtctccagaagacacctcccccggtgttgatcttcgctgagaagaaagcagacgtggacgccattcacgaatacctgctgctaaaaggcgtggaagcggttgctatccatggagggaaggaccaggaggagcggacaaaggccatagaggcctttcgtgaaggtaaaaaagatgtgctggtggccacggatgtcgcctccaagggtctggattttccagccatccagcatgttattaactatgatatgccggaagagattgagaactacgtgcatcgcatcggcagaacaggaaggagtggaaacaccggtatcgcaaccacctttattaacaaggcctgcgacgagtcagtgctgatggacctgaaagctctgttgttggaagcaaaacagaaggtccctcctgtgctccaagtgctgcattgtggtgatgagtctatgctggatattgggggggagcgaggatgtgcgttctgcggaggtcttgggcacagaattacggattgccctaagcttgaggcgatgcaaaccaagcaggtgagtaatataggtagaaaagactacctggctcacagctcaatggacttctag

SEQ ID NO: 184908 - DNA, 1881 bp, Artificial Sequence
  Description of Artificial Sequence: Synthetic coding sequence
atgcaccagatccggaagagcgagtacacccagcccacccccatccagtgtcaaggggtaccagtcgctttgagcgggagggacatgatcggcattgctaagactgggtctggtaaaacggccgcttttatttggcccatgttaattcatataatggaccagaaagaactggaaccaggggatggacccatagccgttattgtgtgcccgactcgggagctttgtcagcaaatccacgcagagtgtaaaaggttcggaaaagcatacaacctgcggtctgtcgccgtgtatggcggaggatccatgtgggaacaggccaaagctcttcaagaaggggcagagatagtggtttgtacgccgggtaggttaatcgaccacgtgaagaaaaaggccactaatctccagcgagtaagctatctggtgtttgatgaggctgacaggatgttcgacatgggctttgaatatcaggtccgctcgatcgcttcacacgtgcggccagataggcaaactcttctcttttctgcgacttttaggaagaagatcgagaagttggcccgagacattttgatcgatcccattcgtgtggtccagggcgatatcggcgaagcaaacgaggatgtgactcagatcgtcgaaatcctccactctggtccatccaagtggaattggctgactaggcgcctagtcgaatttacttcttcgggatccgtcttgctcttcgttaccaaaaaagccaacgcagaagaactggcaaacaacctcaagcaggagggtcataacctggggctgttgcatggcgacatggaccagagtgaacggaacaaagttattagtgattttaagaagaaggatattcccgtgctggttgcaacggatgtcgccgcgagagggcttgatatcccatctatcaagaccgtgattaactacgacgttgcaagagacatcgacaccttgcttactccgaaagacagtaacttcgccggcgatttggttagaaacctcgagggggcaaaccagcacgtctccaaggaacttctggatctggccatgcagaacgcctggtttcgaaaaagcagatttaaaggcgggaaaggcaaaaagttgaacatcggcggcggcggcctcggctatagggaacggccgggccttgggagcgagaacatggataggggcaacaacaatgttatgtctaactatgaggcatataaaccttccaccggagccatgggggaccggttaactgccatgaaggccgccttccaaagccagtacaagtcacactttgtggccgcttccctctctaatcagaaagctggctcaagtgctgctggcgcaagtggctggacttccgccggttccctgaatagtgtgcccacgaactccgctcaacaaggacacaactcgcccgattcccccgttactagtgcagctaagggcatccctggatttggaaatacaggtaatatctccggcgccccagtgacttatccatccgccggtgcacagggggtcaataataccgcctctgggaacaattcaagggagggtacaggcggcagtaatggtaaaagagagcgctacacggagaaccggggaagcagccgacactctcacggggagaccggcaataggcattccgattctcctagacacggcgacggcggcagacatggggatggctataggcatccggaatcctcaagtagacatacggatggccataggcatggcgagaatagacacgggggctccgcgggccgtcatggggaaaatcggggtgcaaatgacggacgtaacggcgaatcacgcaaagaagccttcaatagggaatccaagatggagcccccacctaaaaggaagaaatcccgatgggattcttag

SEQ ID NO: 184909 - DNA, 2817 bp, Artificial Sequence
  Description of Artificial Sequence: Synthetic coding sequence
atgaactggaacaagggcggccccggcaccaagcggggcttcggctttggagggttcgccataagtgccgggaaaaaggaggagcccaaactgccacagcaaagtcattcagcatttggggccacatcctcttcaagtggttttgggaaatccgcacctccccagctgccgtccttctacaagatcggctctaaaagggccaactttgacgaggaaaatgcttactttgaggacgaggaggaagacagttctaacgtcgatctgccgtacatcccagccgagaatagtcctaccaggcagcagtttcactcgaaaccagtcgattccgacagtgacgacgatccattagaagcttttatggccgaggtggaggatcaggccgccagagatatgaaacgtttagaggagaaggacaaggagcgcaaaaacgttaaggggatcagggatgatatcgaagaagaggatgaccaggaggcttactttcgttatatggcagaaaaccctacagccggtgtggttcaggaagaggaagaggacaatttagaatatgatagcgacggtaatcctatcgcaccaactaagaaaatcatcgatcccctgcccccaatcgatcactcggagattgactatccaccctttgagaaaaacttttataatgaacacgaagaaatcactaacctgacaccacagcaactcatagatctccgacacaaacttaacctgagggtgtcaggcgcagcccctccccgccctggcagttcctttgcccactttggcttcgacgaacagctcatgcaccaaattcggaagagcgaatacacccagcctactcctatccaatgtcagggcgtcccggtagccctgagtggccgggatatgattggcatcgcgaaaaccggttcggggaagacggctgcatttatttggccaatgcttatacacattatggaccagaaggagttagaaccaggcgacggcccaatcgcagtgatcgtgtgccctacgcgcgaactgtgccagcagattcatgctgaatgcaaacgtttcggaaaagcctataacctgaggtctgtggctgtctatggtggcggctcaatgtgggaacaagctaaggcgctgcaggaaggcgccgagattgtagtgtgcacaccagggcggctgattgaccacgttaagaagaaggctactaatctgcaacgagtatcctaccttgtcttcgacgaagcagacagaatgttcgatatgggatttgaatatcaggtgcgaagtatcgcatctcacgttcgcccagatcgccagactttgctgttttcggccaccttcagaaagaagatagagaaactggcacgggatattctcattgaccccatcagagtagtccagggcgacattggggaagctaacgaagatgtgacacaaatagtcgaaatcttgcactcggggccgtcaaagtggaattggcttactcgccgtctagtggagttcacttccagcggtagcgtgctgctcttcgttacaaagaaggcaaatgccgaggaattggccaataatctcaagcaagagggtcataatctggggctgctacatggcgatatggatcagtctgaaaggaataaagttatttctgacttcaaaaaaaaggatatccctgttctggtggctaccgatgtggccgcacgcggactggacattcccagcatcaaaacagtgattaattacgatgtcgctagggacattgatacccacacccaccggattggtcgaacaggacgggcgggggaaaaaggagtggcctatactctgttgactccaaaagactcaaatttcgccggcgatcttgtcagaaacctggaaggtgcaaaccagcacgtgagcaaggagctcctggacctcgctatgcaaaacgcttggttccgaaagtcaagattcaaaggcggaaaggggaaaaaactcaacatcggcgggggcggccttggctaccgcgaacgtccgggcctgggctcagaaaatatggacaggggaaacaataatgtgatgagtaactacgaagcatataagccctccacgggagcaatgggagaccgactgacagctatgaaagctgcgtttcagagccagtataagtcacattttgtggccgcctccctcagcaaccagaaggccggttcttcagcagcaggggctagcggttggacttctgcaggttctctgaatagtgtgcccaccaattcagcacaacagggacataattcaccagattctccagtcacatctgcagccaaaggaatcccaggattcggcaacacgggcaacatctcaggcgcacctgtcacttacccgtccgccggcgcccagggagtgaataacaccgcctctggtaacaattctcgcgagggcacaggaggcagtaacggcaaacgtgaacgttataccgagaaccggggaagctccaggcacagccacggggagaccggaaatcggcactccgactcgccccgacacggcgatgggggccgccacggcgacgggtatcggcaccccgagagttccagccgccatacggatggtcacagacatggcgaaaacaggcatggaggtagcgccggccggcatggcgaaaaccgcggagctaatgatggtaggaacggtgagtcacggaaggaggcctttaacagggagagcaagatggaacccaagatggaacccaaggtggattcctctaaaatggataaggtggatagtaaaaccgataaaaccgcagacggatttgccgtgccagagccccctaagcggaagaagagtaggtgggattcatag

SEQ ID NO: 184910 - DNA, 2817 bp, Artificial Sequence
  Description of Artificial Sequence: Synthetic coding sequence
atgaactggaacaagggcggccccggcaccaagcggggcttcggctttggcggcttcgccatatctgctgggaaaaaggaggaaccaaaactgccgcagcagtcacatagcgcctttggcgcaacctctagctcgagcggtttcggcaagtcggctccaccccagctcccatccttttacaaaatcgggtctaagagagctaacttcgacgaggaaaatgcctacttcgaggatgaggaagaagactcaagtaacgtggatcttccttatattcctgcagagaactccccaactcggcagcagtttcacagtaaaccggtagacagtgactcggatgatgatcccctggaggcgtttatggctgaggtggaggatcaggctgcccgcgatatgaagcggctggaagagaaggacaaggagcgcaagaatgtgaaaggtattagagacgatattgaagaggaggatgaccaggaagcgtatttcaggtatatggccgaaaaccccactgcgggcgtggttcaggaagaagaggaggacaacctcgagtatgattcagatggtaaccccatcgcaccgactaaaaagataatagatcccctgcctccaattgaccactctgagatcgattaccctccctttgagaaaaatttctacaatgagcatgaagaaattactaatctgacgccccagcaactgattgacttacgtcacaagctcaaccttcgtgtctcaggagcggctcctcctaggccaggcagctctttcgcacatttcgggttcgacgagcaactcatgcaccaaatacggaaaagtgagtacactcaacccacccccattcagtgccagggcgtgcctgtggctctgtcgggtagagacatgattgggatagctaagaccgggtcaggcaagaccgccgctttcatctggcctatgcttatccacataatggatcagaaggagctggaaccaggtgatggtccaatcgctgtgatagtctgtccaaccagagaactgtgtcagcaaatacacgccgagtgtaagcggttcggtaaggcctacaatctgcggtccgtggctgtttacggtggcgggtcaatgtgggagcaggcaaaggctttacaggagggggcagagatcgtggtctgcacccccggccggcttattgaccacgtaaagaaaaaagccaccaatctgcagcgagtgtcctatcttgtctttgacgaggccgatcgcatgttcgacatggggttcgaataccaagttcgcagcattgcctcccacgtgcgaccagaccggcaaaccctgcttttctccgccactttccgcaagaaaatcgaaaagctggcccgcgatatcctgatagatccaatccgagttgtacagggggatatcggagaggccaacgaggatgtgacacagattgtcgaaattctacattcagggccttctaagtggaactggctgacacgacgcctggtcgagtttacaagcagcggcagtgtgctcttgttcgttaccaagaaggctaacgccgaggaactagcaaacaatctgaagcaagaaggccacaacctggggctcctccatggggacatggaccaatcagagcgcaacaaggtgattagtgacttcaaaaagaaagacatccctgtccttgtggcaacagacgtcgccgctcgggggctagatattccctctataaagactgtcatcaactacgatgtcgccagggacatcgatacccacacccaccggatcgggcgcaccggtcgcgctggtgagaagggcgtggcttacacacttctgacccccaaagatagcaatttcgccggggaccttgtcaggaatctggagggcgcaaatcagcacgtgagcaaggaactgctggatctggctatgcagaacgcctggtttaggaaatccaggttcaaaggaggcaagggaaagaagctcaatatcggcggcggtggcctcgggtatagagagcggcccggattagggtcagagaatatggaccgtggcaataataacgtgatgtccaactatgaggcttacaaaccttccaccggagccatgggggatcggctgacggccatgaaagccgcatttcagagccaatataaaagtcacttcgtcgccgcctcattaagtaatcagaaggcgggcagctccgccgcaggcgcttccggctggacttctgcggggagtttgaacagcgtgcctacgaatagcgcgcaacagggacacaattctcctgactcgccggtgacctctgccgctaaaggaataccaggcttcggcaacactggcaatatcagcggggcccccgtgacatatccgtcagctggcgctcagggcgtgaacaatacggcttcaggcaataatagccgcgaaggcaccggcgggtccaatggcaagcgtgagcggtatactgagaatcgtggctcatcaagacactcgcacggagagactgggaatcgccattctgacagcccacgtcacggagatggggggcgccacggggacgggtataggcaccccgagtcaagttcacgacacacggacggacatcgtcacggagaaaaccgacacggcggtagtgcaggaagacatggagaaaaccgaggagccaatgatggtcgaaatggcgaaagcaggaaggaagcgtttaatcgggagagtaagatggaacctaaaatggagcccaaggttgactcgtccaagatggacaaagtcgactctaagaccgataagacagcggacggtttcgccgttcccgagcctccaaaacggaaaaaaagtcgctgggattcttag

SEQ ID NO: 184911 - DNA, 2817 bp, Artificial Sequence
  Description of Artificial Sequence: Synthetic coding sequence
atgaactggaacaagggcggccccggcaccaagcggggcttcggcttcggtggcttcgccatcagcgcaggtaaaaaggaggagccgaagttgccccagcagagtcacagcgcttttggcgccacatcaagttctagcgggttcgggaaatccgcacctccccagttaccatccttctacaaaattggatccaaacgcgccaactttgatgaagaaaatgcttactttgaagacgaggaggaagactccagcaatgtcgatctgccttacatcccagctgaaaattccccaacacgacagcagttccactccaaaccggtggactctgatagcgatgacgacccacttgaagccttcatggccgaagtcgaggatcaggccgccagagatatgaaacgtctcgaggagaaagacaaggagcgaaagaacgttaaggggattcgcgacgacattgaagaggaggatgatcaggaagcatacttcagatacatggccgagaatcctacagccggagttgtacaggaagaggaagaagataatcttgaatatgactccgacggcaacccgatcgctcctacaaagaagatcatagacccccttccccccatcgaccactctgagattgactacccccccttcgagaagaatttctacaatgagcacgaggagatcaccaaccttaccccacaacaactcattgacctgcggcataaactgaacctccgtgtgtccggcgcggccccgcccaggcctggctcctctttcgcccattttggattcgatgagcagctgatgcaccaaataaggaagagcgaatatactcagccgacgcccatccagtgccagggagtcccggtggccttatcaggcagggacatgattgggatcgccaagactggatcagggaagaccgccgcctttatctggccgatgctcattcacatcatggatcaaaaggagctggagccaggcgacgggccaattgccgtcatcgtttgcccaactcgagagctctgccagcagattcatgcggagtgtaaacggtttggtaaagcctacaaccttcgatctgtggccgtctacggaggcgggagcatgtgggagcaggctaaggcactgcaggagggagccgagattgtggtctgtacccccgggcggctcatcgatcatgtaaagaagaaagcaacaaacctgcagagagttagctatctggtgtttgatgaggccgatcgtatgttcgacatgggttttgagtaccaggttaggtcaatagcctcacatgtgcgcccagatcgccagaccctgctcttttcagctacgttccgaaagaagattgaaaaactggcaagagatatattgattgatcctatccgcgtcgtgcagggagatattggcgaggctaatgaagacgttacccagatcgtagaaatcctgcactccggaccctcaaagtggaactggcttaccaggcggctcgtcgaatttaccagttctggaagcgtgttactgtttgttaccaagaaagcgaacgcagaggagctggctaataatctgaaacaggaagggcacaatctgggattactccacggcgacatggaccaaagtgaaagaaacaaagtgatcagtgacttcaagaagaaggatattcctgtgctcgtcgctactgacgtagcagcgcgagggcttgacattccaagcatcaagactgtgatcaattacgacgtcgctcgggacattgatacgcacacccacagaattggaagaactgggagagcaggtgaaaagggtgtagcatataccctgctaaccccaaaagacagcaattttgcgggggatctggtccgtaatttggagggagcaaaccaacatgtttctaaggaactgcttgacttagcgatgcagaacgcatggttcaggaagagcaggttcaaggggggcaaaggaaagaagctgaatataggcggcggcggcctggggtacagggagcgacccggactcggttctgagaatatggatagagggaacaacaacgtaatgtcaaactacgaagcgtacaaaccctcaacaggggcaatgggggaccgattgacggccatgaaggcagccttccagtcccaatacaaaagccactttgtggcagcttcactaagtaaccagaaggccggaagcagcgccgcaggcgcatctggctggacatccgcagggtcccttaacagtgtgcctaccaatagcgcccagcaaggtcacaactcccctgatagtcctgtgacttccgctgcaaagggaatccccggctttgggaacacggggaatatctcgggagctccagtgacctacccgtctgcgggggcccagggagtgaacaataccgcgtctggaaataacagcagagagggaacagggggctcaaacgggaaacgcgagaggtacaccgaaaacaggggctctagcaggcactctcacggcgagaccggaaatcgacacagtgattctccacgacacggcgacggaggccgtcacggagatggttatcgacatcccgagtctagctcccggcataccgacgggcacaggcacggagagaaccgacatggaggttctgcgggcagacacggagagaatcgaggagccaacgacggcagaaacggcgagagtcgtaaggaagcttttaacagagaatccaagatggagcccaagatggagcccaaggttgactcttctaaaatggataaggtggacagtaagacagacaagacggcggacgggtttgctgtgccagaacctcccaaaagaaaaaagagccgatgggattcgtag

SEQ ID NO: 184912 - DNA, 2817 bp, Artificial Sequence
  Description of Artificial Sequence: Synthetic coding sequence
atgaactggaacaagggcggccccggcaccaagcggggcttcggcttcggcggattcgccatctccgcaggcaaaaaagaagagcctaaactgccgcagcagtcacattccgcatttggcgccacctcaagctcttcaggttttgggaaaagcgcaccccctcaactcccatctttctacaagatcggaagtaagagagctaacttcgacgaagaaaatgcgtactttgaagatgaagaagaagactcttccaatgtggacctcccatacattcctgccgaaaactcccccactaggcaacagttccactccaagccagtggattccgattctgacgacgatccactggaagccttcatggccgaggtggaggaccaggctgcccgcgacatgaagaggctggaggagaaagacaaggagcggaaaaatgtaaagggtattagagacgacattgaagaagaggatgatcaggaagcatactttagatatatggcagaaaatcctacagccggtgtcgtccaggaagaagaagaggataaccttgagtacgatagcgacgggaacccgatcgcgcccacaaagaaaatcattgatcccttacctccaattgaccactcagaaatcgattaccctccgttcgagaaaaacttctacaacgagcacgaagagattaccaacttgaccccccaacagttgattgacctgcgccataagcttaacctgagagtttcaggagccgctcctcctcgccccggtagctcgtttgcccatttcggctttgatgaacaactgatgcatcagattcgcaagtcggaatatactcagcccacgccaatccagtgccagggcgtgccagtggcgctgagcggcagggacatgatcggcattgccaaaactggatctgggaagacagctgccttcatctggcccatgcttatacacattatggaccagaaagagttagaacccggcgatggacccatcgccgtgattgtctgccccacgagggagctgtgccaacaaatccatgcagagtgcaagagatttgggaaagcctataatctacggtcagtggctgtgtacggcggcggctcaatgtgggagcaagcaaaggcgcttcaggaaggagctgagattgttgtctgcacccccgggcggctgattgatcacgtgaaaaaaaaggcaactaacctccagagagtaagttacctggtgtttgacgaagctgacaggatgttcgacatggggttcgaatatcaagtccgcagcattgcgtctcacgttaggcctgaccgtcagaccttgctctttagcgccaccttccggaagaaaatagagaagctcgcacgggacatattaatcgatcccattagggtggtgcagggagatatcggcgaagccaatgaggacgtgacacagattgtggagatactgcactccgggccctcgaagtggaactggctcactcgcaggttagtggagtttactagctcaggctcagttctgctctttgtgacaaagaaagccaatgctgaggaactggctaacaacctgaagcaagagggccataatctgggcctgctgcacggcgatatggatcagtcagagcgaaataaggtgatatcagattttaaaaagaaggacatccccgtgctggtggctacggatgtggccgcacgggggttggacattcctagtattaagaccgtgattaactacgacgtagcacgcgatatagatacccacactcaccgtatcgggagaaccggacgcgccggtgaaaagggggtcgcatacaccctcctcacaccgaaagatagcaatttcgcaggtgatcttgtacgtaatcttgagggagctaaccagcacgtatccaaagaacttttggatctcgctatgcagaacgcatggttcagaaagtcacgctttaaaggcggaaaaggtaagaagctcaacattggtgggggtggcttgggctacagagaaaggcctggcctgggctctgagaacatggacagaggcaacaacaatgtgatgagcaactacgaggcctacaaaccgagcacaggtgcgatgggagatcgactgactgctatgaaggcagcctttcagtcccagtacaagagccactttgttgccgcctctctgagcaatcagaaagcaggaagctccgctgctggagcgagtggctggacctccgcaggaagtcttaactccgtgcccactaacagtgcgcaacagggccacaactcccccgatagtccagtgacgtccgccgccaaaggaatcccaggtttcggcaataccggtaacattagcggcgctcccgtgacttatccatcagcgggagcccaaggtgtgaataatacggcttctggtaacaacagccgcgagggtaccggtggttcgaatggcaaacgcgagcgctacacagagaacaggggttccagtcggcacagtcatggggaaaccggcaaccgccattcggactccccacggcacggcgatgggggaaggcatggggatggataccgccatccagagtccagcagcaggcataccgacggccaccggcacggagagaatcgacatggaggctcagcgggccggcatggggaaaaccggggcgctaacgacggtcgaaacggcgaaagccggaaggaggccttcaacagggaatctaagatggagccaaaaatggagccaaaggtggactcctcaaaaatggataaagtggactcgaagaccgacaagacagcagatggctttgctgtcccggagccaccgaagcgaaagaagtccaggtgggacagttag

SEQ ID NO: 184913 - DNA, 1947 bp, Artificial Sequence
  Description of Artificial Sequence: Synthetic coding sequence
atgagccaccacggcggcgcccccaaggccagcacctgggtggtggcatcccggagatcttcaacggtgagccgcgccccagaacggcggcccgcggaagagctgaaccgcactgggcccgaagggtacagcgtggggcgcggtggtagatggcgtggaacatctcggccccctgaagccgttgccgccgggcacgaggagctgcccctgtgcttcgccctcaaatcccatttcgtaggggccgtcatcgggagaggggggtcaaagattaaaaatatccagagcacgactaatacgaccatccaaattatacaagagcagcccgagagcttggtgaaaattttcggatcaaaggcgatgcagacaaaagcgaaagcggtcatagacaattttgtcaaaaaactagaggagaactacaacagcgaatgcgggatagacaccgccttccagccatctgtggggaaggacggatccacagacaacaatgttgtggccggtgaccgcccattgattgactgggatcaaataagggaagaaggccttaaatggcagaaaacaaagtgggcagacttaccgccaatcaagaagaacttctataaggaaagtactgcaacttcagctatgtccaaggttgaagccgattcctggcgtaaggagaattttaacataacctgggatgacctgaaggatggcgagaagagacccattcctaatcccacatgtaccttcgacgatgcatttcagtgctaccccgaggtaatggaaaacattaaaaaagctgggtttcagaagcccaccccaattcagtcgcaagcttggcccattgtgttgcaggggattgacctgattggggtggcccaaaccggaactgggaaaaccctatgctacctgatgccaggctttatccacctggtgcttcagcctagccttaaaggacagaggaataggccaggcatgctcgtgttaacaccgacacgcgaactggcgctgcaggtggaaggcgagtgttgcaagtactcttacaaagggctgcgctcagtctgcgtgtatggcggaggcaatagggacgaacaaatcgaggaactgaaaaagggcgtcgacataatcatagccaccccagggcgtcttaatgatctgcagatgagtaatttcgtaaacctaaagaatatcacctacttagtgcttgatgaggcggataaaatgctagacatgggtttcgaaccacagatcatgaagatccttctggacgtgaggccagaccgccagactgtgatgacaagcgccacgtggccccattccgtacaccggctggctcagagttatctgaaagagcctatgattgtatatgtggggaccctggatctggttgctgtgagcagcgtcaagcagaatataatcgtgaccactgaggaagaaaagtggtcacacatgcagaccttcctgcagagtatgagtagtaccgacaaagtgattgtcttcgtgtctcgcaaggctgtggcggatcacctgtcttccgacctcatccttgggaacatatcggtggagagccttcacggagatagagagcagagggatcgcgagaaagccctagagaatttcaagaccggcaaggttaggatattgattgccacggacctcgcgtctagagggttagacgttcatgatgttacccacgtctacaacttcgactttccacggaacattgaagaatacgtgcaccggatcggacggaccggtcgggcaggccggaccggggtatccattactactctcactagaaacgattggcgcgtggccagcgagttaatcaacatcctagaacgcgccaatcaatccatcccggaggagctcgtatctatggccgaacggttcaaagcgcaccagcagaaacgggagatggagagaaagatggagagaccacaggggagaccgaagaaattccattag

SEQ ID NO: 184914 - DNA, 588 bp, Artificial Sequence
  Description of Artificial Sequence: Synthetic coding sequence
atgagccaccacggcggcgcccccaaggccagcacctgggtggtggcttcacgaaggtccagcacagtttcgcgggctccagaaagaagacccgcagaggaactgaacaggaccggtcctgagggatactccgtggggagaggaggccgctggcgcggcacgtcaaggccaccggaggctgtagcagccggccatgaggaactccccctctgtttcgccctaaagagccatttcgtgggggctgttattggacggggaggtagcaagataaaaaatattcagagtaccaccaataccaccattcagatcatccaggaacaaccggagagtctggttaagatcttcggcagcaaagccatgcagactaaggccaaagctgtcattgacaacttcgtaaagaaactggaggaaaactataatagtgaatgcggcattgacaccgccttccagccatccgtgggaaaagatggttcaactgacaataatgtggttgccggagaccggccgctaatcgattgggaccaaattcgagaggaaggtctgaagtggcagaagacaaaatgggctggaaaaaagattctcatttag

SEQ ID NO: 184915 - DNA, 675 bp, Artificial Sequence
  Description of Artificial Sequence: Synthetic coding sequence
atggagagcggcgcctacggcgccgccaaggccggcggcagcttcgacctgagaagattcctgacgcagccacaagtcgtagcacgagcggtatgccttgtgttcgcgttgattgtgtttagttgcatttatggcgaaggttattccaatgcccacgagtcgaagcagatgtattgcgtgttcaatcggaacgaggacgcctgccgttacggctccgccattggagtgctagcctttctggcctcagccttctttctcgtcgtcgacgcttatttcccacagatctcaaatgccactgacagaaaatatcttgtgattggcgatcttctgttctcagcattgtggactttcctttggttcgttgggttctgttttttgacaaaccagtgggccgtgactaatcccaaagatgtgctagtgggggccgattctgtccgggccgccattactttctcgttctttagcatcttctcgtggggggtgctcgccagtctggcttaccagcgctacaaagctggggtggacgacttcatccagaattatgtggatcccaccccagatcctaatacggcttatgctagttacccaggagcctctgtggacaattatcagcagcccccctttacccagaacgccgaaaccaccgaggggtaccaacctccccccgtgtactag

SEQ ID NO: 184916 - DNA, 1635 bp, Artificial Sequence
  Description of Artificial Sequence: Synthetic coding sequence
atgagcggctacagcagcgaccgggaccggggccgggaccggggctttggagcacccagatttggagggtcccgggcaggtccactttctggtaagaagttcggcaatcctggagagaaactagtcaaaaagaaatggaacttagatgaacttcctaaatttgaaaagaatttttatcaggaacatcctgacctggcaagaagaactgcccaggaggtggagacgtacaggtatctgcttccagcaatagtgcacatcaaccaccagcccttcctggagagaggtgatgggcctatttgtctggtcttagcccccactcgggaactggcgcagcaggtgcaacaagtggcagcagagtattgccgagcctgtcgcctgaagtccacctgcatatacggcggagccccgaagggcccccagatccgggatcttgagcgaggggtggagatctgcattgcgacccctggccggctcattgacttcctcgagtgcgggaaaaccaacctgcgaagaacaacgtacctagtcctggatgaagctgacagaatgttggatatgggcttcgagcctcagatccggaagatcgtcgatcagattaggcccgatcgacagacactaatgtggagtgcgacttggccgaaggaggtgcgacagcttgctgaggactttctgaaggattatattcacattaatatcggggccctagagttatctgcaaatcacaatatccttcaaattgtggacgtgtgccatgacgtagagaaggacgagaaactcattaggttaatggaagaaatcatgtcagaaaaggaaaacaaaacgatcgtatttgtggagaccaagagacgctgtgatgaattgacaagaaagatgaggcgtgatggctggcctgctatggggattcatggggataagagtcagcaggagcgagattgggtgctgaacgaatttaaacacggaaaggcaccgatcctgattgccactgatgtcgcttcaaggggacttgacgtcgaagatgttaaattcgttattaactatgattatcctaattcaagcgaggactacatccacagaattggccggacagctagatctacaaaaacaggaacagcctatacctttttcactcctaataatattaaacaggtgagcgatctaattagcgtcctgagggaagccaatcaggccatcaaccccaaactcctgcagctagttgaggaccggggatctgggaggtctcgaggcagggggggaatgaaggacgacaggagggatcgatactccgcaggtaaaaggggcgggtttaataccttccgggatagagagaattatgatcgcgggtactcttccctgctgaagcgcgacttcggcgcaaagacacagaatggtgtctactctgctgcgaactatacaaacgggagctttggctccaacttcgtttccgcgggcatccagacttcttttagaacagggaacccaacagggacgtatcagaacggatatgactctacacaacaatacgggtccaacgttcctaatatgcacaacggtatgaaccagcaggcttacgcataccccgccactgcagccgcacccatgattggctacccaatgcccactggttattcacagtag

SEQ ID NO: 184917 - DNA, 1845 bp, Artificial Sequence
  Description of Artificial Sequence: Synthetic coding sequence
atgagcggctacagcagcgaccgggaccggggccgggaccggggctttggcgctcctagattcggtggctcccgggccggacccctcagtggcaaaaagttcggcaatcctggggaaaagcttgtcaagaaaaaatggaacctggacgagctgcccaaattcgagaagaacttctaccaggaacacccagatctggctcggcggaccgcccaagaggtggagacatatagacgctctaaggaaatcacagtgagggggcataattgcccaaagcccgtgctgaacttttacgaagcaaatttccccgccaatgtgatggatgtgattgcacggcagaatttcacagagcccaccgccattcaggcacaggggtggcctgtggctttgtcagggctcgatatggttggtgtggctcagactggatcaggaaaaacattgtcgtacctgttacccgcaattgtccatataaaccaccagccctttctcgagagaggagacggcccgatctgtctggtgctcgcccccactagggagctggcgcagcaggtccaacaggtcgccgcagagtattgccgagcgtgtaggctcaaatccacgtgcatctatgggggcgcccctaagggccctcagattcgggacctagagaggggcgtggagatctgcatagccaccccgggcagacttatcgattttctcgagtgcggaaagaccaatctccgcaggaccacttatctggttcttgatgaggctgataggatgctggacatgggctttgagccacagatccgcaaaatcgtcgaccaaatccgacctgaccgccaaaccttgatgtggtcagcaacctggccgaaggaggtccgccagttggccgaggatttcctgaaggattacatccacatcaatatcggggccctggaactcagcgctaaccacaacatcctgcagattgtggatgtctgccatgacgtcgaaaaggatgagaaactcatcagacttatggaggagatcatgagtgagaaagagaacaaaacaatcgtcttcgtggaaactaaacgacgctgcgacgaactgaccaggaagatgcgccgagatggatggcccgccatggggatccacggcgataagtctcagcaagaacgcgactgggtgctgaacgagttcaagcacggcaaggctccaatcttgatcgctaccgatgtggcgtctagagggctggatgtggaggacgtgaaatttgtcataaactacgattacccaaatagctccgaagactacattcaccgtatcggcagaaccgcacgctcgactaagaccggaaccgcttacacttttttcactccaaataatatcaaacaggttagtgacctgataagcgtactccgcgaagccaaccaggccataaatcccaagttactgcagctcgtagaggaccggggaagcggcagaagcagaggcagggggggcatgaaggacgaccggcgagaccgctactcagccggtaagcggggtggattcaacactttccgtgatcgcgaaaactatgatcggggatacagctccctcctcaaacgagacttcggtgccaagacacaaaacggagtctattcagccgctaattacacgaatggctcgttcgggagcaacttcgtgtcagcaggcatacaaacatccttcaggaccggaaaccccactgggacctaccagaatggctacgattcaacacagcagtatggcagcaatgtccccaacatgcataatggtatgaaccagcaagcatacgcgtaccccgctaccgccgctgccccaatgattgggtatcctatgcccacagggtatagccaatag

SEQ ID NO: 184918 - DNA, 1800 bp, Artificial Sequence
  Description of Artificial Sequence: Synthetic coding sequence
atggacgtgcacgacctgttccggcggctgggcgccggcgccaagttcgatacaagacgcttctcggcggacgccgccaggttccagatcggaaaaaggaagtacgacttcgattctagcgaggtcttgcagggcttagacttcttcgggaacaaaaagagtgtgccaggtgtttgtggcgcctctcagactcaccaaaaaccccagaacggcgagaaaaaagaagaatctctgacagagcgtaagcgcgaacagagcaaaaagaaacgaaaaacgatgactagtgagatcgcatctcaggaagaaggcgcaactattcagtggatgagctctgttgaggccaagattgaggacaaaaaagttcagcgagaaagtaaactgacgagcggaaaactcgagaacctccgcaaagaaaaaatcaacttccttaggaataagcataaaatccacgtccagggcacagatctgcccgatccaattgccacttttcagcaattagatcaggaatacaaaataaacagccggctccttcagaacattctggacgctggcttccaaatgcctactcccatccagatgcaggccattcccgtgatgctgcatggtcgcgagctcttggcttccgctccgacagggtcaggaaagacactggccttcagcatcccaatattgatgcagctgaaacagccagctaacaagggttttcgcgcactgatcatatcccccactagagaactggcatcacaaatacatcgggagctgatcaaaattagcgaaggaaccggttttcgcatccatatgatacataaagccgcagtggctgctaaaaaatttggccccaagagctcgaaaaagttcgatattctggtgaccacacccaacaggttgatctacctgctgaaacaggaccctcctgggatagatttggctagtgtggaatggctcgtggttgatgagtctgacaagctttttgaagatggaaaaaccgggtttagggaccaactcgccagcatcttcctggcctgtacatcccataaggttagacgagcaatgttttctgcgacatttgcctatgacgttgagcagtggtgcaagctgaacctggacaacgtaatctccgtgagtattggcgcccgaaatagtgctgtcgagacagtcgaacaggaactcttgtttgtgggctctgagaccgggaagctcctggctatgagggagttagtgaaaaaggggttcaacccgccagtcctagtgtttgtccagtcaatcgaaagagcgaaagaactgttccacgaactaatttacgaagggataaatgtggacgttatccacgccgagcgcacccaacagcagcgcgataataccgttcatagtttccgtgccggaaaaatttgggtcctaatttgtacagctctcttggctaggggcatcgacttcaaaggcgtcaaccttgtgattaattatgattttcccacaagctccgtcgagtacatacatcggattggacggacgggcagagctgggaataaggggaaagctattacctttttcacagaggatgacaaacccctgctgcggtctgttgccaatgtgatccagcaggcaggttgccccgtgcctgagtacattaagggattccagaagctgctgagtaaacagaagaagaaaatgattaaaaaacccttggaaagagaaagcatctccacaaccccgaaatgtttcctggagaaggccaaggataagcagaagaaggtcaccggccagaattccaaaaagaaggttgctctcgaggataaatcgtag

SEQ ID NO: 184919 - DNA, 1476 bp, Artificial Sequence
  Description of Artificial Sequence: Synthetic coding sequence
atgagcagcgtggaggccaagatcgaggacaagaaggtgcagcgggagagtaagctcacgagtggaaagctagagaacctgcgcaaggaaaaaatcaatttcctgcggaacaagcacaagatccatgttcagggcactgacctgccggatcctatcgcgacctttcagcagcttgatcaagaatataagatcaacagccggctgctgcagaatatcctggacgccggcttccagatgcctactcctattcagatgcaagccattccggtgatgctgcacggacgagagctgctggcttctgccccaaccgggagtggaaaaaccctggctttttccataccaattctcatgcagctgaaacagccagcaaacaaaggtttcagggcgctcatcatctctcccacgcgggaattggcctcacagatacatagagaactgattaaaatctccgagggaacaggttttcggattcatatgatccataaagcggccgtggctgctaagaaatttgggcccaagagtagcaaaaaattcgatattcttgtcaccacaccaaacagactcatctacctgttaaagcaagaccctccaggaatagacctcgcgtctgttgagtggttggtggtagacgagtcagacaaactcttcgaggatggtaagacaggtttcagagaccaactcgcctctattttcctcgcatgtacgagccataaagttcgacgagcgatgtttagtgccacttttgcatacgacgtcgaacagtggtgcaaattaaacttggataacgtgatatctgtgtcgatcggcgcgcggaactcagctgtggagaccgttgagcaagaacttctttttgttggctctgagacaggcaagctgctagccatgcgtgagctggtcaagaagggcttcaacccgccagtgctcgtttttgtgcaaagcatcgagagagcaaaagagctgtttcacgagctcatctatgaaggtattaatgttgacgttatccacgctgagcgcacccagcagcagagagacaacaccgtgcactcattcagagcgggaaagatttgggtcctgatctgtaccgccttactcgcaaggggaatagactttaagggggtcaatctggtgattaattacgattttccgactagctcggttgaatacattcaccggataggacggacaggccgagctgggaataaggggaaagccattacatttttcacagaagacgataagccgctgctgagaagcgtggctaatgtgatacagcaggctggatgtccagttcctgagtacattaagggcttccagaagctgctgagtaagcagaagaagaaaatgattaagaaacctctcgagagggagtccatctctactacaccgaaatgcttccttgagaaggctaaggataagcagaaaaaggtgactgggcaaaattctaaaaagaaggtcgccttggaagataagagctag

SEQ ID NO: 184920 - DNA, 2646 bp, Artificial Sequence
  Description of Artificial Sequence: Synthetic coding sequence
atggccgccgacaagggccccgccgccggcccccggagccgggccgcaatggcccagtggcggaagaagaaggggcttagaaagaggcgcggggcggcctcacaggccaggggcagcgattctgaggatggtgagtttgagatacaggcggaagatgacgctcgggctcgaaagctgggccctgggagaccactgcctacctttcccacatcggaatgtacgtcagatgtggaaccagatactagagaaatggttcgtgcgcagaataagaaaaaaaaaaagtcgggcggattccagagtatgggcctgagctatcctgtttttaaaggcattatgaaaaagggctacaaggtgcctacccctatccagcgtaaaaccattcccgtcattctggacggcaaagacgtggttgcaatggctcggacaggcagcgggaagacggcatgtttcctgcttcctatgtttgaacggctcaaaactcattccgcccagactggggccagagccctaatcttgtctcccacacgagagctggcactccagaccctgaagttcactaaagaactcggcaagtttacaggtcttaagacagctctgattctcggcggtgatagaatggaagaccagttcgcggctcttcacgagaatcctgacataattatagccactcccggccggttagtccatgttgcagtcgaaatgagtctaaagctccaaagtgtcgagtacgtcgtatttgacgaagcggaccgtctgtttgaaatgggattcgccgagcagcttcaggaaattatcgccagactgcccggaggtcaccagactgtcctcttttcagctacattaccaaagctcttggttgagttcgccagagctggactgacggaacccgtgcttattcggctggacgtagacaccaaactgaacgagcagctgaaaacgtccttttttctggtacgagaggacaccaaggccgcggtgctactgcatctgctacataacgttgttcggccgcaggatcagactgtcgttttcgtggctacaaagcaccacgcggaataccttactgaactgcttacaacccagcgcgtctcttgcgcacatatctattctgcactggacccaactgcccgcaagattaacctggctaagttcacgctgggaaagtgttcaactctaatcgttactgatctcgctgcgcgagggctcgacatcccactactggacaatgtgatcaattatagttttccagccaagggtaagttattcttgcatcgggtgggtagggtagcacgcgcagggcgcagcggcacagcctactcactggtggctcccgacgagattccatacctcctcgatcttcacctttttcttggtcgctctctaaccttagctagaccgttaaaggaaccttctggcgtggccggggttgacggcatgctcggtagggtcccacagtctgttgtagacgaggaggactctggcctgcaaagcactttagaagcaagcctcgaattaaggggacttgcacgggttgccgataatgcccagcagcagtatgtgaggtcacgccccgcaccctctccagaaagcattaaacgcgccaaggaaatggacttggtaggtttgggcctgcaccccctgttctccagtcggttcgaggaagaggagctacagcggctgcgactagttgacagtataaagaattatagatcaagagccacaatcttcgaaattaacgcaagttccagagacctgtgttcccaggtgatgagagctaaacgccagaaggacagaaaggcaatcgccagattccagcagggccaacaggggcgtcaggaacagcaagagggaccagttgggcccgctcctagccgacctgccttgcaggagaaacagcctgaaaaagaagaggaggaagaggccggcgaatctgtggaggacatcttttctgaagttgttggcaggaagaggcagcgcagcgggcctaaccggggcgcgaagcgacggagggaggaggcccgccaacgagaccaggaattttatatcccatatcgacccaaggacttcgattccgaacggggactctccatctccggcgaaggaggcgcttttgagcagcaggccgcgggagcagtcctggacctcatgggcgatgaagcccagaacctaacaaggggacgccagcaactgaagtgggatcgtaagaagaagcgcttcgtgggacagtctggacaggaagacaagaagaagattaagactgagtcaggtcggtacatttctagctcttataaacgagatttgtatcagaaatggaaacagaaacagaagatcgatgaccgggactctgatgaagagggagcttctgacagacgggggcctgagagacgcggcgggaagcgcgatagagggcagggagcgagccgaccccatgctccaggtacccctgcgggcagggtgcgcccagagctcaagacaaagcagcagatccttaagcagcggaggagggcacagaaactgcattttttacagagaggcggactgaagcagctgtccgctaggaataggcgcagagtccaggagctgcagcaaggagccttcggcaggggagcacggtccaagaagggaaagatgaggaagagaatgtag

SEQ ID NO: 184921 - DNA, 2649 bp, Artificial Sequence
  Description of Artificial Sequence: Synthetic coding sequence
atggccgccgacaagggccccgccgccggcccccggagccgggccgcaatggcacagtggagaaaaaagaaaggacttcggaagagaaggggtgctgcttcccaagcaaggggatccgatagcgaggatggagagttcgaaattcaggccgaggatgacgcccgcgctcggaagctcggccctgggagaccactgcctacatttcccacatcagagtgcaccagcgacgttgagcctgacacaagggaaatggtgagggctcagaataagaaaaaaaagaaatcagggggcttccagagtatgggactgtcatatccggtctttaagggcatcatgaaaaaagggtataaggtgcccaccccgatccagcgtaaaacaatcccagtcattttggacggaaaagacgtggttgctatggcgcggaccgggtctgggaaaacagcatgctttctgttgccgatgtttgaacgcctcaagacccatagtgctcagactggcgccagggccctcatcctgtccccaactcgggaattggcgttgcaaacgctgaaattcacaaaggagttgggaaagttcaccggactgaagacagcacttatccttgggggcgatcggatggaggatcagtttgcagcccttcatgaaaacccggatataattattgccacgccaggacgactggttcacgtcgctgttgaaatgtcactcaaactgcagtccgtggagtacgttgtcttcgacgaggccgacagactcttcgagatgggctttgccgagcagctgcaagaaatcatcgcccggctacctggaggtcaccagaccgttctgttcagcgccacactaccgaagctactggtagaattcgcgcgggctggcctgacagagcccgttctcattcggctcgacgtggataccaaactgaatgagcaactgaagacgtcttttttcctggtgagagaggacactaaggccgctgtcctactgcacctgctccacaatgtcgtgcgaccgcaggatcaaacagtggtctttgtggccacaaagcaccatgccgagtacctgacagagctgctgaccacccagagagtgagctgcgcgcacatctacagcgcccttgatcctactgctcgcaagattaaccttgcaaagttcaccctgggtaagtgtagcacactgatcgtgacagatttggctgcacgaggactggacatcccattactagataatgtcatcaattatagctttcctgccaaaggcaagttattcctgcaccgagtgggcagagtggcgagggcgggaaggtcaggcacggcctacagcctcgtcgccccagacgagattccgtacttacttgacttgcatctgtttctgggtcgcagcttgacactagccagaccactcaaagaaccatccggggtggccggggtggacggcatgctgggaagggttccacagtctgtcgtggacgaggaagacagtggcctccagagcacattggaagcaagcctggagttgcggggcttggcccgggtcgcagataatgcgcagcagcagtacgtgcggagtcgacctgccccctcccctgagagtattaagcgtgccaaggaaatggacttagtgggcctgggcctgcacccacttttctcgtcacggttcgaggaagaggagctgcagaggttgaggctggtagatagcattaaaaactatagaagtcgtgctacaatttttgaaataaatgcgtcatctcgggacttgtgcagtcaagtgatgcgggcaaaacggcagaaggatagaaaggccatagcacgcttccagcaaggccaacaagggaggcaggagcaacaggaaggccccgtagggccggctccctcacgtcctgctctgcaggaaaaacagcccgaaaaggaagaggaggaagaagctggcgaatccgtggaggacattttcagcgaggttgtgggtagaaaaagacagcgatccggacctaacaggggagctaagagacggagagaggaagcgaggcaaagggaccaagaattctatattccctaccgccccaaggactttgacagtgagaggggactgtccatttccggagaaggcggagcattcgaacagcaggcagctggcgccgttttggatttgatgggtgatgaggctcagaaccttacacgcgggcgacaacagttgaagtgggaccggaagaagaaacgctttgtgggccagagcgggcaggaggataaaaagaaaattaagactgaaagcgggaggtatattagttcaagttataaaagagacctctatcagaagtggaagcagaagcaaaagatcgacgacagggactccgacgaagaaggggcttcagatcggcggggaccagaaaggagaggtggcaaaagagaccgggggcaggccggagcctcccgcccacacgcaccgggcacaccagccggccgagttagacctgaactgaaaactaaacagcagatacttaagcagaggcgccgggcacagaagctgcactttctccaacgggggggactgaagcaactgtccgccagaaatcgccggagggtgcaggaactgcaacagggggcctttggaaggggggcccgatccaagaaaggtaaaatgcgcaaacgtatgtag

SEQ ID NO: 184922 - DNA, 1452 bp, Artificial Sequence
  Description of Artificial Sequence: Synthetic coding sequence
atgagcaccgcccggaccgagaaccccgtgatcatgggcctgagctcacagaatggccaactgagggggcctgttaagcccactggagggcccggtgggggcggcacacagacccagcagcaaatgaaccaattaaagaatacaaatactattaataacggaacccagcagcaggcacagtcaatgaccaccactatcaagcccggcgacgactggaaaaagaccctgaaactccccccaaaagacctgaggatcaaaacttcagatgtgacttccaccaaaggcaacgagttcgaggattactgtcttaaaagagaactccttatgggaatattcgagatgggctgggaaaaaccttctcccatccaagaggaaagcattcccatcgcactatccggccgggatatcctggcacgagccaaaaatggaaccggcaagagcggagcctacctgattcccctgctggaacgactggacttaaagaaggacaacatccaggcgatggttattgtaccaactagagagctagcactccaggtgtcccaaatttgcatccaggtgagtaaacatatggggggcgccaaggttatggccacaacaggagggaccaatctgcgggacgacattatgcgtcttgacgacactgtccacgttgtgatcgcgacacccggacgtatcctcgacctgatcaaaaaaggtgtagccaaagtcgaccatgttcagatgattgtgctagatgaggcggacaagctgctgagccaggattttgttcaaattatggaggatatcatacttacactgcccaaaaataggcagattctactgtactcagccacattccctcttagtgtacaaaagtttatgaacagccacctgcaaaagccctacgagattaacttgatggaagagctgactttgaaaggcgttactcagtattacgcctatgtgaccgagagacagaaggttcattgcctgaataccctcttcagtcggctgcagatcaaccagtccattatattttgcaactcatctcagagagtagaactgctggcaaagaaaatttcccagctaggttattcatgcttttatatacatgccaaaatgcgacaagagcatcgcaaccgcgtgttccacgatttccgtaatgggctgtgccggaacctggtctgtacggacctcttcaccagggggatagacatccaggccgtgaacgtggtgataaactttgactttcccaaactggcagaaacttatttgcacaggatcggccggtctggcaggttcggacacctgggcctggccattaatctgatcacttacgacgataggttcaacttgaagtcaattgaggaacaactggggaccgaaataaagcccatcccatctaatattgataagtctctctacgttgcagaataccactctgaaccagtggaggacgagaagccatag

SEQ ID NO: 184923 - DNA, 1452 bp, Artificial Sequence
  Description of Artificial Sequence: Synthetic coding sequence
atgagcaccgcccggaccgagaaccccgtgatcatgggcctgagcagccaaaacgggcagctgcgagggcccgtgaagcccaccggtgggcctgggggcggcggcacccagacccaacagcaaatgaaccagttgaagaataccaacactataaataatggaacccagcagcaagcccaaagcatgaccaccacaatcaaaccgggtgacgactggaaaaagacactgaagctgccaccaaaagacctgcggataaaaacgagtgatgtgacaagcactaaagggaacgagttcgaggactactgtctcaagcgcgagctgctgatgggcatttttgaaatgggatgggaaaagccttcccccattcaggaagaaagtatcccaatcgccttgtccggcagggatattttggcgcgagccaaaaatgggacaggaaaaagcggggcctatctgattccactattagaacggctggatttgaagaaggacaatatccaagccatggtaatcgtcccgactagagaactggctctgcaagtgtcccaaatctgcatacaggtgagcaaacacatgggcggggcgaaggtgatggccaccacgggcggcaccaatctcagagacgacatcatgagactggatgacaccgtacacgtggtgatagccaccccagggcgcattctcgatctgataaaaaagggcgttgccaaagtcgatcacgtgcagatgattgtcctagacgaggctgacaaactgctctctcaagattttgtgcagataatggaggacatcatcctgactctcccgaagaaccgtcagatactcctgtatagcgcgacgtttccgctgagcgtgcaaaagttcatgaattctcatctccagaagccttatgaaatcaatttaatggaggaacttaccctgaaaggcgtgacacaatactatgcctacgttaccgagaggcaaaaggttcattgcttaaatactctcttctctcggttacagatcaatcagtctattatcttttgcaacagctctcaacgtgttgaactattagccaagaaaatcagtcagctcggatactcctgcttttacattcacgctaaaatgagacaggaacatcgcaatagagtctttcacgatttccgcaacggactgtgtcggaacctggtttgcaccgatctgtttacccggggaatagacattcaggcggttaacgtggtgattaactttgacttccctaagcttgcagagacctacctgcacagaatcggccggtcaggccgctttggccacctcggcctcgccatcaacctcataacttatgacgaccggttcaatctcaagagtatcgaagaacaattagggactgagattaaaccaatcccgtctaatattgataaatccttgtatgtggcagaataccacagcgaacctgtggaagacgaaaaaccctag

SEQ ID NO: 184924 - DNA, 1452 bp, Artificial Sequence
  Description of Artificial Sequence: Synthetic coding sequence
atgagcaccgcccggaccgagaaccccgtgatcatgggcctgagcagtcagaacggacagctgagaggaccagtcaagcctaccggtgggccgggaggtgggggcacacagacccagcagcaaatgaatcagctgaaaaacacgaatacaataaacaatggaacacagcaacaagcccagtcaatgaccaccacaattaagcctggtgacgattggaagaagaccttgaaacttccccccaaggacttgcgtattaagaccagtgatgtaacttccacaaaaggcaacgagttcgaggactactgtctgaagagggagctcttgatgggcatatttgagatggggtgggaaaaaccgtcccccatccaggaagaaagtatcccgattgccctcagcggaagggacatcctggctcgtgctaaaaatgggactggaaaaagtggcgcctatctcatcccactgttggagaggctggatctcaagaaggacaatattcaagcaatggtgatcgtgccaaccagagagcttgctctccaggtgtctcagatctgtattcaagtaagtaaacacatgggaggcgctaaggtgatggccacgaccggcggaacaaaccttcgcgatgatataatgcgtcttgacgacaccgtgcatgtggtgattgccaccccaggtcgaatcctagacctgatcaagaaaggtgtggccaaagtagatcacgtgcaaatgattgtcttggatgaggcagacaaactgttaagtcaagacttcgttcagataatggaagatattattctgactctccccaagaatcgacaaattctgctatacagcgcaaccttccccctgtcagtgcaaaaattcatgaattcccatcttcagaagccctatgagatcaacttgatggaggaactcactctcaagggagtgactcagtactacgcttacgtaaccgaacgccagaaggtgcattgcctgaacactttattttcccggttgcagattaaccaatctattattttctgtaacagcagccagcgggttgagttgctggcaaagaagattagtcagctcggctacagctgtttttatatacacgctaaaatgcgccaagagcacagaaatcgggtatttcacgacttccggaacggcctttgtagaaatctggtgtgtaccgatcttttcacccgggggattgatattcaggccgtaaatgtggtcattaatttcgatttcccaaaactcgcggagacatacctgcatcggatcggtcgttccggccggttcggtcatttaggccttgcaataaacctgattacttatgatgataggtttaatctgaagtcaattgaggaacaacttgggacagaaattaagcctatcccttctaacatagataaatctctgtatgtcgcagagtaccatagcgagcctgttgaggatgaaaagccctag

SEQ ID NO: 184925 - DNA, 564 bp, Artificial Sequence
  Description of Artificial Sequence: Synthetic coding sequence
atgagcaccgcccggaccgagaaccccgtgatcatgggcctgagctctcagaatggtcagctgcgggggccagtgaagcctacaggaggacccggcggtggcggtacgcaaacacaacagcagatgaaccagcttaagaacactaataccattaacaatgggactcagcaacaggcccagtccatgactactacaatcaagcccggtgacgattggaagaagacactcaagctgccccccaaagacctcaggatcaaaaccagcgacgtaacaagcactaagggcaacgaatttgaggactattgcctcaagagggagctcctgatgggtatattcgagatgggttgggagaaacccagcccgatccaggaggagtccataccaatcgccctctccgggcgggacatattagcaagggccaaaaacgggactggcaaatctggcgcctatttaatacctctcctagagagactcgacttgaaaaaagataacattcaggccatggtcatcgtgcccacaagagagctggctttgcaagtgtctcagatatgtaccgtgtgttag

SEQ ID NO: 184926 - DNA, 5139 bp, Artificial Sequence
  Description of Artificial Sequence: Synthetic coding sequence
atggagcggaacgtgctgaccaccttcagccaggagatgagccagctgatccttaacgaaatgcctaaagctgaatattccagtttatttaatgattttgtcgagagcgagtttttcctgatagatggcgattccctactcattacatgtatctgcgaaatatcatttaaaccgggccagaacctccactttttctacttggtcgagcgttacctggtggaccttatttccaagggtggacagttcacgattgtattttttaaagacgcagagtatgcttatttcaatttccccgagttgctttccctccgaacggcactgatactgcacttacagaagaatacgacgatcgacgtcaggacaactttctccagatgcctgagtaaagaatgggggagctttctagaagagagttatccctacttcctgattgtggcggacgaaggactcaacgacctgcagacccagctttttaatttcctgattattcacagttgggcgcgaaaggttaatgtggtcctctctagtggccaagaatctgacgtactgtgcctttatgcgtatttgctccccagcatgtataggcaccagatctttagttggaaaaacaaacagaatatcaaagatgcctataccacattgctgaaccagctcgaaaggtttaagctgtccgctttggctccgttgttcgggtctttgaaatggaacaacatcacggaggaggcccacaagaccgtgagtctgctcactcaagtgtggcctgaaggatccgacatccgccgtgtgttttgtgtcacttcttgttctcttagtcttagaatgtatcatagatttctcggcaatagagaaccgtccagtgggcaggagactgagattcagcaggtcaatagcaactgcttgacactccaggagatggaggacttatgcaaactccactgcctcacagttgttttcttactccacctccctctttcacaaagagcatgcgcccgcgttatcacctctcattgggcggaggatatgaagcctctgctgcagatgaagaaatggtgcgagtatttcattctgagaaatattcataccttcgaattctggaatcttaacctaattcatctgagtgatcttaatgatgagctgctgcttaagaacatagcattctactacgagaacgaaaacgttaaaggacttcatcttaaccttggggacactataatgaaggactacgaatatctgtggaataccgtgtcaaaattggtacgggactttgaggtcggccaacccttccctttgagaacaactaaagtctgctttttggaaaagaaaccatcacctatcaaagatagcagcaatgaaatggttccgaacctgggcttcatcccgacctcctctttcgtcgtggataaattcgcgggggatattctgaaggatttgcccttcctgaaatcagacgacccgatcgttacaagcctcgtcaagcaaaaagaatttgacgagttggtacattggcatagtcataagcccctatcagatgactacgacagaagccgttgccagttcgacgaaaaatcgcgcgaccctagggtgttgaggtccgtgcaaaagtaccatgtgttccaacggttctatgggaattctctcgagacggtgagctcaaagattatcgtgacacagactattaagagtaagaaggacttcagcgggcctaagagcaaaaaagcccatgagacaaaggccgagattatcgctcgagagaataagaaaagactgttcgctcgtgaggaacagaaggaggaacagaaatggaatgccctctcttttagtatcgaggagcaactgaaagagaacttgcattccgggataaaatcactggaagactttcttaaatcctgcaaaagtagctgtgtcaaacttcaggttgaaatggtcggcctaaccgcctgcctgaaagcatggaaagagcattgtaggtccgaagagggaaaaacaacgaaagacttgtctattgccgttcaggtgatgaagcgtatccacagcctgatggaaaagtattcagagctcctgcaagaagacgaccgccaactcattgcccggtgcctgaagtacttaggcttcgatgagttagcctcgtctctgcatccagcccaggacgccgaaaacgacgttaaggtcaagaagcgcaataagtattctgtcgggatcgggcccgctaggttccaactccagtatatgggtcattacctgatcagggatgaaaggaaggacccagacccccgcgtgcaggactttatccccgacacttggcaacgggaacttcttgacgtcgtcgacaagaacgaaagcgcagtcatcgtagctcccacatcctctgggaagacatacgcctcatactactgcatggaaaaggtgctcaaagaatctgatgacggcgtcgtcgtgtacgtggcccctacgaaagcactggtgaatcaagttgccgccaccgtccagaaccgctttaccaaaaacctcccctctggcgaggtgctatgtggagtgttcactcgggagtatcggcatgatgcattgaactgccaggtgctcattactgtcccagcctgcttcgagatcctgctgctcgctccacacagacaaaattgggtgaaaaagatcaggtatgtgatttttgatgaagtgcattgtctggggggcgagattggggccgagatctgggaacacctgctagtgatgatcagatgccccttcttagccctgtcagcaaccatttcaaatccagaacatctcacagaatggctgcagagcgtcaagtggtattggaaacaagaggacaagataattgaaaataacaccgccagtaagcggcacgtcgggaggcaggcggggttccctaaagattacctgcaggtgaaacagtcctacaaagttaggttggtactgtacggagagagatacaatgacctcgagaagcacgtttgctctatcaagcacggcgacatccatttcgatcactttcatccttgcgccgccttgactaccgaccacatcgagaggtacggttttccccctgatcttacactgtcacctcgcgaatctattcaactttacgacgcgatgttccagatctggaaaagctggcccagggcacaggaactctgccccgagaactttatccactttaacaataagctagtgattaaaaaaatggacgctcggaagtacgaggagtccctgaaagctgaactgacgtcatggatcaagaatggcaacgttgagcaggctagaatggtcctccaaaatctttctcccgaggctgatctgtctcccgagaacatgattactatgttcccactcctggtagagaaacttcgcaagatggaaaagttgcccgcactgtttttcctctttaaactgggcgctgtcgagaatgccgctgagagcgtttccacgtttctgaagaagaagcaagaaacgaaacgccccccgaaggccgacaaagaagcacatgttatggccaacaaactaagaaaagttaaaaagtcaatcgaaaagcagaaaatcatcgacgagaaaagccaaaagaagacacggaacgtagaccaaagcttgatccacgaggctgagcatgacaacctcgtgaagtgtttagagaaaaatcttgagattccacaagattgcacctacgccgatcagaaagctgttgacacagaaacattacaaaaagtgttcggccgggtgaagtttgaacggaagggtgaggagctcaaggccttggctgagaggggaatagggtaccatcattcagcaatgagctttaaggagaagcagctggttgagattttatttcggaaaggataccttcgcgtggtgaccgctacaggcactctggccctgggggtcaacatgccatgcaagtccgtggtgttcgcccagaatagcgtgtatttggacgccctgaattacaggcagatgtctgggcgggctggcagacgggggcaagacctgatgggggacgtctatttttttgatattccgttcccaaagatcggtaagcttattaaaagtaatgtaccagaattacgggggcatttccctctgtccatcaccctggtgctgcggctaatgttgctcgcgtccaagggcgacgaccccgaggatgccaaggccaaagtgctatcagtgctcaagcacagtctgctgagttttaaacagcccagagtgatggatatgttgaaattgtacttcctattctcattacagttcttggtgaaagaaggatatctggaccaggaaggcaacccgatgggattcgccggccttgtatcccacttacattatcacgaaccgagcaaccttgtgttcgtgagctttctggtcaacggcctgtttcacgacctgtgtcagccaaccaggaaaggtagtaagcatttctctcaggatgtcatggagaagttagtccttgtgctagctcacttgttcggccgcaggtacttccccccaaagttccaggatgcccacttcgagttctaccagagcaaagtttttttggacgacctacccgaggatttttccgacgcgctcgacgagtataacatgaagattatggaggattttacaacttttctaagaattgtgagcaagctggcagacatgaaccaggaataccagctgccactgagtaaaattaagttcaccgggaaagaatgcgaggattcgcaactggtttcccacctgatgtcctgtaaggaaggacgagtcgcaatcagtcccttcgtatgcctatctggaaactttgacgatgacctcttgagactcgagacacctaatcacgtcactctgggaacaattggtgtgaatagatcccaagcccccgtcttgctgtcccagaagtttgataacaggggcagaaagatgagtctgaatgcctacgctctggacttctataaacatggatcactcatcggtctggtgcaggacaaccgtatgaatgaaggggatgcctattatctgcttaaagacttcgccctcactatcaagtcgatcagcgtgagcttgagggagttgtgcgaaaacgaagatgataacgtcgttcttgcctttgagcagctctctacaacattctgggaaaaacttaataaagtgtag

SEQ ID NO: 184927 - DNA, 363 bp, Artificial Sequence
  Description of Artificial Sequence: Synthetic coding sequence
atggagcggaacgtgctgaccaccttcagccaggagatgagccagttaattcttaatgaaatgcctaaagctgagtattcaagtctgtttaatgatttcgtggaaagcgagttcttcctcatcgacggtgattccctgttaatcacttgcatctgtgagatatcttttaaaccaggacagaacctgcacttcttttatctcgtcgaacgttacctagtggacctgataagcaaggggggccagttcaccatcgtgttttttaaggacgcggagtacgcctactttaattttcccgaactgctctctttgcggacggccttaatcctccacctacagaagaataccactatcgatgtgcgctag

SEQ ID NO: 184928 - DNA, 885 bp, Artificial Sequence
  Description of Artificial Sequence: Synthetic coding sequence
atgatccggtgccccttcctggccctgagcgccaccatcagcaacccagaacacctcactgaatggctgcaatcagtcaaatggtattggaaacaggaggacaaaattatcgagaataacacagcaagtaaaaggcacgtgggtaggcaagctgggttccccaaagattatttacaagttaaacagagctacaaggtgagattggttctgtacggggagaggtacaacgatctggaaaagcatgtgtgttctatcaagcacggtgacatccatttcgaccacttccatccctgtgcggcccttacaactgaccatatcgaacgctatgggttcccccctgatttgacacttagcccccgggagagcatacagctatatgacgccatgtttcagatctggaaaagttggccgcgagcccaagagctctgtcctgaaaactttattcacttcaataataaactggtgatcaagaagatggatgccaggaagtatgaggagtcacttaaggcagagctgaccagttggattaagaacggcaacgtggagcaagcaagaatggtgctccagaacctgtcacctgaggccgaccttagtcccgagaacatgatcacaatgtttccccttctggttgaaaagctgagaaagatggaaaaactacccgccctgttttttctcttcaaactcggggctgtggagaacgccgcagagagcgtgtcaacctttttgaagaaaaaacaggagaccaagcgtcctcccaaggccgataaggaggcacatgtcatggccaacaagctgcgcaaggtcaagaaaagcattgagaaacagaaaataattgacgagaaaagtcagaaaaatcaaaaatgtggctcaaaacctaatacgtag

SEQ ID NO: 184929 - DNA, 1062 bp, Artificial Sequence
  Description of Artificial Sequence: Synthetic coding sequence
atgcagagcaagcgggactgcgagctgtggtgcgagcgggtgaaccccgagaacaaggccgctttagaagcttgggtccgcgaaaccggtattcgcctcgtacaggtgaatggacagagaaaatacgggggcccgcctcccggatgggtggggagccccccccctgcaggatccgaagtcttcatcggtaggttgcctcaggacgtgtatgaacatcaacttattccactgttccagcgtgtgggcagactgtacgagtttcgtctgatgatgacgttctccgggttgaacagggggttcgcgtacgctaggtattcaagcaggcgaggagctcaggccgccattgcaactcttcacaatcaccccttgaggcctagctgcccgctcctcgtgtgtcgcagtacggagaaatgtgaactgtccgttgacgggctacccccgaacctcacaaggtctgccctgctgctagcactccagccactgggacccggtttacaagaggcacggctattgccttcaccaggcccagccccgggccagatcgcattgcttaaattctcatctcatagagctgctgcaatggctaaaaaggccctggttgagggacaatcacatttatgtggcgagcaggttgccgtggagtggctgaagccagatctgaagcagcgactgcggcagcagctggtcggcccattcctgcgctccccacagccggaaggatctcagctggcattggcgagagacaagttgggattccagggtgcccgtgccactttgcagctgttgtgccagcgtatgaaactcggctctccagtctttctaaccaaatgcctcggtatcggcccagccggttggcatcgcttttggtaccaggtggtgatccctggacacccggtgccattttctggactgatttgggtggtcctgaccctggatggtagagatggccacgaagtagcaaaagatgctgtcagcgtccgtctcctgcaggcgctgtcagagtcaggagctaatttgctgtggtccgccggtgccgaagcaggtaccatggtaaaacaatag

SEQ ID NO: 184930 - DNA, 1491 bp, Artificial Sequence
  Description of Artificial Sequence: Synthetic coding sequence
atgttcgccaaggccacccggaacttcctgcgggaggtggacgccgacggggatctgatcgcagtttccaatttgaatgacagtgacaagctgcagctgctctctctcgtgaccaagaagaagcgtttctggtgctggcagaggcccaaatatcagttcctgtccctgactttgggggacgtgctgatagaagatcagtttccctcaccagtggtcgtcgagtctgactttgtgaagtatgaagggaaatttgcaaaccacgtgtcgggcacccttgagaccgccctgggtaaggttaaacttaatctagggggcagttcccgcgtagagtcacaaagctcatttgggaccttgcgtaaacaggaggtggatctgcaacagctcattcgtgactctgccgagcgcactatcaacttgcggaatcccgttctccagcaggtgctggaaggccgtaatgaagtgctgtgtgtcctgacacaaaagattaccaccatgcagaaatgcgtcatcagcgagcatatgcaggtcgaagaaaagtgtggcggcatcgtcggaatccaaaccaaaactgtgcaggtgtccgctaccgaagacgggaacgtgaccaaggattcgaacgtggtgcttgagatccccgcagctaccaccatagcctacggcgtgatcgaactatacgtgaagttggacggacagttcgaattctgcctcctcagaggcaagcagggaggatttgagaataaaaaaagaatcgatagcgtgtacctggatccactcgtctttcgggagttcgccttcattgatatgccagatgccgcacatggtatcagcagccaggatggccccctgagtgtgctaaaacaagccaccttgctgctcgaaaggaactttcatcctttcgctgagctcccagaacctcagcaaacggcactgagcgacatttttcaggccgttctgttcgacgatgagctcctcatggttcttgaaccagtgtgtgacgacttggtaagcggcctgtcccccacagtagctgtgcttggggaattaaagccgcgccagcaacaggatctggtggcgtttctgcagctggttgggtgttctctccaggggggctgcccgggtccggaggatgccggaagcaaacagctgttcatgacagcctacttcctcgtctcagccctggccgagatgcccgatagcgccgcagcactactgggcacctgctgtaagctccagatcatccctaccctttgccacttgctgcgagctttgagtgacgatggcgtgagtgatctcgaggatcccactctgacccctcttaaggacactgaacgtttcggaatcgtacaacgactctttgcatctgccgatatctcactggagcgcttgaaaagtagtgtcaaggcagtcattctgaaggacagcaaagtgttccccctgctactgtgtatcactctgaacggtctgtgtgcactcggccgcgagcattcgtag

SEQ ID NO: 184931 - DNA, 1491 bp, Artificial Sequence
  Description of Artificial Sequence: Synthetic coding sequence
atgttcgccaaggccacccggaacttcctgcgggaggtggacgccgacggcgatttaatcgcagtgtctaaccttaacgattctgataagctgcaattgctgagtctcgtgacgaaaaaaaagagattctggtgctggcaaaggccgaagtatcagttcttgtctcttactctcggggatgtcctcatcgaagaccagtttccgtctcccgtggttgtagaatccgattttgtgaaatatgagggcaaattcgccaaccacgtgtccgggacactggagaccgctctcgggaaggttaagctcaatctggggggaagctccagggtcgaatcccagagttcattcggcacactccgcaaacaggaggtcgacctgcaacagctgattcgcgatagtgccgagagaaccatcaaccttcgcaacccagtgctacaacaggtgctggagggtcgtaacgaggtgttatgcgtgttaacccagaagatcactactatgcagaagtgtgtgattagcgaacacatgcaggtcgaggagaagtgcgggggaatcgtggggatccagacaaagactgtgcaggttagtgcaacagaagatggtaatgtgaccaaagatagtaacgtggttctggaaattcctgcggcaaccacaattgcatatggggtgatcgagctctatgtgaagctagatgggcagtttgaattttgtttactgaggggcaaacaaggaggctttgaaaacaagaaaaggatcgactcagtctaccttgacccccttgtctttagggaattcgcgttcatcgatatgcccgatgctgcacacgggattagtagccaggacgggcccctgagcgtgctgaaacaggcgactctgttactggaaagaaactttcacccttttgccgagctgcctgagccacaacagactgcactctctgatatattccaggcagtgcttttcgatgatgaactactaatggtcctagaaccagtttgtgacgatttggtctcaggcctgtctcccactgtggccgtgctgggagaactgaagcctaggcagcagcaagacttggtggcgttcttgcagcttgtcggctgctcacttcagggtggatgcccgggccctgaggacgccggaagtaaacagctgtttatgaccgcctatttcctggtgtctgccctagccgaaatgcccgattccgcagctgccctcctaggtacatgttgtaaactgcagattataccaaccctgtgtcatttactgcgcgcattgtctgatgacggtgtcagcgacttagaagatccaacactgactccactcaaggatacagagcgcttcggcatcgtgcagcgcctgttcgctagtgctgacatatcactggagcggctgaagtcatccgtgaaggccgtgattctgaaagactccaaagtctttccccttctgctttgtatcacgctgaatggcctgtgtgcccttggccgcgagcattcctag

SEQ ID NO: 184932 - DNA, 999 bp, Artificial Sequence
  Description of Artificial Sequence: Synthetic coding sequence
atgcagaagtgcgtgatcagcgagcacatgcaggtggaggagaagtgcggcggaatcgtgggaatccaaactaagacggtgcaagtgtccgcaacagaggatggaaatgtgaccaaggactccaatgttgtcctcgaaattccggcagccacaaccatcgcctatggagttatcgaactgtacgtcaaactagatgggcagttcgagttttgcctccttcggggcaagcagggcggcttcgaaaataaaaaacgaattgatagcgtgtatcttgatccccttgtgtttagggagttcgcttttattgacatgcccgatgccgctcacggaatttcctcacaggacggaccgctgagtgtgctcaagcaggcaactctgctgttggagcgcaatttccacccatttgccgagctgccggagcctcagcagaccgcactctcagacatattccaagcagtcctgttcgatgatgaactgctgatggtgttggagccggtgtgtgatgatctggtgtctggtctatctcccacagtcgcggtgcttggggagcttaagcccaggcagcagcaagaccttgtggccttcttacaactcgttggctgcagccttcagggggggtgcccaggcccagaggacgctggctcgaagcagttgtttatgactgcgtactttctggttagcgccctggcagaaatgccggactccgccgcagctctcctgggaacttgttgtaagttgcagatcatcccaactctttgccacttgcttcgtgccctcagcgatgacggcgtatccgatctggaggatcccactctgacaccgttaaaggacacagagcggttcgggatagtgcagcggttgttcgctagtgcggacatctccctggagagactgaagtcatcggtcaaggctgtaattctcaaggactcaaaagtgttccccctgctactgtgtatcacattaaacgggttgtgcgctctgggtcgtgagcacagctag

SEQ ID NO: 184933 - DNA, 999 bp, Artificial Sequence
  Description of Artificial Sequence: Synthetic coding sequence
atgcagaagtgcgtgatcagcgagcacatgcaggtggaggagaagtgcggcggaatagtgggaatccagactaagaccgtgcaggtgtctgctacagaggatggaaacgtaacaaaggattccaacgtcgtccttgaaattcctgcagccacaaccattgcctatggggttattgaactgtacgtaaaattagacggtcaatttgaattctgtctgttacgtgggaaacagggcggctttgagaataagaagcgtatagactcagtgtatttagacccactagttttccgcgaattcgctttcattgatatgcctgatgccgcacacgggataagctcccaggacgggccgctgtccgtcctcaagcaggctacccttctcttggaacgcaactttcacccattcgctgaactgccagagcctcagcagactgcactgtccgatatcttccaggccgtcctgtttgacgatgaattactcatggttctcgagcctgtctgcgatgacctagtcagtggcctgtccccaaccgttgctgtgctaggagaattgaagccgcgacaacagcaggacttggtagcatttctgcagttggtgggctgctccctgcagggaggctgtcccgggccagaggatgctggcagcaagcagttatttatgaccgcctactttcttgtctctgcgcttgctgagatgccggacagcgccgcggcgctgctgggtacttgctgtaagctgcagatcatccctacgctgtgtcacctgctgagagctctcagcgatgacggggtctcggacctggaggaccctacactgacccctctgaaagacaccgagcgcttcggcattgtacagaggttgttcgcgagtgcagatattagcctcgagagactcaagtcctctgtgaaggcggtgatcctgaaggatagcaaggtattccctctgctcctgtgtataactctcaacggtctctgcgctctgggacgcgagcactcttag

SEQ ID NO: 184934 - DNA, 1575 bp, Artificial Sequence
  Description of Artificial Sequence: Synthetic coding sequence
atggccaacagcgccggcttcctgggcgacctgaccaccgagggcatcaataaacctggcttttacaaaggcccagctgggtcccaagtgacactaagttcactgggcaaccaaactagagtcttactggaggagcaggctcgccacttactgaatgaacaggagcatgccacaatggcgtactacttggatgaatatcgaggtgggtcggtaagtgttgaagctctggtgatggcactttttaagctcctgaacactcatgcgaagttttcattactaagtgaggtgcgcggcactattagtccccaagacctggagaggttcgaccacctcgtgctgaggcgcgaaattgagagcatgaaagcgagacaaccgcctgggcctggcgccggagatacttattccatggtgtcttattctgatacgggctccagcacgggatcgcacggcaccagcacaacagtcagctccgcaagaaacaccttagacttggaagagactggcgaggcagtgcaagggaacatcaatgccctgcccgacgtgtctgtggatgatgtgagatccaccagtcagggcctctctagtttcaaaccactcccccgccccccaccactagctcaaggaaacgatctgccactgggtcagcccaggaaactgggacgggaggatttgcagcctcctagctccatgccttcttgtagcgggaccgttttttcagcaccccagaaccggtcacctcctgccggaactgcgccaactccaggcacttctagtgcccaggacttaccatcctctccaatctacgcaagcgtctccccggcaaaccccagcagcaagagacccttggatgcccacctggcactggttaaccagcaccccatcggaccttttccaagggtccagagcccccctcatctcaaaagcccctctgctgaggccacagtggctggtggatgcctactaccaccatcaccgagtgggcaccctgaccagacgggtaccaaccagcactttgtgatggtggaggtgcacaggcctgattccgagcccgacgtgaatgaagtgcgagccctgcctcaaactcgaaccgctagtactctctcccatcttagtgattccgggcagactctttctgaggattctggcgtggacgccggagaggctgaagcatctgcccctggacgcggcaggcaatcagtaagcacaaagagccgcagttcaaaggaacttccccgcaacgagaggcccaccgatggcgccaataaaccaccagggctgctggagcccacctccaccctggtgcgcgtaaagaagagcgccgcgactttgggaattgctattgaagggggcgcaaatactaggcagcctctccccagaattgtaaccatccaaaggggaggatccgcccacaattgcggacagctcaaagtcggccatgtgatcctggaggtaaacggtctgactctccgggggaaggagcacagggaagccgcacggattattgccgaggccttcaagactaaggaccgggattacatcgacttcctggttacagagttcaacgttatgctgtag

SEQ ID NO: 184935 - DNA, 2724 bp, Artificial Sequence
  Description of Artificial Sequence: Synthetic coding sequence
atgaacgcccccctggacggcctgagcgtgagcagcagcagcaccgggtcccttggatctgctgcaggcgccggaggtggcggcggagcaggcctgagacttctgtcagctaacgtgcggcagctgcaccaagctcttactgctctgctgtccgaagccgaaagagagcagttcacccactgtctcaatgcctaccatgcccgtaggaatgtgttcgaccttgtgaggactctgcgcgtgctgctcgactccccagtaaaacgcaggttactgccgatgctgcgactggtgatccctaggagcgatcagcttctgttcgatcaatacacagcagaagggctctacttgccagctactacaccctatcgtcaaccggcctggggtgggccggattccgcaggccccggggaagtgcgccttgtgagtctaaggcgggctaaagcacatgagggcttgggttttagcattcggggcgggtctgagcatggcgtgggcatctatgtgagcctcgtggagcccggtagcctggcagagaaggagggcctgcgcgttggagaccagattctacgggtgaatgacaaaagcctcgcaagggtcacacacgctgaggctgttaaggcactgaaagggtcaaaaaaactcgttttgagcgtctattccgctggacgcatccccggagggtacgtgacaaaccatatctatacatgggttgatcctcagggccgatctatctctccccccagcgggttgcctcaaccccatggaggggcactgcgtcaacaggagggggaccggcggtctaccctgcacctgttgcaagggggtgacgagaagaaggtcaacctagtgctgggcgacggccggtccctgggcctgactattcgcggaggggcagaatatggactgggaatctatattaccggagtagaccctgggagtgaggcagagggctctgggctgaaggttggcgaccagatcctggaggtgaatggacgctcgttcctcaacattttgcacgacgaggcggtccggctcttgaagtcgagtagacatctgatcttgacagtgaaggacgtggggcgccttcctagagcaaggactacggtggatgagacaaaatggatcgcctcctcacggatccgggagacgatggcgaactctgccggtttccttggagatcttaccactgaaggaatcaataaacctggattctacaagggtcctgctgggagccaggtcacactgtctagtttaggaaatcaaacacgtgttttgctggaggagcaggcgcggcacttgcttaacgagcaggagcacgccacaatggcttattacctggacgagtatcggggcggctccgtgtctgtcgaagcactagtcatggcgctatttaagctgctgaacacacatgccaagtttagcctccttagtgaggtaaggggcacgattagcccccaggacctggagagatttgatcacctcgtgctgcgtcgagagatagagagtatgaaggcacgccagcctccaggccctggtgctggcgacacctactcaatggtgtcctacagcgacacaggatcttctacaggatcacatggaacctcaaccactgtgagttctgcccgtaacaccttagatcttgaggaaactggtgaagcggtgcaggggaacatcaatgccctccctgatgtcagcgtggatgatgtgcggtctacttcccaggggctcagcagctttaagccgctgcctaggccaccaccactggcacagggaaatgacctgcctctggggcaacctaggaaactcggccgggaggatcttcagcccccaagttcaatgccctcttgcagcgggactgtcttttctgcacctcagaatcggagccccccagcgggaaccgcgccaacacctggtacttctagcgcacaggacttgcctagttccccaatctacgcatccgtgagccctgccaacccttccagcaagagacctctggacgcacacctggcgctggtgaaccagcatcctatcggtccgtttcctcgcgtgcagagtcccccacaccttaagagcccttccgccgaggctaccgtagccggaggttgtttgcttcccccttctcccagtggccacccggatcaaacagggaccaatcagcactttgtcatggtcgaggtgcacaggcccgattccgagcccgatgtgaatgaagtgagagcattgccccagacccgaactgcttctaccctgagtcacctgtcagattctggacaaaccctgagtgaggacagcggcgtggacgctggagaagccgaagcatctgcccctggtcggggaagacagagcgtctccaccaaaagtcgtagtagcaaagagctcccgcgtaacgagcgtccgactgatggtgccaataaaccgcctggcttgctcgaacccacatctactctggtgcgggtcaaaaagagtgctgcaactctcgggattgcaatcgagggaggggccaacaccagacagccactcccaagaatcgtgacaattcagcgtggcggatccgcgcataattgtggacaactaaaggtggggcatgtaatactggaggtgaacgggctgacacttcgggggaaggagcaccgggaagcggctcgcataatcgcagaggcctttaaaactaaggaccgggattacatcgacttcctggtgaccgaattcaatgtgatgctgtag

SEQ ID NO: 184936 - DNA, 1038 bp, Artificial Sequence
  Description of Artificial Sequence: Synthetic coding sequence
atgaacgcccccctggacggcctgagcgtgagcagcagcagcaccggcagtttaggcagtgccgccggagcagggggtggaggaggggctgggcttagacttttaagcgcgaatgttaggcagctacaccaggctctgactgctcttctgagtgaggcagagagggagcaattcacccactgtctgaacgcctaccacgcgaggcgcaatgtgttcgacctggttcgaacgctgcgcgtcctcttggattcccctgtgaagaggaggctgcttccaatgctgcggcttgtaattcctaggtccgaccagctactctttgatcagtatacagccgaaggcctctatctgcccgccactaccccttaccgacagccagcgtggggagggccagactctgccggaccaggcgaagtccgtctggtctcattaagacgtgccaaagcacatgaagggctaggtttctccattcgggggggaagtgagcatggggtgggtatctacgtgagcctggttgaaccaggctccctggcagaaaaggaaggtctccgcgtgggggaccagattctgcgggtaaacgataagagcctcgctagagtgacacatgcggaggccgtgaaggccttgaaggggtcaaagaagctggtgctgtccgtctacagcgccggccgcatcccagggggctatgttacgaatcatatttacacctgggtcgacccacaggggcgctccatctccccgcccagcggccttcctcagcctcatgggggggctctgcgccagcaggagggcgatcgtaggagcacccttcatttattgcagggaggcgacgagaagaaggtgtctggtgtcggcaaagggggacagcccctgcgccatcgtattttgccgccaaatcccgagcagcagtcatgcctggaggctgcaagaaggggctggttctgcccgggatctgtttttcctcaagtatgcacggaggggtggtgcttcttcttcgcctttctctttgacctatgcagtgtgtgctacaatacaggatag

SEQ ID NO: 184937 - DNA, 1671 bp, Artificial Sequence
  Description of Artificial Sequence: Synthetic coding sequence
atgcacggcagcctggaggccctgctgttcctgccccaggtgaccctatcccttgcccacgcccaccttatatgctccaacgcccagctagaaatgtgcgtgttcccccatcggtttctgggggatctgaccaccgagggaattaataagcccggcttctataagggaccagccggttctcaggttacactgtcatcactcggaaatcagactcgggttctgctggaggagcaggcacggcaccttctgaacgagcaggaacatgctacgatggcctattacctggacgagtatcgcgggggcagtgtgtcagttgaagctctcgtcatggccctgtttaaattgctcaatacacatgccaagttctcactcctatccgaggtgagagggaccatctcacctcaggacttggaaagatttgaccacctcgtgctccgacgcgagatcgaatcaatgaaagcgaggcaacctccgggaccaggggccggcgatacttatagcatggttagttactccgatactggttccagcactggctctcacggaacatctacaaccgtttcatctgcccggaacaccctggatctggaggagactggcgaagccgtccagggcaacatcaatgccctgcctgatgtgagtgtcgacgatgttcgtagtacttctcaagggctcagcagcttcaagcctcttccccgaccaccacccctggcgcaaggcaatgaccttcctttgggacagccacgcaaactcggacgcgaggatctgcagccccctagtagcatgccttcatgctctgggacggtgttcagtgcccctcaaaatcggtctcccccggctggcaccgctcctacacccggtaccagctccgcccaggacctaccatcatctcccatatacgccagcgtgtctcccgcaaatccaagtagcaaacgtcccctggacgcacatctagcgctcgtgaatcagcaccctattggacccttccccagggtccaatctcccccccacctaaaatccccttctgcagaggctaccgttgcaggaggctgcctccttccaccctctccctcaggacatcctgaccagacgggcaccaatcagcacttcgttatggtcgaggtgcatcggccagatagcgagccagacgtcaatgaagttagggccttaccacagacgagaacagcctctaccctgtcacacctgtctgattccggacagaccctctccgaagactctggtgttgatgctggggaggcggaggcctccgccccagggagaggtcgccagtccgtaagcacaaagtcgagaagctcaaaagagctgccacgtaatgaacgtccaacagatggagccaataaaccacccggtctacttgagccgacatcaaccctcgtaagagtgaagaagtcagccgccaccctgggaatcgcgatagagggcggagcgaacacacgccagccactgccaagaatcgtcacaattcagcggggcggcagtgcccacaactgtggtcaactgaaggtcggacatgtgattttggaggtcaacggtctgacgctccgtgggaaggagcaccgggaagctgctagaattatcgccgaggcttttaaaaccaaggacagggactatattgactttctggtgacggagttcaatgtcatgttgtag

SEQ ID NO: 184938 - DNA, 1059 bp, Artificial Sequence
  Description of Artificial Sequence: Synthetic coding sequence
atgttcgccgccgccaccaagagcttcgtgaagcaggtgggcgacgggggaaggctcgtgccagtgccatctctgtctgaggcagacaagtatcagcccctctccctcgtcgtcaagaaaaagagatgtttcctatttccccgctacaagtttacttccaccccgtttaccctcaaggacatcctgctcggagatcgcgagatcagcgccggaatcagttcataccagctgctgaattacgaggatgagtccgatgtgagtctgtacggaagacggggtaaccacattgtaaatgacgttgggatcaacgtggccgggtcagattctattgcggtgaaggccagcttcggtattgtaaccaagcatgaagtcgaagtcagcactctcctgaaggaaattaccacacgcaagatcaatttcgatcactctttgattagacagtctcggtcatcacggaaagccgtcctgtgtgtcgtaatggagagtatcaggacaacgcgacagtgttcgctgagcgtccacgctggaatccgcggggaggctatgcggttccacttcatggacgaacagaatcctaaggggcgtgacaaggctatcgtgtttcctgctcatacaactattgcgttcagcgtgtttgaattgtttatctatctggatggggcgttcgacttatgcgtgacatcagtgtcaaagggcgggtttgagcgggaagaaacagccaccttcgctctcctctacagattgcggaacatcctattcgagcggaaccgccgagtcatggacgtcatcagtaggtcccaattgtacctagatgatctgtttagtgattattacgataaaccactctctatgacggatatctcactgaaggaaggcacccacattcgggtcaatcttctgaaccacaacatccctaaaggtccgtgcatcctttgtgggatggggaactttaaaagggagaccgtctacggatgcttccagtgctcagtggacgggcagaagtatgtgcgcttacatgctgtcccatgcttcgatatttggcacaagaggatgaaatag

SEQ ID NO: 184939 - DNA, 1059 bp, Artificial Sequence
  Description of Artificial Sequence: Synthetic coding sequence
atgttcgccgccgccaccaagagcttcgtgaagcaggtgggcgacgggggaagactggtcccagtgccaagccttagcgaagccgacaagtaccagcctctctccttggttgtgaagaagaaacgttgctttctgtttcccaggtataaatttacgagtactccctttaccctgaaggatatcttgctcggtgaccgcgagatctctgctggcattagtagttaccagttgctgaattacgaagacgagagcgacgtgtcactgtatgggcgcaggggaaaccacatcgtcaatgatgttggcatcaatgtggctggcagcgattccattgccgttaaggcctcattcggaattgtgacaaaacatgaagtagaagtgagcacattactgaaagagataaccaccaggaaaatcaacttcgatcatagtcttatccgccagtcacgctcctctagaaaagcagtcctctgtgtcgtgatggaatcaattcgcacaacaaggcagtgtagcctgtccgtgcatgccgggatacggggtgaagcgatgaggttccattttatggacgagcaaaatccaaagggacgcgataaggctatcgtcttcccagcccacaccactattgcgttttcagtttttgaactgttcatctatcttgacggggcctttgacctgtgtgtgacctccgtctctaagggcgggttcgaacgagaggaaacagcaaccttcgccttgctctaccggctgagaaacatcttatttgaaaggaatcgccgggttatggatgtaatatcaagatctcaactgtacttggacgatctgttcagcgactattatgacaaacccttgtccatgactgacatcagtcttaaagaaggaacccacataagagttaacctgctgaaccataacatccccaaaggaccttgcatcctctgtggaatgggcaatttcaagcgggagacagtgtacgggtgtttccagtgtagcgtggacggtcaaaaatatgtccgacttcacgcagtaccctgtttcgacatatggcacaaacgcatgaagtag

SEQ ID NO: 184940 - DNA, 2388 bp, Artificial Sequence
  Description of Artificial Sequence: Synthetic coding sequence
atgagcaagcggcaccggctggacctgggcgaggactaccccagcggcaaaaaacgcgccgggacggacggaaaggatcgagatagggatcgggaccgcgaggatcggagcaaagaccgtgatcgggagagagataggggtgatagggaaagggagcgggagaaagagaaggaaaaggagctgcgtgcgagcactaatgccatgctcattagcgccggccttccccctctgaaagcttcccatagcgcccactctactcactccgcccatagtacacacagtacccactctgcccactctacacatgcgggtcacgccgggcacacatccctgccccagtgtataaatcccttcactaacttgcctcatacgccacgctactatgacatcctgaagaagcgtctgcagctgcccgtgtgggaatacaaagacagatttactgacattctggttcggcatcagtcattcgtccttgtcggagagaccggctcgggaaaaacaacccagatcccacagtggtgcgtggaatatatgagatccctgcccgggccaaaacgtggggtcgcctgcacgcaaccacggagggttgcagctatgtccgtagcacagagagtcgccgacgaaatggacgtgatgctgggacaggaggtggggtacagtatccgcttcgaggactgcagctctgcaaaaaccatcttgaagtatatgacagatgggatgcttctccgcgaagcaatgaacgacccactcttagagcggtacggggtgattatactggacgaggcccatgagagaacgcttgccacggatattttaatgggcgtacttaaagaagtggtacgacagcggagcgacttgaaggtcatcgttatgtccgccacgctcgatgcaggcaagttccaaatctacttcgataattgtcctctgttaacgattcctggcaggacacacccggtcgaaatcttttatactcctgaacctgagagagactatctggaggccgccatacgtacggtgatccagattcacatgtgtgaagaggaagagggcgaccttctgttgttcctgaccggacaggaagagatcgatgaagcatgtaaaagaataaaacgagaagtggatgacttagggcccgaggttggcgatattaagattattcccctatactccaccctgcccccccagcagcagcaacggatctttgaacccccacctccaaaaaaacaaaacggggcaatcggtagaaaggttgttgtctcaacaaatattgctgagacttcactgactatcgatggcgttgtttttgtgatagaccctggttttgcaaaacagaaggtgtacaatcctagaatccgcgtggaatccttactggtaaccgctatcagcaaggctagcgctcaacagcgggcaggccgcgcaggaagaacgcgccctggaaagtgcttcaggctttatacagagaaagcctacaagaccgaaatgcaagacaatacctatccggaaatcctccgctctaatctggggtccgtggtattacagctcaagaagctggggatcgatgatctggtgcattttgacttcatggatcctcccgcccctgagactttgatgcgtgccctagagttgctgaattacctcgccgcccttaatgacgacggggatttaacagaattaggatcaatgatggcggagtttcctctagatccgcaactagccaaaatggttattgcctcctgcgactacaattgctctaacgaggtcctttctattactgcaatgctatccgtgcctcagtgtttcgtaagaccgactgaggcaaagaaggctgccgatgaggctaaaatgaggtttgctcatatcgatggagatcatctgacactccttaacgtgtatcacgcattcaagcaaaatcacgaatcagttcagtggtgctatgataattttatcaattataggagtcttatgtccgcggacaacgtcagacagcagcttagccgaatcatggatcgcttcaatctgccgaggcgtagcactgatttcactagccgcgattactacataaacatcaggaaagcgttagtgacaggatatttcatgcaagtggcgcacctggagcgtaccggtcattacctgaccgtgaaagataatcaggtcgtgcagctgcacccatcaactgtactcgaccataagccagagtgggttctgtacaatgaatttgtcctgaccaccaaaaactacattcgaacatgtacggacattaaacccgaatggctcgtgaaaatcgccccccagtattacgacatgtctaactttccacagtgtgaagctaaaaggcagctggaccggataatagccaaactgcagtctaaggaatactcccagtactag

SEQ ID NO: 184941 - DNA, 2355 bp, Artificial Sequence
  Description of Artificial Sequence: Synthetic coding sequence
atgagcaagcggcaccggctggacctgggcgaggactaccccagcggaaagaaaagagccggaaccgatgggaaagaccgagaccgagacagggaacgggaccgcggcgaccgcgaacgagaacgggagaaggaaaaggaaaaagagctccgcgcctccactaacgcaatgctgatcagtgccggcctcccaccattgaaggccagccacagtgcccatagtacccactcagcgcattccacacacagcactcattccgctcattccacccacgccgggcacgctgggcacacatctctcccgcagtgcattaacccatttactaatctgccacatacccctaggtactatgacatacttaagaaaaggttacaactgccagtttgggaatacaaggaccgttttacagatatcctcgtgagacaccagtcctttgtcttagtgggcgaaaccggatccgggaagacaacccagattccgcagtggtgcgtggaatatatgcggtcactgcccggacctaagagaggcgtggcatgcacccaaccccggagggttgccgcaatgtccgtggcccaacgcgtcgccgacgagatggatgtgatgctggggcaggaggtgggatactcaatcaggttcgaagattgcagcagtgctaagactatactcaagtatatgactgatgggatgttgctgcgtgaggccatgaatgatcctctgctggaaagatatggcgttatcatactggacgaggctcacgagcgcacactggcaaccgatatccttatgggggtgcttaaggaagtggtgcggcaacggagcgatctgaaggtaatcgttatgagcgccacgctcgatgctgggaagttccaaatatattttgataattgcccactcttaactattcctggtaggacccatcctgtggagatcttctatacgcctgaaccggagagagactatctcgaggcagccatcaggacagtcattcagattcacatgtgcgaggaggaggagggagatctgcttctgtttctcaccggccaggaggagattgacgaggcttgcaaaagaattaaacgcgaggtggatgacttggggccggaagtcggagatatcaaaatcatacccttgtatagtactttaccaccccagcaacagcaaagaatcttcgaaccgcctcctcccaagaagcagaatggagccatcggacgaaaggttgtggtgagtacaaacatcgccgaaacatctctcaccatagatggggtggtcttcgtgatcgacccaggctttgcgaagcagaaggtctacaacccacgtatcagagtcgaatcattgttagtgaccgctatctcaaaggcatcagcccagcagcgtgccgggagggcaggaagaacacggccaggcaagtgtttcaggctatacaccgaaaaggcctacaagacagagatgcaagataacacctaccccgagatcttgaggagtaaccttgggtccgtggtacttcaactgaaaaagctcggtattgacgacctggtgcatttcgactttatggatcccccagcccccgagactctcatgcgagcgcttgagctgctgaactacctggcagctctgaacgatgacggcgatctaacggagcttggttccatgatggcagaattccccctcgacccccagctggccaagatggtcatcgcgtcctgcgactacaattgtagcaacgaagtcttgagtatcactgcaatgctaagcgtgccccagtgtttcgtgcgcccaactgaagccaagaaggctgctgacgaggccaaaatgaggtttgcccacatcgacggggatcaccttacactgctcaatgtataccatgcttttaaacaaaatcatgagtcagtgcaatggtgctacgataatttcattaattacagatcactcatgagcgctgataatgtgcggcagcagctctcaagaatcatggatcgcttcaatttaccccgacgttctaccgacttcacatctagggattattacatcaacataagaaaagccctcgttacgggctacttcatgcaagtggcacacctcgagcgcacagggcactacttaacggtgaaagataaccaggtggtgcagctgcatccatccacggtgctggatcacaagccggagtgggttctgtacaatgagttcgtgctaacgacaaaaaactacattcgtacctgtacggatataaagcccgagtggctagtgaaaattgctccccaatactacgatatgagcaacttcccccagtgtgaagcaaagagacagctggaccggattatcgccaagctccagtcaaaggagtacagtcagtattag

SEQ ID NO: 184942 - DNA, 1683 bp, Artificial Sequence
  Description of Artificial Sequence: Synthetic coding sequence
atggagagccagcccgcccaggagtgcctgatgcagatgttcctgcctatagagcccgcctgtttcgtggagtggctgggaacctcaccttcccagctgggcgtcgttatggtggatgaagcgcatgaaagaaccctacacacagatatcctctttggtctaataaaggatgtcgcgaggttcaggccagagctgaaagtactggtagcttccgcaacgatggacaccgcccgtttttcaacctttttcgatgacgccccagtcttcaggatccctggacggagattccccgtcgatattttttatactaaagcccccgaggccgattatctcgaagcgtgcgtcgttagcgtgctgcaaattcacgttacccagccacctggggacatcctcgtgttcctgacgggccaggaagaaatagaggcagcttgtgaaatgttgcaagatagatgtaggaggcttggttctaaaatacgtgagttactggttttacccatctacgcaaatctgccatccgacatgcaagctcggatctttcagccaacacctcccggcgccaggaaggtcgtcgtagccactaatatagccgagactagcctgactatcgagggaataatctatgtcttagacccaggattttgtaagcagaaaagctacaatccccgaaccggaatggagtccctcactgtgactccttgtagcaaggcctcagctaaccaacgggcaggacgtgcgggccgtgtagcggctggtaagtgctttcggttgtatactgcttgggcctatcagcacgagcttgaagaaaccactgtgccagaaatccaacgaacaagcttaggaaacgttgtgctcctgttgaaaagtctgggaatccatgatctgatgcacttcgacttcctggacccacccccttacgagacccttctgcttgccctcgagcagctctatgccttgggagcccttaatcaccttggggaactgaccacgtccggccgcaaaatggctgagctccccgtcgatcccatgttaagcaagatgatcttagcctctgagaagtattcttgttccgaggagatcctgactgtggccgctatgcttagcgtgaataactccattttttatcgtcctaaggacaaagtagttcacgcagacaatgcccgggtgaacttttttctgcccggtggagaccaccttgtcctgctgaatgtgtacactcagtgggccgaaagtggctatagttcacagtggtgttatgagaactttgtgcagtttcgttctatgaggagggcgcgcgatgtgagggagcagttggaggggctgctggagagggtggaggtgggtctctcgtcatgtcagggagactacattagagttagaaaagctatcacagcaggttacttttatcacacagcgagattgacgcgctccgggtataggaccgttaaacagcagcagactgtctttatccaccctaacagctccctgttcgagcagcagcctcggtggttattgtaccacgagctggtgttaacaacaaaggagtttatgcggcaggtccttgaaatcgaatcctcatggctcctggaggtggccccccactattacaaggctaaggagttggaggatccccacgccaaaaagatgcccaaaaaaatcggtaagacgagggaggaactagggtag

SEQ ID NO: 184943 - DNA, 3126 bp, Artificial Sequence
  Description of Artificial Sequence: Synthetic coding sequence
atggccacccccgccggcctggagcggtgggtgcaggacgagctgcattctgttttgggcttgtccgaacgacacgtggcccagttcctcattggaacagcacagcggtgcacaagtgccgaggaattcgtgcagcgcctaagggatacagacaccctggacctttccggccccgcaagggattttgcattaaggctgtggaacaaagtgccgcgcaaagccgtggtggagaaacctgcccgcgcagccgaacgcgaggcgagggcccttcttgagaagaaccggtcataccgccttttggaagatagtgaggaaagctctgaggaaacagtgtctcgcgcagggagttcactccagaaaaaaaggaaaaaacggaaacacttaaggaagaagcgggaggaagaggaggaggaggaagcttcagagaagggaaagaaaaagacaggagggtccaagcagcaaacagaaaagcctgagagcgaggatgagtgggaacgtacggagcgggagaggctccaggaccttgaggagcgggatgcatttgcagagagggtgcgccaaagggacaaagatagaacccggaacgttttagaaagaagcgacaagaaggcttacgaagaggcccagaaaaggctaaagatggcggaagaggacagaaaagccatggtgcccgagctgcgaaaaaaatctcggagggaatacctggccaaaagggagcgggagaaactggaggacttggaggccgagctcgctgacgaggaatttttgttcggagatgtggaattgagtcgacatgagcgtcaggagttgaaatataaacgccgggtccgggatctggcacgtgagtaccgtgccgctggagaacaggagaaacttgaagctaccaacagataccacatgcccaaggaaaccaggggccaaccagcacgggccgtagacttggtggaagaggagagcggtgctccgggtgaggagcaacgcagatgggaggaagcccgcttaggcgccgcatccctgaaatttggcgctagggacgcagcatctcaggagcccaaatatcagttggtcctcgaggaagaggagacaattgagttcgtccgcgccacacagttgcaaggagatgaggagccgagcgccccccctacaagcacacaagcacagcagaaggaatccattcaggctgtccgccggtcccttccagtttttccattcagggaggagttgctggcagccatcgctaaccatcaggtgctgattatcgagggagagacaggatctggtaagaccacacagataccacaatacctgttcgaggagggctatacgaataaaggcatgaagatcgcatgcacccagccccgtcgggtggccgctatgtccgttgccgccagggttgcacgggagatgggcgtgaaactaggcaacgaggtcggttatagtatcaggttcgaggactgcacgtccgaacgcaccgtgctgaggtacatgacggacggtatgcttcttagggagtttttgtctgagccggacttggcaagctattccgttgtgatggtcgacgaagcacacgagcgaactctgcacactgacatcctgttcggcctgatcaaggatgttgcacgcttcaggcccgaactgaaagtccttgtcgcctccgcaactatggatacagccaggttttccacttttttcgatgacgcacccgtattccggattccaggaagacgctttccagtggacattttctacaccaaagctcctgaggcagactacttggaagcttgtgtggtgagcgttttgcagatccatgtgacccagccacctggcgacattctggtgtttctgaccggccaggaggagatagaagcggcttgtgagatgctgcaagacaggtgtaggcggctgggcagtaagatcagagagctgctggtgttgcccatatacgctaatctgccaagcgatatgcaagctaggattttccagcccacgccaccaggagctcggaaggtagtggtcgcgacaaacatcgccgaaacatccctgacaatcgaggggatcatctatgtgctggatcccggcttttgtaagcagaagagctacaacccccgcaccgggatggaatccctgactgttactccatgcagtaaggcatcagctaatcaaagggccgggagagccggccgtgtggccgccggcaaatgcttccggttatacacagcctgggcctaccagcatgagctggaagagactaccgttcctgaaattcagcggacctctctgggcaacgtggttctcctgcttaagagtctgggtattcacgacctgatgcacttcgattttctagatccccccccctacgagaccctgttactcgcacttgagcaactatatgcactcggtgctctgaaccacttgggtgaactgactacatccgggcgaaaaatggctgaactgcctgtcgaccccatgctgtccaagatgattctggcttccgaaaagtatagttgctctgaggagatcctcaccgttgctgcaatgctgtctgtcaataatagcatcttctataggcccaaggacaaagtagtgcacgccgacaatgcccgcgtaaacttcttcctgcccgggggtgatcacctggtactgctgaacgtgtacactcagtgggccgagagcggctattctagccagtggtgctatgagaacttcgttcagttccgcagtatgagaagagctagagatgttcgtgagcagctagagggactcctcgagagagtggaagtggggctttcatcctgtcagggggattatattagagtgcgtaaggccatcaccgccggttacttttaccatacggcacgtctcacaaggtccgggtacaggaccgtgaagcagcagcagacagtctttatccaccccaattcatcgctgtttgagcagcagccgaggtggctcctgtatcatgagctggtgctcaccaccaaagagtttatgaggcaggtcctggagatcgagtcatcttggctgttggaagtggcccctcattactacaaggcgaaagaactcgaagaccctcacgctaaaaaaatgccaaagaaaatcggtaagaccagagaagaattaggttag

SEQ ID NO: 184944 - DNA, 1683 bp, Artificial Sequence
  Description of Artificial Sequence: Synthetic coding sequence
atggagagccagcccgcccaggagtgcctgatgcagatgttcctgccgattgaacccgcctgtttcgtagaatggttgggcactagccctagtcaactcggggtagtcatggtggacgaagcccatgaacgtaccctgcatacagatattttgtttgggctgattaaggatgtggccaggtttcgtcccgagcttaaggttctggtagcctccgcgaccatggatacggcacggttttcgacctttttcgatggggctcctgtcttccgcatccccgggcggcgctttcccgtggatatattctacacgaaggcaccagaagccgactacctggaggcttgtgtagtgtccgtccttcagattcacgtgacacagccaccaggcgatatcctagtgttcttaacggggcaggaggaaattgaggccgcatgtgagatgttgcaggaccgctgtcgccgcctgggttccaaaatccgtgagttactcgtgctgcccatctacgccaacctcccctcggatatgcaggcaaggatttttcaacctacgccacccggtgcccgtaaggttgtcgttgctacgaacatagctgagacaagtctgacaatagaaggaattatttacgtgctggacccagggttttgtaagcagaagtcctataatcccaggactgggatggaaagcctgacagtgacaccttgttccaaagcgagcgcaaatcaaagggctggacgggccggtagagtggccgccggtaaatgcttcagactgtatacagcatgggcctatcagcacgaattggaggagactaccgtgcccgagatccagagaactagcctcggaaatgtcgtattgctgctgaagtccctaggtattcacgacctgatgcactttgactttctggaccctcccccctatgaaacattgctacttgcccttgagcagctatatgctttgggagcactgaatcacttaggggagcttacgacatctggaagaaagatggctgaattaccagtggatcccatgcttagcaaaatgatcctagcttccgagaagtactcctgcagtgaagaaatcctcaccgtagctgccatgctctcggtaaataacagtatcttctacagacccaaggacaaagtggtgcacgccgacaacgcgcgagtcaactttttcctgccaggcggagaccacttagtcctgctgaatgtctacacccagtgggcggagagcggatacagctctcagtggtgttacgagaacttcgtccagttcaggtccatgcgtcgggcaagggacgtacgcgagcaactcgagggtctgctggagagagttgaagtggggctttctagttgccagggtgactatattagagtgcggaaggccatcaccgcaggatacttctatcatacggcccgcctcacaaggtctggatatcgtaccgtgaagcagcagcagactgtttttatccaccctaattcttctctgttcgagcagcagcctcgctggctactttaccacgaactcgtgctgacgacaaaagaatttatgaggcaagtcttggaaattgaaagttcatggctactggaagtcgctccacactactataaggccaaggagctggaggacccacacgcaaaaaaaatgcccaaaaaaattggaaagaccagagaagaactgggctag

SEQ ID NO: 184945 - DNA, 3126 bp, Artificial Sequence
  Description of Artificial Sequence: Synthetic coding sequence
atggccacccccgccggcctggagcggtgggtgcaggacgagctgcatagtgtccttgggttgagtgagcggcacgtcgcacagtttttaatcggaacggcacaacgctgcactagcgcagaggagttcgtccaaaggctccgcgacacagacacactggatctgagtggaccagccagggacttcgcattgagactctggaacaaggtgccccggaaagcagtagtcgaaaagccagctagggctgctgagagagaagcaagggctttgcttgagaaaaaccgaagctacagacttctcgaggacagcgaggagtctagtgaagagaccgtctcccgggccgggtcaagccttcaaaagaagcgcaagaagaggaagcatcttcggaaaaagagggaagaggaagaggaggaggaggcctccgagaaagggaagaagaagacaggcggaagcaaacaacagaccgaaaagcccgagtccgaagacgaatgggagcgaactgaacgtgagcgactgcaagacctggaagaaagggatgccttcgccgagcgggtgcgccagagagataaggatcggacgcggaacgtgttagaacgatcagacaaaaaggcatatgaagaggcccagaagcgcctaaaaatggcagaggaggaccggaaggcaatggtgccagagctacgcaaaaagagccgacgagagtacctcgctaaacgagaacgagagaaattagaggacctggaagctgagctggcggacgaggaattcctttttggggatgttgaactatctagacacgagcgccaagagcttaagtacaagcgccgggttcgcgacctagctagagaatatagagccgccggcgaacaggagaagctggaagccacaaacagatatcacatgcctaaggagaccagaggtcagcccgcccgggccgttgatctggtggaggaggagagcggagcaccgggggaggagcagcgtcggtgggaagaggctcgtctcggtgccgcaagtcttaaatttggagctcgggatgcagcctcgcaggagcctaagtatcaactggtactggaggaggaagaaaccattgagttcgtgagggccactcaactgcagggcgacgaagagccaagtgcccccccgaccagcacacaggcacagcagaaggaatccatccaggccgtgcgaaggtccctgcctgtcttccctttccgcgaggagctcctggccgccatcgccaaccaccaagtgcttatcattgaaggtgagaccgggagtggcaagacgacgcagattccccagtacctcttcgaagaaggctacacaaacaagggtatgaagattgcctgtacacagcccagacgtgttgctgcaatgtccgttgccgcccgcgtcgctcgcgagatgggcgtgaagctgggtaatgaagtggggtactcaatccggtttgaggactgcaccagcgagcgtaccgtgctcagatacatgacagatggaatgttattgcgggagttcctttccgagccggacctggctagctacagtgttgttatggtggacgaggcgcacgaaagaaccttgcacacagacatcctttttgggttaatcaaggatgtcgccagattccgtcccgagttaaaagtgctggtcgcttctgccactatggacacggcccgattttctacgttcttcgatggggcccctgtctttagaattccgggccgccggttccccgtcgacatattttataccaaagcgcctgaagccgactacctggaggcttgcgtggtgtccgtgctgcagattcatgtgacacagcctcctggcgacattctggtgtttctgacaggccaggaggagatagaggctgcttgcgagatgctgcaggatcggtgccgccgcctcggaagcaagattcgggagctgttggtcttgccaatatatgccaacctgcctagcgatatgcaggctcgcatcttccagcccaccccacccggggcacggaaggtggtggtcgcaacaaatattgccgagacctctttaacgatcgaggggatcatttatgtgctggatcccggtttctgtaagcagaaaagttacaacccgcgaacagggatggagtctctgacagtgacgccctgttcaaaggctagcgccaaccagcgagccgggcgcgccggacgcgtagcagcggggaaatgctttcggctctataccgcatgggcttatcagcatgagttggaggaaactaccgttcctgaaatccagcgcacgtccttaggaaatgtcgtgttactattaaagtctttagggatccatgacttgatgcatttcgactttctggaccctcctccttacgaaacattactcctggcgctcgaacagctgtatgcacttggcgcactaaatcaccttggtgagctgaccacttctggacggaagatggcagaactgcccgttgacccaatgttgtcaaagatgatcctggctagcgaaaagtatagctgcagcgaggaaatcctcaccgtcgcagcgatgctgtctgtgaataacagcatattttaccggcctaaagataaagtcgttcatgccgacaatgcgcgcgtgaatttctttttgcctggaggcgaccacctcgtgctgctgaatgtttacacgcagtgggctgaatccggatactcaagtcaatggtgctatgagaattttgtccagttccgcagtatgcggcgagccagggacgtgcgtgagcagctcgagggcctgctcgagcgagttgaggtcgggctgtcctcatgtcagggcgactacatccgggtgcgcaaggctataactgccggctacttctatcacactgcccgactgaccaggtctggttacaggacagtgaaacagcagcagacggtttttatacatcccaattcttcactcttcgaacagcagccacgctggctactatatcatgagctcgtcttaaccaccaaagaattcatgaggcaggtccttgagatcgaatcttcctggttgctggaggtcgctccccattactacaaagctaaggaactcgaggacccacacgctaagaaaatgcctaagaagatcggcaagaccagggaggagctgggctag

SEQ ID NO: 184946 - DNA, 1683 bp, Artificial Sequence
  Description of Artificial Sequence: Synthetic coding sequence
atggagagccagcccgcccaggagtgcctgatgcagatgttcctgccaatagagcctgcgtgcttcgtcgaatggttagggacctcgccctctcagctgggggtagtcatggtggacgaagcacacgaaagaaccctgcacaccgatatcctgtttggccttattaaagatgtggcccggttcagacccgagctgaaagtgctcgttgccagcgctaccatggatactgcacgtttcagcaccttttttgatgatgcgccggtctttagaatcccgggtcggcgctttcccgtcgacattttttatacaaaggcccctgaggccgattatctcgaggcttgcgtggtgtctgtcttacagatccacgttacacagcccccgggcgatattctggttttccttacaggccaggaagagatcgaggcagcctgtgagatgctccaagaccgatgtaggagactggggtcaaagatcagggagctcctagtgctccctatctacgccaacttacctagcgatatgcaggcacgcatctttcagccaactcctcccggcgctaggaaagtggtagtggccaccaatatagcagaaaccagtctgaccattgagggcattatctacgtgctggacccgggtttttgtaagcagaagtcttataatccaaggaccggtatggaatctctgaccgtcaccccgtgttcaaaggcaagcgccaatcaaagagccggcagagctggaagagtcgccgccggaaagtgcttcagattgtataccgcgtgggcctaccagcatgagctggaagagactactgtccccgagattcagcggacttctctcggcaatgtggtgctgctgttgaaatccttgggcatccatgatctaatgcattttgactttctcgatccccccccttacgagactctgctcctggcccttgaacaactatacgcgttgggggcactgaaccatctcggagaactcaccacatcaggccggaagatggcagagctgcctgtggaccccatgttgagtaaaatgattttggccagcgaaaagtattcatgttcggaggagatcctaacagtggccgccatgctgagcgttaataatagtattttctacagacctaaagacaaagtagtacacgcggataacgcgcgggttaatttttttttgcctggaggcgaccacctggtgctgctcaatgtttacactcaatgggcagaaagcggctattcttctcagtggtgctacgagaactttgtgcagttccgcagtatgcggagggctcgagacgttcgtgaacagctggagggattgctagaaagagtcgaagtggggctaagttcctgtcaaggggactatattcgagtccgtaaggccatcacggccgggtatttctaccacaccgccaggctcactcggtctgggtaccggacagtcaagcagcaacaaacagtgtttatccatcctaatagcagtctgtttgaacagcaaccacgctggctcctgtatcatgagctggtcctgacaactaaagaatttatgagacaagtgcttgagatcgagtctagctggcttctggaagtggcccctcattattacaaggccaaggagttagaggatcctcacgccaaaaagatgccgaaaaagatcggcaagaccagagaggagctcgggtag

SEQ ID NO: 184947 - DNA, 888 bp, Artificial Sequence
  Description of Artificial Sequence: Synthetic coding sequence
atgagcgaggacccccggggccccaaggtgccccggaaggccgtggtggagaagcctgctcgagctgccgagcgagaagctagggcccttctggaaaaaaatcgatcttaccgtctgctggaggacagcgaggaaagtagcgaagaaactgtgagtagggccgggtcttccctgcagaaaaagagaaagaagcgaaagcatcttaggaaaaaaagggaggaagaggaagaagaggaggctagtgagaagggaaagaaaaaaactggaggttcaaagcagcaaacagaaaaaccagagtctgaggacgaatgggagcgtactgagagagaacgactgcaggacctggaagaacgagacgcattcgccgagagagttagacagcgcgataaagatcgaacacgtaatgttttggaaagatccgacaaaaaagcatatgaagaagcacaaaagcgcctgaagatggcagaggaggatcggaaagctatggtacccgaactgcgaaagaagagccgccgggaatacttggccaagagagaacgcgagaagctcgaagacctggaggctgagctggctgacgaggagttcctgttcggggatgtcgagctcagcagacatgagagacaagagttaaaatacaaaagaagggtacgcgacttagcccgggaatatcgcgctgcaggagagcaagaaaagttggaagcaacaaatcgctatcatatgcctaaggaaaccaggggtcaaccagctcgggcagttgacctcgttgaggaggaaagtggcgcgcctggcgaggagcagcggcgctgggaagaggcccggctcggagctgccagcctcaaattcggcgcacgagacgcagcgtcccaggaacccaaataccagctgtag

SEQ ID NO: 184948 - DNA, 3126 bp, Artificial Sequence
  Description of Artificial Sequence: Synthetic coding sequence
atggccacccccgccggcctggagcggtgggtgcaggacgagctgcatagcgtgctcggcctctctgagagacatgtggcacagtttctgattggtaccgcacagcggtgcacttccgccgaggaatttgttcagaggctgagggacacggacacacttgacctcagcggcccggcccgtgatttcgctctacggctctggaataaggtaccacggaaagcagtggttgaaaagccggcaagagccgccgaaagagaagcacgggcgctactggaaaaaaacaggagttaccgtctgcttgaggacagtgaagagtcttcagaggaaaccgtatctagggctggaagctccttacagaaaaaacgcaaaaaacgcaaacatttacgcaagaagcgcgaggaggaggaagaagaggaagcctctgaaaaaggaaagaagaaaacaggcggatctaaacaacagacggagaagcctgagtctgaagatgagtgggagcgcacagagcgcgaacgcctgcaagacctggaagaaagagatgcattcgccgagcgggtccgtcaacgggacaaagacagaaccagaaacgtgttggagaggagcgacaagaaggcttacgaggaggctcagaaacgtctgaagatggctgaagaggacaggaaggccatggtgcccgaacttcggaagaagtctaggagagaatatttggccaaacgggaacgagaaaagttggaggaccttgaagctgagctggccgacgaggaatttctcttcggggatgttgaactttcgcggcatgaaagacaagaactgaagtacaagaggagggtgcgggacctggcacgggagtatcgcgccgcaggcgagcaggagaaactcgaggcgacaaatcgttaccacatgcccaaagaaacaagggggcagcccgcccgggctgtggatctggtcgaggaggagagcggcgccccaggggaggagcagaggcgctgggaggaggctagactgggcgcggcttctctgaaatttggggccagggatgccgcttcacaggagccaaagtaccagctggtgctggaggaagaagagaccatcgagttcgtaagagctactcagctacagggcgacgaggagccgtccgcccctcccacgtcaacccaagcccagcagaaggaatctatacaggcagtccggaggtcactgcctgtgtttccatttagagaagaactgctagcagcaattgccaaccaccaagtgctgattattgagggagagacaggatcaggtaaaacgacacaaatcccccagtacctcttcgaggaaggatacaccaacaagggtatgaagattgcctgtacccaacctcgccgagtcgctgcaatgtccgtggccgccagagtcgcgagggagatgggtgtgaaactggggaacgaggttggctactcaattagattcgaggattgtacaagcgagcggacggtgctcagatacatgactgatggaatgctgctgcgggaatttttaagtgagccagatctggctagctactcggttgtgatggttgatgaggcacacgaaagaacactccacaccgatatcctgtttggtctgatcaaagatgttgctcgctttcgtcctgagctgaaagttctcgtagcctccgctacaatggacaccgcgcggttttcgacgttcttcgatgatgcgccggtgttccggatccctggacgcagattccctgtcgacattttctacacgaaggcccccgaagccgattaccttgaagcttgtgtcgtgtccgtgctgcagattcacgtcacccagcctccaggagacattctagtgttcctgaccgggcaggaagaaatagaggctgcctgtgagatgctgcaggacagatgtcggcgactggggtccaagatcagagaactactcgtcttacctatttatgcgaatctgccctccgacatgcaggcacgcatttttcagcccaccccccccggagccaggaaggtcgtggtcgcgactaacattgccgaaacttccctgactatcgagggaattatctatgtcctggatcctgggttctgtaaacaaaaatcatacaacccgagaaccggcatggagagcctgactgttacaccatgcagtaaggcttccgctaatcagagggcagggcgagctgggcgggttgccgccggcaaatgtttccgcctttacacagcctgggcctaccaacatgagcttgaggaaacaactgtcccggagattcagcgcacgtcgttaggcaacgtggttttgctgctaaaatccctcgggattcacgatctgatgcacttcgattttcttgatccccccccttatgaaaccctactgctagcgcttgagcaactgtacgctctcggggccctgaaccatcttggggagttgacaacgagtggaaggaagatggctgaattaccagtggaccctatgctgtccaagatgatcctcgcatccgagaagtactcttgctctgaagagattcttacagtggcagccatgctgagcgtaaacaactctatcttctaccgtccgaaagacaaggtggtgcatgctgataacgcaagagttaactttttcctgcccggtggggaccatcttgtcctcttgaatgtgtacacacaatgggcagagtctggctacagttcacaatggtgttacgaaaattttgtccagttcagaagcatgcggagagccagagacgtgagagagcagttagagggattactcgagcgggtggaggttgggctgagcagctgtcagggcgactacatcagggtgagaaaagccattacagccggatatttttaccatactgccagattaaccaggagcgggtatcggacagttaaacagcaacaaactgtatttattcaccccaacagttccctgttcgagcagcagccccgctggcttttgtaccacgagctcgttttgactaccaaggaatttatgcgacaggtgctagagattgaatcttcctggctccttgaagtcgcaccccattactacaaggccaaggagcttgaggaccctcatgctaaaaagatgcccaagaaaatcggaaagacccgcgaggaattaggctag

SEQ ID NO: 184949 - DNA, 3126 bp, Artificial Sequence
  Description of Artificial Sequence: Synthetic coding sequence
atggccacccccgccggcctggagcggtgggtgcaggacgagctgcacagcgtgcttgggctttctgagaggcatgtcgctcagtttctgatcgggactgcacagagatgtaccagcgccgaggaattcgtccagcgccttagggacacagatactctggatctgtcaggcccagcgcgggacttcgctctgcgcctctggaacaaagttccccgcaaggctgtggtggagaaaccagctcgcgctgctgagagggaggctcgcgctctgctggagaaaaataggtcctacaggcttttagaagactccgaggaatccagcgaagaaaccgtgagccgtgccgggagctccctgcaaaagaaacgcaagaaacggaagcatctgcggaagaagcgggaggaggaggaagaagaagaggcttccgaaaaaggcaagaaaaagacaggagggtccaaacaacaaaccgagaagcccgagtccgaggatgaatgggagcgtaccgagcgggaacggttgcaagatctagaggagagggatgctttcgccgaacgcgtccgccagagggacaaagatcgcactaggaacgtactcgagaggagtgacaaaaaagcgtacgaagaggctcagaagagactaaaaatggcagaggaggataggaaagccatggtgccggaactgcggaagaagtctcgccgcgagtaccttgctaagagagagcgggagaaactagaagatttggaggctgagcttgccgatgaggagttcctcttcggggacgtggagctttcccgtcacgagaggcaagagttgaaatacaagcggcgcgttcgggacctggctcgggaatatcgagcagcaggcgagcaggaaaagctggaggcaacaaaccggtatcacatgcccaaagaaactcgcggacagccggcacgagccgtggacctcgtggaggaggagagcggggcccctggagaagagcagcgccggtgggaggaggctcgcctcggagctgctagtctcaagttcggagcccgagacgcagcctctcaggagccaaagtatcagctggtcctggaagaggaagagaccattgaattcgtgcgagccacccaactgcagggtgatgaggagccatccgctccgcctacttcaacccaggctcagcaaaaggagtccatccaggccgtccggaggagtttgcccgtctttccttttcgcgaggagctgcttgcagctattgcgaatcaccaggtattaatcattgagggagaaaccggttccggcaaaacaacccagattccgcagtatctctttgaagagggctacactaataagggaatgaagattgcctgtacacagccccggagggtggctgctatgagcgtagccgctagagtggcccgtgagatgggagtcaaacttggcaatgaggtcggatactcaatcagattcgaagactgtacatcagaacgcacagtgctcagatacatgacagacgggatgctcctgcgggagtttttgtctgaaccagatctcgcctcctactccgtggtaatggtggatgaggcgcatgagagaaccttgcatacagacattctgttcggactgatcaaagatgtcgcaaggtttagacccgagctcaaggtgcttgtggcgagcgccactatggacaccgcccggttttccacattttttgacgatgcccctgtcttcagaatccccggccgcaggttccctgtagacattttttacaccaaggccccagaagcggactacctggaggcgtgcgtagtgagcgtgctccagatccatgtaactcagcctcctggtgacattctggtgttccttacgggccaagaggaaattgaagccgcctgcgagatgctgcaagaccgatgtcgccgtttggggtctaaaattcgcgaattacttgtactaccgatatatgctaatctacccagtgacatgcaggccagaatttttcaacctactcctccgggcgcaaggaaggtggtggtggccacaaatattgccgagacgtccctaaccattgagggcatcatctacgttttagatcccggcttttgtaaacagaaatcctacaatccaaggactggtatggagagcctgactgttaccccttgctcaaaagctagtgcaaaccagagggcgggcagggcaggacgggtggcggccggtaagtgttttagactgtatacagcctgggcttaccagcatgaactcgaggagaccacagtgccagaaatccagcggactagcctagggaacgtcgtgctgctgttaaaatcactgggaattcacgacctgatgcatttcgattttctggacccccctccatacgagaccctgctactggcgctggaacaactgtatgctctcggcgcactgaatcacctcggcgagctgacaacctccgggagaaaaatggccgaactgccggtggacccaatgctctccaagatgattctcgcgtctgagaagtatagctgctccgaggagatcctgacagtggccgccatgctgtccgttaacaacagtatcttctatcggccaaaagacaaagttgtgcatgcagacaatgcacgcgtgaacttcttcttacccgggggcgatcacttggtgctgctcaacgtctatactcagtgggctgagtccggctactcatcccaatggtgctatgagaattttgtgcagtttaggagcatgcgccgggcccgtgatgtccgggagcaactggaagggctgctggagcgcgttgaagtgggtttgagctcatgtcagggggattacataagggtgcgaaaggcaatcaccgcaggttacttctaccacacagcccggttgacgcgatccgggtatcggactgtcaagcagcagcaaactgtgtttattcatcccaacagcagtctgttcgaacagcaacctcgttggttgctgtaccacgagctcgttctcactaccaaagagtttatgcgacaggtgctggaaattgagagctcttggttgttggaggtcgctccacactactataaagccaaggagttggaagacccgcatgcaaaaaaaatgcctaaaaagattggcaagaccagagaggaattaggatag

SEQ ID NO: 184950 - DNA, 3126 bp, Artificial Sequence
  Description of Artificial Sequence: Synthetic coding sequence
atggccacccccgccggcctggagcggtgggtgcaggacgagctgcattctgttctcggtttgtccgagcggcacgtggctcagtttttaattgggacggctcagagatgcacgtccgctgaagaattcgttcagcgattaagagatacagacaccctcgacctgagtggtccagcacgggacttcgctctgaggttatggaataaggtacctcggaaggccgtagtggagaagcccgccagagctgctgagagggaagccagggcgcttctggaaaaaaataggtcttaccgactcttagaagactcagaggaaagctctgaagagactgtgtcacgggccggatcaagtctgcagaaaaagaggaaaaagcgcaaacatcttaggaagaaacgcgaggaagaggaggaggaggaagccagcgagaaaggaaagaaaaaaaccgggggatctaaacagcaaacagagaagccagagtccgaggatgagtgggaaaggaccgaaagggagaggctgcaggaccttgaggagagggatgcctttgccgagagagtccgccaaagagacaaagacagaacccggaatgtcctggagcgttctgacaaaaaggcctatgaagaggcacagaagcgcctgaagatggcagaagaggacagaaaggccatggtccccgagctcaggaagaagtccaggcgtgaatatctggcaaagcgcgagcgtgagaagctggaagacctagaggcggaactcgcggacgaagaatttctgttcggcgatgttgaactttcccgccacgaaagacaagagctgaaatacaagcgacgcgttagggacctagccagagagtatcgcgcagcaggcgaacaggagaagctggaagctacaaatcggtatcacatgcctaaagagacccggggtcagcctgcccgtgccgtcgacctcgtcgaggaggagtccggagcgcctggggaagagcagaggcgatgggaggaggcgaggctgggagccgcctccttgaagtttggagcgcgggatgcggccagccaggaaccgaaatatcagctggtgctggaggaggaggaaactatcgaatttgttcgggctactcagctccaaggcgatgaggagccttcagctccccctacgagcacccaggcacagcaaaaggaatctatccaagctgtgcgacggtccctccctgtgttcccctttagggaggagttactggctgcaattgcaaatcatcaggtgctcattattgagggggaaactggctccgggaagacaactcagattcctcagtatttgttcgaggagggatataccaacaagggcatgaagatagcctgcactcagccccgcagagtagcagccatgagcgtggccgccagagtggcgagggagatgggtgtgaagctgggcaatgaagtcggctactccattagatttgaggactgcacctccgagcggaccgtgcttcggtatatgaccgacgggatgctcctgcgagagttcctttcggaacccgatctggcctcctacagcgtcgttatggttgacgaagcccacgagagaactttgcacacggatatcttatttggcctgatcaaggatgttgcccgctttcggccagaattaaaagtactagtggcctctgctacaatggacactgcgcgcttctctactttttttgatgacgctccagtgtttcgaatcccaggacgcagatttcctgttgacatattctacactaaagcccccgaggcagactatctggaggcctgcgtggtaagtgtactccaaattcatgtgacccagccaccaggcgatatactggtattcctcactgggcaggaggagattgaagccgcctgtgaaatgttacaggatcgttgtaggagacttggctccaagatccgcgagttgctggtgcttccaatctacgctaacttgcccagtgacatgcaggcccgcatattccagcccacccctccaggggctcggaaagtcgtagtcgccaccaacatcgccgaaacctccttgactattgagggtataatctacgtgttggacccaggattttgcaagcagaagtcctataatccaagaaccggtatggagagcctgaccgtgacaccgtgcagcaaagcttctgctaaccagagagctgggcgggccggacgagtcgctgctgggaaatgcttcagactgtatactgcatgggcataccagcatgaactagaggaaacaactgtgccagagatccagagaacttctctggggaatgtggtgctccttcttaaatcactgggcattcacgacctcatgcacttcgatttcctggatccgccgccctacgagaccctgctgctagctctagagcaactgtacgcccttggtgcactgaatcacctgggcgagctgaccacctcaggtcggaaaatggctgagctccctgtggaccccatgcttagcaaaatgatccttgccagcgagaagtatagttgcagcgaagagattctgacagtcgccgccatgctgagcgttaataactccattttttatcgccccaaagacaaggtagtgcacgcggacaacgcccgtgtcaacttttttctgcccggcggagatcatttagtcctactcaacgtttacacccagtgggcagagtccggatatagcagccaatggtgttacgagaatttcgtgcagtttcgcagtatgcgtcgtgcccgcgacgtgagagagcagctagaaggactcctagagagagttgaggttggactatcctcctgtcagggggattatatcagggtccgaaaggcaataacagctggctatttttaccatacagcccggcttacccgatctggatatcggaccgtgaaacagcagcaaacagtcttcatacaccccaactcgtcgctgttcgagcagcagccccgttggttgctctaccatgaactggtccttacaaccaaagagttcatgagacaggtgttggagatagaaagctcttggctactggaagtggctccgcactactacaaagcaaaggaactggaagatccccatgccaagaaaatgcctaagaagatcggaaaaactagggaagagctgggctag

SEQ ID NO: 184951 - DNA, 888 bp, Artificial Sequence
  Description of Artificial Sequence: Synthetic coding sequence
atgagcgaggacccccggggccccaaggtgccccggaaggccgtggttgaaaaacctgctcgggcagcagagcgagaagcacgagctctgcttgaaaaaaatcgatcctaccgtctgttggaagacagcgaggaaagtagtgaagagacagtttccagggcaggatcctctttacaaaaaaagcgcaagaagaggaagcacttgagaaagaagcgcgaggaagaagaagaggaagaggcatccgagaaggggaagaagaagacgggcggcagcaagcagcagaccgaaaaacccgagagcgaagacgagtgggaaagaacagagagagaaagacttcaggacctggaggagagagacgcatttgccgaaagagtccgccagcgagacaaagatcgaaccagaaacgtgctggagaggagtgataaaaaagcttacgaggaagcccaaaagcgcctcaagatggccgaagaagatcgcaaggcgatggtgcctgagttacggaagaaatcccgacgagagtatctggccaaacgggagcgcgagaagctggaggacctggaggccgagttggccgatgaggaattcttgttcggagatgtggaactgtcccggcatgagcgtcaggaactgaagtataaacgccgagtgagggatctagctcgcgagtaccgagctgcaggggaacaggagaagttggaggcgacaaatcggtaccacatgccaaaggagactcgaggacagcccgcgcgggctgtggatttagtggaagaggaaagcggggctcctggagaagagcagaggaggtgggaggaagccagactcggcgccgcatccctcaaattcggggcgagggatgcggcttcccaggagccgaaatatcagctctag

SEQ ID NO: 184952 - DNA, 888 bp, Artificial Sequence
  Description of Artificial Sequence: Synthetic coding sequence
atgagcgaggacccccggggccccaaggtgccccggaaggccgtggtagagaagccggcccgggctgccgagagagaagccagggccctccttgagaagaatcgcagttaccgtctattggaagactccgaagagtcaagtgaagagactgtctctcgggctggctcttcgctgcaaaagaagagaaagaagaggaagcacctccggaagaaacgggaggaggaagaggaggaagaggctagcgaaaaaggtaaaaagaagacgggcggttctaaacagcaaacggaaaagcctgaaagtgaagatgaatgggagcgcacagaaagggagcgcctgcaggacctcgaggagcgagacgcttttgccgagcgtgtgaggcagcgtgacaaagatcggacccggaacgtgctcgaaaggtccgacaaaaaagcttatgaagaagcccagaagcgacttaagatggcggaagaggataggaaagcgatggtccccgagttaaggaagaaatctcgacgcgagtacttggctaaaagggagcgggagaaactggaggacctggaggctgagcttgccgacgaagaatttctctttggcgacgtggaattgtctaggcatgagaggcaggaacttaagtacaagcgtcgggtccgcgatctggccagggaatacagagctgccggagagcaagaaaaactggaagccacaaaccgctatcatatgcccaaagaaactagagggcagccagctcgcgcggtagatctggtcgaggaagaatccggggcacccggggaggagcagcgccgctgggaagaggctcggctgggggctgcctctctgaaatttggtgcacgagatgctgcatcgcaggagccaaagtatcagctgtag

SEQ ID NO: 184953 - DNA, 1683 bp, Artificial Sequence
  Description of Artificial Sequence: Synthetic coding sequence
atggagagccagcccgcccaggagtgcctgatgcagatgttcctgcctattgagcccgcgtgttttgtcgaatggctaggtaccagcccctcacagctgggcgtggtgatggtggacgaagcccacgaacggaccttacataccgacatactcttcggcctcataaaagacgtcgctcggttcagacccgagctgaaagtcttggtggccagcgcaactatggacactgcccgcttctctacatttttcgacgatgctcctgtttttcggatcccagggagaaggtttccagtcgatattttttatactaaggctcccgaggctgattacttggaagcctgcgtggttagtgtgctgcagatacacgtgacgcagcctcctggcgacattctggtgttcctgaccggacaagaagaaatcgaagccgcttgtgagatgcttcaggacaggtgcaggagactcggatccaaaattagggaacttttggtgctgccaatctacgctaatcttccttctgacatgcaggcccgaatttttcaacctacccccccaggagccagaaaggtggtcgtggcgactaatatcgcagaaacaagcttgacaattgaaggcataatttatgtgctcgatccgggtttctgcaagcaaaaaagctataacccacgcacaggaatggagtcgttaactgtaacgccttgctcaaaagcatcggcaaaccaacgcgctggacgggcgggccgagttgccgccggaaagtgtttccgcctgtacactgcatgggcttatcagcacgaactagaggagactacagtgccagaaatccagcgaacaagcctagggaacgtggtactgctcctcaaatcactcgggattcatgaccttatgcactttgactttctggatcctcctccgtacgagacgctcctgcttgcgttagagcaactctacgcacttggtgccctgaatcacctgggcgagctgactacgtcaggacgtaagatggctgagctgcctgttgacccaatgctgtccaagatgatcctggcgagcgaaaagtattcttgctctgaggaaatcctgacagtcgctgctatgctctctgtcaataattctatcttttaccgtccgaaggacaaagtcgtgcacgcggataatgccagagtcaatttttttttgccagggggagaccacctggtgctgctgaacgtgtatactcagtgggcggaatcagggtactcctcccagtggtgctatgaaaactttgttcagtttcggagcatgcgcagagctagagacgttcgggagcaattggaagggttactagaacgtgtggaggtaggcctgtcaagctgtcagggcgactatattcgcgtcagaaaggcaataaccgcaggttacttctaccacactgcccggcttacacggagcggatacagaactgtaaagcagcagcaaaccgtcttcattcaccccaattcctccttattcgagcagcagcccaggtggctgctttaccatgaactagtgctaaccactaaggaattcatgcggcaggtcctggagattgaatcctcttggttgttggaagtggcgccccactactacaaggctaaagagcttgaggatccccatgctaagaaaatgcctaagaagatagggaagacaagggaagagctgggctag

SEQ ID NO: 184954 - DNA, 888 bp, Artificial Sequence
  Description of Artificial Sequence: Synthetic coding sequence
atgagcgaggacccccggggccccaaggtgccccggaaggccgtggtggaaaagcccgctcgtgctgccgagagagaagcccgggccctgcttgagaagaaccggagctataggctcctcgaggatagcgaggagagttccgaagaaacggtgagcagggccggatcttcgctccagaaaaagaggaagaagcgcaagcatctgcgaaagaagcgggaagaggaggaggaagaggaggctagcgagaagggaaagaaaaaaaccggtgggtcaaagcagcagacagagaagccggagagcgaagatgagtgggagagaaccgaacgggaacggctgcaggacctggaagagagggacgcctttgccgagcgagtccgccagagagataaggacagaacccggaatgtgctggagagatctgacaagaaagcctacgaggaagcccaaaagaggctaaaaatggctgaggaggaccgcaaagcaatggttcctgagttgcggaaaaagtcgcgcagagagtacctcgctaaacgggagagagagaaattagaggatctagaggccgagctggcagatgaggagtttttatttggcgatgttgaactctctaggcacgagcgccaagaactgaaatacaagcgccgcgttcgtgacctggctcgcgaatatagagcagctggtgaacaagagaagctggaggccacaaatcgatatcacatgcctaaggagactcggggccagcccgccagagctgtcgacttggtagaggaagagtctggtgcaccaggagaggaacaaaggcggtgggaggaagctaggcttggggcagcttcactgaaattcggggcaagggatgcggcttcccaggagcccaaataccaattatag

SEQ ID NO: 184955 - DNA, 888 bp, Artificial Sequence
  Description of Artificial Sequence: Synthetic coding sequence
atgagcgaggacccccggggccccaaggtgccccggaaggccgtggtggaaaagcctgcacgcgctgctgaacgcgaagcgcgggccctgctggaaaagaataggagctaccgcctattagaggactctgaggagagctcagaagaaaccgtatcccgtgccggctccagtctgcagaagaaacgcaaaaagaggaagcacttgcgcaaaaaaagagaagaagaagaggaagaggaggccagtgagaaaggtaaaaaaaaaaccggcgggtctaagcagcagactgagaaacctgaaagcgaggacgagtgggaacgtacagagcgcgagagactccaggatctggaggagcgcgacgccttcgccgaacgggttagacagcgggataaagaccgcactcgtaatgttctggagagatctgacaaaaaagcctatgaagaagcccagaaaaggcttaagatggcagaggaagacaggaaggccatggtccccgaactgagaaagaaatccagacgcgagtatctggcaaaacgagaacgagagaagctggaggatctggaggccgagctggcagatgaggagtttctgttcggggatgtcgagttgtcaaggcatgagaggcaggagctgaagtacaagcgcagggtgcgagacctggccagagagtacagagccgccggcgagcaagagaagctggaggctacgaacaggtaccacatgcccaaggagacccgcggccagccagcgagagctgtcgaccttgttgaggaagagtcgggtgcgcctggagaagagcaacgaagatgggaagaggcccggctcggcgcggccagtttgaagtttggggcacgtgatgccgcatcgcaggagcccaaatatcaattgtag

SEQ ID NO: 184956 - DNA, 888 bp, Artificial Sequence
  Description of Artificial Sequence: Synthetic coding sequence
atgagcgaggacccccggggccccaaggtgccccggaaggccgtggtggaaaagcctgcgcgggccgcagagagggaagcccgggctctcctggagaagaaccggtcttaccgtctgctggaggattccgaggaatcttcagaagagacagtgagcagggccgggagcagcttgcagaagaaaaggaagaaaaggaaacacctcaggaagaagcgcgaagaagaggaagaggaggaggcctctgaaaagggaaagaaaaaaacaggtggaagcaagcagcagacagagaagccggagagtgaggacgaatgggaacgtaccgaaagagagagactgcaggatctggaagaaagggatgcttttgctgagcgagtcaggcagcgagataaggaccgtaccaggaacgttctggaaaggagtgataagaaggcatacgaagaggcacagaagaggttgaagatggcggaggaagaccgcaaagccatggttcctgagctaaggaagaagagccgacgcgagtatctcgcaaaacgggagagggagaaactcgaagatctggaggccgaactcgccgacgaggaattcctgttcggggatgtggaacttagccgtcacgagcgacaagaattgaagtacaagcgtcgagtccgggatctggcacgtgaataccgcgccgcaggcgagcaagagaaattggaggctaccaatagatatcacatgcctaaggaaacccgaggccagcctgcacgagcggtggacttggtggaagaagagtccggagctcccggagaggagcagcgcagatgggaggaggcgcggttgggcgctgcctccctcaagtttggagcccgcgacgccgcttctcaagaaccaaaataccaactctag

SEQ ID NO: 184957 - DNA, 888 bp, Artificial Sequence
  Description of Artificial Sequence: Synthetic coding sequence
atgagcgaggacccccggggccccaaggtgccccggaaggccgtggtagagaaaccagctagggccgccgagagggaggccagggctctcctcgagaagaacaggtcctaccgactactagaggatagtgaggaatcatctgaagagactgtgagtagagccggaagcagtctccagaagaagcggaagaagcgaaaacacctccgcaagaaacgggaggaggaggaggaagaggaagcttctgaaaaggggaagaaaaagaccggggggtcgaagcagcagaccgagaagcctgaaagtgaagacgagtgggagcggacagagagggagcggctacaggacctggaggagcgggatgcctttgccgagagagtgcggcagcgggacaaggaccggacaagaaatgtgctggaaagatcggataagaaggcttatgaggaggctcagaaaagactcaaaatggctgaggaggacagaaaggcaatggttccagaactaaggaagaagtcccgcagagaatacctggccaagcgagagagagagaagctcgaggatctggaagctgagttagccgatgaggaatttttgtttggagacgtagaactgtccaggcacgaacgccaggagcttaaatacaagcgcagagtcagagacctggccagggagtatcgggccgctggtgagcaagaaaagctggaggccactaaccggtaccatatgcctaaggaaacacgagggcagcccgcacgcgccgtggatctcgtagaagaagaaagtggtgccccaggagaagagcagagaaggtgggaggaagcccggctgggcgccgcatccctgaagttcggggctagagacgccgcttcccaggaacccaagtatcagttatag

SEQ ID NO: 184958 - DNA, 1683 bp, Artificial Sequence
  Description of Artificial Sequence: Synthetic coding sequence
atggagagccagcccgcccaggagtgcctgatgcagatgttcctgccaatagagcccgcttgcttcgtggagtggctgggaacaagcccttctcagttgggcgtcgtgatggtcgatgaggcgcacgaacgtacattgcacactgacatcctatttggtctgatcaaggacgtggccaggttccgaccagagctgaaggtgttggtagcgtctgcaacaatggacacagcccggttctcaaccttttttgacgacgctccagtctttagaatccccggtcgcaggttcccagtggatatcttctacactaaagctcccgaagccgattacctggaagcctgtgtcgtgtcagtgctacaaatccacgtcacacagccaccgggcgatatcttagtctttctgaccggacaggaagaaatcgaggccgcgtgcgaaatgttacaagatcggtgccgtaggctcggttcaaaaatcagagagctcctcgtgctgcccatctatgcgaatctgccttccgacatgcaggccaggattttccaacctaccccacccggcgccagaaaggtggtggttgccaccaatatcgcagaaactagcctaaccatcgaaggtattatctacgtgttggatccaggattttgcaagcaaaagtcttacaatccacgcacaggcatggagagtctgactgttaccccttgcagtaaagcctccgccaatcagcgcgccgggcgcgccggcagggtcgcagcaggtaaatgcttcagattatacactgcatgggcatatcagcatgagctggaagagactaccgtgcccgagattcagagaacctccctgggtaacgtggtgttacttctgaagtcactggggatccacgacctgatgcactttgacttcctggacccacccccttatgagacgctgctactggcactcgagcagctttatgcattgggagccctgaaccacctgggagaactgaccaccagtgggcgcaagatggccgagctccctgttgatccgatgctgagtaagatgattctggcaagtgagaagtacagctgctcagaggagatacttacggtcgcggcaatgttgtcagtcaacaatagcatcttttacagacccaaagacaaggttgtccatgcggacaacgcccgtgtcaattttttcctgccaggtggcgatcacttagtcctgctgaatgtctacacacagtgggcggagtccggttacagctctcagtggtgttatgaaaattttgtccagttccgcagtatgaggcgtgccagagatgtgagagagcaattggagggcctgcttgaaagggtcgaggtcggactttctagctgtcagggcgactatatccgggtgaggaaggctatcaccgctgggtacttctatcacactgcgaggcttacccgaagcgggtacaggacagtcaagcagcagcagacagtgttcatccaccccaatagcagcctatttgagcagcagccacgctggttactgtatcacgagctggtgcttactactaaggaattcatgcgtcaggtgttagagatcgagtccagttggctcttagaggtcgccccgcattattacaaagccaaggagttggaggaccctcatgccaagaaaatgccaaagaagatcgggaagacccgtgaagagctcggatag

SEQ ID NO: 184959 - DNA, 888 bp, Artificial Sequence
  Description of Artificial Sequence: Synthetic coding sequence
atgagcgaggacccccggggccccaaggtgccccggaaggccgtggtggaaaagccagccagagccgccgaacgggaagcccgggctctgcttgaaaagaataggtcatatcggctgctggaagattctgaggaatctagtgaggaaacagtgtcaagggcaggcagtagcctgcaaaaaaaaagaaagaaaaggaagcatctgcgtaagaagagagaggaggaggaggaagaggaggccagcgaaaaaggcaagaagaaaaccgggggatccaagcagcagactgaaaaacctgaaagtgaggatgagtgggagagaactgagagagaaaggcttcaggatctggaggagagggacgcctttgcagaaagagttcgtcagagagataaggatagaactaggaacgtgcttgagaggtcagataagaaggcctatgaggaggcccagaaacggcttaagatggcagaagaggatcggaaggcaatggtacctgaactgaggaaaaagagcagaagagaatatctggccaagagggaacgtgaaaaactagaagatctcgaggcagagctggcagacgaggaattcctgttcggggacgttgagctatccagacatgagcgacaggagcttaaatacaagcgaagggtgagggacctcgctagggagtaccgcgccgccggcgagcaagaaaagcttgaagcaaccaaccgatatcacatgcccaaggagacacgcgggcagcctgccagagcagttgatctcgtagaggaagaatccggtgctccaggagaggagcagaggcggtgggaggaagccaggctgggtgcagcttccttgaagttcggggcccgtgacgccgcatcacaggagcccaaatatcagctgtag

SEQ ID NO: 184960 - DNA, 2010 bp, Artificial Sequence
  Description of Artificial Sequence: Synthetic coding sequence
atggccacccccgccggcctggagcggtgggtgcaggacgagctgcactcagtgctgggcctttcagaacggcacgtggctcaattcctcatcggcacagcgcagaggtgtacatccgctgaagagttcgtccagcgacttagggacactgatactctcgacctgtccggcccagcccgcgatttcgccctgagactctggaacaaggtgccaaggaaggctgtcgtggagaaaccagctagagccgcagaaagagaagcccgagctttgctcgagaagaaccggtcataccgactactagaagatagtgaagagtcctcagaggagacagtctcaagagccggtagcagcctgcaaaaaaagaggaaaaagaggaaacacttgcgcaaaaaaagggaagaggaggaggaagaggaggcctccgaaaaaggaaagaagaaaaccggcggatcgaagcagcaaaccgagaagccggagagcgaggatgaatgggagcgaactgagcgcgagcgcctccaagacttggaggaacgggacgccttcgctgaaagagtgcgtcaacgtgataaggatcggacacggaatgttttggaacgttcggacaagaaagcatatgaagaggctcagaagaggctaaagatggccgaggaggacagaaaagccatggttcccgaactgcggaaaaagagcaggagggagtatttagccaaaagagagagggagaagctggaggacctggaggccgaactggccgacgaagagttcctctttggagatgtggagttgagccgacacgaaaggcaggaacttaaatataagcgacgcgtgagggacttggccagggaatatagggctgcgggcgaacaagagaagcttgaggccaccaataggtaccacatgcctaaagaaacccgcggccaacctgcaagggcagtggacctggtggaagaggagtcaggggcgcccggggaagagcaaagaagatgggaggaggccagactgggcgccgcatcccttaagttcggcgctagagatgctgcttcccaggaaccaaaataccagcttgttctggaagaggaagagacaatagaattcgtgagagctacacaactgcagggcgatgaagagcctagcgcaccacccaccagcactcaagcgcagcagaaagaaagcatccaggctgtgcgccgcagcctgcctgtgttcccatttagagaggagctgcttgccgctatcgccaaccatcaggtgctgatcattgagggagagaccgggagcggaaaaaccacacagatccctcaatacctcttcgaggagggttatacaaataaaggtatgaaaattgcttgtactcagccacggagagttgccgcaatgtctgtggcagcccgagtggcccgcgaaatgggagtgaaactgggcaatgaggtagggtatagcattcgatttgaagactgtactagcgagcgcacagtgcttaggtacatgaccgatgggatgctcctgagggaatttctcagtgaacccgacctggctagctattccgttgtaatggtggatgaggcccacgaacggacccttcacaccgatatcctgtttgggctgattaaagatgtcgcccggttcagaccggaactgaaagtattagtggcctctgctacaatggacacagcacgattttctactttctttgacgacgctcctgtgttcagaatccccggtcgtaggttcccagtggacatcttttacacaaaagccccggaagccgattatctggaagcctgtgtggtgagtgtgcttcagatccacgtcacccagcccccaggcgacatacttgtgttcctcactggtcaggaggagattgaagccgcctgtgagatgctgcaagaccgctgccggcgcttaggtagcaaaatcagagaactgttggtcctgcccatctacgcaaatctcccttccgacatgcaggcacgaatattccagccaaccccgcctggagccaggaaatag

SEQ ID NO: 184961 - DNA, 3126 bp, Artificial Sequence
  Description of Artificial Sequence: Synthetic coding sequence
atggccacccccgccggcctggagcggtgggtgcaggacgagctgcacagcgtgctagggctcagcgagcgacatgtggcacagttcctgataggcacagcacagcgttgcacatcagcagaagagttcgttcaacgcctgcgcgacacggacaccctggatctatcagggccggccagggactttgctctgcgactttggaacaaagtcccaaggaaggccgtggtcgagaaacctgctcgagctgctgagcgtgaggcaagggcactgctcgaaaagaatcggtcatatcgtctgctcgaagatagcgaggagtcctccgaggagactgtgtctcgggcggggtcctccctgcagaaaaagcggaagaagcggaaacatctgcggaaaaaacgcgaggaggaagaggaagaagaggcctccgagaaagggaagaagaagacaggtgggagcaagcaacagacagagaaaccagaatccgaggatgagtgggaaagaaccgagagggaacgtttgcaggatctggaggaacgggatgccttcgccgagcgagtgcgccaacgagacaaagatagaactaggaatgtgttagaaagatccgacaaaaaagcatatgaagaggcccaaaaaagactgaagatggctgaagaagaccgcaaagccatggtccccgaactgcgcaagaaatctcgacgggaatacctggcaaaacgggagagggaaaagctggaagatttggaggctgaacttgctgacgaggagtttcttttcggcgacgtggagcttagccgccatgaaaggcaagagttaaagtataagagacgagtgagagacttggcccgcgagtaccgagccgctggggagcaggaaaagttagaggcgaccaatcgctatcacatgcctaaggagacacgaggtcaaccagccagggccgtcgatctggtggaggaggagagtggcgcgcccggggaagagcaaaggagatgggaagaagcaaggctgggcgctgcgtctctaaagtttggcgctagggacgctgcctcccaggaacccaaatatcagttggtgctggaggaggaagaaactatcgaattcgttagagcaacgcaactgcagggcgatgaggaaccctctgcgccccctacttccactcaggcccagcagaaggaaagtatacaggccgttcgccgatccctgcctgttttcccctttcgggaggagctgcttgccgcaatcgccaatcatcaggtgcttatcatcgaaggcgaaacgggctcagggaagaccactcaaataccacaatatttatttgaggagggatacacaaataagggcatgaagattgcctgtacgcagcccagaagagtggctgccatgtccgtggctgcacgggtcgctcgtgaaatgggggtgaagttgggcaatgaagttggctacagtatcaggtttgaagactgtacttcggaaaggacggtgctgcgatacatgaccgatggtatgctactgagagagttcctgagtgagcccgacctcgcatcatacagtgtggtgatggttgacgaggcgcatgaaagaactctccacacggatatcctgtttggcctcatcaaagatgttgcgcggttccgaccagaactgaaggtcctcgtggccagcgcaacgatggacactgctagattctctacatttttcgatgatgcaccggtgttccgtattccggggcggcgcttccctgtcgatattttctacactaaagctccagaggccgactacttagaagcctgcgtggtctcagttctgcagatccacgttactcagccccctggggatatactcgtttttctgacgggacaagaagagatcgaggccgcttgtgagatgctccaggatcgctgccgccggttgggttctaaaatacgagagcttctggtgttgcctatctacgccaatctgccttcagatatgcaggcccggatcttccaaccaacgccgcctggcgcccgaaaagtggtggtggcgaccaacattgctgaaacttccctcacaatagaagggattatatatgtgctggacccaggcttctgcaagcagaagagctataacccacgcaccggtatggagagcctgacagtgactccttgctcaaaggcctctgctaaccagcgtgcgggccgagctggcagggtcgccgccggtaagtgtttccgactatatacagcctgggcttaccagcatgagctagaggaaaccacggtgccggagatccagaggacgtcactgggcaacgtcgtcttactcctgaaatccctgggcatacacgacctaatgcacttcgacttcctggaccctccaccgtatgagaccctgctacttgctctggaacaactgtatgctctcggggcactgaatcacctcggcgagctcactacttcggggcggaagatggcagaactgccagtggatcctatgctgtcaaagatgattctcgccagcgagaagtacagctgttcagaggagatcctaacagtggcagcgatgctgtctgtgaacaattccattttttataggcccaaagataaagtagtgcatgcggataacgccagggtgaatttctttctcccgggaggtgatcatttggtcttacttaacgtctacacccaatgggctgagagtggctacagcagccaatggtgctacgagaattttgttcagtttaggtccatgcgccgggctcgcgacgttagagagcagctggagggcttactcgagcgagtagaggttggcctgtcttcctgccagggcgactacatcagggtgcgcaaagctattactgctggctatttctatcacacagctagactgacacgctccggatatcgaactgtaaagcagcagcagacagttttcattcatcccaattccagcctattcgaacaacagcctagatggttgctgtatcatgaacttgttctgacaactaaagagttcatgcggcaggtcctcgaaatcgaatcttcctggctattagaagttgctccccactattataaggctaaggagcttgaagacccccacgctaagaagatgccaaagaagattggcaaaactcgagaagagttgggctag

SEQ ID NO: 184962 - DNA, 1683 bp, Artificial Sequence
  Description of Artificial Sequence: Synthetic coding sequence
atggagagccagcccgcccaggagtgcctgatgcagatgttcctgcccatcgagcctgcttgctttgtggaatggttgggtacttccccatcccagttgggagtggtgatggtcgatgaggcccacgagcgtaccctccacactgatatactgttcgggctcatcaaagatgttgccagatttcgccccgagctcaaggtgttggttgcctccgctactatggatactgcccgattctctaccttcttcgacgacgcgcccgtttttcggatacctgggcgccggttccctgtggacatattctacacgaaggcaccagaggctgactatctggaggcctgcgtagtctctgttctgcagatccacgttactcagccaccaggcgacatccttgtcttcctgactggacaggaggaaatagaggctgcctgtgagatgctgcaggatcggtgcagacgactgggaagtaagatcagggagcttctggtcctgccaatctacgcaaatctgccttcagacatgcaggccagaatcttccagccgaccccgcccggcgccagaaaggtggtcgtcgccactaacatcgctgagactagcctgaccatcgaggggataatctatgtcctagaccctggtttttgcaagcagaaatcctataatccccgcaccggcatggaaagtctgacagtgacgccttgtagcaaagcctcagcgaatcagagggcaggccgggccggacgcgtggccgctggaaaatgtttcagactgtataccgcctgggcctaccagcatgaacttgaggagacaaccgtgccggaaattcagaggacaagcctgggcaacgtggttctgttactcaagtctctaggcatccatgatttaatgcacttcgattttctcgacccacccccttacgaaacgctattgctggcactggaacagctgtatgccctgggggcacttaaccatctcggggagctcacaacatctgggcggaaaatggccgaattgccagtcgatcctatgctgagcaaaatgatcctggcctcagaaaagtactcatgctccgaggagattctgaccgtagctgctatgctgtctgtcaacaatagcattttttacagacccaaagataaggtggttcacgctgacaacgctcgagtgaacttcttccttcccgggggtgaccacttggtattattaaatgtgtatactcagtgggcggaaagcggctattcgtctcaatggtgctatgagaacttcgttcagttcaggtcaatgagacgtgcccgtgatgtacgggagcagctggagggactcttagaaagagtggaggtgggtctgagtagctgccagggggactatattcgggtcagaaaagccatcacagccggttatttctaccacaccgcacgtttgaccagatctggttaccgcacagtgaaacagcagcagactgtcttcatccaccctaatagcagcctgttcgaacaacagcccaggtggttgctgtatcatgagctggttctgacaacaaaagagttcatgcggcaagtgctggagatcgagagttcatggctcctggaggtggcaccccactactataaggccaaagagctcgaggaccctcatgccaagaagatgcccaagaagatagggaaaacacgtgaggagctgggatag

SEQ ID NO: 184963 - DNA, 1683 bp, Artificial Sequence
  Description of Artificial Sequence: Synthetic coding sequence
atggagagccagcccgcccaggagtgcctgatgcagatgttcctgccaattgaacccgcctgttttgtcgaatggctcggcacttctccatcgcaacttggagtggtgatggtagatgaggcacatgaacgcacactgcacacggatatactctttggccttatcaaagatgtggcaagattccgccctgaactgaaagttctggtggctagcgccaccatggacactgctagattttcaacttttttcgacgacgcgccagttttccggattcccggtcggaggtttcccgtggatatcttttacactaaagctcccgaggccgactacctcgaggcatgtgtggtctcggtccttcagatacatgtaacccagccacccggagacattttagttttcctcactggccaggaggagatcgaggcggcttgtgaaatgttgcaagaccggtgtaggcggctcggcagtaaaatcagggagttactcgtgttacctatttacgctaatttacctagcgacatgcaagctcgtatttttcagcccactccccccggggcacggaaggttgtggtggctactaacatcgctgaaacctccctaacaattgaaggaatcatttatgtcctggacccaggattctgcaagcaaaagagttacaatccacggaccgggatggagtccctgacagtgacgccatgctctaaagcctcagccaaccaacgggccgggagagccgggcgggtggccgccgggaagtgttttcggctctatacagcatgggcttaccaacatgaactggaggagaccacggtgccagaaattcaaagaacttcccttggcaacgtcgtactgttgttaaagtcactgggaatccacgatctgatgcacttcgattttctggaccctccaccctatgagaccctgttgcttgcactagaacagttgtatgctctgggcgccctgaaccatcttggtgaattaactaccagcggtaggaagatggcggagctgcccgttgatccaatgctatcaaaaatgattctcgccagtgagaagtattcatgttcagaagagatactcactgtagctgcgatgctttctgtcaacaattctatattttatcgccccaaggataaggtggtgcacgcagataacgcccgtgtgaacttcttccttcctggcggtgaccatcttgtcctcctgaatgtctatacccaatgggcagagtcgggttactcatcacagtggtgttacgagaattttgtacaatttagatctatgcggagggcccgagacgtgcgcgagcagctggagggtctcctcgagcgcgtagaggtgggtctgagctcatgtcagggtgattacattcgggtccgcaaagcgatcaccgcagggtacttctatcatactgcaaggctgactagaagcggctatcgaaccgttaagcagcaacagaccgtgtttatccacccaaatagttccctgtttgaacagcagccccgctggcttctctatcacgaactcgttctgacaacaaaggaatttatgagacaagttcttgagatcgaaagctcatggcttctagaagtggcaccacactattacaaggcgaaggaactggaggacccccatgccaagaaaatgcctaagaaaattgggaagacgcgagaagagctggggtag

SEQ ID NO: 184964 - DNA, 567 bp, Artificial Sequence
  Description of Artificial Sequence: Synthetic coding sequence
atggagagccagcccgcccaggagtgcctgatgcagatgttcctgccgatagagccagcatgcttcgtcgagtggctgggcaccagtccctcgcagctcggcgtggtcatggtcgatgaggcccacgagagaactctgcatacagacattttgttcggcctcataaaggacgtcgctcgctttcgtcccgagctgaaggtgctggtcgccagcgcaaccatggataccgccagattctccactttttttgatgatgcacctgtctttcgaattcccgggcgcaggtttcccgtggatatcttttataccaaggcccccgaggccgattatctggaggcatgcgtcgtgtcagtgctgcagatccacgttacgcagccaccaggggacattctcgtcttccttacaggtcaggaggagatcgaggccgcgtgtgagatgctccaggaccgctgtcgtagactggggagcaaaatccgggaactgctcgtgctgcccatctacgcaaacctcccaagcgatatgcaggccaggatcttccagccaactcctccaggggccaggaagtag

SEQ ID NO: 184965 - DNA, 3126 bp, Artificial Sequence
  Description of Artificial Sequence: Synthetic coding sequence
atggccacccccgccggcctggagcggtgggtgcaggacgagctgcactctgtgctcggcctgagcgaacgccacgtggcccaatttctcattgggaccgctcaaaggtgcacctctgccgaagagttcgttcagcggctgagagataccgatactcttgatttatccggcccagcacgggattttgccctgagattgtggaataaagtaccgcggaaagccgtggtggaaaaaccggccagagcggctgagagggaggctcgggcgctcctggagaagaatagatcttatagactcctcgaggacagtgaagaatctagtgaagagacagttagtcgcgccgggagcagtctgcaaaaaaaaagaaaaaagaggaagcatctacgaaagaagcgtgaggaggaagaggaggaggaagccagtgaaaagggcaaaaagaagacgggagggtctaagcagcaaaccgaaaagcctgagtcagaggacgaatgggagcggacagagcgggagaggctacaggacctagaagaacgggatgctttcgctgaaagagtgaggcagcgtgataaagatcggactagaaacgtgttagagagatcagataagaaagcctatgaggaagcccagaagagactgaaaatggccgaggaggatcggaaggccatggtgccagagcttaggaaaaaatcacgtcgagagtacctcgccaagcgcgagagggagaagctggaggacctggaggcggaattagcagacgaggagttcctgttcggtgatgtggaactaagcagacatgaaagacaggaactcaagtataaacgccgggtcagagatctggcacgtgagtatcgggctgccggcgagcaggagaaactggaggcaaccaaccggtaccacatgcctaaggagacacggggtcagcccgcaagagcagttgacctggttgaggaggaatccggcgcgcccggtgaagagcagcggagatgggaagaggcccgactgggagccgcttcgctcaagtttggagcgcgtgacgctgcatcccaggagccaaaatatcagctggtgctcgaagaagaggagacaatcgaatttgtcagggctacacaattacagggagacgaggaaccctccgcacctccaacttctacccaggcccagcaaaaagagtccattcaggcagtaagacgcagtctacccgtgttcccctttcgggaagagctgctggccgctattgcaaaccaccaggtgctcattattgaaggtgaaacaggttctgggaagaccacccagattccacagtaccttttcgaggaaggatacaccaataagggaatgaagatcgcctgtacgcagccaaggcgagtggcagcgatgagtgtggcagcgcgggtggcccgcgagatgggtgtgaagctgggcaatgaggtaggttacagcatccgctttgaggactgtacctctgaaaggacagtattgaggtacatgaccgacggaatgctcctgcgggagttcctgagcgagcccgatttggcctcctactccgtggtcatggtcgacgaggcacatgagagaacgctacatacagacatcctattcgggttgatcaaggacgttgctagattccggccggagctcaaagtgcttgtggctagtgccacaatggacacagcccggttcagtacattcttcgacgacgcaccagtgtttcggattcctgggcgtaggttccctgtcgatatattctacaccaaagctccagaagctgactatctagaggcctgcgttgttagtgtgcttcagatacatgttacacagccgcccggagacatcctggtgttcttgacagggcaggaggaaattgaggccgcttgcgagatgcttcaggaccgttgccgccgccttggctcaaaaatcagagaactgttagtcctgcctatttatgctaacttgccctccgatatgcaggcaagaatcttccagccaacaccccctggcgcaagaaaagtcgtggtcgcaactaatatagctgaaaccagccttaccatcgagggcattatttatgtcctggatcccggattttgcaagcagaagtcctacaacccaagaacaggcatggagagcttgaccgtgaccccatgcagtaaggccagcgccaaccagagagctggcagagccggcagggtggccgccgggaagtgtttcaggctgtatactgcttgggcctaccagcacgagctcgaggaaaccaccgtgccggagatccagaggactagccttggaaacgtggtactgttgctaaagtctctgggcatccacgacttgatgcacttcgactttcttgatccacccccctacgagactttgctgcttgccctagaacagctttacgcgctgggggctttgaatcacttgggcgagcttacaacaagcgggcggaagatggccgaattacccgtcgatcctatgctcagtaagatgatcctcgctagcgaaaaatactcatgttccgaagaaatcctgacagtggctgctatgctctctgtgaacaactcaatcttttacaggcccaaagataaggtggtgcacgctgacaatgcaagagttaattttttcctacctggcggcgaccacttagtgctcttaaacgtctatacacagtgggctgagtcaggctactctagtcagtggtgttacgaaaatttcgtgcaattccgcagtatgagacgagctagagacgtgagagaacagctcgagggcctgctcgaacgcgttgaagtgggcctgagctcttgccaaggtgattatataagagttcgaaaagcgattacagccggatatttttaccatacagcccgtctgacacggtcaggttatagaaccgtaaagcagcagcagacagtttttattcacccaaatagctccctttttgagcaacagcccagatggttactctaccatgagctggtcctcaccacaaaggaatttatgcggcaggtcttagaaatcgagagcagctggctgctcgaagttgcccctcattactacaaggctaaagagctggaagatcctcatgcaaagaagatgccgaagaagataggcaaaacgcgggaggagctcggatag

SEQ ID NO: 184966 - DNA, 444 bp, Artificial Sequence
  Description of Artificial Sequence: Synthetic coding sequence
atggccacccccgccggcctggagcggtgggtgcaggacgagctgcatagcgtacttggcctatctgagcggcatgtggcccagttcctgattgggactgctcagcggtgtaccagtgctgaagaattcgtccagcggcttagggacacagacacactggatctatccgggccggcccgcgacttcgctctgcggctgtggaataaagtaccaaggaaagccgtcgtagagaagcccgccagagcagctgagcgtgaggcccgggcgctgctagaaaaaaacaggagctatcgtctgctggaagatagcgaagaaagttccgaagagactgtttctcgtgccggctcctccctccagaagaaacggaagaagcgaaaacacctgcgcaagaagcgagaagaagaggaagaagaggaagccagcgagaagggcaaaaagaagtag

SEQ ID NO: 184967 - DNA, 4110 bp, Artificial Sequence
  Description of Artificial Sequence: Synthetic coding sequence
atgggcggcaagaacaagaagcacaaggcccccgccgccgccgtggtcagggcagcagtaagcgcttctagagccaaaagcgcagaggctggcatagccggcgaagcccaatccaagaaaccggtcagcagacccgctacagcagcagcggccgccgcgggtagtcgggagcccagagtgaaacagggcccaaagatctacagcttcaatagcacaaatgactccagcggaccggccaaccttgacaagtccattctcaaggtcgtaataaataacaaactggagcagcgcatcatcggcgtgattaacgagcataaaaaacagaataatgacaagggcatgatatctgggagactcaccgccaagaagctacaggacctctatatggcactacaggcattcagcttcaagacaaaagacatcgaggatgcaatgaccaacaccttactgtacggcggcgatttacactccgcgttggattggctctgcctgaatctgtccgatgatgctctgccagaaggtttctctcaggaattcgaggaacagcaaccaaagtcccggccgaagttccagagccctcagattcaggccaccattagcccgccactgcaacctaaaaccaaaacatatgaggaggaccctaagtcaaagcctaaaaaagaggaaaagaacatggaggtcaacatgaaggagtggatcttgagatatgccgagcaacaaaacgaagaggagaaaaacgaaaatagcaagtccttggaagaagaagaaaaatttgacccgaatgagcgataccttcaccttgctgccaaattacttgatgctaaagaacaggccgctacatttaaattggagaaaaacaaacagggccaaaaagaggctcaggagaaaatacggaagttccagagggaaatggaaacgctggaggatcaccccgttttcaaccccgccatgaagatttcacaccaacagaatgagcggaagaagcctcccgtagcaactgagggagaaagcgcgctgaacttcaacctgttcgaaaagagtgccgctgcaactgaggaggaaaaagataaaaaaaaggaacctcacgacgtgagaaactttgactatactgcgcgtagctggactgggaagtctcctaaacaattcttgattgactgggtgcgtaaaaaccttcctaagagccctaacccgtcgttcgaaaaggtgccagtcggaaggtactggaagtgtcgcgtacgcgtcatcaagtccgaagacgatgtgctagtggtttgccccaccatcctaaccgaggatgggatgcaggcgcagcacctgggcgccaccctcgccctgtacagacttgtgaaggggcagtccgtccaccaacttctgccgccaacctatagagacgtatggttggaatggagcgatgcagagaaaaagcgggaggagctgaataagatggaaactaacaagccccgcgatctgtttattgctaagctgctgaataagctgaaacagcaacagcagcagcagcagcaacattcagaaaacaagcgggaaaatagcgaagatcccgaggaatcctgggaaaacctggtgagcgatgaggatttttctgcactgagcctggagagcgcaaatgtggaagacttggagccggtcagaaatctgtttagaaagctgcagagtactccaaagtaccaaaaattgctgaaggaaaggcagcagctccctgtctttaaacatagggattctatcgtggaaacgcttaaaagacatcgggtggtggtagtggccggggaaaccggctcaggaaagtccacccaggtacctcacttcctactggaagacctgctactgaacgaatgggaggcctccaagtgcaacattgtttgcactcagccgagacgcatctctgcagtcagtctcgccaacagagtgtgcgatgagctgggatgcgagaacggtccgggtgggcgcaacagtctgtgtggttaccagatcaggatggagtcgcgtgcctgcgagtcaactcgactgctatactgcacaacaggagtcttgctgaggaagttacaggaagacgggctcctgagcaacgtgagccacgttatcgtagatgaggtgcatgaacgaagtgtgcagtcagacttcctccttattatcctgaaagaaattctacagaagaggagtgatctgcacttgatcctcatgagcgctacagttgactcagagaagttctcgacctattttacccactgcccgatcctgagaattagtggtaggtcttaccctgtggaggtgttccacttggaggacatcattgaggagactggcttcgtgttagagaaagactctgaatactgtcagaagtttctggaggaggaggaggaggtgaccataaacgtgacttcaaaagccggcggcataaaaaagtaccaggagtacatcccagttcagacaggcgcccacgccgatctcaacccattctatcagaaatatagctccaggacccagcatgctatattgtacatgaatcctcataaaataaatctagatctgattttggagttacttgcctacctggataagtcacctcagttcaggaacatcgagggcgccgtcctcatattccttcctggcttggcccacattcaacagctgtacgatttgctctcaaatgatcggaggttctatagcgagagatacaaggttattgcactgcactcaatccttagcacccaggatcaggccgctgctttcactttgccccctcccggcgtgaggaagattgtgctggctaccaacatcgctgaaactggcatcacaatccccgatgtggtgttcgtcatcgacacggggagaactaaggaaaacaagtatcatgaatcatcacagatgtcatcgctggtggagacctttgtgtccaaggctagcgcactccagaggcagggtcgagctggacgggtgcgggacggattctgtttccgcatgtacacacgcgagagattcgaaggtttcatggattactctgtgccagagattctgcgcgtcccactggaggagctctgcctgcatataatgaaatgtaatctggggagtccggaggattttttgtctaaagccttggacccaccacagttgcaggttataagcaacgccatgaacctgctcagaaaaattggagcctgtgagctgaatgaacccaaactgacacccctgggacagcacctggctgctttgccggtaaatgtgaagattgggaaaatgctgattttcggcgctatcttcggttgccttgatccagttgcaacactagcagcagtgatgacagagaagagccctttcaccacccccattggtcggaaagacgaggctgatctcgctaagtctgcattagccatggccgacagtgatcacctgacaatttacaacgcatacctgggatggaagaaagcaaggcaagagggtggctatagaagtgagataacatactgcagacggaatttcctcaaccggacctcgctcctgacgctggaagatgtgaagcaggagctcataaagcttgtcaaagctgcgggcttctctagctcaacaacctccacctcatgggaaggaaaccgagccagccaaactttgagttttcaggaaattgctctgctcaaagccgtgttagtggctggtctgtacgacaatgtcggtaaaatcatttacactaaatccgttgatgttacagagaagctcgcctgtattgtggagactgcgcagggcaaagcccaggttcacccatcgtctgttaaccgtgacctgcagacccatggctggctcttgtaccaggagaagattagatacgccagggtctatctccgggaaacaaccctgatcacccctttccctgtgctccttttcggtggggacatagaggttcagcatagggagagactcctgagtattgatggatggatctacttccaggcccctgtgaagatcgctgtgattttcaaacagctgagggttctcatcgattctgtactgagaaagaagttggagaacccaaaaatgtcactggagaacgacaaaatccttcagataattactgaactcattaaaactgagaataactag

SEQ ID NO: 184968 - DNA, 1989 bp, Artificial Sequence
  Description of Artificial Sequence: Synthetic coding sequence
atggaggaggagggcctggagtgccccaacagcagcagcgagaagagatacttccctgagagtctcgacagctcagacggggatgaagaagaagtgctcgcatgcgaggatttggaactcaaccccttcgacggactcccctacagctcacggtactataaactcctgaaggagagagaggacctacccatttggaaagaaaagtattcattcatggagaacttgcttcagaatcagatcgtcatcgtgagcggtgacgccaaatgcgggaaaagtgcccaggtgccccaatggtgtgccgaatactgtctctccatccattatcagcatggtggggtgatctgcactcaagtccataaacaaactgtcgtacaacttgctctccgtgtggccgatgagatggatgtgaacatcggacatgaagtgggctacgtaattcctttcgagaactgttgcactaacgaaaccatccttaggtattgcaccgatgacatgctgcagcgggaaatgatgagcaatccatttttgggatcttacggagttattatccttgacgatatacatgagcgaagtatcgcaaccgatgtgctgttagggctgttaaaagacgtgttgctagctcgacccgagctcaagctcatcataaactcaagtccacacctcatctccaagctgaacagctactatggcaatgtgcccgtgatagaagtgaaaaacaaacaccccgttgaggttgtgtacctgtctgaagcacagaaagactcatttgagtctattctccgtcttatctttgagatacaccattcaggcgaaaaaggggacatcgtcgtctttcttgcctgcgagcaggtgtacaatccgcgcatccgagccaatagcttggtgatgcaaccaatttcccaatcccaggcagaaattagaaaacagatattgggctcatctagttccggtaagtttttttgcctgtatactgaagagttcgcctccaaggatatgaccccccttaaacccgctgagatgcaagaggctaacttgacaagcatggtcctcttcatgaagagaatagacatcgctggcctgggtcactgcgacttcatgaatcgacccgcacccgaatccctgatgcaagccttagaggacttagactatctcgcagcactggacaacgacggaaatctgtcagaatttggcatcatcatgtccgaattccctcttgacccgcagctgtctaagtccatcctcgcctcgtgtgaatttgactgtgttgacgaagtgctgactattgctgccatggtgacagccccgaactgcttctcacacgtgcctcatggtgctgaggaggcggctctgacttgttggaaaacgttcctccatccggagggagaccactttacactgatctccatttacaaggcctatcaagataccaccttgaactcttcttccgagtactgcgtggaaaaatggtgccgtgactactttcttaactgctccgcgttaaggatggccgacgtgatccgcgccgaactgctggaaatcataaaacgaatcgaactgccatacgctgaaccggcgttcggctcaaaggaaaatacattaaacattaagaaggccttactgtccgggtatttcatgcagatcgctagagatgttgacggatctggtaattacctgatgttgacccacaaacaggtagcacagctgcacccgctgtctggatattccattacaaagaaaatgcctgagtgggtgctttttcataaattcagcatttccgagaacaattacatccgtataactagcgagatctcaccggaactatttatgcagctcgttcctcagtactacttcagcaacctgcctccaagtgaatctaaggacatcctacagcaggtggtcgaccatctgagcccagtttcaacaatgaacaaggaacaacaaatgtgcgaaacctgcccagagaccgagcaaagatgtactctgcagtag

SEQ ID NO: 184969 - DNA, 2232 bp, Artificial Sequence
  Description of Artificial Sequence: Synthetic coding sequence
atggaggaggagggcctggagtgccccaacagcagcagcgagaagagatatttccctgaaagcctggacagctccgacggggacgaggaggaagtgctggcctgtgaagacctggagctgaacccttttgatggtctgccttattcttcgagatactacaagcttctgaaagagagagaagatctccctatttggaaagagaagtacagttttatggaaaatctcctccagaaccagatcgtcattgtgagcggcgatgctaagtgcggcaaaagtgcccaggtccctcagtggtgcgccgagtactgcctgtcaatccattatcaacacggcggcgttatttgtacacaggttcacaagcagacagtggtgcaacttgctctgagagtcgcagatgagatggatgtgaatattggacacgaggtcgggtacgtgatcccattcgagaactgttgcacgaacgaaaccatcttgaggtattgtaccgacgacatgctgcagagagagatgatgtctaatccatttctgggttcgtatggggtgataattttggatgacattcatgaacgatccattgcgacagatgtgcttttaggactgctcaaagacgtgctgctggcgcggcctgagttaaagctaattatcaacagtagtcctcatctgatctcaaagttaaattcttactatgggaatgtgcctgtcattgaagtgaaaaacaagcacccagtagaggtggtctatctgagcgaggcccaaaaggactcctttgaatcaatccttcggcttatcttcgaaatccatcatagtggcgaaaaaggagacatcgtcgtctttctggcctgcgagcaggatattgaaaaagtttgcgaaactgtgtaccagggcagcaatttaaaccccgacctcggagaattggtggtggtccccctgtacccgaaggagaagtgctccttgtttaagcccctggacgaaaccgaaaaacggtgccaagtttatcagaggcgcgtggttttgaccacctcttctggtgaatttctcatatggtctaattccgtgagatttgtgattgatgttggcgtggaaaggcgcaaagtgtacaacccaaggattagggccaacagcctagtcatgcagcccatttcccagagtcaagcagaaattaggaaacagatactgggtagctccagctccggaaagttcttttgcttgtacaccgaggagtttgcctcaaaggatatgacacccctgaagccggccgagatgcaggaagcaaacttaacaagtatggtgctgttcatgaagaggattgacattgccgggctcgggcactgcgattttatgaacagacctgcccccgagtcattgatgcaggcactggaggacttagactacctcgctgcgctggacaacgacggaaatttgtccgaattcggaattatcatgagcgagttcccactcgatccccaattgtccaaatccatcctggctagttgcgagttcgattgcgtagacgaagtgttgacaattgctgccatggtgacagctcctaattgtttttcccacgttcctcatggtgccgaggaggctgcgctcacatgctggaagacattcctccaccccgagggtgatcacttcacccttatctcaatttacaaggcatatcaggacaccacccttaacagctcatctgaatactgcgtagagaaatggtgtagggactattttctgaattgctccgcactgaggatggcagacgttattcgggctgagctattagaaataatcaagcggattgaactgccttatgcggagccggcttttggaagcaaagagaacaccctgaatattaagaaggctctgttgtccgggtattttatgcaaatagccagggatgtcgatggttctggaaattacctgatgctcacgcataagcaggtggctcaactgcatcctctttctgggtactccatcacaaaaaaaatgcccgaatgggtgctttttcacaaattttccatttccgaaaataattatattcgcataacttctgagatcagtcccgagctgtttatgcaactcgttcctcagtattactttagcaacctgcctcccagtgagtcaaaagacatcctgcagcaggtagttgaccaccttagtccggtctccacaatgaacaaggaacagcaaatgtgtgagacatgccccgaaactgaacagcgctgtacgctgcaatag

SEQ ID NO: 184970 - DNA, 1104 bp, Artificial Sequence
  Description of Artificial Sequence: Synthetic coding sequence
atgcagcccatcagccagagccaggccgagatccggaagcagatcttaggatcttcctcaagcggaaagttcttctgcttgtacactgaggagtttgcaagcaaagatatgactcccctgaagcctgctgaaatgcaggaagctaatctcacgtctatggtattgtttatgaaacggatcgacattgcaggcctggggcactgtgactttatgaaccgtcccgcccctgaatctctaatgcaagccctcgaggatctagactacctggctgctcttgacaatgacggcaatctttcggagtttggaatcattatgtcagagttcccccttgatccgcagctgtccaagagcatactggcctcctgcgagttcgattgcgtcgacgaggttcttactatagcagctatggtgactgctcccaactgtttctcccatgttccacacggagccgaagaagcggctctgacttgctggaagactttcctccatcccgaaggggaccacttcacccttataagtatatacaaggcctaccaggacaccaccttgaactcttcctctgaatattgtgtggagaagtggtgccgggactattttctgaattgcagtgccctgagaatggcagacgtgatccgggcagagctgctcgaaataatcaagagaattgaacttccttacgctgagccggcgtttggttcaaaggaaaataccctgaatatcaagaaggccctgctatctggctactttatgcagattgcccgagacgtggatggatcgggcaactatctgatgctgactcacaaacaggtcgctcagctccatccactcagcggctatagcatcactaaaaagatgcctgagtgggtactgttccataagttttctatatccgagaacaactacatccggatcacttcggagatctcccccgagctgttcatgcagcttgtaccccagtattactttagcaatctcccaccctcggagagcaaggatatccttcagcaggtcgttgaccacttgtctcccgtctctaccatgaataaggagcagcagatgtgcgagacctgtccggaaacagagcagagatgcaccctccagtag

SEQ ID NO: 184971 - DNA, 339 bp, Artificial Sequence
  Description of Artificial Sequence: Synthetic coding sequence
atggaggaggagggcctggagtgccccaacagcagcagcgagaagcgatatttccccgagtcactggacagctctgacggcgatgaggaagaggtcctcgcatgtgaggatttggagttgaatccgtttgatgggctaccctattctagtagatactacaagctccttaaagaacgcgaagatcttcctatttggaaagagaagtattcgttcatggagaaccttcttcagaaccagatcgtcatcgtcagcggcgacgcgaagtgtggaaaatctgcacaagtgccccagtggtgtgccgaatactgtctcagcatccactaccaacacggaggatag

SEQ ID NO: 184972 - DNA, 1935 bp, Artificial Sequence
  Description of Artificial Sequence: Synthetic coding sequence
atgaccatcgagatcgacttcctgcagaagaagagcatcgacagcaacccctacgacaccgacaaaatggctgcggaatttatccagcagttcaacaatcaagcttttagcgttggtcaacagttagtattctccttcaacgagaagctctttggcctacttgtgaaagatattgaggccatggacccttcaatcctgaagggggagcccgccaccggcaaaagacagaagatcgaagtcggcctggtggtcggtaacagccaagtggcatttgaaaaggccgaaaactcatctctgaaccttatagggaaggccaagaccaaagagaatagacagagtataattaatccagactggaatttcgagaaaatgggcattggaggactggataaggagtttagcgacatattccggcgggctttcgcatctcgagtgtttccacctgaaattgttgagcagatgggctgcaagcacgtgaagggaatccttctttatggcccacctggctgtggaaagacactactagctaggcagattggcaagatgctgaatgccagggagccaaaagtggtgaacggcccagagatcctcaataaatacgttggcgaaagcgaagctaacatacggaagctttttgccgatgctgaagaagagcaaaggaggctcggcgcaaactccggactgcatataataattttcgacgaaattgatgccatctgcaagcaacgtgggtcaatggctgggtccactggagtgcatgatactgtggtaaatcagctgcttagtaagatcgatggtgtggagcagctgaataacattcttgttattgggatgacaaaccgcccagatctgatcgacgaggcattactgcggccagggcggctcgaagttaagatggagattggattgccagatgaaaaggggcggctgcagattttacacatccataccgccaggatgcgggggcaccagttgctgagcgccgacgtggacatcaaagagttggctgtcgagaccaagaactttagcggcgccgagctggaggggctcgtgcgcgccgcgcagtccacagccatgaacagacacattaaggcctctacaaaggttgaagtggacatggagaaggcagaaagcctgcaagtgacgaggggtgactttttggcgagcctcgaaaatgacattaagcctgcctttggaacaaaccaagaggattacgcaagttacattatgaatgggattattaagtggggggaccctgtcacacgcgtcctggacgacggcgagctactcgttcagcagaccaagaatagcgataggacccccttggtctcagtgttattagaggggcctcctcattctggaaaaacagccctggccgctaaaatagccgaggagtccaacttcccgttcatcaaaatttgctctcccgacaagatgattggcttcagcgagacagccaagtgtcaggccatgaagaaaatctttgatgatgcttacaagtcacagctttcatgcgtggtggtggacgacattgaaaggttgctcgactatgtcccaatcggaccacgattctctaacctggtcttacaggcgctcttggttctcctgaaaaaagcacctccgcaggggcgtaagttattgataatcgggaccacttcccgaaaggatgtgctacaggaaatggagatgctgaatgccttcagtacaacgattcatgtgcccaatatcgccactggagagcagcttctggaagccctggaactccttggcaacttcaaagacaaggaaaggaccactattgcgcagcaggtcaagggcaaaaaggtgtggattgggattaagaaactgcttatgctgatcgagatgagtcttcagatggacccagaatatagggtccgcaagtttttggcattgctgcgcgaggaaggggcttag

SEQ ID NO: 184973 - DNA, 1452 bp, Artificial Sequence
  Description of Artificial Sequence: Synthetic coding sequence
atgcccgaggaggccggcttcccccccgccaagcggttccggcccggaagcggccccccctcccgcgccgggagttttccaccgggcaggcaggttgtgatgttactcactgccgggagtgggggcagaggcgggggagggggccgtcggcagcagccgccccttgctcagcccagcgcatctccgtatcccgaagcagtcgagttgcagcggagaagcctccccattttccaggcgagagggcagcttttagcgcagctccggaatcttgacaacgccgtgctcatcgggtcgccctttttcaccggacatccaggcgtgccgcactgggccggcggggaccgcagccatgagcaggacgtgccgcggcattgcaaagccccgccacgccggctcccctgtgacgcgggccccagctccgtgcggctgccagcgctctgcactgctgcaccttctctgccccgcggcccaaaggatagcgggctcgaggttctcgctgtgcagcgcgttagtaagacgcaggcctggcagagaacgggccgcgcaggcagagaagattccggcatatgttatcggctgtatactgaagacgagttcgaaaagtttgataaaatgactgtccctgaaatccaacgctgcaatctcgcatccgtcatgctccagctactggcaatgaaagtccccaatgtcctgaccttcgattttatgagtaagcccagcccagatcatatacaggccgccatcgcacaattagatttattaggcgccctggagcataaggacgaccagcttaccttgacacctatgggacgcaaaatggccgcgttcccattggaacctaagttcgctaagaccatattaatgtcacctaagtttcactgcaccgaagagattctaaccattgtaagcctcctctccgtagattccgtgttgcacaaccctccgtctagacgggaagaggtacaaggagtgcgcaaaaaatttatatcgtccgaaggggaccatatgaccttgttaaacatctatcggacctttaaaaaccttggtggtaataaggattggtgcaaagagaacttcgtgaactccaagaacatgacactggtggctgaagttcgggcccagctgagggatatttgccttaagatgtccatgcccatagcttcatctcggggtgacgtggaatctgtaaggcgatgcctggctcactctctgttcatgtccacggcagagctgcaaccagatggcacttatgctactaccgacacccatcaacccgtggctattcacccttcatccgtgcttttccactgcaaaccggcatgtgtggtctatactgagctgctgtatacgaataagtgctatatgcgggatctgtgcgtcattgatgctcaatggctttacgaagcagcccctgagtacttcaggcgcaaactgcggacagctaggaattag

SEQ ID NO: 184974 - DNA, 2940 bp, Artificial Sequence
  Description of Artificial Sequence: Synthetic coding sequence
atgagctacgactaccaccagaactggggccgggacggcggcccccgcagttccggcggtggttatggtggtggtccagcgggcggccacggcgggaaccgaggatcggggggcggcgggggtggaggtggaggggggagaggaggccgcggccgacacccagggcatctaaaaggaagagaaataggcatgtggtacgcaaaaaaacaggggcagaaaaataaagaagctgaacgacaggagcgtgccgtagtgcacatggacgagaggagagaggagcagatcgtgcagctgctgaattctgtgcaggccaaaaacgataaagaatccgaggcccaaataagctggttcgctccagaagatcacggatatggcacagaggtgtccactaaaaacactccttgtagtgaaaataagcttgacatacaggagaagaagctgatcaaccaggaaaaaaaaatgttcagaatcagaaatcgatcgtatatcgaccgggactccgaatacctgcttcaggaaaatgaaccggatgggactctggaccagaaattgttggaggatctacaaaaaaagaagaacgacctgaggtacatcgagatgcagcattttagggaaaaactgcccagctatggcatgcagaaggaactggtaaacctgatcgataatcaccaggttaccgtcatcagcggtgagaccgggtgcggcaaaacaacgcaggtgacccaatttatccttgacaactatattgagaggggaaagggctctgcatgcagaattgtatgcacacagccccgacggatttccgctatctccgtagccgaaagagtcgccgcagaacgggccgaatcttgtggctcgggaaacagcactggttaccagattaggctccagtctcgactgcctcgcaaacagggctccattctatactgcacaacaggcatcattctccaatggctacagtcagatccgtatctcagtagcgtgtcccatatcgtgctagacgagattcatgaaaggaatcttcagtcggatgttctgatgaccgtggtcaaagatctgctgaacttccggtctgatctgaaggtaatacttatgtcagccaccctgaatgctgaaaagttttccgaatatttcggaaattgccctatgattcacattcccggtttcaccttccccgttgtggagtatctgctcgaagacgtgattgaaaaaatccgctacgtccctgagcaaaaagaacatcggtcgcagtttaaaagaggttttatgcaagggcacgtgaaccgacaggagaaggaggagaaggaggctatctataaggaaaggtggcctgactacgtgcgagagctgcgccgcagatactccgcctcgactgtggacgtgattgagatgatggaggatgacaaggtggatctcaatctgatcgtcgctttaatcaggtatatagttctggaggaagaggatggcgccattctggtgttcttgcctggctgggataatatcagtactctccacgatttactgatgagccaggtaatgttcaagagcgacaaatttctgattatacctctgcatagtcttatgccaactgtgaaccagacacaggtgttcaagagaaccccgcctggagtgagaaagatcgtgatcgctaccaacattgccgagacctccattactatcgatgatgtggtgtacgtgatcgacggcggcaagatcaaggagacacactttgacacgcagaacaacatcagcacgatgtctgccgagtgggtaagtaaggctaatgccaaacagaggaaaggacgcgcaggcagggtgcaaccagggcattgctaccatctctataacggactccgggcctcgctcttggacgattatcagctgccagaaatcctgcggactcctctcgaagagctctgcttacagataaaaattctgcgactgggcgggatcgcctattttctgagcagattgatggacccaccttcgaacgaagcagtcctgctgtctatccgccatcttatggagctcaacgctttggacaagcaagaggagctgacaccgctgggtgtgcatctcgcccggctccccgtagagccccacattggcaaaatgatacttttcggcgccttattttgctgcctggacccagtcctcacaatcgcagcatctttgtccttcaaagatccgttcgtgattccactaggctgggaggaggccagaaggcgaggcttcagatatgaaaaggactactgctgggaatattttctcagctcgaatacactacagatgctgcataatatgaaggggcaatttgcagagcacctgctgggagccgggttcgttagttcaagaaacccaaaggacccagagtctaacatcaatagtgacaacgaaaagattatcaaggcggtaatttgcgccgggctgtatccgaaggtagcaaagatacgactgaatctcggaaagaagcgcaagatggtgaaagtttacactaaaaccgatgggctcgtcgctgtccatcccaaatccgtgaatgttgaacaaaccgattttcattacaactggttgatctaccacctaaagatgagaacctccagtatctacttgtatgattgtactgaggtttccccctactgtctcctcttcttcggaggagacatcagcatccagaaagataacgaccaggagaccatcgcagttgatgagtggattgtcttccaatcaccagctcgcatcgcccatttggtcaaggagcttagaaaagaactggacatattactacaggaaaagatcgagagcccacacccagtggattggaacgacaccaagagcagggactgtgccgtgctgtccgccataattgacctcataaaaacgcaagagaaggctactcctagaaacttcccgccccggtttcaggacggttactatagctag

SEQ ID NO: 184975 - DNA, 2985 bp, Artificial Sequence
  Description of Artificial Sequence: Synthetic coding sequence
atgagctacgactaccaccagaactggggccgggacggcggcccccgaagctcaggcggcggatatggcggcggtccagcggggggtcacggcggtaatcgaggctccggcggaggcggaggtggtggtgggggtggacgcggcgggcggggtcggcaccctgggcatctcaaaggcagagagataggcatgtggtacgcaaagaaacagggccagaagaataaagaggccgaacggcaagagagagcagtggttcatatggacgagagacgcgaagagcagatagtgcaactgctcaacagcgtccaggccaagaacgataaggaaagtgaggctcaaatatcttggtttgcgcctgaggatcatggctacggaacggaagtcagcacaaagaatacgccatgtagcgagaacaagttggatattcaggagaagaagctgattaatcaggagaagaaaatgttcagaattcgaaaccgctcatatattgaccgtgatagtgagtaccttctgcaagaaaacgaacctgacgggactctcgaccaaaaactcctcgaggatctgcaaaagaaaaagaacgatctgcgctacatcgaaatgcagcacttcagggaaaaactgccatcttacggcatgcagaaggaactggtgaacctcattgacaatcatcaagtgacagtaattagcggggaaacgggatgtgggaaaaccacacaagtcactcagtttattctggacaactatattgagcgcgggaaggggtctgcctgtcgtattgtttgtacccagcctagacgtatcagcgcaatttctgtcgcagagcgggtggccgcagagagggcagagtcctgtgggagtgggaacagcaccgggtaccagataagactgcagtctaggctcccacggaagcagggtagtatcctctattgtacaactggcattattctgcagtggttgcagagcgacccctatctgagtagcgtctctcacatcgtcctggatgagatccatgagagaaaccttcagtccgacgtcctcatgactgtagtgaaggatctcctcaactttaggagcgatctgaaagtcatccttatgtcagctactcttaacgctgagaagttttctgagtattttggaaattgtcctatgattcatattccaggctttaccttccctgtggtcgaatatctgctggaggacgtgatcgagaagatacgatacgtgcctgaacagaaagagcatcgtagccagtttaagagaggctttatgcagggccacgtgaaccgccaggagaaagaagagaaggaagcgatctataaggagcgatggccagactatgtaagggaattgcggcgccgctattctgcgagcacagtggacgtcattgaaatgatggaagatgacaaagttgacctcaatctgatcgtggcgctgattaggtacatcgtattggaggaagaagacggagccatcctggtcttcctgccaggatgggacaatatttctaccctgcatgaccttttaatgagtcaggtcatgttcaagtccgtgaatcagacccaggtattcaagcggacccccccgggcgttaggaagatagtgatcgccactaatattgctgagacttccattactatcgatgatgtggtgtacgtgatcgacgggggaaagattaaggagacgcactttgacacccaaaataacattagcacaatgtctgcagagtgggtgtcaaaggccaacgccaagcagcggaaagggcgcgctggccgggtgcagccaggccactgctatcatctatacaacgggctcagggccagcctgttggatgattatcagctccccgagatccttagaacccctcttgaagagctgtgtctgcagatcaaaattctgcgactcggcgggattgcctactttctgtcacgtctgatggaccccccatcgaatgaagcagtgctgttgtccattcgacatttgatggagttgaatgccttggacaagcaggaggagctgaccccactaggtgttcatctcgccagactcccagtggagccacacatcggtaagatgattcttttcggtgcattattttgctgtctggatccagtcctgactatagctgccagcctgagctttaaggacccctttgtgatcccactgggtaaggaaaaaattgccgacgcacgtaggaaggagcttgcaaaagatacaagatccgatcacctaacagtcgtgaacgccttcgagggctgggaggaggcgcgcaggagaggctttagatacgagaaggactattgctgggaatacttcttgtcaagcaatacgctgcaaatgctgcacaatatgaaagggcaattcgctgaacaccttctgggagctggattcgtttctagtcggaacccaaaggatccggagagtaacattaattcggacaatgaaaagataatcaaagccgtcatatgcgccggcctttatcccaaggtggctaaaatcagactcaacctgggaaagaagcggaaaatggtaaaggtgtatacgaagactgatggcctggttgcggtgcacccgaaatctgtcaatgtagaacagactgactttcactacaattggctgatataccatctgaagatgagaacatcttctatttacttgtatgactgtacagaagtatcgccctactgtttgctcttttttggcggagatatatctatacagaaggacaacgaccaggaaaccatagcggttgacgaatggatcgtttttcagtcccccgcccgtatcgcccacctcgtgaaagaactccgcaaggagctggatattctcctacaggagaaaattgagagtccccatccagtggattggaatgataccaaatcacgtgattgcgccgtcctgtccgccattatcgacctgatcaaaacacaggaaaaagctacccctaggaactttccccctcgattccaagacggatactattcctag

SEQ ID NO: 184976 - DNA, 3027 bp, Artificial Sequence
  Description of Artificial Sequence: Synthetic coding sequence
atgagctacgactaccaccagaactggggccgggacggcggccccagatcttctgggggagggtacggaggaggcccggctggggggcacggagggaacaggggttctggggggggaggcggcggggggggagggggaaggggtgggagggggcgacaccccggtcatctgaaaggccgcgagataggtatgtggtacgcaaagaagcaaggacagaaaaacaaagaggcagaacggcaggagagagctgtcgtgcacatggacgaacgtagagaggaacagatagtccagttgcttaactccgtgcaagctaagaatgataaagaaagcgaggcccagatcagctggttcgcccctgaggatcatggatatggcacggaggtgtcaactaaaaatactccctgcagtgaaaataagctcgatatccaggagaagaagctgataaaccaggaaaaaaaaatgttcaggatccggaatcgctcctatattgatagagacagtgagtatctgctacaagaaaacgaaccagacgggaccttggaccagaagctcctggaggaccttcaaaagaaaaaaaacgatctgcgttacatcgaaatgcagcatttccgagaaaaactgcccagctacggtatgcagaaagagcttgtgaatctcattgataatcatcaagtcaccgtaattagtggcgaaactggctgcgggaagaccacccaggtaacacagttcatcctggataactatattgagcggggcaagggttccgcctgtcggattgtatgcacccaaccaagacgaatcagcgccataagcgtggctgaacgcgtcgccgcagagcgcgcagaatcctgtgggtcaggaaattctactggatatcagatccgactgcaaagtaggttgcctaggaagcaagggagtatactgtactgtactaccggaataatactgcagtggttacaatctgacccctacctcagtagcgtcagtcatatcgttctggatgaaattcacgagcgaaatttacaatccgacgtccttatgacagtggtgaaggacctgctgaacttccgtagcgacctgaaagtgatattgatgagtgcaacactcaacgctgagaaattcagtgagtattttggcaactgcccgatgatacacattccagggttcacgtttccagtagtcgagtatttgctcgaagatgtgatagaaaaaatccgatatgtgccagagcagaaagagcaccgcagtcaattcaagcgagggttcatgcagggccacgtaaatcggcaggaaaaggaggagaaggaggcaatatacaaggagcgatggccagactacgtgagagagctcaggcggcggtactcagcctcaaccgtcgacgttatagaaatgatggaagacgacaaggtggatctgaacctgatcgtggctttaatccggtacatcgtgttggaagaggaggatggcgctatcctggtgtttttgcccggctgggacaatatttcgaccctgcacgacttgctgatgagtcaggttatgtttaaatctgacaaattcctgatcattccgctccactccttgatgcccaccgtgaaccagacccaggtgttcaagcgcactccccccggcgtgcgcaagattgttattgccacgaacatcgccgaaacttcaatcaccatcgatgatgtcgtctacgtaattgacgggggaaagattaaagagactcactttgatacccagaacaacatatcaacgatgagtgctgagtgggtctcaaaagcaaatgccaagcaaaggaagggccgtgccggcagggtgcagccaggtcactgttatcacttatacaacggtctacgcgcttccctgctagacgattatcagttgcctgagatacttcgaaccccactggaggagctgtgcttgcaaatcaaaatactgagactgggcggcatcgcctatttcctgtcacgtttaatggaccccccgtctaatgaggccgtcctgctgtctatccgccacctgatggaactgaacgccttagataagcaggaagagcttacgccactgggagtgcacctggctaggctgccagtggagccccacatcggaaaaatgatcctgttcggggctctgttttgctgtctggatcctgtcctgaccatagcggcttctctctcttttaaagatcctttcgtgattccactgggtaaggaaaagattgcagacgctagacggaaggaactggcaaaggacacccggtccgaccatctgacagtcgttaacgcgtttgaggggtgggaagaagcccgccgccgcgggttcaggtacgagaaagactattgttgggagtacttcctgagcagcaacacccttcagatgttacataatatgaaaggtcagttcgctgaacatctgttaggtgcaggattcgtctcatctcggaacccaaaggacccggagtctaatattaactccgacaacgagaagattatcaaagctgtcatctgcgctggtctgtaccccaaagtcgctaagattagactgaacttgggaaagaaacgcaaaatggtgaaggtctatacgaagacagatggactggtcgccgttcaccctaagagcgtgaacgtagagcagactgatttccattacaattggttaatttaccacctgaaaatgaggacgagttccatttacctgtacgactgcactgaagtgagcccctactgtttattattttttggcggagacatttccatccagaaagacaatgatcaagagacaatagcggtggacgaatggatcgtcttccaaagtccagcacgcattgcacaccttgttaaggaactgcgcaaggagctggatatcctactccaggagaagatagagtctcctcaccccgtggactggaacgataccaaatcaagggattgcgcagtgctctctgctattatcgatttgatcaaaacacaagagaaggccacaccacggaatttcccgcctcggttccaggatgggtattacagttag

SEQ ID NO: 184977 - DNA, 2985 bp, Artificial Sequence
  Description of Artificial Sequence: Synthetic coding sequence
atgagctacgactaccaccagaactggggccgggacggcggcccccgctcctccggagggggatatggaggggggcccgccggcggacacggagggaacagaggttccggagggggggggggcggcgggggaggcggccggggggggcggggacgccatcctgggcacctgaaaggtcgcgaaataggcatgtggtatgcaaagaaacagggccaaaagaataaggaggcagaacggcaagagcgtgccgtggtccatatggacgagagacgggaagaacagatagtgcagctgctcaactctgtccaggctaagaacgataaagaatccgaggcccagatcagctggtttgcacctgaagaccacggctacggaacagaagtctccactaaaaataccccttgcagcgagaataagctggatatccaagaaaaaaagctgatcaatcaggaaaagaagatgtttagaatacgtaatcggtcctacatcgatcgcgacagtgagtacctgttacaagaaaacgagccagacgggaccctggaccagaagcttcttgaggacctgcagaagaaaaagaacgatctgagatatatcgaaatgcagcattttagggagaaactcccgtcatacggaatgcaaaaagaactggtcaatctcatcgacaatcaccaagtcacggtgatctcaggggagaccggatgcgggaaaactacacaggtcactcaattcatcctggacaactacatagagcgggggaagggcagtgcatgtcgtattgtgtgcacgcagccacgcagaatctccgctatatctgtagctgaaagggtggcagccgagagggccgagtcatgtggtagcggaaatagtaccggatatcagattcgtctgcagtcccgcttgccaagaaagcagggaagcattctttactgcactacaggaatcatcctccagtggctccagtccgacccctacttgtcttctgtgagccatatcgtgctggacgaaatacacgagcggaatctccagtcggatgtattaatgaccgttgttaaagatctgttaaactttcgcagcgatttgaaggtaatcctgatgagtgctacacttaacgctgaaaagttttccgaatattttggcaactgtcccatgatccatattcccggatttaccttccccgttgtcgagtacttgctcgaggatgtgatcgagaaaatacgttatgtgccagagcagaaagagcacagaagccagttcaaacgcggattcatgcaggggcatgtgaaccgccaggaaaaggaagaaaaagaggccatttacaaggaaagatggccagactatgtgcgtgaactccgacgccgctactcagcttccacggtcgacgttattgagatgatggaagatgacaaggtggatttaaatctgattgtcgcgttgattcggtacatcgtgttagaggaggaagacggggctattctggtttttttacctgggtgggacaatatctctacactgcatgatctgctcatgtctcaagttatgtttaagagtgggaccatgagccaggtgtttaagagaacgccacctggtgtcagaaaaattgtgattgcaaccaatattgcagaaacaagcatcacaatcgacgatgtggtctacgtaattgacgggggtaaaattaaagagacccacttcgatactcagaataacatctccacaatgagtgccgagtgggtttctaaggccaacgcgaaacaacggaagggccgggctgggcgggtgcagccaggacattgctaccatctgtacaacggccttcgggccagcttgttggacgattaccagctacccgaaatactgcgaacacccctcgaagagctatgcctgcagataaagattctgcgcctcgggggaatcgcgtacttcctgagtcggctcatggacccaccttctaacgaggccgtcttactctccattcgacatctgatggaactgaacgcgcttgacaaacaggaagagctgactcccttaggtgttcatctggcccgtctgccagtagaaccccatatcggaaagatgatcctctttggtgccctattctgctgcttggacccagtgttaactattgccgcttcgctgtcatttaaagacccattcgtgatccccctggggaaagagaaaatagcggacgcacgcaggaaggagttggcgaaagacactaggtcggaccacctgactgttgtgaacgcatttgagggatgggaggaggcacgcagacgcggattcagatacgaaaaggactattgttgggaatacttcctgtccagcaatacactgcagatgctccataatatgaaagggcagttcgcagaacatctactgggggccgggttcgtgagcagtcggaatccaaaggacccagaatctaacattaactctgacaatgagaagatcatcaaagctgtcatttgtgcaggtctgtatccaaaggtggcgaaaatccgactgaatcttggaaaaaagaggaaaatggttaaggtgtataccaaaacagatgggctggtggccgtgcatccaaagagcgtaaatgtggaacaaactgatttccactacaactggctgatctatcacttaaaaatgaggaccagtagcatatacctctacgactgtaccgaagtctctccatactgcctactgttctttgggggcgacatttccattcaaaaagataatgaccaggagactatcgccgtggacgagtggatcgtgttccaaagccccgctagaattgcccacctggtcaaggaactcaggaaggaactggatattctgttacaggagaagatcgaatccccacacccagtcgattggaacgacaccaaatcccgcgactgtgcagtcctgtctgccataatcgatctaattaagacccaggaaaaggctactcctcggaatttcccgcctcggtttcaggatgggtactattcctag

SEQ ID NO: 184978 - DNA, 3684 bp, Artificial Sequence
  Description of Artificial Sequence: Synthetic coding sequence
atgggcgacaccagcgaggacgccagcatccaccggctggagggcaccgatttggactgccaggttggtgggctgatctgtaaatcaaagagcgccgcatctgaacaacatgtgtttaaagccccggcccccaggccttcgctgctgggactggatcttttggctagcttaaaacgccgagagcgcgaggaaaaggatgacggagaggacaagaaaaagtctaaagtcagcagctataaggattgggaggaaagcaaagatgatcaaaaagacgccgaggaagaggggggcgaccaggctggccaaaacatacgcaaagatcggcattacagaagcgccagggtggagacgccaagtcaccccggaggcgtctccgaagaattttgggaacgctcccgtcagcgcgaacgagagcggcgcgaacacggcgtctatgcttcaagtaaggaagagaaagactggaagaaggagaagtccagggaccgagattatgatcgcaagcgggatagagatgaacgcgaccgatccagacatagcagcaggtccgagcgagatggtggaagtgagcggagctccagacgcaacgaaccggaaagcccccggcaccgtcctaaggatgccgctaccccctctcgatctacgtgggaggaggaggattccggctacggatcctctcgcagatcgcagtgggagagtccatctcccacccccagctatagggatagtgaacgcagccatcgtctgtccaccagggatcgggatagatccgtgcgcgggaaatacagcgatgatacaccactgccaaccccttcctataagtacaatgagtgggccgatgatagacgtcatttaggctctacccccagacttagtcgcggccgtggacgtcgggaagagggagaggaaggcattagcttcgacacagaggaagagcgacagcagtgggaagatgaccaacgacaggccgatcgtgattggtacatgatggatgaggggtacgacgagttccacaatcccctggcgtatagttctgaggactacgttaggcgtcgggaacaacatctgcacaagcagaaacagaagaggatatcagcgcagagaagacaaatcaatgaggacaatgagcgctgggagaccaacagaatgctgacgtcgggagtggttcatcgtctggaagtggacgaagacttcgaggaggacaatgctgcgaaagtgcatttgatggtccacaacctggtccccccttttttagacgggcgcattgtgtttaccaaacagcccgagcccgtgattcccgttaaggacgctacctcagaccttgcaataatagcgcgcaaggggtcccagaccgtgcgcaagcaccgggagcagaaagaacgcaaaaaagctcagcataagcactgggagcttgcaggcactaaactgggggacataatgggagtgaagaaagaggaggagcctgataaggctgtgacggaagacgggaaggtagattaccgcactgagcagaaattcgccgaccatatgaaacgcaagtccgaggcttctagcgaattcgccaaaaaaaagagcatcttggaacagcggcagtacctgcccatttttgcagtacagcaggagttactgaccataataagggacaacagtatagttatcgttgtgggtgaaaccggcagcggcaaaacgacacagttgacacaatatctccacgaagacggctacactgattacggtatgatcggctgtactcagcctaggcgggtggctgctatgagcgtagccaagcgcgtttcagaagaaatggggggtaatctcggggaggaggttggctatgccattaggttcgaggattgcaccagtgagaacaccctgattaagtatatgacagatggaatcctgctaagagaaagccttcgggaagccgatctggaccactactcagctattattatggacgaagcgcacgagcggtcccttaatactgatgtgctgtttggacttctgagagaagttgtcgcaagacgcagcgaccttaagcttatcgtgaccagtgcaactatggatgcggaaaagtttgccgccttctttggtaatgtgcccatctttcacattccaggccggacttttcccgtggatatactgttttcgaagacaccgcaggaagattatgtggaggctgccgtaaagcagtcccttcaggtgcatctctctggagcgccaggcgatattctcatttttatgcccggacaggaggacatagaggtgacttctgaccagatcgtggagcatctcgaagaacttgaaaatgcccctgctctcgctgtgctccccatctattcccagctgccatcagacctgcaggctaaaatctttcaaaaagcccctgacggtgtgcgcaaatgcattgtggccaccaacatagccgagacaagtttaacggttgacggaataatgttcgtcatagattccggttactgcaaactgaaggtgttcaatcccaggatcggcatggatgctcttcagatttatcccatatcccaggctaacgccaaccaacggagcggacgagccgggcgcacaggccctggacagtgtttcaggctctatacacagtccgcgtataaaaacgaactgctgacaacaacagtccctgagatccagcgcaccaatctcgcaaatgtggtcctattactgaagagcctcggggtgcaagatctgctccagttccatttcatggatccccccccagaggataacatgttaaatagtatgtaccagctctggatattgggggcactcgacaatactggcgggcttacctctaccgggcgcttgatggtagagtttccgctggaccctgccttatcgaaaatgctcatcgtatcttgcgacatgggctgttcctcagaaatcttgctgatcgtttctatgctttcggtgccagctattttttatagaccaaaagggagagaagaggaaagtgatcaaatacgtgagaaatttgcagtgcctgagagtgatcatctaacctacttgaatgtttacctgcagtggaagaacaacaattatagcacaatatggtgcaacgatcattttatccacgctaaggccatgcgaaaggtccgagaggtcagagcccagctgaaggacatcatggtgcagcagcgtatgtctctggccagttgtggtaccgactgggacattgtgaggaagtgcatctgtgctgcttattttcatcaagcagctaagctgaaggggatcggcgagtatgtgaatatccgaacaggaatgccttgtcacttacatccaacctcaagcctgtttggcatggggtacacacccgattatattgtgtatcacgaattggttatgactacaaaagaatacatgcagtgcgtcacagccgtagacggcgagtggctggccgagcttggccctatgttctacagcgtgaaacaggcggggaaaagccggcaggagaatcggaggagagccaaggaagaggccagcgccatggaggaagaaatggccctagcggaggagcaattgagagcccggaggcaggagcaggagaaacgctctccactcggctcagtacgaagtaccaagatttacacgcccgggcggaaagaacagggcgagccaatgaccccaaggagaaccccagcaaggtttgggctctag

SEQ ID NO: 184979 - DNA, 1620 bp, Artificial Sequence
  Description of Artificial Sequence: Synthetic coding sequence
atgggcgacaccagcgaggacgccagcatccaccggctggagggcacagatttagactgtcaggtgggtggcctgatttgcaaatctaagtccgccgccagcgaacagcatgtgtttaaggcgcccgctccgaggccctcgctcctgggactcgatttgcttgcctcactcaagcgtcgggagcgcgaagaaaaggacgatggggaagataagaaaaagtcaaaggttagctcctataaagactgggaagaatccaaggatgatcaaaaagacgctgaagaggaaggcggtgatcaagccaaaatcttccagaaagctccagacggagtaagaaaatgtattgttgctacaaatattgcggagacgtcccttacggtagacgggatcatgttcgtgattgatagtgggtattgcaagctgaaggtgtttaacccccgtattggcatggacgctcttcaaatttaccctatatcgcaggcaaatgcaaaccagaggtccggccgagctggcaggaccggaccaggacagtgtttcaggctttatacccaatcagcctataagaatgagcttctcaccactaccgtgccggaaatccagaggaccaatctggctaacgtggtcctgctgcttaaatcactcggcgtgcaggaccttttgcagtttcacttcatggaccctcctcctgaggataacatgctgaactctatgtatcagctttggatactgggggccctggacaacaccggagggctgaccagtacaggcaggcttatggtcgagttccccctcgatcccgccctgagcaaaatgttgatagttagttgtgacatgggatgctcctctgaaattctcctgatcgtgtctatgctgtccgtgcccgcaatcttctatcggcccaagggcagagaggaggaatctgatcaaattcgcgagaaattcgctgtcccagagagtgatcacctgacctacctgaacgtgtacttgcagtggaaaaataacaactactctactatttggtgcaatgaccattttatccatgctaaagcaatgcgcaaggtgagggaggttcgagcacagctcaaggatatcatggttcaacagaggatgtcactggcctcatgtggcaccgactgggacattgtacgcaaatgtatctgtgctgcttatttccatcaggccgctaagctcaagggtatcggcgaatatgtcaacatccggacaggtatgccgtgccacctgcatccaacatcgtcccttttcgggatgggctacacacccgactatatcgtgtaccacgaactggtgatgacaaccaaggagtacatgcaatgcgtgaccgcagtagatggagagtggctcgcagagctgggacctatgttttatagcgtgaaacaggccgggaaatccagacaggagaacaggcgaagggccaaggaggaagcgagcgccatggaggaagaaatggcactcgcagaggagcagttaagagcccggcgtcaggagcaggaaaagagatccccattggggtccgttagaagtacaaaaatctacactcctggccggaaggagcagggagaaccaatgactcctaggcgcacccctgcccgtttcggactgtag

SEQ ID NO: 184980 - DNA, 2340 bp, Artificial Sequence
  Description of Artificial Sequence: Synthetic coding sequence
atgagccggttccccgccgtggccggccgggccccccggcggcaggaagaaggagagagatcaagggatctccaagaggaacggttatccgctgtttgcattgcagaccgggaggaaaaggggtgcacatctcaggagggcggtacgaccccaacattcccgatccagaagcagcgtaagaaaatcatacaagcggtccgtgataactctttcctgatcgttaccggtaacacggggtctggcaagaccacacagctccctaaatatttatatgaggcgggcttcagccaacacggcatgataggcgtgacgcaaccaagaaaagtggcggcgatctcagttgcgcaacgggtggccgaggagatgaagtgcaccctgggatcaaaggtggggtaccaggtgaggtttgacgattgctctagtaaagagactgcaatcaagtacatgacagacgggtgcctgcttaagcatattctgggggaccctaacctcaccaaatttagcgtaatcattctagacgaagcccacgagaggacattaactactgacattctgtttggacttctaaaaaaactgtttcaagagaaatcccccaaccgtaaagagcacctgaaggtggtcgtcatgtccgcgacgatggaactagctaaactgtcagcttttttcgggaattgcccgatctttgatatcccaggtaggctctatcctgtacgcgagaaattttgtaaccttatcggcccaagggatagagaaaatactgcatacatccaagccattgtcaaggttactatggatattcatctgaatgaaatggctggagatatactcgtttttctgaccgggcagttcgaaatcgagaagtcatgtgaactgctgttccagatggccgaaagcgtggattacgattatgatgtccaagacacaaccctggacggcctcctcattctgccctgttatggttctatgacaactgatcagcagcgacgaatttttcttcctcccccccctggaattcgcaagtgtgtcatttctacaaacatttccgcaacgtctctcaccatcgacggtatacggtacgtggtggacggaggcttcgtaaaacagcttaaccataatccaaggctagggctcgatatactggaggtggtccctatttccaaaagcgaggccctgcagcgtagcggaagggcaggcaggacctcaagcggcaagtgtttcagaatctactcaaaggacttctggaatcagtgcatgcccgatcatgtgatacccgagattaagagaacttcactcaccagtgtggtgctgactctcaaatgtctcgcaattcatgatgtgataaggttcccatatctggacccccctaatgaaaggctgatcctggaagcactaaagcaactgtatcagtgcgatgcgatagacagaagcggacacgtaactcgcttagggctatccatggtggaatttcctctccccccccaccttacttgcgcagttatcaaggcagcatctttggactgcgaggatctgctcctgccaattgccgccatgctttcagtggaaaatgtgtttatccgcccagtggaccccgaatatcagaaggaggcagaacagcggcaccgagagctcgctgctaaagccggtggctttaacgatttcgctacacttgcggtaattttcgaacagtgtaaaagtagcggggcaccagctagctggtgccagaagcattggatacactggagatgtctgttcagcgcctttcgagtggaggcacagctccgggaactgatacgcaaactcaagcagcagagtgattttcccaaggagacctttgaaggtcctaagcatgaagtgctccgcagatgcttgtgcgcaggctactttaagaacgtcgcacgacggtctgtgggccggaccttctgcacaatggacgggcgggggagccctgttcacatccatccgtcttcggccctgcatgagcaagagacaaagctagagtggatcatctttcacgaggttctggtgaccactaaagtctacgcgaggattgtgtgtcctatacgttacgagtgggtgagagatctgttacccaaacttcacgagttcaacgcgcatgatttgtcctccgtggcccgccgggaggtccgcgaagatgcacgcagaagatggacaaataaggaaaatgtgaaacaattgaaggacggcattagcaaagacgtcttgaagaagatgcagcgccggaacgacgacaaatctatctccgacgcacgagcccgcttcctggagcggaagcagcagaggacccaggaccatagtgacacccgaaaggagacaggatag

SEQ ID NO: 184981 - DNA, 2169 bp, Artificial Sequence
  Description of Artificial Sequence: Synthetic coding sequence
atgagccggttccccgccgtggccggccgggccccccggcggcaggaggagggagaacgctcgagagacctccaggaggagcggttgtctgccgtatgcatcgcggacagggaggaaaaggggtgtacgtctcaggagggagggacgactccgaccttcccaattcaaaagcagcgcaaaaagattatacaggctgtccgagataactctttcttgattgtaactgggaatacaggctcaggtaagactacgcaattacccaaatacctatacgaagcaggctttagtcaacatggaatgatcggcgtaactcagccacgcaaagtcgcagctatctctgtggctcaaagagtggctgaagagatgaagtgtacgttgggctctaaggtgggctaccaggtgaggtttgacgattgtagcagcaaggaaaccgcaatcaagtacatgacggacggttgtctactgaagcacatactcggcgacccaaatcttaccaagttttccgtgattatccttgatgaagcccacgaacgaaccctgacgacagatatactttttgggcttctgaagaaattgtttcaggagaagtcacctaaccgtaaagagcacctcaaagtggtcgtgatgtctgctacgatggaactggctaagctgagtgcatttttcggcaattgcccgatatttgacattcctgggcgtctctaccctgtgagagagaagttttgcaacctgattggcccccgcgatcgtgagaacacggcttacattcaggctatcgtgaaggtgacaatggacatccacttgaacgaaatggccggcgatatcctggtgttcctgactgggcagtttgagattgagaagagctgcgaactgctcttccagatggccgaatcggtcgactatgattatgacgtccaggacaccacgcttgacggacttctgatcctgccatgctacggaagcatgacaaccgatcagcaacggcggatcttcctgccaccgcctcctggaatcaggaaatgtgtgatatccactaacatctcggccacatctctgacaattgatgggataaggtacgtagtggatggcggatttgtaaagcagctcaaccataatccccggctaggactagacatattggaggtggtccccattagtaaatcagaagcattgcaaaggagtgggcgagctggtaggacatcatccggaaagtgcttccggatctattccaaagacttctggaaccaatgcatgccggaccatgtcattccagaaattaagaggacctctctcaccagcgtcgtcctgactctgaagtgcctggccatacatgacgtgatccggttcccatatttggatccccctaatgagaggctgattctggaggctctgaaacagttataccaatgtgatgctatcgaccggagtggtcatgtgactagactggggctcagtatggtggagttcccactgcctccacatcttacttgcgcagtcatcaaggccgcgtcattggattgcgaagatttgcttttgccgatagcagctatgcttagtgtggagaatgtgttcattcgccctgtggacccagagtatcagaaagaggccgaacagcggcaccgggagctggcagccaaggctggagggtttaacgactttgctaccctggctgtaattttcgagcagtgtaagtcatcaggcgccccagcctcatggtgtcagaaacattggattcattggcgatgtttgttctccgcctttcgagtcgaggcccagctgcgcgagctgatacgtaagctgaagcaacaatctgatttcccgaaggagacgttcgaggggcctaagcacgaagttctcagaaggtgcctgtgtgccggttacttcaagaatgtggcccgcaggtccgttggccgcaccttttgtaccatggacggccgggggtcccctgttcacattcatccttctagcgcacttcatgagcaggagactaagttggaatggatcatattccatgaggttctggtaaccactaaagtatacgcgagaatcgtgtgtcctatccgatacgagtgggtgcgagacctgttgcctaaactccacgagttcaacgcacacgacctgtcctccgtggccaggagagaggtgagcaagattaaacttttccagtag

SEQ ID NO: 184982 - DNA, 2196 bp, Artificial Sequence
  Description of Artificial Sequence: Synthetic coding sequence
atgatcggcgtgacccagccccggaaggtggccgccatcagcgtggcccagcgagtggctgaggaaatgaagtgtaccctggggtctaaggtggggtatcaggttcggttcgacgattgttcctccaaagagacagctatcaaatatatgaccgatggatgtctgttaaaacatatccttggagaccctaacctgactaaattttcggtgattatccttgatgaggcacatgaacgtacactcactacggacattctgtttggcctgctgaagaagttattccaggaaaagagtcccaatcgaaaagagcacctgaaagttgtggtgatgagcgccactatggaattggcaaagctgtccgcctttttcggaaactgccccattttcgatataccaggccggctgtaccccgttcgcgaaaagttttgcaaccttatcggccctagagatcgggagaataccgcctatatccaagccatcgtaaaggtgaccatggacatccatctgaacgagatggccggagatatactggtcttcctgactgggcagttcgagattgaaaagagctgtgagctcctgttccagatggctgagtctgttgactatgattatgatgttcaggatactacgctagacggccttctaattcttccatgctatggctccatgactacagtgtctcagacatcgcttaccttcgtgacacatattcagatcatgaaacagattagcgagaatcagcacagcctgactggactgaccatcgccggcattacgggggtttcccatcacgcccgacctagaaatatgacttgcaacgaaaaactgaatcagcaaaggcggatctttctcccccccccgcccggcattcgaaagtgcgttatttcaacgaacataagcgccactagtctgactatcgatggcattcgatatgttgtcgacggggggttcgtgaagcagctgaaccataaccctcgtctcggtctggatatactggaagtggtgcccataagtaagagcgaggccctgcaacgttctggaagagctgggcggacctccagtggcaaatgctttaggatctattctaaggatttctggaaccagtgtatgccagatcacgtgataccagagatcaaaagaacaagtctcacatctgttgtgctcacactgaaatgtcttgccatccacgacgtcatccgatttccctacctggacccccctaacgaacgcctcatcctggaggcactgaagcagctataccagtgcgacgctatcgatagaagcgggcacgttacgagattagggctgtccatggttgagtttccactgccacctcacctgacctgtgcagtcataaaagctgcctcactcgattgcgaggatttgctgctgcccatcgccgcaatgttgagtgtcgagaatgtgttcattagaccagtggaccctgaataccagaaggaggcagaacagcggcatagggagcttgcggccaaggccgggggattcaacgacttcgctactttggctgttatattcgaacagtgcaaatcaagcggtgcccccgcgagctggtgtcagaagcactggattcactggaggtgcctctttagcgcctttcgggtggaggcgcagctacgggagcttattaggaaactcaagcagcaatccgattttcctaaggaaacattcgagggaccaaagcacgaggtccttcgaaggtgtctttgtgccggctattttaaaaacgtcgctagaaggtccgtgggtaggaccttctgtacaatggatggccgtggcagtcctgtgcacatccaccccagctcagctttacatgaacaggagacaaagctcgaatggattatctttcatgaggtgctggttacaacgaaagtgtatgcaaggattgtatgtcccatcagatacgagtgggtgagagaccttctgcctaaattacatgaattcaacgcgcatgacctgagctctgttgcccgaagagaggtgcgcgaggatgcccggaggcgatggacaaacaaagaaaatgtcaaacaactgaaagacgggatatccaaggatgtgcttaagaaaatgcagaggcggaacgacgacaagtccatttccgacgctcgcgccaggttcctggagcggaaacagcagcgtactcaggatcactctgacacgcgaaaggagacaggatag

SEQ ID NO: 184983 - DNA, 2109 bp, Artificial Sequence
  Description of Artificial Sequence: Synthetic coding sequence
atgagccggttccccgccgtggccggccgggccccccggcggcaggaagagggcgaaaggtcacgcgatctccaggaggagcgactttcagctgtctgcattgccgacagagaggaaaagggctgtacctcacaagaaggaggtaccacccctaccttccccatccagaaacagcgaaagaagatcatacaggctgagaccgcgatcaaatacatgacggatggctgtctccttaagcacattctcggcgacccgaacttaactaagttcagtgttattatcctcgatgaggcccatgaacgcacacttaccaccgacattctgtttggtcttttgaagaaactcttccaagaaaaatctccaaataggaaagagcacctgaaggtggttgtcatgtcagctactatggagctggcaaagctgtcagctttctttgggaattgtcccattttcgatatccctggaaggctttatccagtccgtgagaagttctgtaacctgataggcccacgggaccgcgagaacaccgcttacatccaggccattgtcaaagtcacaatggatattcacctaaacgaaatggctggagatatccttgttttcctcaccggccagtttgagattgaaaagtcttgtgaactgctcttccagatggcggagtctgtggactatgattacgacgtacaggatactactttagatggactactcatccttccatgttacgggtcaatgacgacggaccagcagagaaggatatttctgccaccgcccccaggaattcgcaaatgtgttatctccacgaatatctcagcaacaagcttaacgatcgacgggatccgctatgtggtggatggagggtttgtgaaacagttgaaccacaatcccagactggggctggatattttggaggtcgtgcctatctcgaaaagcgaggccctccagagaagcggtcgcgccggcaggacttcatctgggaaatgttttagaatatatagcaaagatttttggaaccagtgtatgccagatcacgtgattccggagataaagaggacctctctgaccagtgtggtgctgacgttgaaatgtctggccatccacgacgtaattagattcccatatctcgatcccccgaatgaaaggctgatcctggaggccctaaagcaactctatcaatgtgacgccatcgaccgtagcggccatgtgactcggctagggcttagcatggtggagtttccccttccaccccacttgacctgcgccgtcataaaggctgccagcttggattgtgaggatctgctgctgcctatcgctgccatgctctctgtggaaaacgtgtttattcgaccagtggacccggagtaccagaaggaggcagagcagcgacatcgcgaattagccgctaaggctgggggattcaatgattttgcgaccctggcagtgatcttcgaacaatgtaaatcatccggagcaccagcctcctggtgccagaaacattggattcattggcgctgcttgttttccgcatttagggtggaagcgcagttgagggagctgatcaggaaactgaaacagcaaagtgactttcccaaggaaactttcgagggaccaaagcatgaagtcctgaggcggtgtctttgcgctggatactttaagaacgttgcgcgccgttcagtgggcaggactttttgcacaatggacggccgcgggagcccggttcatatccacccttcatccgctctacacgagcaggagaccaagctagaatggattatttttcacgaagtgctggtcacaaccaaggtttacgctaggatcgtatgcccaataagatatgaatgggtgcgcgatctgctgcccaaactgcacgagttcaacgcgcacgacctgtcttctgtggccagacgcgaggtcagggaagatgcccgtcggagatggacaaataaggagaatgtgaaacagctgaaggacggcatcagcaaggacgtccttaagaagatgcagagacggaacgatgataagtctatcagtgatgctcgagcaaggttcctggaacggaaacagcagcgtactcaggaccattctgacactcggaaagagaccggctag

SEQ ID NO: 184984 - DNA, 3663 bp, Artificial Sequence
  Description of Artificial Sequence: Synthetic coding sequence
atggccgtggccgtggccatggccggcgccctgatcggcagcgagccaggcccagctgaggagcttgctaagttggaatacctaagcctagtgtctaaggtgtgtacggagctggataaccacttaggcatcaacgacaaggaccttgccgagtttgtgatcagccttgcggaaaagaataccacctttgacacttttaaggcatccctcgtcaagaacggtgctgagttcacagactcgctcatcagcaatctgctccgccttatccaaaccatgagacctcccgcgaagcccagcacttcgaaagatccggtagtaaaacccaaaactgagaaggaaaagctgaaggagctgttccctgttctgtgtcaacccgacaacccttccgtgcggaccatgctcgatgaggatgacgttaaggttgcggtggacgtgctcaaggagcttgaagcactgatgccatcagcggcaggccaggagaaacagagagatgcggagcacagggaccggacaaagaagaagaagcgctcacgttcacgtgaccgaaaccgcgatcgggatagagacagagagcgtaacagggatagagaccacaaacgcagacacagatctagatccaggtccagatcccgaactagggaaagaaacaaggtgaaaagccgctacagaagcaggtctaggtcgcagagccctcctaaagatagaaaggaccgcgacaaatatggggagcgaaacctagacaggtggagagacaaacacgtcgaccgccccccccctgaggagcccactattggcgatatatacaatggaaaagttaccagcatcatgcagtttgggtgttttgtgcagctagaagggctgagaaagcggtgggaagggctagtgcacatctccgagctgcggcgagaggggagagtcgctaatgttgccgacgtggtctcaaagggccagagagtaaaggtcaaagtgctctcctttacaggcacaaagacctctctgtccatgaaggatgtcgatcaggaaacaggcgaggatctgaaccccaatcgtcggcgaaatcttgtcggtgaaaccaatgaggagacctccatgagaaatcccgacaggcccacacacctaagcttggtcagtgcccctgaggtggaggacgacagcctggaacgaaaaagacttacacgaatttccgaccctgagaagtgggagatcaagcaaatgattgctgccaatgtcctcagcaaggaagaatttccagacttcgatgaagagaccgggattctgcccaaggttgacgatgaagaagatgaagatcttgagattgaacttgtcgaggaggagccgcctttcctgagaggacacacaaagcagtccatggacatgtctcccatcaagatcgtgaagaaccccgatggatctctgagccaggccgcaatgatgcagtctgccctggctaaagagagacgtgagctgaaacaagctcagcgagaggcagaaatggattccattcccatggggcttaataagcactgggtggaccccctccccgatgcggagggacgtcaaatagccgcgaacatgcggggaataggaatgatgcccaatgacatccccgagtggaagaaacacgcctttgggggtaacaaggcatcctacggcaaaaaaacacaaatgagcatcctggagcaaagagaaagcctgcccatctataaactgaaagagcaattagtacaagccgtgcatgataaccagattctaatcgtgataggggaaacagggtccggaaagacgacccagataacccagtacctggcggaggctggatacacaagcagaggcaagattggttgtactcagcccaggagggtggcggccatgagcgtggcgaagcgtgtcagtgaggagtttggttgctgcctgggccaggaggtcggatatacgatcaggtttgaggattgcacatctccggagaccgtcattaaatacatgacggacggaatgctgctgagagagtgcctgatcgatccagacttgacacagtatgccatcattatgctggatgaagcccacgagaggacgatacacaccgatgtgttgtttggcctcctgaagaagacagtccaaaagcgtcaggacatgaaacttatagttaccagcgcaacactagatgccgtaaagttcagccagtacttctacgaggcgcctatcttcactattccaggccgaacgtacccagtggaaatcctctataccaaggagcccgaaaccgactacctcgacgcctcactgattaccgtgatgcaaatacatctcactgagccgcctggagacatcctcgtgtttctaactggtcaggaagaaatcgatactgcctgcgaaattttgtacgagcgcatgaagtcactcggcccagacgtgcccgagctgattatcctgccagtttattccgcattgccgagcgagatgcagacaaggatatttgacccggccccacccggctccagaaaggtggtcatcgctacaaatatcgcagaaacctcattaacaatagacggcatctattacgttgtcgacccaggcttcgtcaaacagaaggtgtataactccaagaccggcatagatcagctcgtagtcactcctatttcccaagctcaagccaaacagagagcaggtcgtgccggtcggacaggacccggcaaatgctaccgcctctacaccgaacgggcttacagagacgaaatgctgacgaccaatgtgccggagattcagaggactaacttggcctctaccgttctgagccttaaggcaatgggcattaacgacctgctctctttcgatttcatggatgccccgcccatggagaccttaatcacggcgatggagcaattgtataccttaggagctctcgatgatgagggactcctgacccggcttggccgcagaatggcagagttccccttggaaccaatgctctgtaaaatgctgattatgagtgtacacctggggtgttcagaggagatgctgacgattgtctcaatgttatcagttcagaatgtgttttaccgtccaaaagataagcaagcactggcggatcagaagaaggcaaagttccaccagaccgagggggatcatctgacactgctggcggtttacaattcttggaaaaataacaagttctccaacccatggtgttacgaaaacttcatacaggcgcgttcactcagaagagctcaggacatccgtaagcaaatgctgggaattatggataggcacaaactagatgtcgtatcctgtggaaagtccacagtcagggttcagaaggcaatctgctctgggttttttaggaacgctgcaaagaaggacccacaggagggataccgcacactaatcgaccagcaggtcgtttatattcaccctagctcagccctcttcaacaggcagccagaatgggtagtgtatcacgaacttgttctgacaaccaaggaatacatgcgcgaggtcacaacaattgaccccagatggctcgtggagttcgctccagctttttttaaggtcagtgaccctactaagttgagcaagcaaaagaaacagcaacgactggaaccattgtataaccggtatgaggagcctaatgcttggcgcattagccgggcctttagacggcgctag

SEQ ID NO: 184985 - DNA, 3546 bp, Artificial Sequence
  Description of Artificial Sequence: Synthetic coding sequence
atggccgtggccgtggccatggccggcgccctgatcggcagcgagcccggacctgccgaagagctcgctaaactggagtatcttagcctcgtatccaaggtgtgcactgaacttgacaatcacctgggtattaatgacaaagacctcgctgaatttgtgattagcctagcagagaaaaataccaccttcgatactttcaaagctagtctcgtgaaaaatggtgccgagtttactgacagcctcattagtaacctcctccggctaatccagacaatgcgacctccagccaaaccaagtacgtctaaagacccggtggttaaaccaaagacggagaaggaaaagctcaaggagttgttcccagtcctatgccagcctgacaatccgtccgttcgtactatgttggatgaagacgatgtcaaagtggccgtcgacgtactcaaagaactggaggctcttatgccctctgcggccggacaagaaaaacagcgcgatgctgagcatagggacagaacaaagaagaagaagaggtccagaagcagggatagaaatagggacagggacagagatagggaaaggaaccgcgaccgagaccacaaaaggagacatcgctcgaggagccgctcacggtccagaactagagagcgcaataaggtcaagagccgttatcggtctcgctccagatcccagtcgccgcccaaggaccggaaggacagagataagtatggagagcggaaccttgatagatggagggataagcatgtcgatcgcccccctcccgaagaacccacaatcggggacatctataatggcaaggtgacaagtatcatgcagtttggatgcttcgtccagctggaaggactgagaaagcggtgggagggacttgtacacatctccgagctacggagagagggacgcgtcgccaacgttgcagatgtggtttcaaagggccagcgtgtgaaagtgaaggtgctgtcctttaccgggacaaaaacttcgctctccatgaaggacgttgatcaggaaactggggaggacttgaatccaaatcgccgccgcaatttagtcggcgaaacaaatgaagagacctccatgaggaacccagataggccaacccatctgtctctggtgtccgctccggaagtcgaagacgactctctggagcgcaagcgccttacccggataagcgacccggaaaagtgggagattaagcaaatgatcgcagcaaatgtactgagtaaggaggaattcccggatttcgacgaagaaactggaatactccccaaagtcgatgatgaggaggatgaggaccttgagattgagttagtggaggaggaacccccatttctgaggggccacacaaaacaaagcatggacatgagccccatcaagatcgtgaagaatcctgacggatcactcagccaggcggctatgatgcagagtgcactggcaaaagaacgacgcgagcttaaacaggcccagcgtgaggcagagatggattctattcccatggggttgaataagcattgggtggatcctctgccagatgctgaaggacgtcagatagctgcaaatatgcgcggtattgggatgatgccaaatgatatacctgaatggaagaaacacgcctttggtggaaataaggccagctacggaaagaagacacagatgtccatcttggagcaacgagaatcgctgcctatatacaagttgaaagaacagcttgtacaagccgtgcatgacaaccagatcctgatagttataggtgaaacaggcagcggcaagacaacacaaatcactcagtacctggcagaagccgggtacaccagccgcggtaagatcgggtgcacccagccccgcagagtggctgccatgtcagtcgcaaagagggtaagtgaggagtttgggtgttgcctaggccaggaagtaggctataccataaggttcgaggactgcacctcccccgagacagtgatcaagtacatgacagatggcatgctgctgcgggaatgtcttatagatcctgatttaacccagtacgctatcatcatgcttgatgaagcacatgaacggacaattcatacagacgtgcttttcgggctgcttaagaagacggtgcaaaaaagacaagacatgaaacttatcgtgacttctgccactctggacgcagtaaagttcagccaatacttttacgaggcgcccatatttactatacccgggcgtacttaccccgtggagatactgtacaccaaggaaccagagaccgactatctcgatgcaagtctgatcacagtgatgcagattcatctgaccgaacctcctggcgatatcctggtcttcctgacagggcaggaagagatcgacacagcgtgtgaaattctgtacgagaggatgaagagcttaggccccgatgtgcctgagttgataatactgcccgtgtacagtgccttgcccagcgagatgcagacacgaatcttcgatcctgcccctccaggcagccggaaagtggttatcgcaactaatatcgcagagacatccctgactatcgatgggatctattacgtggtggatccaggctttgtgaaacagaaggtctacaatagcaagactggcattgatcagcttgttgtgacccctatttctcaggctcaagccaagcagagggcggggcgcgctggtcgcactggtcctggaaaatgttataggttatacacggagcgtgcttaccgcgacgaaatgctcactacgaatgtacccgagatccagcggactaatctcgcctctacagtgctgagtttgaaagccatgggcattaatgacctgctcagcttcgacttcatggatgctccacctatggagactctcatcacagctatggagcagctctacaccctgggagcgttggacgatgagggtttgttaacacggctcgggcggaggatggccgaatttcccttggaacctatgctgtgcaaaatgctgattatgtcggttcatcttgggtgcagcgaagaaatgctgacgattgtcagcatgctgtccgtgcaaaatgtattctatagacctaaagataaacaggcccttgccgatcagaagaaagcaaaattccaccagaccgagggagaccatctgaccctgctggcggtctacaactcttggaaaaataacaaattttcaaacccctggtgctatgaaaatttcatccaggcgcggagcttgcgccgcgcacaggacatccggaaacaaatgcttggaatcatggaccgacacaagctagacgtcgtgagttgcggtaaatcaacggtgcgagtccaaaaggccatctgttctggcttctttaggaatgccgcaaagaaagacccccaggaggggtaccggacactgattgatcagcaagtggtctacatccatcctagtagcgccttgttcaataggcagcccgagtgccctaaacattttttgcccgtcgtcgcagtcgctgttagcctggagcagtgcctgagcaaattcgaggacctcaacaaagagctgggcctggttacctgctag

SEQ ID NO: 184986 - DNA, 3813 bp, Artificial Sequence
  Description of Artificial Sequence: Synthetic coding sequence
atgggcgacgtgaagaacttcctgtacgcctggtgcggcaagcggaagatgacaccatcgtatgaaattcgagccgtgggtaacaagaatcggcaaaagttcatgtgtgaggtgcaggtcgaagggtacaactacaccggaatgggaaattctaccaacaagaaagacgcccagagtaacgccgcccgcgacttcgtgaattacctcgtgcgcatcaacgagattaaaagtgaagaggtcccggcttttggcgtggcctcccctccccccttgactgacactccggacactacagctaatgctgaaggagacctgccgaccaccatgggcggccctcttccaccccatttggccctcaaggcggagaataactccgaagtcggtgccagcggttacggcgtgccagggcccacctgggatagaggtgctaacctgaaggactattacagcagaaaagaagagcaagaggtacaggcgaccctggaaagcgaggaggttgacttgaatgccgggcttcacggtaattggactttagaaaatgccaaggcccggttaaaccaatattttcagaaagaaaagatacagggggaatacaagtatactcaggtggggcctgatcacaaccgtagcttcatagccgaaatgaccatctatattaaacaactcggacgcaggatcttcgccagggagcacgggagtaacaagaagctggctgctcagagctgcgcactctccctggtgaggcagctgtaccatttgggcgttgtggaagcatactctggacttaccaaaaagaaagagggagaaacagtagagccctacaaagtaaatctcagtcaggacctcgaacatcagctacagaacattatccaagagctaaatctggaaattctcccacctcctgaggatcctagtgtgcccgttgccttgaacatcggcaagctggcccaatttgaaccttcacagagacaaaatcaggtgggggtggtgccctggagtccaccccaatccaattggaatccgtggacctcgagcaatatcgacgagggtcctcttgctttcgctacccctgaacagatatctatggatttgaagaacgagctcatgtatcaactggagcaggaccatgatttgcaagctatattacaggaacgagagcttttacccgtgaagaaattcgagtctgagatcctcgaggctatcagtcagaacagcgtggtcatcatcaggggtgcaactggctgtgggaagactacccaggtgccacaattcatcctggacgactttatacagaatgatcgggccgccgagtgtaacatcgtagtcacccagcccagacgaatctccgccgtgtctgtggctgagagagtcgcctttgagcgcggggaagaaccaggcaagtcatgtggttactccgttcgattcgaatctattttgccacggccccacgcgtccatcatgttctgcacagtaggggtgctgctcagaaaactggaagctggcattcgagggatcagccatgtcattgtagacgaaatccatgaaagggacatcaataccgactttctcctggtggtgcttcgagacgttgttcaggcttaccccgaagttcggatagtccttatgagcgcaacaatcgacacgtctatgttctgcgaatatttttttaactgtccaatcatcgaagtgtacggacggacatatcctgtgcaggagtacttcctggaagattgcatacagatgacacacttcgtccctccccccaaagataaaaagaagaaggacaaagatgacgacgggggagaggacgatgatgccaactgtaatcttatctgtggcgacgagtatgggcctgagaccagactcagcatgtctcagctgaatgaaaaagagacgccttttgagcttatagaggcactgctgaaatatattgagactctaaacgtcccaggtgccgtcctcgtttttctcccaggttggaatctgatttatacgatgcagaaacacttggagatgaaccctcacttcgggagtcaccggtaccaaatcctgccacttcactctcagattcctcgcgaggagcaacgaaaggtgtttgacccagttccagtaggggtgaccaaggtgatcctttcgaccaacatcgcagaaacctctattaccatcaatgatgttgtctatgtgatcgattcatgtaagcagaaagtgaaattgtttacagctcacaataacatgacaaactatgctaccgtgtgggccagcaagaccaacctagagcaacgaaaaggtagagccggcagagtccggcccggcttttgcttccacctgtgcagccgcgccagatttgaaagactcgagactcacatgacaccagagatgttcaggacccccctgcatgaaatagctctcagcatcaagctcctccggctgggagggatcggccagtttttggccaaggcgatcgagccaccgcccttggacgcagtgattgaagccgagcacactctaagagagcttgacgctctcgacgccaatgacgaactcactccgttggggaggatcttggcgaagttgcccattgagccccggtttggtaaaatgatgattatgggctgtatcttctacgtcggggatgctatatgtaccatcgctgccgcgacttgctttccggaaccctttatcaacgagggcaagcgactgggatacatccaccggaatttcgccggaaatagattctcggatcacgtggccctcctgtctgtgtttcaggcatgggacgatgcccgcatgggcggggaggaagccgaaatcagattctgtgaacacaaacgcctgaacatggctactctacgcatgacatgggaggccaaggtgcagctaaaggagatactcatcaactctggttttccagaggactgtctgctgacccaagtgttcaccaacacggggccagataacaacctcgacgttgttatttcattgctggcctttggcgtgtacccaaatgtgtgttatcataaggagaagaggaaaattctgacaacggaaggtcgaaacgcactcatacataagtcatccgtgaactgccctttttcgagccaggatatgaagtacccatctcctttttttgtgtttggcgagaagattcgaacccgagctatctccgccaagggcatgacactggtgacccctcttcagcttctcctgttcgcctccaagaaggtgcagagtgacggccaaattgttcttgtggatgattggatcaaactgcagatcagtcacgaagcagcagcctgtataacagggttacgagcagctatggaggccctcgtggtggaagtgacaaagcaacctgcgatcatttcccagctcgatccagtgaacgagagaatgcttaatatgatccggcaaatttcccgcccaagtgcggccggtataaacctcatgatcgggagcaccaggtatggagacggcccccggccacccaagatggcaagatacgacaacgggtccggataccggcgtggcggtagctcctactctggcggggggtacggcgggggatacagtagtggcggttatggtagcggtgggtatggcggatccgctaacagcttcagggctgggtatggggctggcgtgggtggtggataccgcggcgtgagccgtggaggatttcgaggcaattcgggtggtgattaccgtgggcctagcgggggctatcgaggttcaggaggcttccaacgcgggggaggtcgaggcgcctatggcaccggctactttggccaggggagaggtggtggggggtactag

SEQ ID NO: 184987 - DNA, 1800 bp, Artificial Sequence
  Description of Artificial Sequence: Synthetic coding sequence
atgggcgacgtgaagaacttcctgtacgcctggtgcggcaagcggaagatgaccccttcctatgaaattagggccgtggggaataagaatagacagaagttcatgtgcgaagtccaggtggagggttacaattacacaggcatgggcaattctaccaacaagaaagacgcccagagcaacgcagcccgagatttcgtcaattatctggtccgcatcaatgaaataaagtcggaagaagtgcccgcctttggagtcgcctctcctcctccgctcactgacacaccagacacgaccgccaacgctgaaggggaccttcccactacaatggggggcccactgcccccacatttggcactaaaagccgaaaataactccgaagtcggggcatctggctacggggttccaggtcccacatgggaccgcggagcgaacctgaaggattactattccaggaaggaggaacaggaggtacaggccactctcgaaagtgaggaagtagacctcaacgcaggattgcacggaaattggactctcgaaaacgcgaaagctcgcctgaatcagtactttcagaaggagaaaatccaaggcgagtacaagtatactcaagtagggccagaccataatagaagctttattgccgaaatgacaatttacataaagcagctgggaaggcggatttttgccagggagcacggttcaaataagaaactggcagcccagtcgtgtgccttatcacttgtgcgccagctctaccacttgggggtagttgaagcgtacagtggcctcaccaagaaaaaggagggtgaaacggttgagccttacaaggtgaatcttagccaggatctggaacaccaactgcagaacattattcaggagctgaatctagagatcctccctcccccggaggacccctcggtaccagtggctctgaatatcggaaagctcgcacaattcgagccttctcagagacagaaccaggttggggttgttccctggtcccctccccagtctaactggaatccatggaccagctctaacattgacgagggaccacttgcatttgccacccccgagcagattagcatggatctgaagaatgaactaatgtaccagctcgaacaggatcatgacctccaggctatcctgcaggaacgagagctattgcccgtgaagaagttcgagagtgagatccttgaggctatcagtcagaactccgtcgtgatcataagaggtgctaccggatgcggcaagacgacacaagtgcctcagttcatcctggacgatttcattcagaatgatcgggctgccgaatgtaacattgtcgtcacgcaacctagacggatatccgccgtgtctgtggcggagcgcgttgctttcgaacgtggcgaggaacccggaaagtcatgcggttacagtgtacgcttcgaaagcatactcccgcgacctcacgcctctatcatgttctgtaccgtcggtgtgttgcttagaaagctcgaagctggtataaggggcattagccatgtcatcgtggacgaaattcatgaaagagatatcaatactgattttttgctggtggtcctgcgcgacgtggtgcaggcttatccagaggtgagaatagttctgatgtcagccacgatagatacatccatgttctgcgagtatttttttaattgtcccattatagaggtatacggtagaacctaccctgtccaggaatattttctggaagactgtattcagatgacccacttcgttccaccccccaaggataaaaagaaaaaagataaaaagaagaaatag

SEQ ID NO: 184988 - DNA, 1197 bp, Artificial Sequence
  Description of Artificial Sequence: Synthetic coding sequence
atgatgctgaagggcatcacccggctgatcagccggatccacaagcttgaccctgggagatttctacacatggggacgcaagcgagacaatcaattgctgcccatctggataaccaagtcccagtggagtccccccgcgccatttcccggacaaacgaaaatgacccagcaaaacacggcgatcagcatgagggccaacattataacatctcaccccaggacctggagaccgtcttcccacacggactgcctcctcggtttgtcatgcaagtgaaaacgtttagcgaggcctgcctgatggtccgaaaaccagccttggagttgctgcactacctaaagaacacctccttcgcctatcccgcaatacgctatctgctctatggagagaagggtacaggaaaaactttatccctatgccacgtgattcacttttgtgctaaacaggattggcttatcctgcacattcccgatgcacacctgtgggttaaaaactgtcgtgatctgctccagtctagctacaacaaacagcgctttgatcaacccctggaagcatccacctggctgaagaacttcaagaccaccaatgagagatttctgaaccagatcaaagtacaagaaaagtacgtgtggaataaacgcgaaagtactgagaagggaagcccacttggcgaggtcgtggagcagggaattacaagggtccggaacgctaccgatgccgtcgggattgtgctgaaagaactgaagcgccagtcatcactgggcatgttccacttgctcgttgccgtagacggaattaacgctctttgggggagaactactctgaaacgtgaggacaagtcccccatcgcacctgaggagctcgcactggtacacaacctccgaaagatgatgaaaaatgactggcacggaggcgccatcgtttcagctttatcacaaacagggtcactctttaaacctcggaaggcctatctgccacaggagctgctgggtaaagagggcttcgacgccttggaccccttcatacccattttggtgagcaactacaacccaaaggaattcgaatcgtgcatccaatactacctcgagaataattggctgcagcatgaaaaggcccccactgaggagggaaagaaagagttgctcttcttgtccaacgctaatccatctctccttgaaaggcactgcgcctatctctag

SEQ ID NO: 184989 - DNA, 1197 bp, Artificial Sequence
  Description of Artificial Sequence: Synthetic coding sequence
atgatgctgaagggcatcacccggctgatcagccggatccacaagctcgacccagggagatttcttcatatggggacacaggcacgccagtcgatcgctgctcacctcgataatcaggtgcccgtggagtcaccaagagccatctcgagaaccaatgagaatgaccccgctaagcatggggaccaacacgaaggtcagcattacaacataagcccacaagatctggaaacagtgttccctcacgggctgccgcctaggttcgtgatgcaggtcaagacgttctcagaggcatgtcttatggtacgtaagcccgcactagagctgcttcactaccttaagaacacttccttcgcctacccagccatccgatatttactgtacggagagaagggaacggggaaaaccctctcactttgccacgtaattcacttttgcgctaagcaggactggttaatcctacatattccagatgctcatctttgggtcaagaactgccgagacttgctgcaaagctcatataataagcagagattcgaccaacccttagaggcgagcacctggctgaaaaatttcaagacaacaaatgagagatttctgaaccaaataaaggtgcaggaaaagtacgtatggaacaagcgcgagtccaccgaaaaggggagcccccttggagaagtagtagaacaagggatcactcgagtccgcaacgcaaccgacgctgtggggattgtgctcaaggaattaaagcgccagagtagtctgggaatgttccacctactggttgccgtagatggcattaatgccctgtggggtagaaccacgctaaagagggaggacaaatcccctattgcaccagaggaactggcactcgttcataatctacggaagatgatgaaaaacgattggcatggtggggccatcgtgtcagcccttagccagaccggatcgctctttaagcccagaaaagcttatttgcctcaggagttactcggcaaagaaggcttcgatgcacttgatcctttcatcccaattctcgtgagtaattataatcctaaggagttcgagtcatgcattcagtactacctggagaacaattggttgcagcatgagaaggcacccaccgaggaaggtaaaaaggaacttctgttcctctccaatgctaaccccagtctcctggagcggcactgcgcctatctgtag

SEQ ID NO: 184990 - DNA, 1095 bp, Artificial Sequence
  Description of Artificial Sequence: Synthetic coding sequence
atgatgctgaagggcatcacccggctgatcagccggatccacaagttagatcctggaagatttctgcatatgggcacccaggcccggcaaagcattgcagcccatctcgacaaccaggtgccagtggaaagcccaagagccattagcaggacaaatgagaatgacccggttaagacgttctctgaagcctgtctaatggtccggaaacctgctttagagcttctgcactaccttaaaaatacatcctttgcctatcccgctatccgctatctcctttacggtgagaaagggacaggtaaaaccctgtcactttgtcatgtgatccacttttgtgcgaagcaggactggttgatcctccacattcccgatgcccatctatgggtgaagaattgtcgtgaccttctacagtcctcttacaataagcagagattcgaccagcctctagaggctagtacgtggctaaaaaatttcaagactacaaatgaacgcttcctgaaccagattaaagtgcaagaaaagtatgtgtggaacaagcgggagagcacagaaaaagggtccccacttggagaagtcgtggaacaggggatcactcgagtaaggaacgcaactgatgccgtgggaatagttttgaaggagctgaagcgccaatcttcactgggaatgtttcacctgctcgtggccgtggatggcattaatgcattatgggggaggaccaccctgaaacgtgaggacaagtcccctatcgcccctgaagagctcgcactggtacacaatcttcgcaaaatgatgaagaacgattggcatgggggagccattgtatctgcactgtctcagacaggttccctgttcaaacctcgaaaggcttaccttcctcaggagttattgggcaaggagggatttgacgcactggaccccttcataccgatccttgttagcaattataaccccaaggaatttgagtcttgtatacagtactatctagaaaacaactggctccagcacgagaaagcacccacagaggaaggtaaaaaagaactcctgtttctttctaacgctaacccctcattgctggaacgccactgtgcttacctttag

SEQ ID NO: 184991 - DNA, 1074 bp, Artificial Sequence
  Description of Artificial Sequence: Synthetic coding sequence
atgatgctgaagggcatcacccggctgatcagccggatccacaaggcgaaacatggggaccagcacgaaggccagcactataacattagtccacaagaccttgaaaccgtcttccctcatggactcccccctcggtttgttatgcaggtgaagaccttcagtgaagcctgcttgatggtgagaaagcccgccctagagctcctccactatctcaaaaacaccagcttcgcctaccccgccatccgatatctattgtacggcgagaaaggcacaggaaagaccctatcactgtgccacgtgattcatttttgcgctaaacaagactggctcatcctgcacatacccgatgcccacctctgggtgaagaattgcagagacctattgcagagctcttacaacaagcaacggtttgaccaacccctggaggcttccacgtggttgaagaattttaagacaacaaacgaacggttcttgaatcagatcaaggtccaggagaagtatgtctggaacaaaagagagagcacagagaagggatcccccctgggggaagtagtggaacaaggaatcactagggtccgaaacgcaacggacgcagtgggtatcgtgcttaaagaactgaaaaggcaaagctctttgggaatgtttcacttgctggtcgccgtggacggcattaatgccctttggggccggacgactctaaagcgggaagacaaaagccccatcgcccctgaggagttggcccttgtgcataacctgaggaaaatgatgaaaaatgactggcatggcggggctattgtgtctgccctatcacagacaggatcactgttcaagccacgtaaggcctacctgcctcaggagctgctcggtaaggaaggatttgacgccctggatccgttcatcccaattctcgtgtcaaattacaatccaaaagagtttgagtcatgcatccagtattacctcgagaataactggttacagcatgagaaggctcctactgaggagggcaagaaggagctcctttttctaagcaatgccaatccaagcctcttggagagacactgtgcctatctgtag

SEQ ID NO: 184992 - DNA, 1047 bp, Artificial Sequence
  Description of Artificial Sequence: Synthetic coding sequence
atggccggcctgaagcggcgggccagccaggtgtggcccgaggagcacggggagcaagagcatggcctctattcactgcacaggatgttcgacatcgtgggcacccatctcactcaccgcgacgtccgcgtgctgtcatttctgttcgtagatgtgattgacgatcatgagagaggcctcataagaaatggtcgcgactttttactggccctggagcgccaggggcgatgcgatgagtccaacttccgacaggtgctgcagcttctgcggattataactcggcatgatcttctgccgtacgttactttgaagcggcggcgcgccgtgtgtcccgatctcgtcgataagtatcttgaagaaaccagcatcagatacgttacgccacgcgctctctcagacccggagccaaggcccccccagccttctaagaccgtccctccccactatccagtggtgtgctgtccaacctccggcccgcaaatgtgctctaagcgacccgcgcgagggcgagccactctgggttcccagcggaagcgcagaaagtctgtcacaccagaccccaaggagaagcagacatgcggggaagaggtgcaaggatttcagcgttggtctcgcctggagggggagtacaaagagttactggggcattgggctgtttatgctattcagtatatccgtctcagagtacgggcggagtattgtcagcacgagacagccctccagggcaacgtgttcagcaacaagcaggaccctctggagaggcagtttgaaaggttcaatcaggctaatactatcctcaagagcagagatctagggtctatcatctgtgatataaaattttcagagctgacatacctggatgccttttggcgggattacataaacggcagtttgctcgaagcattaaaaggagtctttatcaccgactctctcaaacaagccgtgggccacgaagctatcaaactgctcgtgaatgtcgatgaggaggattatgagctggggcgccagaagctgctgaggaatctcatgctacaggctttaccttag

SEQ ID NO: 184993 - DNA, 957 bp, Artificial Sequence
  Description of Artificial Sequence: Synthetic coding sequence
atggccggcctgaagcggcgggccagccaggtgtggcccgaggagcatggagagcaggaacatggtctatacagcctacacagaatgttcgacatagtcggtacacatttaacacacagggacgtgcgcgtgctttcctttctgttcgtagatgtcattgacgaccatgagagagggctgatcagaaatggccgggatttcctgctggctcttgaacgccaggggagatgtgacgaatcaaacttccggcaggtgcttcagcttttgaggatcatcacacggcacgacctgttaccctacgttacccttaagagaaggcgagctgtgtgccccgacttagtcgataaatatctcgaggagacttccataaggtacgtcaccccacgagcactgtcagatcccgaaccacggccccctcagccgtctaaaaccgtccctccccattacccggtcgtgtgctgccccaccagtggtccccagatgtgttctaagcggcctgcacggggacgcgcaaccttggggagccagcggaagcgcagaaaatccgtgacacccgaccctaaagaaaaacagacctgcgatatccgattaagagtgagggcagagtattgtcagcacgagacagcactccagggaaatgtgttcagtaataaacaggacccacttgagaggcaattcgaacgattcaatcaggccaataccatactgaagtcccgggacctcggctcgatcatttgcgacattaagttcagcgaattaacctatcttgatgctttttggcgagattatatcaatggctcgttgttggaagccctaaaaggggtctttattactgatagcttgaagcaagccgtgggacacgaggcgattaaactacttgtaaacgtggatgaagaggactacgaactcggcagacagaaattgcttaggaacctgatgctgcaggccctgccttag

SEQ ID NO: 184994 - DNA, 1047 bp, Artificial Sequence
  Description of Artificial Sequence: Synthetic coding sequence
atggccggcctgaagcggcgggccagccaggtgtggcccgaggagcacggtgaacaggaacatggactgtactctcttcaccgcatgttcgatatcgtgggtacccacctgacccatcgggacgttagagtgttgtctttcctgtttgtggacgtgattgacgatcatgaacgaggcctgatacgtaacggacgcgattttttgttagccctggaaagacaggggcgttgcgatgagagcaacttccgccaggttctgcaactgctaagaattatcactcgccatgacctccttccttacgtcacgctaaagagaaggcgcgccgtgtgtcccgatctcgtggataaatatttagaagaaacttctatcagatatgtcacccctcgcgcactgtccgaccccgagccgagacccccgcagccctccaagacggtcccaccacactaccccgttgtgtgctgtcccaccagcgggccccagatgtgctctaaaaggccagcccgcggccgggctacactgggatctcagcggaaacgcagaaagtccgttactccagatccgaaggaaaagcaaacctgcggggaagaagttcagggcttccagcggtggtctcggctggaaggcgaatataaagagctcctgggccactgggccgtgtacgctattcagtatattcgcttgcgggtgagggctgagtactgccaacacgaaaccgctctgcaaggcaatgtcttttccaacaagcaagaccccctggagcggcagtttgaaaggttcaaccaggcgaatacgattctgaagtctcgcgacctgggaagtataatttgcgatattaagttctctgagctgacttatttggacgctttttggcgcgattacattaacggtagtttgttggaagccctgaagggggtattcattactgactccctgaagcaggcggtcggacacgaggctatcaagctcctggtaaacgtcgacgaagaagactacgagttgggccgacaaaagcttttaaggaacctgatgctgcaggccctgccttag

SEQ ID NO: 184995 - DNA, 957 bp, Artificial Sequence
  Description of Artificial Sequence: Synthetic coding sequence
atggccggcctgaagcggcgggccagccaggtgtggcccgaggagcacggggaacaggagcatgggttatattccctgcatcgcatgttcgatattgtggggacgcatctcacccatagggacgtccgggtacttagcttcttgttcgtcgacgtgatcgacgaccatgagaggggtctgatccgcaacggtcgggacttcctgcttgctctggagcgccagggtcgctgtgacgaatccaatttcagacaggttctacagttgctccgcattattacccgccatgatttactgccatacgtcacccttaaacggagaagagccgtatgtccagacctggtggataagtaccttgaggagacatccatccggtatgtcacccctcgagcactgagcgatcctgagccacggccgcctcagccttccaagacagtaccaccacattatccagtggtctgctgtccaacttctggaccgcagatgtgtagtaaacggccagctagagggagggccactcttggttcacagagaaaacgtcgaaagtccgtgacacctgatcctaaggaaaagcagacctgcgacatccgcctgcgggtcagggcggagtactgtcaacatgaaaccgccctgcagggaaatgttttttccaacaagcaagacccactggagcgacaattcgagcgattcaaccaggctaatacgatcctcaaatcccgggacctgggatcaatcatttgcgacattaaattttcagaactaacctatttagacgcattctggcgcgattacatcaacgggagtctgcttgaagctctgaaaggcgtgttcatcacagactcactcaagcaagccgtcgggcacgaagcaattaaattactcgtgaacgttgacgaagaagattatgagctcggcagacagaaactgttaaggaatctcatgctgcaggccctgccctag

SEQ ID NO: 184996 - DNA, 828 bp, Artificial Sequence
  Description of Artificial Sequence: Synthetic coding sequence
atggccggcctgaagcggcgggccagccaggtgtggcccgaggagcatggggagcaggagcacggcttatacagtctgcatagaatgttcgacattgtgggaactcatctaacccaccgggatgtgcttcagctactccgcatcattactcgccacgatctactcccatacgtgacactcaagcggcggcgggccgtatgccctgatcttgtggataagtatctggaagaaacctctataagatatgtgacccctagggccctcagtgacccagaaccccggcctccccaaccttccaaaacagtgcctccacattacccagtggtgtgttgtccaacgtcagggccgcagatgtgctcgaagcgtcccgcacgtggccgtgctactctgggcagtcagaggaaacggaggaagtcggtaacccctgatcccaaagaaaaacaaacctgtgacatccgcctgcgtgtgcgcgctgagtactgccaacacgagacagccctgcagggtaatgtgtttagcaacaaacaggatccccttgagaggcagtttgagcggttcaatcaagccaatacaattttgaaaagtcgggatctcggctcgatcatttgcgatatcaaattttcagagctcacttacctggacgcattttggagagactatattaatggctctttactggaagccctgaaaggcgtgtttattaccgattcactaaaacaggctgtgggtcacgaagcaatcaaactgctcgtaaacgttgacgaggaggactatgaactgggtcggcaaaagttgctgcgcaacctaatgctgcaggcgctgccttag

SEQ ID NO: 184997 - DNA, 957 bp, Artificial Sequence
  Description of Artificial Sequence: Synthetic coding sequence
atggccggcctgaagcggcgggccagccaggtgtggcccgaggagcatggggagcaggaacatggactgtacagtctgcatagaatgtttgacatcgtgggcacacatctgacccaccgagacgttagggtacttagctttttgtttgtggacgtgatagatgatcacgagcgcggactgattcggaacggacgcgatttccttctggcacttgagcgccaggggagatgcgatgagtccaacttcaggcaagttctacaactgctgcggattataactcgccatgacttgcttccgtacgtgaccctgaaacgcagacgcgctgtatgccctgacttggtggacaaatacctggaggagacctccatccgctacgtcacaccgcgcgccttgtcggatccggaacctagacctccacagccctctaaaacagtgcctccccactacccggtcgtctgttgccccacgtctgggcctcaaatgtgtagcaaaagacctgctcggggaagggctaccctgggatcccagaggaagagacgtaagtcggttacccctgatccaaaagagaaacagacctgtgacatccggctgagggttcgcgccgagtactgtcaacacgaaactgctctccagggcaatgtcttctctaataaacaagaccccctggaacgccaattcgagagatttaaccaggccaataccattctgaaatctagagacctaggctcaataatttgcgatattaaattctcggaactcacatacctggacgccttttggcgtgattatattaacggttcgctactcgaggcactcaagggcgtgttcattacggattcgctgaagcaagcagtcgggcacgaggctatcaagctgttagtgaacgttgatgaagaggattatgagctgggacgacagaagctgctgaggaatcttatgctgcaggccctgccatag

SEQ ID NO: 184998 - DNA, 957 bp, Artificial Sequence
  Description of Artificial Sequence: Synthetic coding sequence
atggccggcctgaagcggcgggccagccaggtgtggcccgaggagcacggagagcaggagcatggtctctattcattgcaccggatgttcgatattgtaggaacccatttgacgcaccgggatgtgagggttttgagcttccttttcgttgacgttatagatgatcatgagcgcggactgatcaggaatggacgcgactttctgctggcccttgagcgtcaagggcgttgcgacgaatctaatttccgtcaagtgctccagttgttgcgcattataacccgccatgatctgctcccgtacgtgacactcaaacgccggagggctgtttgcccagacctggtggataaatatctcgaagaaactagcatcagatatgttacacctcgagcgttgtccgatccagaaccacggccaccccagccatcgaagaccgtcccgccacattacccggtggtgtgctgccctacatcaggtccacaaatgtgtagcaagagacctgcgcgggggcgagcgacgctaggctcacagcggaaacggaggaaaagtgtcacccccgatcccaaagaaaaacagacctgtgacattaggctgagggtgcgcgctgagtattgccagcacgaaacggccttgcagggcaacgtattttctaataaacaggacccactcgaacgtcagttcgagcggtttaatcaggccaacaccatcctgaagtcgcgcgatctcggctccataatttgcgatatcaagttctctgagctgacttacctcgatgccttttggcgggactacattaacggctccttattagaagccctgaagggagtcttcataacagatagcttgaaacaggctgtcggccacgaagctataaaacttctggtcaatgtagatgaagaagactacgaactgggtagacagaagctgctgagaaacctcatgcttcaggccctgccttag

SEQ ID NO: 184999 - DNA, 1917 bp, Artificial Sequence
  Description of Artificial Sequence: Synthetic coding sequence
atggacctgtggcagctgctgctgaccctggccctggccggcagcagcgatgccttcagcggctctgaagccaccgcggccatcttgagccgcgctccttggtcactgcaatcagtcaatcccggacttaaaaccaattcttctaaggaacctaaattcaccaagtgccgcagccccgaaagagagacattctcttgtcattggacagacgaagtgcaccacggcactaagaatcttggaccaatacaactgttttacactagacgcaatacccaggaatggacacaagagtggaaggagtgtcccgattacgtgtccgccggggaaaatagctgctacttcaactcatcgtttactagcatctggattccctattgtatcaagcttacttcaaatggcggcactgtcgatgagaagtgtttttccgtggacgagatagtgcagcctgatccccccattgccttgaactggaccctgttaaatgtatcactgactggcattcatgccgatattcaggttcgatgggaagcaccgagaaacgccgatattcaaaaaggttggatggtgctggagtatgagcttcagtacaaggaagtgaatgagaccaaatggaaaatgatggatcccattctcactacatccgtgcctgtatactctcttaaggtggacaaggaatacgaagttcgagtcagatcaaaacagcgcaactctggtaattatggagagttttccgaagtcctgtacgttacacttccccagatgagccagttcacctgcgaggaggatttctactttccctggctcctcatcataatttttgggatctttggcctaacggtgatgttgttcgtgttcttattttccaagcagcagcggattaaaatgttgattctgcccccagtgcccgtacctaaaataaagggtattgatcctgacctgctgaaagaaggcaaattggaggaggttaacaccattctggccatccacgatagttacaagcccgagtttcatagcgacgacagttgggtcgaattcatcgagctggacatcgatgagccagacgaaaagacagaggaatctgacactgatcggctgctctcatcagaccatgaaaagagccactctaacctcggagtcaaagatggtgattccggtcgtacatcatgctgtgaaccggatattctcgaaactgacttcaatgctaacgatatccacgagggaacttcagaggtcgcccagccgcaaaggctgaagggtgaggctgatcttctgtgcctcgaccagaagaatcagaacaacagtccgtaccatgatgcgtgtccggccactcaacaaccttccgtcattcaggccgagaaaaacaaacctcagccattgcccaccgagggagcagagtcaacccaccaagcagcacatatccaactgtccaatcccagctccctctctaacatcgatttctacgctcaggtgagcgacatcacacctgctggaagtgtcgttttaagccctggtcaaaagaacaaagcaggaatgtctcagtgtgacatgcacccagaaatggtctctctgtgtcaagaaaacttcctgatggataatgcttacttttgcgaagcggacgccaagaagtgtattcccgtggctcctcacatcaaagtggaaagccatatccagccctctcttaaccaggaggatatctacataacaaccgaaagcctcactaccgcagctggacgcccaggtacaggcgagcatgtgcccgggtctgagatgcctgtgccagactacacgagcatccacattgtgcaatcccctcagggtctgatactgaacgcaacggcgctcccactgccagataaagagttcctgtcatcctgtggttacgtgtccacagaccagttaaataaaattatgccttag

SEQ ID NO: 185000 - DNA, 1113 bp, Artificial Sequence
  Description of Artificial Sequence: Synthetic coding sequence
atgttccaggccagcatgcggagccccaacatggagcccttcaagcagcaaaaggtggaggatttttacgacatcggcgaagaactaggaagcggacaattcgctatcgtcaagaagtgtagagaaaagtctaccggcctagaatacgccgctaagttcataaaaaaaaggcaatccagggccagccgcagaggggtctcacgtgaagagatagagagagaagtatctatccttaggcaggtgctgcaccataacgtcataaccttgcatgacgtctacgagaaccgaaccgatgtggtcctgatccttgagctggtttcgggcggggagctgtttgactttttggctcagaaagagtccctttcggaggaggaggctacctcctttattaaacaaattctggacggtgtcaactatctgcacactaaaaagatcgcacactttgacctgaaaccagaaaatattatgctgcttgataagaatattcccatacctcatatcaaactgatagacttcggactcgcgcacgagattgaggatggagtggagttcaaaaacatcttcggcactcctgagtttgttgcaccagaaatcgtgaactatgaacccttggggcttgaagctgatatgtggtccatcggagtcattacttatatacttctgtcaggcgcttcacccttcttaggcgatacgaagcaagagaccctggccaatattaccgctgtttcttatgacttcgatgaggagttctttagccagacgagcgagctcgccaaggatttcatccgcaaattgctggtcaaagagacacggaaacggctcaccatacaggaggccttaagacatccctggattaccccagtagataaccagcaagctatggtccggagggagtcagtcgtcaacctggaaaacttcaggaagcaatacgtcagacgcagatggaaattgagcttttcaatcgtatcactgtgcaaccatctgacacggtcactgatgaagaaagtacatctccgccctgacgaggatcttaggaactgcgagagcgatactgaggaggatatcgccaggcgaaaggcgttgcatccccggagacgatcttcaacctcttag

SEQ ID NO: 185001 - DNA, 1113 bp, Artificial Sequence
  Description of Artificial Sequence: Synthetic coding sequence
atgttccaggccagcatgcggagccccaacatggagcccttcaagcagcagaaggtagaggatttctacgacatcggagaagagcttgggtcaggtcaatttgcgatagtgaaaaagtgtagagaaaagagcacaggattagagtacgctgcaaaattcattaaaaagaggcagagtcgggcctctcgacgcggtgtttcccgggaggagattgagagagaagtctcgattctgagacaagtgcttcatcataacgtaattactctgcacgacgtttatgagaaccgtaccgatgtggttctaatcctggaactagtatcaggaggagaattatttgattttctggcccagaaagaaagtctctcagaggaagaagccacgtcattcataaaacagattctggacggcgtcaactatctgcataccaaaaaaatcgctcacttcgacctgaagcccgaaaatatcatgctgctcgataaaaacatacccatccctcacattaagctcatcgatttcgggcttgcccacgagatcgaagacggagtggagtttaagaatatcttcggtacgccagagtttgtcgccccagagatcgtgaactatgaacccctaggtctggaagctgatatgtggagtattggtgttatcacttatatactcctgtctggcgcctcgcccttcttgggcgatacaaagcaagagacactggcaaatataacagcggtgtcctacgactttgacgaggaattctttagccaaacttccgaactcgccaaagatttcattaggaagctgttggtgaaggaaacccgcaagcgtctcactatacaggaagcactgagacatccttggattacgcctgtagacaatcaacaggccatggtgcgacgtgaaagcgtggtgaatctcgagaattttcggaaacagtacgtacgacgtcgctggaaactctctttttctattgtttcactgtgcaatcatctcacgcgaagtctgatgaaaaaagtgcacctccgccctgacgaggacttgcgtaactgtgagtctgatacagaagaggacattgcacggcggaaggcactgcaccccagacgaaggtcctccacctcttag

SEQ ID NO: 185002 - DNA, 246 bp, Artificial Sequence
  Description of Artificial Sequence: Synthetic coding sequence
atgttccaggccagcatgcggagccccaacatggagcccttcaagcaacaaaaggtcgaggatttctacgatattggtgaagagttgggatccggacagtttgcaattgtgaagaagtgcagagaaaaaagcactggcttagaatatgctgccaaatttattaagaagcggcagtcccgcgcctcaagaaggggcgtgtctagagaggagatagagcgcgaagtgagcattcttcgccaagtctag

SEQ ID NO: 185003 - DNA, 2223 bp, Artificial Sequence
  Description of Artificial Sequence: Synthetic coding sequence
atggccaccgccaacagcatcatcgtgctggacgacgacgacgaggatgaggcagcggcgcaaccaggcccaagtcatcccttgccaaatgccgcatctcccggagcggaggcaccttccagtagcgagccccacggcgcccgcggctcatcttctagcggcgggaagaagtgttataagcttgagaacgaaaagctgttcgaggaattcctcgaactgtgcaagatgcagacagcagatcacccagaggtggtgccttttctgtacaatcgccaacaaagagcgcacagtctgtttcttgcttcagctgaattttgtaatatcctgtcacgtgtattgagtagggcaaggtctaggccagccaagttgtatgtttatattaacgagctttgcaccgtcctgaaggcgcactcggcaaagaagaagctcaatctcgcgccagcagcgactacttcaaacgaaccctcgggcaataaccctcccactcacctatcacttgacccgaccaatgcagagaataccgccagccagtcccccagaacacgtggatcacgccggcagattcagagacttgagcagttgctggcgctgtacgtggcagagattagacgcttgcaagagaaagaactggatctttcagaactggacgacccggactccgcttacctgcaggaggcgcgtttaaaaagaaagctgattcgcttgttcgggagactctgtgaactgaaagactgctcctccttgacagggcgggtcatcgagcagagaattccataccgaggtaccagatatcccgaagtgaacaggagaatcgagcgcctaattaacaagccgggccctgacaccttccctgactacggggatgtactgcgggccgttgaaaaagctgccgctaggcactccctggggttgccgcgccagcagctccagctgatggcccaagatgctttcagggatgttgggattcgtcttcaggaacggcgccacctcgacctgatctataacttcggctgtcacttgaccgatgattacaggcccggcgtagacccagcgctgagcgaccctgtgttagcccgacggctgagggagaatcgcagtctcgcaatgtcgcggctggatgaagtgattagtaaatatgctatgctgcaggacaaatcagaggaaggagaacggaagaagcgccgagctaggctccagggaacatcaagccattcagccgatactccagaagccagcctcgacagcggcgaaggcccaagtggtatggccagtcagggctgtccgtccgcctcccgggccgagacggatgatgaagacgatgaggaaagtgatgaagaggaggaggaggaagaggaggaggaggaagaagaggccaccgactctgaagaagaagaggatctcgaacagatgcaagaaggacaggaagatgatgaggaagaagatgaggaggaggaggctgccgccggcaaggatggagacaagagtcctatgtcttctttgcagatctccaacgagaagaatctggaaccagggaagcagatttccaggtccagcggcgagcaacagaacaagggtcgcattgtctccccctccttgctgagcgaagaacctctggccccatctagcatagatgcagaaagcaatggagagcagccagaggaactcacattggaggaggagtctcccgtctctcagttgttcgagctagaaatcgaggccctcccgcttgataccccgagctctgtggagaccgatatcagctccagtcggaagcagtcggaggagccgtttactacagtgctggaaaacggagccggcatggtctccagcaccagctttaatggtggtgtgtctccacacaactggggggactctggcccgccatgcaaaaagtcaagaaaggagaagaaacagaccggatccggtcccctggggaattcttatgtcgagcgccaaagatccgtgcatgaaaaaaatgggaaaaaaatctgcactctgccctctcctccctcacccctggcaagcctggcccccgtggctgactcgtccacccgtgtggattcaccatcacacggtctggtgacatccagcctgtgcatcccgagcccagcgcggcttagccaaaccccgcatagccagccacccaggcccggcacatgtaaaacatctgtggcaacacagtgtgaccctgaggagatcatagttcttagtgactccgactag

SEQ ID NO: 185004 - DNA, 2223 bp, Artificial Sequence
  Description of Artificial Sequence: Synthetic coding sequence
atggccaccgccaacagcatcatcgtgctggacgacgacgacgaggacgaagcagccgctcaaccaggcccatcacaccctctgccgaacgcagcttcgccaggggcagaggctcccagctcctccgagcctcacggggctcgcgggagctcatcaagcggcggcaaaaagtgctacaagctagagaacgagaaactcttcgaggagtttttggagctgtgcaaaatgcagacagccgatcatcccgaggtggtgcccttcctgtataatcgacagcagagagcgcatagcctgtttttggctagcgctgaattttgtaatattctttccagagtccttagtcgtgcccggtcacggcctgcaaagctttacgtatatataaacgagctgtgtacggtgctgaaggcacacagcgccaaaaaaaagcttaacctcgcccccgccgcaaccacaagcaatgaaccttctggaaataaccctccaactcacttatccttggaccctacgaacgctgaaaacaccgccagccaaagcccccggacacgtggttctaggcggcaaattcagcgactggaacaattgctcgccctttacgttgccgaaattcgccggctccaggagaaagagctcgatttatccgagctggacgatcctgattccgcctatttgcaggaagccaggctgaaacgaaaactgatcagactcttcgggagactgtgtgagttgaaagactgcagttccttaactggaagggtgatcgaacagcgcataccatatagggggactcggtaccctgaggtaaaccggagaattgaaagactgattaataagcccggcccagacacttttcccgattacggcgatgttctgagagcagtggaaaaagctgctgcacgccattcccttggcttgccacgacagcagttgcaattaatggcccaagacgcttttcgcgatgtcggcatccgactccaggagcggcgtcatctagatctcatctataacttcggttgtcatttgactgatgactaccgcccaggtgtcgatcccgccctcagcgacccagtactcgcccgccggctgcgagaaaacagatctttagccatgtctcggcttgatgaagtgattagcaagtacgctatgttgcaagacaaatctgaagagggagagaggaaaaagcgaagagccaggctacaaggaacttcctcccacagcgctgatactcccgaggccagtcttgactccggcgaggggccctccggcatggcttcgcagggctgtccatcagccagtcgcgcggagactgacgatgaagatgatgaagagtccgacgaagaggaagaggaagaggaggaagaagaagaggaagaagccacagattccgaagaggaagaagaccttgagcaaatgcaggaggggcaggaggacgatgaagaggaggatgaagaggaggaggctgctgctgggaaggacggggacaaaagcccaatgagctctctgcagattagcaacgagaaaaaccttgagcccgggaagcagattagtcgcagctctggtgaacagcagaacaagggaaggattgtgtccccatctctcctaagcgaggagccgctggccccctcctccatagacgcagaaagtaatggtgagcagcctgaagagcttaccctcgaggaagagtctccagtcagtcaactattcgagttggagatagaggcattgccgctcgacacacccagctctgtggaaactgatatctcaagttctagaaagcagtcagaggaacccttcacaaccgtcctggaaaacggggctggaatggtctcaagcacaagcttcaacggtggggtgtcccctcataattggggagactccggtcctccatgcaagaagtctcggaaggaaaagaagcagacaggctctggacctttgggaaactcatacgtcgagcgccagcgatcagtgcatgaaaaaaacggaaagaaaatatgtaccctaccaagccctccttctcccctggccagcctcgcccccgtggctgactcgagcacacgagtcgatagcccctctcacggcctagtcactagttctctctgcatcccttcaccagctcgcttgagtcagacaccacattcccagccgccacgccctggcacctgtaagaccagcgttgctactcagtgtgaccctgaggagatcattgtcctgagtgattctgactag

SEQ ID NO: 185005 - DNA, 2223 bp, Artificial Sequence
  Description of Artificial Sequence: Synthetic coding sequence
atggccaccgccaacagcatcatcgtgctggacgacgacgacgaggatgaggcagctgcgcaaccaggtccctcgcaccccctgccaaacgctgcatcaccgggcgccgaagctccttcttcatctgaaccacacggcgcccgagggagcagttcaagcggaggaaagaagtgctacaagctggagaacgagaagctgttcgaagaatttctggagctgtgcaaaatgcaaactgccgaccatccagaagtggttcctttcttgtacaatcgccagcagagagcacactcactgtttcttgcttccgccgaattctgcaacatcctttccagggtgctgtctagggccagaagccgcccggctaaactctacgtttacattaatgagttatgcaccgtgcttaaggcgcatagcgcaaaaaaaaaactaaatttggcccccgccgctaccacttctaacgagccgagcgggaataacccacccacacatctctccttggaccctacaaacgccgaaaatactgctagccagtcacctcggacacgcgggtctagaagacaaatccagcggctggagcaactgcttgcactctacgtggctgagatcagacggcttcaagaaaaagagctggacctctctgaactggatgatccggattccgcctatctgcaggaggcgcgccttaaaagaaaactgatacgcctgttcgggcgcctgtgcgaactgaaggactgctcttctcttacaggccgagtgatcgaacagcgcattccgtatcgtggcacccggtaccctgaggttaacagaaggatcgaacggctgatcaataaacccggaccagatacgttcccggattacggcgacgtccttagggccgttgagaaggccgcagcacgacattcattaggcctcccgagacagcagttgcagctcatggcccaagacgccttccgggacgtgggaatccgcttacaggagcggcgacacctggaccttatttacaactttggttgccatctgaccgacgattatagacctggcgtggaccctgccctttcggacccggtgctcgcaaggcggctcagggagaatcgttccctagctatgagcaggttagatgaggtcatctctaaatatgcgatgttacaggacaagtccgaagagggggagcggaagaaacggcgcgcccgcctgcagggtaccagttctcattccgctgacaccccagaggcttctctcgacagtggcgaaggcccgagcggcatggcctcacaaggttgtccctctgctagccgcgcagaaacggacgacgaggacgacgaggaaagtgacgaagaggaggaggaagaggaggaagaggaggaagaggaggccacagactcagaggaggaggaggacctggagcagatgcaggaagggcaagaggacgatgaggaagaagacgaagaggaggaagcagcagccggcaaggacggcgacaagagccctatgagctctcttcagataagcaatgaaaagaacttggagcccggcaaacagattagccgatcatctggagaacaacagaacaaaggcagaatagtgtcaccaagtctgctctcagaggaaccattggccccaagttccatcgacgcggagtcaaacggcgagcaacccgaagaactgacactcgaggaggagagccccgtgtcccagttgtttgagctcgagatcgaagctctccccttggatactccaagttcagtcgagaccgacatctcttcaagccgcaagcaatcagaggagcccttcaccactgtgcttgagaatggagctggaatggtgagctccactagtttcaacgggggggtttccccccataattggggcgatagcgggcctccgtgcaaaaaatctcgtaaggagaagaaacagaccgggtctggtcccctgggtaactcttacgttgaaaggcaacgctcagtgcatgaaaagaacgggaaaaagatttgcactctccctagtccaccctcacccctggcttcactggctccagtggcagactccagcacccgcgtggactcccccagtcacggcctagtgacttccagcttatgcatcccctctccggcgcggctgtctcagacacctcactctcagccacccaggccaggcacttgcaagacctctgtcgcgactcagtgcgaccccgaggaaatcattgtccttagtgatagcgactag

SEQ ID NO: 185006 - DNA, 2223 bp, Artificial Sequence
  Description of Artificial Sequence: Synthetic coding sequence
atggccaccgccaacagcatcatcgtgctggacgacgacgacgaggatgaagccgctgcccagcccggacctagccaccccctgccaaatgcagcaagcccgggggcagaggccccgtcaagctccgagcctcacggggcccgcggatcatcctcctctggtggcaaaaagtgctacaaattggaaaatgagaagctgtttgaagagtttctggagttatgcaagatgcaaacagcagaccacccggaggtggtgccattcctatataatcggcagcaacgcgctcattccctgttcctcgcctcggccgaattctgtaatattctctcgagagtcctatccagagccagatcccgccccgctaaactgtatgtgtatataaatgagctgtgtactgtcctgaaggcccactccgcaaagaagaagctgaacctggctccagctgccaccacatcaaatgagcccagtggaaacaacccacctacccatcttagcttggacccaaccaacgcagaaaacacggctagccagtcgccacggactaggggttctaggcgccagatccagcgcctcgaacaactgctggccctttacgtcgctgagatacgacgcttgcaagagaaggagcttgacctatcggaactcgacgatcctgatagcgcatacctccaagaagcacgacttaaaagaaaactaatacgactttttggacgcctctgtgaactcaaggactgtagcagcctgaccggaagagtgattgagcagagaattccttatcgcgggacaaggtatcctgaggtcaaccggaggattgaaaggctgatcaacaaacctggacccgacaccttcccagactacggggacgtcctcagggctgtggaaaaggcagcagcccgccatagtctggggctgcccagacagcagctgcagttgatggcccaggacgcctttagagatgtgggcattaggttgcaggaaagaagacatttagatctcatatacaactttggctgtcatctgaccgatgattatcgacctggagttgatcctgccttgagcgatcccgtgctcgcccgccggctgagagagaaccgctcactcgccatgtcccggctggacgaggtgatttccaagtacgccatgctccaggataaaagtgaggaaggcgagagaaagaaaagacgcgctagactgcagggtacatcatcccatagcgccgatacccctgaggctagtctagactcaggagaaggcccttcaggcatggcatctcagggatgtccatccgccagtagagccgaaaccgacgatgaggacgatgaagaaagcgacgaggaggaagaagaggaagaagaggaggaggaggaggaggccaccgactctgaagaagaagaggacttagaacaaatgcaagagggacaggaggacgacgaggaggaggatgaagaggaagaggccgcggctggcaaagatggagacaaatcgcccatgagttccctgcagattagtaatgagaagaatctcgagcccgggaaacagatctctagatcttccggggagcagcagaataaaggacggatcgtctcaccctccctgctctcagaggaaccacttgcaccaagcagtatagacgccgagtccaatggagaacagccagaggagctgactcttgaggaagaatctccagtgagccagctttttgagctggagatcgaggcactaccgcttgataccccctcgtccgtggagactgacatatcctcctctagaaaacagtccgaagagccatttaccactgtcctcgaaaacggcgcgggcatggtatcctctacatcgtttaacggtggcgtttctccgcacaattggggggactcaggtcccccttgtaagaaatctcgcaaggagaagaagcagacaggctccggtccactgggcaattcctacgtagagcgacagcgatctgtgcacgagaagaatggcaaaaagatatgcacattaccttcccccccatcccccctcgcatccttggcccccgtagccgactcgagcaccagagttgattcaccttctcacggcctggtgacctcttcgctctgcataccatctcccgcaagacttagccaaacgccccactcacagccgcctcgccccggtacatgcaagacctctgttgccacacagtgcgatcctgaagagatcatagtcctgtccgatagcgactag

SEQ ID NO: 185007 - DNA, 393 bp, Artificial Sequence
  Description of Artificial Sequence: Synthetic coding sequence
atggccaccgccaacagcatcatcgtgctggacgacgacgacgaggatgaagccgctgcacagcctgggcccagccacccgctcccgaatgcagcttcccctggtgcggaagccccatcttcttctgagccacacggcgcaaggggcagcagttctagtggggggaagaaatgttacaagctggagaacgagaaattgtttgaagagttcctcgagctctgcaagatgcagactgctgatcaccccgaagtagtccccttcttatacaaccgccagcaaagagctcacagtctgttcctggcaagcgctgagttttgtaacatcctctcccgcgtcctttctagggctagatccaggccagccaagctctatgtatacatcaacgaattatag

SEQ ID NO: 185008 - DNA, 147 bp, Artificial Sequence
  Description of Artificial Sequence: Synthetic coding sequence
atggccaccgccaacagcatcatcgtgctggacgacgacgacgaggatgaggctgcagcccagccagggccttctcatcccctgccgaatgcagcgtcacccggggccgaggcaccaagcagctcagaaccgcacggggctcggtag

SEQ ID NO: 185009 - DNA, 393 bp, Artificial Sequence
  Description of Artificial Sequence: Synthetic coding sequence
atggccaccgccaacagcatcatcgtgctggacgacgacgacgaggatgaggccgccgcccagcctggtccatctcatccgttgccaaatgccgccagcccaggcgcggaggcgccgtcttcctctgagccgcacggggcacgcggctcctcgtcctccggcgggaaaaaatgttacaaacttgagaatgagaagcttttcgaggaattcctggaactgtgcaagatgcagaccgcagatcacccggaggttgttcctttcctctacaacaggcaacaacgcgcccacagtctgttcctggctagtgcagagttctgtaacattcttagcagagttctctcacgcgcaagaagccggcctgcaaagctgtatgtctatataaatgagctctag

SEQ ID NO: 185010 - DNA, 147 bp, Artificial Sequence
  Description of Artificial Sequence: Synthetic coding sequence
atggccaccgccaacagcatcatcgtgctggacgacgacgacgaggatgaggccgctgctcaaccaggtccaagccaccccctaccaaacgctgcgtctcctggagcagaggccccttcttcaagcgagccacatggagcgagatag

SEQ ID NO: 185011 - DNA, 537 bp, Artificial Sequence
  Description of Artificial Sequence: Synthetic coding sequence
atggccaccgccaacagcatcatcgtgctggacgacgacgacgaggacgaagcagctgcccagccaggccctagccatccgctacccaatgccgcttcacccggggccgaggctccgagctctagtgaaccgcacggcgctcgtggcagcagtagcagcggcggcaagaaatgttacaaactggagaatgagaaattattcgaggagtttctagagttgtgcaaaatgcaaacagccgatcatcccgaggtggtcccctttctgtataatcggcaacaacgcgcccactctctgtttttggcctctgctgagttttgcaatatcctgtcaagagtgctgtcacgggccagatcgagacctgctaagctgtacgtatatatcaatgagctgtgtacggtgctgaaagctcactctgctaagaaaaagctcaacctggcacctgctgctacaaccagtaatgagccaagcggaaacaacccgccaacgcacctcagtctggatcccacaaacgccgaaaataccgctagtcagagctag

SEQ ID NO: 185012 - DNA, 537 bp, Artificial Sequence
  Description of Artificial Sequence: Synthetic coding sequence
atggccaccgccaacagcatcatcgtgctggacgacgacgacgaggacgaggctgccgcccagccaggcccaagtcaccccctaccaaacgctgcctctcccggggcggaagccccaagctcctccgaaccccatggcgcccggggcagttcttcctccggagggaagaagtgttacaaactggagaacgagaagcttttcgaggagttcctagagctctgtaaaatgcagaccgccgaccaccccgaggtcgtgcccttcctatacaatcggcaacaacgtgcacattctctgttcctagcctccgccgaattctgcaatattctgagtagggtgttgtcccgtgcccgaagtaggcccgccaaactctatgtgtatattaacgaactgtgcactgtgctgaaggcccactctgccaagaaaaagctgaacttggctccagccgccaccacatcaaacgaaccaagcgggaacaatccccctacccatctcagtttggaccccacgaatgcagagaacacggcctcccaatcatag

SEQ ID NO: 185013 - DNA, 2223 bp, Artificial Sequence
  Description of Artificial Sequence: Synthetic coding sequence
atggccaccgccaacagcatcatcgtgctggacgacgacgacgaggacgaagcagcggcccaaccaggaccaagccaccccctcccgaatgcggccagccctggtgcagaagcaccgtcctctagtgagcctcatggtgcccgggggtcttcaagctcgggcggaaagaagtgctataagctagagaatgagaagctatttgaggaatttcttgagctatgtaaaatgcagactgccgaccaccccgaagtagtccctttcctgtacaaccgccagcagagagctcactcactcttcctggcctcggccgagttctgcaatattctttctcgagtgctctctagggctcggtcccgccccgcaaagctgtacgtgtacattaatgagctgtgcaccgttctgaaggcacactcagccaaaaaaaagctcaacctggcccctgccgcaacaaccagtaacgaaccttccggcaacaacccccccacccacctctctctggacccaactaacgccgagaatacggcgtctcagagtcctaggactagaggcagccgtcgacagattcagcgcctcgaacagctgttggccctttatgtcgcggaaattcgaaggctgcaagagaaagaacttgatctttccgaacttgacgatccggactctgcatatttgcaggaggctaggctcaagagaaagctcattaggctgtttggccgtctgtgcgaactgaaggactgttccagtctaaccgggagggttatagagcagcgtatcccttacagagggacgcgctatcctgaggttaataggcgcatcgagaggctgatcaataagcctggcccagatacgttccctgactatggcgacgtgctgagagcggtcgaaaaggctgcagctcgtcactcacttgggctgcctcggcagcagctgcagctgatggcacaagacgcctttagggacgtaggcattcgtctccaggagagaagacacctggatttgatctacaatttcgggtgccacctgacggatgactatcgccccggtgtagatccagctctctctgatcctgttcttgcacgaaggctgagagagaaccgcagtttggctatgtctcgccttgacgaagttatcagtaagtatgcgatgttgcaggacaaatcagaagaaggcgaaagaaaaaagcgccgggctcggctgcaggggacgagctcccatagcgcggacacgcccgaggcatcactcgacagtggtgagggcccgagtggcatggcaagtcaggggtgtcccagtgcctcaagagctgagacagatgacgaagacgatgaagaatcggatgaggaagaggaagaagaggaggaagaagaggaagaggaggccacggatagcgaggaagaagaggacctagagcagatgcaagagggccaggaagacgacgaagaagaggacgaggaggaagaggccgctgcggggaaagacggggataaaagcccgatgtcgtccctccaaatctcaaacgagaagaatctcgaacctggcaaacagatctcacgctcatcaggcgaacaacagaacaaaggtcgcatcgtctccccgtctctgctttctgaggagccactcgcaccctcctcaatcgacgctgaaagcaatggggagcagcctgaagagctgacccttgaagaagagagccccgtgtcccaactgttcgaattggagatagaagcactaccactagatacccctagcagcgtcgaaacagacatatctagcagtagaaagcagagcgaggaaccatttacaacagtgcttgagaacggggcaggcatggtcagttcgacctccttcaatggaggcgtcagcccacacaattggggtgactctgggcctccttgtaaaaagagccgtaaggaaaagaagcagactggttccggtccactggggaactcttatgtagaaagacagcggagcgtgcacgagaaaaacgggaaaaagatttgtactctgcctagtccaccctcccccttggcgagccttgccccagtcgcggattcatccaccagagtggatagcccatcacacggcctcgtcacaagctccctctgtatcccctcacctgcacgattaagtcaaacaccacattcacaaccaccgaggcccggcacttgcaagacaagcgtggccactcagtgtgacccagaggaaatcatcgttctgtccgactctgactag

SEQ ID NO: 185014 - DNA, 2223 bp, Artificial Sequence
  Description of Artificial Sequence: Synthetic coding sequence
atggccaccgccaacagcatcatcgtgctggacgacgacgacgaggacgaggcagccgctcaacccggaccgagtcaccctctgcccaatgcagccagccccggcgctgaagctccctcctctagcgagcctcatggcgctagggggtcttcctccagcggcggcaagaaatgctacaagctggagaatgaaaaattatttgaggagttcctggagctgtgtaaaatgcagactgctgaccacccagaggtggtccctttcttgtacaacagacagcagagagctcacagcctgttcctggccagtgcagaattttgtaatattttgagtagggtcttgtctcgggcccggtcgaggccagcaaagctttacgtctacataaacgaattgtgcacagttctgaaagcgcactctgcaaaaaaaaagctcaatctagcaccagcagcaaccacttccaatgagccctcaggcaataacccccccacccacttgagccttgaccccactaatgcagagaacaccgcatcacaaagcccacgcacaagaggtagccggcgccagattcagcggcttgagcagctcttggctctctatgtcgccgagattaggcgcctgcaagaaaaggagctggatctgtctgagttagatgacccagactcagcctacttacaggaagcccgcctgaagcgtaagctcatccgcctcttcgggaggctgtgcgaactgaaggactgttccagcctgacgggccgggtgatcgagcagaggattccatacagaggcacccgataccccgaagtcaaccgaaggatcgaacggctgatcaacaagcctggtcccgatacgttcccggactatggggacgttctgcgcgcagtggagaaagccgctgcccgtcactctttaggcctgcctcgacagcagctccaactgatggctcaggacgccttccgggacgtgggcattaggcttcaggaacgcaggcatttggatttaatatataacttcggatgccatctgactgacgactacagaccgggggtggatcctgctctgagtgaccctgtgttggcccggagactgcgtgaaaatcgatcactcgctatgtcacggctcgatgaggttatctccaaatatgccatgctccaagataagagtgaggagggagagcgcaaaaagcggagagcccggttacagggcacatccagtcacagcgcagacactccggaggcatctctggacagtggggagggtcccagtggcatggctagccaggggtgcccttcagcaagtcgcgccgagacagatgatgaggacgatgaagagtcagatgaagaagaagaggaagaggaggaagaggaagaagaggaggcgaccgactcagaggaggaagaggatctcgaacagatgcaggagggccaagaagacgacgaagaagaagacgaggaagaagaagcggccgccggcaaggatggcgataagtcccctatgtcatccctgcagatctctaacgagaaaaacctcgagcctggcaagcagatctccagatcttccggtgaacagcagaataaggggcgcatcgtttccccatccctgctgtccgaggaacctttagctccctcttcaatagacgctgagagcaatggggagcaacccgaggagctcacactggaagaggaaagtcctgtcagccagctattcgaactggaaatagaggccctgccccttgacacccctagctccgtggagaccgatatctcgagtagtcgcaagcagtcagaggaaccctttaccacagtgctcgagaatggggctggaatggtgtcatccacctctttcaatggtggagtctccccacacaactggggagatagcgggccgccttgcaaaaaaagtagaaaagagaagaagcagacagggtccgggcctctgggcaatagctatgtggaaaggcagagatcggtccatgagaagaacggaaaaaagatttgtactctcccttctcccccatcaccactggcctctcttgctcctgtggctgatagttcaactagggttgactctccaagccatggactggtaaccagttctctgtgcattcccagtccagctaggctgagtcagaccccacattctcagcctcctcggcccgggacttgtaaaacctcagttgctactcagtgtgacccagaggagattatagtccttagcgattcagactag

SEQ ID NO: 185015 - DNA, 393 bp, Artificial Sequence
  Description of Artificial Sequence: Synthetic coding sequence
atggccaccgccaacagcatcatcgtgctggacgacgacgacgaggatgaggccgcagcccagccaggcccatcacacccgctgcctaatgctgcaagtcccggcgccgaggctccatcatcctccgaacctcacggggcacgggggagttccagcagcggcggcaaaaagtgttataaacttgagaacgagaagttatttgaggaatttctagagctgtgtaagatgcagaccgccgaccatcccgaagtggtgccatttctctacaacagacagcaacgggcacattcactgttcctcgccagcgccgaattttgcaatattctgagtagagtactatcgcgcgctcgatcccgcccagctaagctgtacgtgtacatcaatgagctgtag

SEQ ID NO: 185016 - DNA, 537 bp, Artificial Sequence
  Description of Artificial Sequence: Synthetic coding sequence
atggccaccgccaacagcatcatcgtgctggacgacgacgacgaggacgaagcggctgcccagcctgggccctctcaccctcttcccaacgcagcttcaccaggagctgaggcccctagttcctctgaacctcacggtgctcgcggctctagcagtagtggcggtaaaaaatgttacaagctggagaatgagaaattattcgaagagttcttggaactctgcaagatgcagaccgccgatcaccccgaagttgtgccattcttatataacagacagcaaagagctcatagcctctttctcgcctctgcggagttttgtaatatactctcccgagtcctgagccgcgcacgatctagaccagcgaaactgtatgtctacataaatgagctgtgtaccgtactgaaggcccattctgctaagaagaagctaaatctcgctcctgcagcaacaacatctaatgaacccagcggtaataacccacccactcaccttagcctggatccaaccaatgcggagaatacggcgtcgcagagctag

SEQ ID NO: 185017 - DNA, 2223 bp, Artificial Sequence
  Description of Artificial Sequence: Synthetic coding sequence
atggccaccgccaacagcatcatcgtgctggacgacgacgacgaggatgaagctgctgctcaaccaggtcccagccaccctctccctaacgccgcgagtccaggggcggaggctccctcctcttctgagccccatggagcccgggggtcttcttcaagtggcgggaaaaagtgttataaactggagaacgagaaactcttcgaggaatttctggagttgtgcaagatgcaaacagccgaccaccccgaagtggtgccgttcctgtacaaccgccagcaacgtgcacactccctttttttggcatcggctgagttctgcaacatacttagccgcgtcctctcacgagccaggtcaagacccgccaaactctatgtgtatattaatgagctctgtaccgtcttaaaagcccacagcgcaaagaagaaacttaatctcgctcctgcagccaccacttcgaacgagccctcaggcaataaccccccaacccacctgagcctcgatccaacaaatgccgagaacacagcgtcccagtctcctcgtacccgggggtctaggaggcagatccagcgactggagcaactactcgcattgtatgtcgcagagattcgcagacttcaagagaaggagctggatctgtccgagctggacgacccggactctgcataccttcaggaggccagattaaagaggaaattgatcaggctgttcgggagactatgcgagctcaaagactgtagctctctgacaggacgggtgatagaacaacgcataccctacagaggtactaggtatcctgaggtgaaccgaagaatagagaggctgatcaacaaaccaggaccagatactttcccagattacggagacgttctgcgggccgtagaaaaggccgctgctagacattccctcggactgcctcgacagcagctccagcttatggcccaagatgcattccgcgatgttggtatccggctgcaggaacgccgacatctcgatttgatttacaacttcggatgccacctgacagacgactacagaccaggcgttgatcccgccctctccgatcccgtgctggcacgacgcctcagagaaaaccggtctctagccatgagtaggctggacgaggtcatttccaagtatgccatgctgcaagataagtctgaagaaggagaaagaaaaaagcgcagggccagactgcaaggtacaagcagtcactctgctgatacacccgaagcctccctcgacagtggcgagggaccctcaggtatggcgagccaagggtgtccctcagcatccagagctgaaaccgacgatgaggacgacgaggaaagcgacgaggaggaagaggaggaagaagaagaggaagaggaggaagccacagactccgaggaggaggaggatctcgagcagatgcaagaaggtcaggaggacgacgaggaagaggacgaagaggaagaagctgccgctggtaaagacggagataagtctccgatgtccagcttgcagatttccaacgagaagaatctcgaaccggggaaacagatcagtcgtagcagtggtgagcagcaaaataagggaagaatcgtttcccccagccttctttccgaggaacctctggcgccctcgagcattgatgccgagtctaatggagagcagcctgaggagctcactctggaggaggaatccccggttagccagctattcgagctggagattgaagcactgccgttagacacaccttcttctgttgagactgatatctcttcgagccgcaagcagtcagaagagccatttacgaccgtgcttgaaaacggggccggcatggttagttccacctcatttaatggcggtgtgagcccccataattggggagattccggccccccttgcaaaaagagccgaaaggagaagaaacagacaggctccgggcctctgggcaattcctacgtggaaaggcagcgatccgtccatgagaaaaacggaaagaaaatctgtactttgccaagccctccaagccctcttgccagcctggcccccgtcgcggactcaagcacgcgagtggacagtccatcccacggcctggttacttcctccctctgtattcctagtccagcgaggctgtcgcagaccccccactcgcaaccaccccgcccgggtacctgcaagacgtctgtcgctacccagtgcgatcccgaagagatcatcgtgctcagtgattcagattag

SEQ ID NO: 185018 - DNA, 147 bp, Artificial Sequence
  Description of Artificial Sequence: Synthetic coding sequence
atggccaccgccaacagcatcatcgtgctggacgacgacgacgaggacgaggcggctgcccagcccggccctagtcacccacttccaaatgcagcgtcacccggggctgaggccccctctagctcagagccccatggagctaggtag

SEQ ID NO: 185019 - DNA, 393 bp, Artificial Sequence
  Description of Artificial Sequence: Synthetic coding sequence
atggccaccgccaacagcatcatcgtgctggacgacgacgacgaggacgaagccgccgcccagcctggccccagccaccctttacctaacgctgctagcccaggagcagaggccccttctagctcagaacctcacggagccagaggatcaagtagcagcggcggcaagaaatgctacaagttagagaacgagaagctgttcgaagaattccttgaactatgcaagatgcaaacagcagaccaccccgaagtggtgcctttcctgtataacaggcaacagcgcgcccactctttgttcctggcttccgctgagttttgcaacatcctctccagagttctgtcccgggcgagatcgcggcccgccaagctctatgtctacattaatgagctgtag

SEQ ID NO: 185020 - DNA, 537 bp, Artificial Sequence
  Description of Artificial Sequence: Synthetic coding sequence
atggccaccgccaacagcatcatcgtgctggacgacgacgacgaggacgaggccgcggcccagccaggaccttcacacccattacctaacgcggcaagtcccggagctgaggctccatcgagctcagaaccacacggggcgagggggagtagtagctctggaggcaagaagtgctacaaactggaaaacgagaaactgttcgaagaatttctggagctgtgtaaaatgcagaccgctgatcaccctgaggttgtcccgttcctctataaccgccagcagcgggcccactcactgtttctggcctccgctgaattttgtaacatactgagcagagtactatccagagccagatctagacccgcaaagttgtatgtgtacataaatgaactgtgtactgtcctcaaagctcatagtgcaaagaaaaaactgaatctcgcccccgctgccaccaccagcaatgagccttcaggcaacaaccctccaacacacttgtccctggacccaaccaacgccgaaaacactgccagtcagagctag

SEQ ID NO: 185021 - DNA, 2223 bp, Artificial Sequence
  Description of Artificial Sequence: Synthetic coding sequence
atggccaccgccaacagcatcatcgtgctggacgacgacgacgaggacgaggcagccgcccaaccaggcccatctcacccactgccaaatgccgcatctcccggcgctgaagccccgtcaagctctgagccccacggcgccagaggttcctctagttccggaggcaagaagtgttacaaactggaaaacgaaaaactcttcgaagagttcctggagttatgtaaaatgcagactgccgaccaccccgaggtggtccccttcctctataaccggcagcagagagctcatagtctgttcctggcatccgccgaattttgcaatatcctctcgcgagtgctgtcccgggccaggtcacgcccggccaaactctatgtttacattaatgagctgtgtacagtactgaaggcccactcagccaagaagaaattgaacctggcccctgcagccaccacatcgaatgagccatctggaaataatcccccaacgcatctgtccctcgatcccactaacgctgaaaataccgcgagccagtcacccaggacacggggatccaggcggcagatacaacgcctggaacaactgcttgcactctacgttgcagagatacggcggctgcaggaaaaagaactggatctgtctgagctggacgatccggactctgcttacctccaagaggccagattgaagaggaaacttataaggctcttcggccggctttgcgagttgaaggattgttccagcctgaccgggagggtgatcgaacagcggatcccctatcgaggtactcgttaccccgaggttaatagacgtatcgaaagactgattaacaaaccagggccggatacttttcccgattacggggacgttctgagagcagttgaaaaggctgccgcccgccatagtctaggacttccccgccagcaactacaactgatggcccaggacgcctttagagacgttggtatcagactgcaggaaagaagacatctggatctaatatacaacttcggctgccatctcacagatgattacaggcctggagtggatcccgctctcagtgatccagtgcttgccaggcgcctgcgcgaaaaccgcagtttagcaatgagccgccttgatgaggttataagtaagtacgccatgctgcaggataagtccgaagagggcgaacggaagaagaggcgcgcccggctgcaaggaacctcaagccattcagctgacacccctgaggctagcctcgatagcggggagggaccatctggcatggcctcacaaggatgcccaagtgcaagccgtgccgagaccgatgatgaagatgacgaggaatctgatgaggaagaggaggaggaggaagaagaagaagaggaggaggctactgactccgaagaggaggaggatctagaacaaatgcaagaagggcaagaggacgatgaggaagaggatgaagaggaggaggccgcagcaggcaaagatggcgacaagtctcctatgagttccctgcagatctctaacgaaaagaatcttgagcctggtaaacagatatcccggagctctggagaacaacagaacaagggccgcatcgtttccccctctctgctgtccgaggaacctctcgctccctcatcgatcgacgctgagtcaaacggagagcaacctgaggagctgaccctggaggaagagtctccggtctcccagctgtttgagttagaaatcgaggctttgcccctggatacccccagttccgtggagactgatatttcctcaagtcggaaacagtcagaggaaccgttcacgaccgtgttggagaatggcgcgggcatggtctccagtacaagttttaatggcggcgtgtcccctcataactggggggatagcggtcccccctgtaagaagtctaggaaagagaaaaaacagaccgggagcggtccactggggaatagttacgtagagcgacaacgatccgttcatgagaagaacgggaagaagatatgcaccctcccctcgcccccgagcccccttgcaagtttggcaccagtcgctgacagcagcacgcgcgtggattccccctcacatggattggtaacttcttccctgtgcatccccagtcccgcccggctctctcaaactccgcattcccagccccccaggccagggacttgtaagacttccgtggccacccagtgtgacccagaggaaatcattgtcttaagtgattcagactag

SEQ ID NO: 185022 - DNA, 147 bp, Artificial Sequence
  Description of Artificial Sequence: Synthetic coding sequence
atggccaccgccaacagcatcatcgtgctggacgacgacgacgaggatgaggccgccgcccagcctggaccttcccacccattaccaaacgctgcctctccaggggcggaggcaccctctagcagcgagcctcatggtgcacgatag

SEQ ID NO: 185023 - DNA, 1998 bp, Artificial Sequence
  Description of Artificial Sequence: Synthetic coding sequence
atgcagaccgccgaccaccccgaggtggtgcccttcctgtacaacagacagcagcgtgcacacagtctgttcctcgcctcggcagaattctgcaacatcttatctagagtactcagccgggccagatccaggcccgcgaaactctatgtgtatatcaatgaactgtgtacggtgcttaaagcacactctgcaaagaaaaagctgaacctggccccagcagcaacaactagcaatgaaccatcaggtaacaaccctcccactcacttaagcctcgaccccaccaacgctgaaaacaccgctagccagtcacctcgaacgaggggaagcagaagacagattcagcgactagaacagttgctggcactgtatgttgccgagatccgccgcttacaagagaaggagctggatctgtctgagctggacgatcctgatagcgcttacctgcaggaggcaagacttaagcgcaagctgatcaggttgttcgggaggctgtgtgagctcaaggactgttctagtctgacaggcagagtaattgaacagcggatcccttaccgcggtaccagatatcctgaggtcaaccgccgtatcgagcgattgatcaacaaacctggccctgatacattccctgattacggcgatgtgctgagagccgtggaaaaggccgctgctagacatagtctcgggttgcctcgccagcagttacagttgatggcccaggacgcctttagggacgtgggaattcgactccaggagcgaagacatctggacctgatttataacttcggatgtcatctgactgatgactacaggcctggagtggacccagccctaagcgacccagtgctggctcgccggctacgcgagaacagaagcctggccatgtctcgcttggatgaagtaatttcgaaatacgcgatgttacaagataagtccgaagagggggagcggaagaagcggagggccagactccagggaacctcttctcattcagcagacacaccagaggctagtctggatagtggagagggtccaagtggtatggccagtcaaggatgcccctcagcctcccgagctgaaacagatgatgaggatgacgaagaatcagatgaagaggaggaggaggaggaggaggaggaggaggaggaagcaacagactccgaagaggaggaggatctggaacagatgcaagagggacaagaggatgatgaggaagaggacgaagaggaggaagctgctgccggtaaggacggtgacaaatcaccaatgagcagtcttcaaatcagcaatgagaagaacctcgagcctgggaagcaaatttctagatcatccggcgaacagcagaataaggggcgcatcgtcagcccatcactgctttccgaggagcctttggctccctccagcatcgacgctgaatctaatggagaacagcctgaggaattaacactcgaggaggagtcgcctgtgagtcagttatttgagctcgagatcgaggctttgcccttggacacaccatcgtccgtggaaacagacattagcagcagcagaaaacagagcgaagagccattcacaacggttctggagaatggggccggcatggtttccagtaccagttttaatgggggggttagtccccataactggggagattctgggcccccctgcaagaaatcgcggaaggaaaaaaaacaaacaggaagtggaccactgggtaattcttacgtggagcgccagcggagcgtgcatgaaaagaacggtaagaaaatttgcactttaccctcccccccgagcccccttgccagcctcgcgccagtagcagactccagcactagagttgatagtccctctcatgggcttgtcacttcaagtttgtgcatcccgtcccctgcaaggctttcgcagaccccccatagtcagcctcccaggccagggacttgtaaaacttccgtcgccacacaatgtgaccccgaagagatcatcgttctgtcagattctgattag

SEQ ID NO: 185024 - DNA, 1998 bp, Artificial Sequence
  Description of Artificial Sequence: Synthetic coding sequence
atgcagaccgccgaccaccccgaggtggtgcccttcctgtacaaccggcagcaaagagcgcacagcctgttcttggcatccgcagagttctgcaacatcctgtctcgggtgctctcaagagcacgctcgagacccgcaaagctatatgtgtatatcaacgaactttgtaccgttctgaaggcccacagcgcaaaaaagaaactgaacctggccccagcagccacaacaagtaacgaaccttcaggaaacaatccccccactcatcttagtctggatccgactaatgcggaaaataccgcatcacagtctcccaggacccgaggtagtcgtaggcaaatccagaggctggaacaattacttgccctctatgtggccgaaattcgacgccttcaagagaaggaactcgaccttagtgaacttgatgaccctgactccgcctacctgcaagaagcccgcctcaaacgaaagttgatcagactgttcgggcgactctgtgagcttaaagattgttccagcctcacgggccgcgtgatagagcagcgcatcccctatcgagggacacgttacccagaggtgaaccgcagaattgagcggctgatcaataagcccggcccggataccttcccggattacggggatgtgctgcgggcagttgagaaggccgcggcacgacatagcctcggcctcccccggcaacagctgcagctgatggctcaggacgcctttagagacgtcgggatacgtttacaggagagacggcacctggacctgatttataactttggctgccatcttaccgacgactatcgcccaggcgtagaccctgctctttcagatccagtcctcgccaggagattgcgtgagaaccgctctttggctatgagccggttagacgaagtgatctcaaagtacgccatgcttcaagataaatccgaggagggggagagaaaaaagcggagagcgcgtctgcagggcacctcgtcacacagtgcagacacccccgaggcatctctcgatagcggggaaggccccagtggcatggcgtctcagggttgtccaagcgccagtcgagccgagactgatgacgaagatgacgaagagtcggacgaggaggaagaagaggaggaagaggaggaggaggaagaagccacagactccgaggaggaggaagacctggagcagatgcaagaaggacaggaggatgacgaggaggaggatgaagaggaggaggccgcagcaggcaaggacggggacaaatctcctatgtcttcgttacaaataagcaatgagaaaaatctggagcccggtaagcagatctccagatcttctggggagcagcagaataagggccggatcgtcagcccctcacttctctcagaagagccgctggctccaagcagcattgatgccgaaagtaacggtgagcagcccgaagagctgaccctggaagaggagtcccccgtgtcccagctcttcgagctcgaaattgaggcactgcctctggatacgccatcatccgtggaaaccgacattagctcctcacgaaaacaatctgaagagcctttcacaaccgtgctcgagaatggggctggaatggtgagctctaccagctttaatggcggcgtgagtccccataattggggcgatagcgggcccccttgtaagaaaagccgaaaggagaaaaaacagacaggaagcggaccactcgggaattcctatgttgaacgccagagatctgtccacgaaaagaacggtaaaaagatctgtacgctcccgtctccccctagtcccctggcttcccttgctcctgtagctgacagctctactagggttgattcaccatcacacggacttgttactagctccctttgtatcccatctcccgctaggctgagtcagaccccgcactcccagccacctcgccctggcacttgcaagacatccgtggctacacaatgcgatccagaagagatcattgtgctgtcagattctgattag

SEQ ID NO: 185025 - DNA, 1998 bp, Artificial Sequence
  Description of Artificial Sequence: Synthetic coding sequence
atgcagaccgccgaccaccccgaggtggtgcccttcctgtacaacagacagcagcgagcccactcgctgttcttggccagtgcagagttttgcaacatcctatcccgcgtcctgtctcgcgctaggagcagacctgccaagctgtacgtttacattaatgagctttgtactgtcctcaaagctcacagtgctaaaaaaaaactgaatcttgccccagctgccactaccagtaacgagccatctggcaataatcccccaactcatctgtcgctcgatccaaccaacgcagagaatactgccagccagtcgcccaggacacggggatcaagacggcagatccagagactggagcagctgctagctttgtatgttgccgagatccgtcgcctccaggaaaaggagcttgaccttagcgaactggatgaccccgactccgcatatctgcaagaagcacgcctgaagcggaagctcatcaggcttttcggccgtttgtgcgaattgaaagactgttcaagcctgactggacgagtcattgaacagaggattccctaccgggggacacgctatccagaagttaaccggcggattgagaggcttattaataaaccaggcccagacacgtttcccgactatggggacgtgctgcgagccgtggaaaaggctgctgcaaggcactccctgggtctccctagacaacagctacaacttatggcccaggatgcctttagggacgtcgggatacggttgcaggagaggagacatctcgaccttatctacaactttggatgccaccttacggacgattaccgacccggtgtggatccagcactttccgaccccgtgctcgcccgacggctacgcgaaaataggtccttggccatgagtagactggatgaggtgatctctaagtatgccatgctgcaagacaaatccgaagagggggagcgcaagaagcgcagagcgaggctgcagggcacaagtagccactcagccgacactcctgaagcgagcctagactctggcgaggggcctagcggcatggcttctcagggatgtccatccgcctctagagcagagacagacgacgaggacgatgaggagagcgatgaggaagaggaggaagaggaggaagaagaggaggaagaggccacagactccgaagaggaggaggaccttgaacaaatgcaggaagggcaagaagatgacgaggaagaggacgaggaagaggaggctgcagcgggaaaagatggggacaaatctcccatgtccagtctgcagatttccaacgaaaaaaaccttgagccaggcaagcagatctctcgctcctccggcgagcaacaaaacaaaggccgcatcgtttcaccatcgctcctctctgaagagccgctggccccgtcaagtattgatgcagagagcaacggggagcagcccgaggaactcacccttgaggaggagagccccgtgagtcagctgtttgagttagaaattgaggcgttacctttagacaccccctctagcgtggagacggatatttctagcagtcgcaaacagagcgaagagccttttacgacggtgctagagaatggtgccggaatggtgtctagcaccagctttaatggaggggttagtccacacaattggggagactcaggtcccccatgcaagaagagtaggaaagagaagaaacaaactgggtcaggtcccttaggcaactcatacgtcgaaagacagcgatccgtacacgagaagaatggcaagaagatctgtactctgccatctccaccttcaccgctggcaagcctggctccggtcgccgactcctctacgcgcgtcgattctccttctcatggcctggtaacttcctctctgtgtataccctcccctgccaggttgtctcagactccacattcccagccacctaggcccgggacttgtaagacctcggtggctacccagtgcgatcctgaggaaatcattgtgctgtctgattcagattag

SEQ ID NO: 185026 - DNA, 1998 bp, Artificial Sequence
  Description of Artificial Sequence: Synthetic coding sequence
atgcagaccgccgaccaccccgaggtggtgcccttcctgtacaaccgtcaacagagagcccactccctgttcctcgcttcggcggagttctgtaacatcttgagccgagtcctgtccagggctcggtcccgccccgcgaaactgtatgtgtacataaacgaactctgtactgttctgaaggctcactcagctaagaaaaaactgaacctcgcccccgcggccacgacttctaatgagccgagtggcaataatcctccaactcacttgagtctcgaccccaccaacgcagaaaacacggcctcccagtctcctagaactagagggtcccgccgccaaatacagcgtctcgagcagctgcttgccctgtacgtcgcagaaatcaggcgtcttcaggaaaaagagttagacctttccgagctcgacgacccagattccgcctacctgcaggaagcaagactgaagagaaaactcatcaggttatttgggagattgtgtgaactaaaggactgttcatcactcacagggagggtgattgaacagaggataccataccgcgggactcgctacccagaagtaaacagacggattgaaaggctcattaataagcctggtcctgacacattccctgactacggtgatgttctccgtgccgtggaaaaggccgctgcacgccactcacttgggctgcctcgacaacagctgcaactgatggctcaagacgcgtttagagatgtcgggataagactccaggaacgacgccatttggatctcatttataactttggttgtcatctcaccgatgactatcggcctggggtcgatcccgcccttagcgatcctgtgctcgcacgcaggctaagggagaatcgatctttggctatgagccgactcgatgaagtcatttctaaatacgccatgctccaggataagagtgaggagggggagaggaagaaacggagggccagactgcagggaacctcttcccacagcgccgacacccccgaggcaagcctggacagtggcgaaggccccagtggtatggcatctcagggatgcccaagcgcaagccgcgcggaaacggacgacgaggacgatgaagagagcgacgaggaagaggaagaagaagaagaggaagaagaggaagaagcaacagattccgaagaagaggaggatcttgaacagatgcaggagggtcaggaagatgatgaggaggaggatgaggaggaggaagcagccgcaggcaaggatggcgataaaagccctatgagttctctccaaatctctaacgagaaaaatctagaaccgggaaaacagatctctcggtcatccggcgagcagcaaaacaagggcaggattgtgagcccctccttactttcagaagaacctctggctccttcttcaattgacgcagaatcaaacggcgaacagccagaggagttaacattagaagaggagtcaccagtgtctcagctgttcgagctcgaaatcgaagcactccctctggacacccccagctctgtcgagactgacatttcctcttcccgtaaacagtccgaggagcccttcaccactgtccttgaaaatggcgctggcatggtgtcaagtacctcctttaatggtggcgtctcgccacacaactggggggacagcggacctccttgcaaaaaaagccggaaggaaaagaaacaaacaggaagtggacctttagggaactcatacgttgaacggcagagatctgtccatgagaaaaatggtaaaaagatctgtacactccctagccccccctcccccctagcttcactggctcctgttgcggacagttctacacgtgtggatagtccttctcacggattagtgacctcatctctctgtattccttctccggctcggctgtctcagaccccacattctcaacctccacgacccggaacttgcaaaacttccgtggctacccagtgcgaccctgaagaaattatcgtcctcagcgacagcgattag

SEQ ID NO: 185027 - DNA, 1080 bp, Artificial Sequence
  Description of Artificial Sequence: Synthetic coding sequence
atgaaggccaccatcatcctgctgctgctggcccaggtgagctgggcagggccattccagcagaggggtctcttcgatttcatgctggaggacgaagcttctggaattgggcctgaggttccagatgatcgggacttcgaacccagcttgggacctgtgtgcccattccgatgtcagtgccatttacgcgttgtgcaatgcagcgacctaggcctcgataaggtccctaaggatctgccccctgataccactctgttagatttacagaataacaaaattacagagataaaagacggcgatttcaaaaatctcaaaaatctgcatgctctgatcctggtcaataacaaaatttctaaagtgtctcccggcgctttcactcctttggtaaagctcgaacggctctatctctccaagaaccagttgaaagagttgcccgaaaagatgcccaagacacttcaggagttgcgggcccacgaaaatgaaattactaaagtcagaaaggtcacctttaatggcctgaatcagatgatcgtgatcgaattaggtaccaaccccctaaagagcagcggcatagaaaatggagccttccaagggatgaaaaagctgagttacatccgcatcgccgatacaaatattacaagtataccacaagggttgccccccagtttgacagagctccatttagacgggaacaagatctcgcgggtggatgccgcaagcctgaaaggactgaataacttagcaaagctcggtctttcttttaatagtatctctgccgtggacaatgggtcactggccaacaccccacacttacgtgagctgcacctggataataataagctgactcgggtacctggaggcctggccgagcacaagtacattcaggtggtgtatcttcataacaataacatatccgtggtaggttctagcgatttttgcccaccagggcacaacacaaaaaaggcttcttactccggagtttccctattctccaatccggtccagtattgggaaatccagccttccacattcaggtgcgtgtacgtccgcagcgcaatacagctcggcaactataagtag

SEQ ID NO: 185028 - DNA, 7092 bp, Artificial Sequence
  Description of Artificial Sequence: Synthetic coding sequence
atgcccgtgctgggcgtggccagcaagctgcggcagcccgccgtgggctccaagcccgtccacaccgcactccccattccaaatctgggaacaaccggctcacagcattgctcatctcgcccgttggagctgacagagacagaatcttcgatgctgagctgccaacttgctctgaaatccacctgtgagttcggagaaaaaaagcctctgcaggggaaagccaaggagaaggaggatagcaaaatttatacagactgggcaaaccactacctggccaaaagcggacacaagagactaattaaagatctccagcaggacatcgcagacggggtcctcctagcagaaatcatccagatcatcgccaacgaaaaagtagaggacataaatggctgtccgcgcagccagtcacagatgatcgagaacgtggacgtctgccttagtttcctggctgccagaggggtgaatgtgcagggcctcagtgccgaagaaattaggaacggaaatctgaaggcaatacttggactattcttctctctgtccaggtacaagcagcaacagcatcatcagcagcagtactaccaatccctcgtggagctgcaacagagagtgacccatgctagcccaccctctgaagcatcccaggccaaaacgcagcaggacatgcagtcatccctggctgcaagatacgccacccaatcgaaccattctggaattgctacaagccaaaagaaacccacacgtttgccaggaccatcccgagtcccagcagcgggtagctccagcaaagtccagggagcttcaaatctgaatagaagatctcaaagcttcaatagtatcgacaaaaataaaccacctaattatgccaatggcaacgagaaagattcatccaaggggcctcagtcatcaagcggcgtcaatggaaatgtgcagccaccttcaacagccggacaacctccggcctcagctattccttccccttccgcctccaaaccatggcgctccaaaagcatgaacgtgaaacacagtgccacctctacgatgttgaccgttaaacagagctcgacagccacctccccaaccccttcgagcgatcgcctgaaaccacctgtcagcgagggggtgaagacagccccctccggccaaaaatctatgctggagaaatttaagctggttaacgcccgaacggctttgcgcccccctcagcctccttcatcagggccctcggatggcggtaaagatgacgatgccttctccgagtccggcgagatggaggggttcaatagcggtttgaattccggggggagcactaatagctcgcctaaggtgtcccccaagttagctcctcccaaggcggggtctaagaatctgtctaacaaaaagtcactactccaacccaaagagaaggaggaaaagaaccgcgataaaaacaaggtctgtacagagaagcctgtgaaggaagaaaaagatcaggtcacagagatggcaccaaagaagacaagcaagattgcctctctgatcccaaaaggtagtaagaccacggccgcgaagaaagagagcctgattccctcttctagcgggattccaaagccaggttcaaaagtgccaacagtcaaacaaaccatctcgccagggtccactgcttctaaggaatctgaaaagtttagaaccacaaaaggcagtcccagtcaaagtttgagcaagcccatcacgatggagaaggcaagcgcttctagctgccccgctcctctcgaaggtcgcgaagccggacaagcttccccaagcggaagctgtactatgaccgttgctcaaagctccggccagtctaccgggaacggcgcagtgcaattaccccaacaacaacaacatagccacccaaataccgcaaccgtggcaccctttatatatcgagcccattccgaaaacgagggcactgccttgccttccgccgacagctgtaccagcccaacgaagatggacctgagctactctaaaaccgcaaaacagtgcttagaagaaatatcgggggaagacccagagacacgcaggatgcgcaccgtaaagaatatcgccgacctccggcaaaatttggaggaaacaatgtcctccctgcgcggcactcaaatatcccattccaccctggagaccacattcgactccacagtcacgacggaggtaaatggcagaaccatacctaatctgacctcccggccaacgccgatgacctggcgcttaggtcaggcttgcccccggctccaagcaggcgatgcaccatctttgggcgccggctatccacggagcggcacaagtcgattcatacataccgatccctcacgtttcatgtacaccacccctctccggagggctgccgtctcccgactcggcaatatgtcccagattgacatgtctgaaaaggcctcttctgacctggacatgtccagcgaagtcgacgtgggcggttatatgtcagacggcgacatcctgggaaagtccctacgtaccgacgacattaactccggttatatgacagatggtggactgaacctctataccaggagtctgaatagaattcccgacactgctaccagccgcgatatcatccaacgaggcgtacacgacgtcaccgtggatgctgactcctgggatgattccagctcagtaagtagcggcctaagcgacaccttggacaacatctcaactgatgacctgaatactacttcttcagtgagctcttactcgaacatcactgttcccagcagaaagaatacacagttgcgcactgacagtgagaaaagaagtaccacagacgaaacttgggactcgcccgaggaactgaagaaacccgaagaagatttcgacagccacggcgacgctggcggaaagtggaaaaccgtatcctcgggcctgccagaggatcccgagaaagccgggcagaaagctagcctttcagtgtctcagacgggctcctggagaaggggcatgtctgctcagggcggcgccccaagtagacagaaggccgggactagcgcactgaagacacctgggaaaacggatgatgcgaaagcttccgagaagggcaaggccccccttaaaggtagtagcctgcagcggtcgcctagtgatgccggtaagtccagcggagatgaagggaagaagcctccatccgggataggaaggtccacagccacatcctccttcggattcaagaagccatccggagtaggcagtagcgccatgattacgagcagcggcgcgacaatcacttccggtagcgctaccttggggaaaatccctaagtcagccgccatcggcggcaaatccaatgcagggcgcaaaacaagcctcgacggttcacagaatcaggatgatgtcgtgctgcacgttagctctaaaacaactcttcagtataggagcctgccacgaccatctaaaagctcaaccagcgggattcctggccggggcggtcataggtctagtacgagcagtatcgattccaacgtgtcttccaaatcggccggcgcaaccacaagcaaactgcgtgagcctaccaagattgggtcaggtcggagtagccccgttacagtcaaccagacagataaagagaaggaaaaagtagcagtttccgactccgagtcagtgagcctttctgggtctccaaagagctcccctacatcagccagcgcctgtggtgcacagggactgagacagccaggttcaaagtaccctgacatcgcgagcccaacatttcgcaggttgttcggtgcaaaagccggggggaagtccgccagcgccccaaatacagaaggtgtgaagtcttccagtgttatgccctcccctagcaccacattggctcgacagggatccctcgagtctccgtcatctggcactggcagcatgggctccgccgggggtctgagcggatcttcctcaccattgttcaacaaaccatctgacctgaccaccgatgtgatatcactgtcccatagcctggcgtcgtccccagcttcggtccattcgttcacatctggcggcttagtgtgggctgccaacatgtcgagctcttcagcgggctccaaagataccccatcctaccagtcaatgaccagcctgcacactagcagcgaatcgatcgatctgcccctttcccatcacgggtcactctccgggctcaccaccggaacgcacgaggttcagtctctcctgatgcgtaccgggagcgtacggtccacactctcggaaagcatgcagctcgaccggaacactctgcctaagaaagggttgcgctacacgccatctagtaggcaggccaatcaggaggaaggaaaagagtggctgaggagccactctaccggtgggctccaggacaccgggaaccaaagccctctcgtgtccccctccgccatgagcagttccgctgccggcaagtatcatttctctaatctggtgtcacccacaaacctatcccagtttaacctgcctggaccatctatgatgcgctcaaacagtatcccggcccaagattcctcatttgacctctatgatgactcacagctgtgtggatccgccacaagtctggaggaacgaccgcgagccatctcacatagtggcagtttcagggactcgatggaagaagtccatggatctagtctctcccttgtgtcctcaacaagtagtctatattcaacagctgaggccgggggcagcctggagcagattcacaagctccggcgggagctggttgcttcccaagagaaagtggcgactttgacatcccagctcagcgccaatgcgcacctcgtcgcagcctttgagaagagtttgggaaacatgactggccgcttgcagtccctgactatgacagccgagcagaaggaatctgaactgatagaactcagggaaacaattgaaatgctgaaggcacaaaactctgctgctcaggctgccatacagggggcactgaatgggccggaccatccaccgaaagacctaagaatacggcgccagcactctagtgaatccgtgagcagcattaactctgcgacctcacacagctcaatcggaagtggaaacgacgccgactctaaaaaaaagaaaaaaaagaattgggtgaatagccggggtagtgagcttcgcagttcatttaaacaggcattcggtaaaaaaaagtcgaccaagcccccaagctctcacagcgatattgaggagttaaccgatagcagcctccccgcgagcccaaaactgccacacaacgctggggattgcgggtcagcatctatgaagccatctcaaagtgcctctgccatttgtgagtgcaccgaagctgaagcagagatcattctgcagctcaagtccgaactcagagaaaaggaattaaaactgacagacatccgactggaggcgctctctagcgcgcatcacctggaccaaataagggaagccatgaaccgtatgcagaacgaaattgaaattttaaaagccgaaaatgaccgactgaaggccgagactggcaacactgccaaaccaactcgacctccgtccgagtcttctagcagtaccagcagcagttccagccgacaatctctcggcttaagcttaaacaacttgaacataaccgaggcggtgtcaagcgacattctgctagatgacgctggagatgctactgggcacaaggacggtcggagcgtgaagatcatcgtgtccattagcaaaggttatgggcgggctaaagatcaaaaaagtcaggcatacctcatcggatctatcggagtatctggcaagacaaaatgggatgtcctcgacggggttatacgacggctgtttaaggaatatgtatttagaatcgacacatctacctctctgggactgtcgagcgattgcatcgcctcttactgcatcggcgacctcatcagaagtcacaacctagaggtgccggaacttctgccttgcgggtatctggtaggggacaacaacatcattaccgttaatctaaaaggcgtcgaggagaacagccttgattcttttgtattcgacaccctgattccgaagccaattacacaaaggtatttcaatttactgatggagcaccataggatcatcctgagtgggccgtccggcactggtaagacttatttggcaaataagctcgctgagtatgttattactaaatccggccggaaaaaaaccgaagacgcgatagctacattcaacgtcgaccacaaaagcagcaaagaattgcagcagtatttggccaacctggccgagcagtgttcagcagataataatggcgtggaactgcctgtagtgatcatcttggataacctgcaccacgttgggtcactctccgatatctttaatgggtttctgaattgtaagtacaacaagtgcccttacattattgggaccatgaatcagggcgtgagcagcagccccaatcttgagctgcaccataattttagatgggtgctatgcgctaaccacaccgagccagtgaagggttttctcggcagataccttcggagaaagctgatagagatcgagatagaacgtaatattaggaacaacgatctagtcaagatcattgactggattcccaaaacgtggcatcatttaaattctttcttagagacgcactcctctagcgacgtgaccattggacctagattatttctcccttgtccaatggacgtggaggggagtcgagtctggtttatggatctctggaactattcccttgtaccttacatcctggaggccgtgcgcgaaggactacaaatgtacgggaaaaggactccctgggaggacccaagcaagtgggttttggatacctatccctggtcatcggcaacactcccacaggagtcgccagccctgctgcagcttcggcccgaagatgtagggtatgagtcctgtacctccaccaaggaggccacaacatcgaagcacatcccgcagactgataccgagggcgacccactcatgaatatgctcatgaaactgcaggaggccgctaattatagttccacccagagctgtgattctgagagcacaagccaccatgaggatattttagattctagtttggaatctacactgtag

SEQ ID NO: 185029 - DNA, 519 bp, Artificial Sequence
  Description of Artificial Sequence: Synthetic coding sequence
atgaaggccaccatcatcctgctgctgctggcccaggtgagctgggccggaccattccagcagcggggactgttcgacttcatgcttgaggatgaggcttctgggattggacctgaggtgccagacgatagggatttcgaaccatctcttgggccggtgtgtccatttaggtgccagtgtcacttgcgagtcgtgcaatgctctgatctgggcctcgacaaggttccaaaagacttgcctcccgatacaaccttgctggaccttcagaataacaaaattacggaaataaaagacggtgactttaagaacttgaagaacctccatgtggtctatctacataataataatatttccgtggttggcagttctgatttctgtccccccggacacaacaccaaaaaggcaagctactccggtgtgagtctgttcagtaaccctgtccaatactgggaaattcagccttcaacttttcggtgcgtctatgttaggagcgcaattcagctcgggaattacaagtag

SEQ ID NO: 185030 - DNA, 1080 bp, Artificial Sequence
  Description of Artificial Sequence: Synthetic coding sequence
atgaaggccaccatcatcctgctgctgctggcccaggtgagctgggctggcccatttcagcaacggggcctgtttgacttcatgttggaagatgaggccagcggcattgggcctgaagtgcccgacgatagggattttgagccttccctggggccagtgtgcccattccggtgtcagtgtcacctgagagttgttcagtgttcggatctcggcctagacaaagtgcccaaagacctgccccctgacactaccctgcttgacctacagaataacaagataactgaaatcaaggacggggatttcaagaatctcaagaacttgcatgccttaatcctcgtgaataacaaaattagtaaggtttctccaggcgcatttactcccctcgtgaagttggagcgactctacctgagcaaaaaccaattgaaggaactgcccgaaaagatgcccaagactcttcaggagttaagagcccatgagaatgaaatcactaaggtgcggaaagtgactttcaacgggctaaatcagatgattgtgattgagctgggtacaaacccgctcaaaagcagtggaatagagaatggagcctttcaggggatgaagaagttgtcatacatccgtattgcagataccaacataacaagtatcccccaaggcctccctccctctctgactgagctgcacctcgacggtaataaaatttctcgcgtggatgccgcttctctcaagggtctcaataacctggctaaactgggactgtccttcaattccatttccgcagttgataacggctccctagccaatacaccccacctgcgtgagctgcatctcgataacaacaagttaacgcgagttcctggcggattggcagaacataaatacatccaggtagtgtatctccataataacaacatatctgttgtgggatccagtgacttctgcccaccaggtcacaataccaagaaagcttcctactcaggcgtttctttgtttagcaaccctgttcagtactgggaaatccaaccatccacctttagatgtgtttatgtgcggagcgcgattcagctgggtaactacaagtag

SEQ ID NO: 185031 - DNA, 753 bp, Artificial Sequence
  Description of Artificial Sequence: Synthetic coding sequence
atgaaggccaccatcatcctgctgctgctggcccaggtgagctgggctggcccatttcaacagcgagggctgtttgacttcatgttggaggacgaggcaagcggaattggtcctgaggttcccgatgaccgcgattttgagccttctctggggcccgtgtgccccttccgatgccagtgtcacctacgcgtcgttcagtgttctgacctggaactcggcacgaatcctctcaaatcctcaggcatcgaaaatggcgccttccaaggcatgaagaagctgtcatatatccgaattgccgacaccaacatcacttccatacctcaggggttgccccctagccttactgagctgcatttggatggcaacaaaattagccgcgtggacgctgcatcactaaaaggactgaataacctggctaagctgggactgtccttcaatagcatttctgccgtcgacaacggaagtcttgcgaacaccccccacctgagggagctgcacctcgacaacaacaagcttaccagggttcccggggggctggcggagcacaagtacatccaggtcgtttacctgcataataacaacatttctgttgtagggtccagtgacttttgtccacctggacacaataccaagaaggcctcatactctggtgtttccctcttcagcaatcccgtacaatactgggaaatccagcccagtacgttccggtgcgtgtatgttcggagtgccattcaactgggcaattacaaatag

SEQ ID NO: 185032 - DNA, 639 bp, Artificial Sequence
  Description of Artificial Sequence: Synthetic coding sequence
atgaaggccaccatcatcctgctgctgctggcccaggtgagctgggcaggcccatttcagcaacgcgggctcttcgactttatgctggaagacgaggcctccggcatcgggccggaggtcccagatgaccgcgactttgagcctagcctcggtccggtctgccctttccgatgccagtgccacctacgagtcgtacagtgtagtgacctgggcctgcccccgtccctgactgagctgcatcttgacggaaataagattagccgcgtggacgctgctagcctgaaggggctgaacaatctagccaagcttgggcttagcttcaatagcatcagtgctgtcgacaatggcagcctcgccaacacgccgcaccttcgtgagttgcacctggacaacaacaaattaactagagtgccggggggtctcgcggagcacaagtatatccaggtggtgtatctccacaacaacaatatctctgtggtaggctcgagtgatttctgcccccccgggcataacacaaagaaagcaagctacagcggggtgtcattgttttccaaccctgtacagtactgggagatacagcctagtaccttcagatgtgtgtacgtcaggtccgccatacagctcgggaactacaagtag

SEQ ID NO: 185033 - DNA, 519 bp, Artificial Sequence
  Description of Artificial Sequence: Synthetic coding sequence
atgaaggccaccatcatcctgctgctgctggcccaggtgagctgggccggccctttccaacagaggggtttgtttgattttatgttagaagacgaggcctctggtatcgggcccgaggttccggacgaccgagatttcgaacctagcctaggacccgtgtgccccttccgatgccagtgccacctccgggtcgtgcagtgctccgacttaggcctcgacaaggtccctaaggacctgccacctgacacaacgctactggatctgcagaacaacaagattacggagattaaagacggagattttaagaacttaaagaatctccacgtcgtttacctgcataacaacaacatatcagtggtcggatcatcagatttctgtcccccgggacacaacacgaagaaggccagctactctggggtttctctgttttccaatccagtccagtactgggagatccaacccagcacatttcgatgtgtgtacgttaggtctgccatccagttgggtaactataagtag

SEQ ID NO: 185034 - DNA, 228 bp, Artificial Sequence
  Description of Artificial Sequence: Synthetic coding sequence
atgaaggccaccatcatcctgctgctgctggcccaggtgagctgggcaggaccttttcagcagcgcggcctgtttgatttcatgctagaagacgaagccagcggcatcgggccggaggtgcccgacgacagagattttgagccatcgctgggccctgtatgtccctttcggtgtcagtgccatcttcgcgtcgtccaatgcagcgacttggggtgtctgccatcatag

SEQ ID NO: 185035 - DNA, 639 bp, Artificial Sequence
  Description of Artificial Sequence: Synthetic coding sequence
atgaaggccaccatcatcctgctgctgctggcccaggtgagctgggcaggacccttccaacaaaggggtctgtttgattttatgctggaagacgaggcatctggcattgggccagaagtgccagatgatcgggattttgaaccctcccttgggcccgtgtgtcccttcagatgccagtgccatttgcgcgtcgtgcagtgcagtgatctgggactacctccttccctgactgaactccacctggacggtaataagatcagtagggttgacgccgcctcactgaagggacttaataacctagcaaaattaggattgagttttaattcaattagcgccgttgataacgggtcactcgccaacacacctcacctccgagagttacatctggacaataacaagttgactagggtgccaggtggactggctgaacacaagtacatacaggtggtatatctacacaataacaacattagcgtggtcggtagtagtgacttttgtccccccggacataataccaagaaagcttcctactctggtgtgtctcttttctcaaatcccgttcagtactgggaaatccagcctagcaccttcaggtgcgtgtacgtgcgttctgccatccagctgggcaactataagtag

SEQ ID NO: 185036 - DNA, 540 bp, Artificial Sequence
  Description of Artificial Sequence: Synthetic coding sequence
atgaaggccaccatcatcctgctgctgctggcccaggtgagctgggccgggcctttccagcagaggggcctttttgattttatgctggaggacgaggccagcggaataggacctgaagtgccagacgaccgcgacttcgagccttcgctgggtccagtgtgcccctttaggtgccagtgtcacctgagagttgtacagtgttctgatttgggactggataaagtacccaaggatttgcctccagataccacccttctcgacctgcagaataacaaaatcaccgagataaaggatggcgatttcaagaatcttaaaaatcttcacgcgctgatacttgtgaacaacaagatcagcaaagtcagtcccggtgcatttacaccccttgtgaaactagagaggctttacctgtctaaaaatcagctgaaggaactgcctgaaaaaatgccaaagacactgcaggaactgcgggcccacgaaaacgaaatcaccaaggtgagaaaggtcacttttaacggactgaatcagatgattgtaatctag

SEQ ID NO: 185037 - DNA, 360 bp, Artificial Sequence
  Description of Artificial Sequence: Synthetic coding sequence
atgaaggccaccatcatcctgctgctgctggcccaggtgagctgggctggacctttccagcagcgcggcctctttgacttcatgctggaagatgaagcctcaggcatcggcccggaggttccggatgatagggacttcgaacctagcttagggccagtgtgtccatttaggtgccagtgtcacttacgagtggtccagtgttccgatcttggactagacaaagtacccaaagacctgcctcccgacaccacattactcgatctgcagaacaataaaatcactgaaataaaagacggtgacttcaagaaccttaagaacctacacgccctcatcctggtcaataataagataagcaagtag

SEQ ID NO: 185038 - DNA, 525 bp, Artificial Sequence
  Description of Artificial Sequence: Synthetic coding sequence
atgaaggccaccatcatcctgctgctgctggcccaggtgagctgggccggtcctttccagcagcgtggattgtttgacttcatgttggaggatgaggctagtggcataggaccggaagtgcctgacgatagagattttgagccttccctagggccagtgtgtccctttcggtgccagtgccacctgcgtgtggtgcaatgttctgacctcgggctcgataaggtgccaaaagaccttccccccgacaccaccctcctggatctgcaaaacaataaaattaccgaaataaaagacggggatttcaagaacctgaagaaccttcacgcactgatactggttaataataagatcagcaaggtgtctcccggtgctttcacccccctggtgaaacttgagaggctttacctgtccaaaaaccaactgaaggaactccccgagaagatgcccaaaacacttcaggagctgcgagcacatgaaaacgagatcaccaaggtgagaaaggtgactttcaatggcctgaactag

SEQ ID NO: 185039 - DNA, 537 bp, Artificial Sequence
  Description of Artificial Sequence: Synthetic coding sequence
atgaaggccaccatcatcctgctgctgctggcccaggtgagctgggcaggccccttccaacagagggggcttttcgattttatgctggaggatgaagcttcaggcattggacccgaggtcccggacgacagggattttgagcccagtctgggccctgtgtgtccctttcggtgtcagtgtcacctcagggtggtccagtgcagcgacctgggcctcgacaaagttcccaaggatcttccacctgacacaactttactggaccttcaaaacaacaagatcactgaaatcaaggatggtgatttcaaaaatctgaagaatctgcatgcccttatcctcgtgaacaataaaatctcaaaggtctcccctggggcctttaccccgctcgtaaagctcgaaaggctgtatcttagcaaaaatcagttgaaggagctccccgaaaaaatgcccaaaactctgcaggagctgcgggcccacgagaacgaaataactaaagttcgcaaggtcactttcaacgggcttaatcagatgatcgtctag

SEQ ID NO: 185040 - DNA, 1080 bp, Artificial Sequence
  Description of Artificial Sequence: Synthetic coding sequence
atgaaggccaccatcatcctgctgctgctggcccaggtgagctgggccggaccgtttcagcaacgcgggcttttcgacttcatgcttgaagatgaggctagcggcataggccctgaagtgcccgatgatagagactttgagcccagtctgggccctgtgtgccctttcaggtgccaatgccacctgcgagtggtacagtgctccgatctcgggctggataaggttcccaaggacctcccaccggataccacccttctggacctccaaaataataagatcaccgagatcaaagacggagattttaaaaacctgaaaaacctacacgcccttatcctggttaataacaagatttcaaaggtctctccaggtgcgtttacgcctctggttaaactggaaaggctctatttgtcaaagaatcagcttaaggagctccctgagaagatgcctaagacgctgcaggagttgcgcgcccatgagaacgagatcaccaaagttaggaaagtgacgttcaacgggctgaaccagatgattgtgatcgagcttgggacgaacccactgaaatccagcggcatcgagaatggagccttccagggaatgaagaaactttcttacatccggatcgccgatactaatatcacatccatcccccagggattgcccccttctctcactgaacttcacttggatggaaacaagattagtcgggtcgatgctgcaagcctgaaagggttgaataatctcgccaagctgggcctcagcttcaactctatctcagccgtcgacaacggctctcttgccaacacaccccacttgagagagctccacctggataacaataagcttacacgagtgcctggcggattagccgaacataaatacattcaggttgtatacctgcataataacaacatcagcgtcgtaggctccagcgacttttgtccccctggtcacaacactaagaaggcttcgtactctggcgtgagtctgttctccaacccggtccagtattgggagatccagccttccacgttccggtgcgtgtacgtaaggtctgccattcaactcggcaactacaagtag

SEQ ID NO: 185041 - DNA, 5598 bp, Artificial Sequence
  Description of Artificial Sequence: Synthetic coding sequence
atgacccggtgggtgcccaccaagcgggaggagaagtacggcgtggcattttataattacgacgcccgtggtgccgacgagctgagcctgcaaataggggatacagtccatattctggaaacctatgaagggtggtacagaggctacacacttcgcaagaaatccaaaaagggaatcttccccgccagttacattcacctcaaggaggccattgtcgagggcaaaggccaacatgagactgtgatccctggggacctgcctctaattcaggaagtaacgacgactctgcgcgaatggtcaactatttggcgtcaactgtacgtccaggacaaccgcgagatgtttaggtctgttaggcatatgatatacgacctgatcgaatggcggagtcagatccttagcggaacattaccacaggatgaattgaaagagctcaaaaagaaggtcaccgcaaaaattgattacggcaacaggatcttagatttggacctggtcgtccgagatgaagatgggaacatactggatccagagctgacaagcaccatcagtctctttcgcgctcatgagatagcatccaaacaagtggaagagagattacaagaagagaagagccaaaaacagaatatagatatcaacaggcaggccaaattcgcagcaactcccagtctcgccttgttcgttaacctgaaaaatgtggtttgcaaaatcggtgaggacgcagaggtgcttatgtctctgtatgatccagtggaaagcaagttcatttccgaaaactacctcgtcagatggtcttcatcaggcctgccaaaagacatcgatcgactccataacttacgagccgtattcacagatctcggttctaaagacctgaaacgggaaaaaatttccttcgtgtgccaaatcgttagggttggacggatggaactgcgcgacaacaacactcgcaaacttacgagcggtctgcggcgcccctttggcgtggccgtgatggacgtgaccgacatcatcaatggcaaagtcgatgacgaagataaacaacactttattccatttcagcccgtggccggagagaatgacttccttcagactgtcatcaataaggtgatagcggctaaagaggtcaatcataaagggcaaggcttgtgggtcacgcttaagctcctacccggcgacattcatcagatccgaaaggaattcccccatctggtagaccgaacaacagccgtcgcgcgcaagacaggatttcctgagataataatgccaggtgatgtcaggaacgatatatacgtcaccctggtccagggcgacttcgataaggggagtaaaaccacggcaaagaatgtggaggtgactgtgagtgtgtatgacgaggacggcaagcgacttgagcacgtcatattccctggcgccggggacgaggccatctcagaatacaagtcagtgatctattaccaggtgaaacagccccgctggtttgagaccgtcaaagttgcgattcccattgaggatgtgaaccgatctcaccttagatttacatttagacaccggagttcccaagactcaaaggacaaaagcgaaaagatattcgccctagcttttgtcaaattgatgcgatatgacgggaccactcttcgagacggagagcatgacctgattgtttataaggctgaagctaaaaagctggaagatgccgccacctacctgtccctacctagcaccaaagctgagctggaagagaaagggcatagcgcaacaggcaagagcatgcagagcctggggtcatgcaccatttccaaagactcatttcagatctcaacactggtttgttccactaagctcactcagaatgtggacctcctcggacttctgaaatggaggtccaacacatcactgctgcagcagaatttgcgtcagctcatgaaagtagatggcggtgaagtggttaaatttctccaagacactcttgatgctctgttcaatattatgatggagaattcagagtccgaaacatttgacacactggtgtttgacgccctggtctttattatcggactcattgctgacaggaaattccaacactttaatccagtacttgagacatacattaaaaaacacttcagtgccactttggcttacaccaagttgaccaaagtgttgaaaaattacgtcgacggtgccgaaaagccgggggtgaacgaacaattgtataaagccatgaaagctcttgaatctatcttcaagtttatcgtccggagccggattctgtttaatcagctgtacgagaacaagggggaggccgactttgttgagtctctcttgcaattgtttagatctattaatgacatgatgagctctatgtcagaccagaccgtccgggttaaaggggccgcgctgaagtacttgccgaccatagtcaatgatgtcaaactggttttcgaccccaaagagctatccaagatgtttacagagttcatcctgaatgtccccatgggcctcctgacgatccaaaaactctattgcctgattgagatcgtgcatagcgacttgtttactcagcacgattgtcgtgagatcctgctgcctatgatgactgaccagctgaagtaccacctcgaaaggcaggaggatttagaagcctgctgtcaactcctgtctcacattctcgaggtgctatatcgcaaggatgtgggacccactcagcgccatgtccagatcatcatggaaaagctgttaaggactgtgaacaggaccgtcattagcatgggacgcgacagtgaactcataggaaatttcgtagcctgcatgactgctatcctgcggcagatggaagactaccactatgcccacttaattaagacatttggcaaaatgcggactgatgtggtcgacttcctgatggagacctttattatgtttaaaaatcttatcggaaaaaatgtctacccattcgattgggttatcatgaacatggtccaaaataaggtgttcctgagagcaattaaccagtatgctgacatgctgaataagaaatttttagatcaggccaatttcgaattacagctttggaataattacttccacctagccgtggccttccttactcaggaatcactccagctggaaaacttttcttccgcaaaacgtgctaagattctcaataagtatggggacatgcggaggcagatcggctttgagatccgcgacatgtggtataacctcggccagcataagatcaaattcatccctgagatggtcggacccatcctggagatgactcttattcctgaaactgagctgcgtaaggccacaatcccaatattttttgatatgatgcagtgcgagtttcactcaacgagatcctttcaaatgttcgagaacgagattattaccaagctggatcatgaagtggagggcgggcgcggcgacgagcagtataaggtgctcttcgataagatcttactggagcactgccgtaaacacaagtaccttgcgaagacaggcgagaccttcgtcaagcttgttgtccgtctaatggagcgcctgcttgattataggacgatcatgcacgacgagaataaagagaatcgcatgagttgcaccgtcaacgtgcttaacttctataaggagatagagcgagaggaaatgtacatacgctacttatacaaattatgtgatctgcacaaggagtgcgataattacaccgaggccgcctatacattacttttgcatgccaaactgttgaaatggtccgaagatgtgtgcgttgcccatctgacccagagagacggttaccaggctaccacccaagggcaattgaaagaacagttgtaccaagagatcattcattattttgataaggggaaaatgtgggaagaagctatcgccttaggcaaagaactggccgagcaatatgaaaacgaaatgtttgattacgagcagcttagtgaacttttgaaaaagcaagcgcagttttacgaaaatattgtcaaagtaattcgcccaaaaccagattacttcgcagtaggatattacggacagggctttcctaccttcttaaggggcaaggtgttcatctatcgcggcaaagaatacgagagacgagaagattttgaggccagactgctgactcagtttcccaatgcagaaaagatgaaaacgacttcccctcccggagatgacatcaaaaattccccaggccaatacattcagtgcttcacagtcaaaccaaagttggacctgcccccgaaatttcaccgcccagtgagtgagcaaatcgtgagcttttaccgggtgaatgaggtccagcggtttgaatactctcgtcccattagaaagggtgagaaaaaccctgacaacgaatttgcaaatatgtggatcgagagaaccatttatacaacggcctacaagctccccggcattttgagatggtttgaggttaagtcggttttcatggtcgagattagccccttggagaatgccatcgaaaccatgcagttgaccaacgataagattaactccatggttcagcaacacctagacgaccccagcctcccaattaaccccttgagcatgctccttaacggaatcgtcgatcctgccgtcatgggcgggtttgccaattatgagaaggccttttttacagaccggtatctccaggagcatcccgaggctcacgagaaaatcgaaaagctgaaagatctcatcgcatggcaaataccatttcttgctgaaggtataaggatccacggtgacaaagtcacagaagctttgaggccatttcacgagcgcatggaggcctgctttaagcaactgaaagagaaggtggagaaggaatatggtgtgcggattatgccgtcaagcctcgatgacagaagaggcagccgcccccgatcaatggttcgaagcttcactatgcctagctcatccaggccactgagtgtggcttcagtatcatccttgagtagcgactctactccttccaggcccgggagcgatggattcgctctggagcctcttctaccaaaaaagatgcactcccggtcccaggacaaactggataaggatgacttagaaaaggaaaaaaaagataaaaaaaaagaaaagagaaactctaagcatcaggaaatctttgaaaaggaatttaagccaaccgatattagtctccaacaatcggaagctgtgattttgtcagaaaccatctccccactgaggcctcagagacccaaaagccaggtgatgaatgtcatcggctctgaacgacgttttagcgttagtcccagtagtccttcatctcaacagactccaccccctgttacaccgagggctaaactatcattctccatgcagtcctccttggaattgaatggaatgacaggggctgacgtagctgacgtgccacccccgcttccccttaagggctccgtcgctgattatggaaacctgatggagaatcaggacttgttgggcagtcccactcctcctcctccgcctccccaccagagacacttaccgccccccttgccttccaagacccctcctccacctccaccaaaaacaacgagaaaacaggcatcagtcgatagtggaatcgtgcagtag

SEQ ID NO: 185042 - DNA, 6561 bp, Artificial Sequence
  Description of Artificial Sequence: Synthetic coding sequence
atggccggcgagcggacccggcggttcacccggagcctgctgcggcccggccaggccgccgagttgaggcacagtgccgcttcggcggcagccgtcgccgtgtcaagcagacagcagcagcgtcaagagaaaccaaggctcctcgaaccgctggactacgagaccgtcatcgaagagctggagaagacatacagaaacgaccccctgcaggacctgctcttctttccctcagacgacttttctgccgccacagtgtcttgggacattcgcacgctgtacagcactgtgcccgaagacgccgaacataaggcggaaaacctgctggttaaagaagcttgcaaattctactcatcacagtggcacgtggtgaattacaagtacgaacaatacagcggcgacattcgacagctgcctcgtgcggagtacaagcccgagaaacttcccagccatagctttgagattgatcatgaggacgcagacaaagatgaagacaccacttctcacagcagttctaagggtggagggggcgccggaggaacaggcgtgtttaaaagcggatggctctacaaggggaacttcaatagcacagtcaacaacacagttactgttcgaagctttaaaaaacgctacttccagttgacacagctgcctgacaattcttacataatgaacttctataaggacgagaaaatatcaaaagagccaaagggttgcatcttcctcgattcgtgtaccggggtggtacagaataatagactccgaaagtacgcctttgagctcaagatgaatgacttgacctatttcgtccttgccgccgagacagaaagcgatatggatgaatggatccacaccctgaatcggattctgcagatctcacctgagggcccactgcaaggtaggagatctactgagctgacggatttgggcctggactcattagataattccgtgacctgcgaatgcaccccagaagaaaccgacagctctgagaataacctccatgcagattttgctaaatacctcacagagacagaagacactgtaaaaacgacaagaaacatggaacgtctaaacctcttttcactggacccagatatcgacactctgaaattacagaagaaggatctcttggaacccgagagtgtaataaaacccttcgaagagaaggctgcaaaaaggattatgattatttgcaaggcattgaacagtaatctgcagggctgtgtgactgagaacgagaacgaccccattacaaatattgaaccattttttgtttcagtcgccttgtacgatctaagggacagtaggaaaatctccgcagacttccatgtggacctcaaccatgccgcggtccgccaaatgttgctgggggccagtgtcgcactggaaaatggaaacattgacaccatcaccccgcgacagtcggaggaacctcacatcaagggcttgcctgaagaatggttaaaattccccaagcaggctgtgttctcagtttccaaccctcactccgagattgtgctcgtcgccaagatcgagaaggtcttaatgggcaacatcgcctctggggcagaaccttatataaagaaccctgactctaacaaatacgcccagaagatcctcaagtctaatagacagttctgcagcaaactcggcaaatatcggatgcccttcgcgtgggcagtacgtagcgtgttcaaagataatcagggcaatgtggaccgagattcacgtttctcccccctgtttcgccaggagtcatccaagataagcacagaagacctagtcaagctggtgtccgattacaggcgcgcagataggatttctaagatgcagactatacctgggtccttggatatcgcggtggacaatgtcccactcgagcaccccaattgtgtgacctctagtttcatccctgttaagcctttcaatatgatggcacaaactgagcctaccgtggaggtcgaagagttcgtgtacgattcaacaaagtactgccggccataccgggtatacaagaatcagatatatatctatcccaaacaccttaagtacgatagccagaagtgtttcaacaaagcccggaatatcactgtatgtattgagtttaagaatagcgatgaggagagcgccaagccgctgaaatgcatttacggtaagcctgggggccccctgttcacttctgccgcttacactgctgtgctgcatcactcccagaaccctgatttcagtgacgaggtcaagatagagctacctactcagctgcacgagaaacaccatatcttattctcattttatcacgtcacttgcgacattaacgccaaggcgaacgcaaaaaaaaaggaggctctggagaccagtgtgggttacgcttggctccctttgatgaaacacgaccagatagcatctcaagaatataatatacccatcgccacgtccctccctccgaactatctgtccttccaggattccgctagcgggaaacacggcggctccgatattaaatgggtggatgggggcaagcccctgtttaaagtgtcaactttcgtggtgagcacagtgaacacccaggacccgcacgtgaatgcctttttccaggagtgccagaagcgtgagaaagatatgagccagtcacccacctctaacttcattcgcagttgcaagaatctgctcaacgtcgaaaagattcacgccataatgagttttcttcctattattttgaaccaattgttcaaggtcttagtgcagaacgaagaggatgaaattaccaccactgtaactcgagttctaacagacatagtggccaagtgtcacgaggaacagttggatcactccgttcaaagctacattaaattcgtgttcaaaaccagagcgtgtaaggaaaggacagtgcatgaggagcttgctaaaaatgtcaccgggctactgaaatcaaacgacagcactaccgtgaagcatgtgctgaaacattcctggttttttttcgccataattttgaaatcgatggctcagcacttaatcgacactaataagatccagcttcccagacctcagcgctttcctgagtcctatcagaatgaattggataacctggttatggttctgagcgatcacgttatctggaagtacaaagacgctctagaagaaactcggagagccaaccacagcgttgcccgattcctcaagcggtgtttcacgtttatggatcggggatatgtgtttaagatggtgaacaactatatttccatgttcagcagcggagatctgaaaacactgtgccaatataagttcgactttctgcaagaggtgtgtcaacatgagcattttattccactctgtctgcccattcgctccgccaatattcctgacccactgactccttctgaatccactcaggaactgcacgctagcgacatgcccgaatactccgtgactaacgagttctgtagaaaacacttcctaattggaatattgctgcgcgaagtcggtttcgcactccaggaagaccaggatgttagacacctcgccctggctgtcctcaagaatctgatggccaagcactcttttgatgaccggtatcgcgaacctaggaaacaggctcagatcgcaagtctctatatgccgctctacggtatgctccttgacaatatgcctcggatctacttgaaagatctctatcccttcacagtgaacacttccaatcagggcagccgggatgatctatctaccaatggcggttttcagagtcagaccgcgatcaaacacgcaaattctgtcgatacctccttctcaaaggacgtattaaatagtatagccgccttctctagtattgcaattagcacagtcaaccacgcagattccagggcatctttagcgtcactcgactcgaatccttctactaacgagaagtccagtgagaaaacagataactgcgaaaaaatcccccgtcccctctctttgatcggatcgacattgcggttcgataaactagatcaggcagaaaccagatcacttctaatgtgttttctgcacatcatgaagaccattagctacgaaacgctcattgcttactggcagcgcgccccatcacccgaagtgtcagacttcttcagtatcctggatgtctgcctgcagaactttagatatttgggcaaaaggaatataatcaggaagattgctgcagcctttaaatttgtccaaagtacccagaataacgggaccctcaagggatccaacccgagctgccagacaagtgggttgttgagccagtggatgcattccacaagtagtcatgaaggacacaagcagcataggagtcagacactgcccattatcagaggcaagaatgccctgagcaacccaaagctcttgcagatgctggacaacaccatgacaagcaactctaacgaaattgatattgtacatcatgtggacaccgaggcgaatatagccacagaggtgtgcctgaccattctcgatctgctaagcctttttactcagacacaccagcggcaattgcagcagtgtgattgtcagaactcactgatgaagagagtctttgacacttacatgctgtttttccaggtaaatcaatctgctaccgcactgaaacatgtttttgcaagtttgaggttattcgtgtgtaaattcccatcagcatttttccaggggccagctgacctctgtggcagcttctgctatgaggtcctcaagtgctgtaaccaccgctccaggagtacccaaacagaggcctcggctctcttgtatttctttatgcgcaagaacttcgagtttaacaaacagaaaagcatcgtgcgatcccacctccaactcatcaaggctgtaagtcaactgatcgctgacgccggcatcggggggtccagattccaacatagtcttgccatcaccaacaactttgccaacggagacaaacaaatgaagaactccaatttccctgccgaggtgaaggacctgacgaaacgcattcgaaccgtgcttatggcgactgcgcagatgaaggaacatgaaaaggatcccgagatgctcgtcgatctgcaatacagccttgccaactcgtacgcttcaacgcctgagctgcggagaacgtggctggaatcaatggctaagatccacgcccgaaatggcgatctgtcagaggcagctatgtgttatatacacatcgcagcccttatcgccgaatatcttaagcggaaggggtactggaaagtcgagaagatatgcacagccagtttgttatctgaggacactcatccctgtgacagcaatagcctgctcacgacaccatccgggggcagcatgtttagcatggggtggccagcattcctctctattacaccaaacattaaggaagagggggcgatgaaggaggatagtggtatgcaggacactccatataatgaaaacattctcgtggagcagctgtacatgtgcgttgagtttttgtggaaaagtgagcggtatgaactgatcgcggacgtcaataagcccatcatcgccgtattcgagaagcaacgggatttcaagaaactcagtgacttgtactatgacattcataggagctatttgaaggttgcggaggtagtgaatagcgaaaagcgcctctttggcaggtactaccgcgttgccttttatggccagggtttctttgaagaagaggaaggaaaagaatatatctataaagaaccgaagttgaccggactctctgaaattagtcagcgtctcctgaagttgtacgcagataagttcggcgcagacaacgttaagatcattcaggattcaaacaaagtgaaccctaaagatctggacccaaagtatgcctacatccaggtgacttatgttaccccttttttcgaagagaaggagatagaggaccgaaaaacagattttgagatgcaccacaacatcaaccgcttcgtctttgaaaccccctttacgctgagtggtaaaaaacacgggggcgtggcggaacaatgtaagaggagaacaatactgaccactagccacctgttcccatacgtcaaaaagcgcatacaggttatttctcagagctccacagagctgaatcctattgaggtggccattgacgagatgtcaaagaaagtatcagagctgaaccagttgtgcaccatggaggaggtagatatgataaggcttcagctgaagctacagggcagcgtcagcgtcaaagtgaacgcggggcccatggcctacgcaagagcctttcttgaggaaactaacgcaaagaagtacccagataaccaggtgaagttactcaaggaaatattcaggcagttcgcagatgcttgcggacaggccttggacgtgaatgaaaggctaataaaggaggatcaactagaataccaggaggagctgcggagccattataaagatatgctgagcgaactctcgaccgtgatgaacgaacagatcaccggcagagatgacttgtctaagcgtggagtagaccaaacatgtacccgtgtgattagtaaagctactccagcgttaccaaccgtgtcaatctcttcctcagcggaagtgtag

SEQ ID NO: 185043 - DNA, 2103 bp, Artificial Sequence
  Description of Artificial Sequence: Synthetic coding sequence
atgaccagcaacagcaacgagatcgacatcgtgcaccacgtggacaccgaggctaacatcgcaaccgaagtctgtctgactatcttagatctgctaagtctgtttacccagacacatcagcgccagttgcagcagtgcgactgtcagaactcactgatgaagagagtctttgatacatatatgctgttctttcaggtgaatcaaagcgccaccgcattgaagcacgtgttcgcgagtctcaggctgtttgtctgcaaatttccatcagcattcttccaggggcccgccgacctgtgtggctccttctgctacgaagtcctgaagtgctgcaaccacagatctaggagcacccagacagaggcttcggccctcctatatttttttatgagaaagaattttgaatttaataagcagaagagtatcgtgagatcccacctgcaactgatcaaagctgtctctcaactgattgccgacgccggcatcggaggttctcgattccagcatagtttagccatcaccaacaactttgctaacggagacaaacaaatgaaaaatagtaactttccagccgaggtgaaggatttaaccaaaaggatacggacggttctgatggccaccgctcaaatgaaggagcatgaaaaggatccggagatgctggttgatctgcagtactctctggcaaactcatacgcatccactcccgaattacgcaggacatggctagaaagtatggccaagatccacgcgcgcaacggagatctgtcagaagccgctatgtgttatattcacattgcagccctcatagctgagtacctgaagcgtaaaggcatgtttagcatggggtggcccgctttcttgtcaatcacgcctaatatcaaagaagaaggagctatgaaagaagatagcggaatgcaagacaccccttacaatgaaaatatcctcgtcgagcaactttacatgtgtgtggagttcctttggaaaagcgagaggtatgaactgattgccgacgtgaataagccaatcatcgccgtctttgaaaaacaacgcgacttcaagaagttgtccgatctctattacgatatccatcgcagttacctcaaggtggctgaggtcgtcaactctgagaaaaggctttttgggcggtactaccgcgtagctttttatggccagggagtcgggtttttcgaagaagaggagggcaaggaatacatttacaaggaaccgaagctgaccggcctgtccgaaatatctcagcgtttgttgaagttatatgcagataaatttggcgcagataacgtgaaaattattcaggattccaataaagttaatccaaaggatttagacccgaaatacgcatatatccaggtgacgtacgtcacacctttctttgaagagaaggagatcgaggatcgtaagactgattttgaaatgcaccacaatattaatagattcgtgtttgagacgccttttacattgtccggtaagaagcatggcggagtggccgagcagtgcaaaagaaggacaattctgactacaagtcacctgtttccctacgtcaagaagcgcatacaggttatctcccagtctagcaccgaactcaatcccatcgaggtcgccatcgacgagatgagtaagaaggtctccgagcttaaccagctctgcaccatggaggaagtcgatatgatcagactacagcttaagctccaggggagcgtgagcgttaaggtgaacgctggtcctatggcctatgcacgcgctttcttggaagagaccaatgcgaagaaataccccgacaatcaggtgaaactgctgaaggagattttccgccagtttgccgacgcatgtggtcaggctctggacgtgaacgagaggctgattaaggaagatcagttagagtatcaagaggaactccggagtcattataaagacatgttgtcggaattgagtacagtgatgaacgagcaactgtgtaggggcccatgcttgtactcgttctgctctagtgtgtcctccataagcctcagcaccgtcagcaaatctgattacggtcagggcagacctgtgaaagccagaagtggtcctaatctgcacagttctaactag

SEQ ID NO: 185044 - DNA, 6543 bp, Artificial Sequence
  Description of Artificial Sequence: Synthetic coding sequence
atgagcttccggggcaaggtgttcaagcgggagcccagcgagttctggaaaaagcgtcgtacagtccgaagagtgaaccaagaggagatccatcgcttctcttctcaggagaagcctcgactgctcgagccattggattatgagaccgtgatcgaagagcttgaaaagacctatagaaacgacccgctgcaggacctcttgtttttccctagtgacgacttttccgccgccacagtgtcatgggatattcgtacgctgtatagcaccgttcctgaggacgctgaacacaaggccgagaacttgctcgtgaaagaagcctgtaagttctactcatcccagtggcacgtagttaactataagtacgaacaatacagtggggacatcagacagttaccgcgcgccgaatataaacccgagaaactgccatctcactctttcgagatcgaccacgaagatgcagacaaggatgaagacaccacttctcactcctcctccaaaggcggaggtggggccggcggaaccggcgtatttaagtccggatggctgtataaggggaacttcaactctacagtgaataacacagtcactgtgaggtcttttaagaaacgctactttcagttaacacagctccccgataactcatacatcatgaacttctacaaagacgagaaaatatccaaagagcctaagggctgtatattcttggactcctgcacaggagtggtacagaacaaccgcctgaggaagtacgcatttgagctgaagatgaatgacttgacatacttcgtcctcgccgctgaaacagaatccgacatggatgagtggatccacaccctcaatcggattctccagataagtccagagggcccactccagggaaggaggtctaccgaattgacagatctgggcttagactcattggataacagtgtgacctgcgagtgtaccccggaggaaaccgattcatccgagaacaacttacacgcagatttcgctaaatatcttacagaaaccgaggacaccgttaagaccacacgcaatatggaacggttgaatctgttctcccttgatcctgacatcgacacactcaagctacaaaaaaaagatctgcttgagccagaatccgtgatcaagcccttcgaggagaaagcagccaagcggattatgatcatctgcaaagccctgaattcaaacctgcagggatgcgtcaccgaaaacgagaatgaccccatcacaaacatcgagcctttctttgttagcgtcgcactgtatgacctgcgcgacagtagaaagatctccgccgattttcatgtggatttgaatcatgcagccgtgcgacagatgctcctcggggcctctgtcgccctcgaaaatggtaacatcgacaccatcactccacggcaatccgaagaacctcacatcaaggggttgcccgaagagtggttaaaatttcccaagcaagctgtgttttcagtgtccaacccccatagcgagatcgtgctggtcgccaaaatcgaaaaagtgcttatggggaatatcgcatctggcgccgaaccatacatcaagaaccccgactctaacaagtacgcacaaaaaatactcaagtcaaaccggcagttctgctccaaattagggaagtacaggatgcctttcgcctgggccgttcgttccgtttttaaggacaaccagggcaacgtggatcgcgatagcagattttcacccctatttcggcaagaaagcagtaagatttcaaccgaagatctggtgaagctagtgagcgactaccggcgcgctgaccgcattagcaagatgcaaaccattccaggctccttggatatcgccgtcgataacgtgccccttgagcatccaaattgcgttactagcagtttcatccccgtgaagccctttaacatgatggcccaaaccgagcccactgttgaagtggaggaatttgtatatgattctacaaagtactgtcgcccctatagagtctacaaaaatcagatatatatttaccctaaacaccttaagtacgatagccagaagtgttttaataaagcacgcaatataacggtttgtatcgaattcaagaacagtgacgaagagagcgcgaaaccccttaagtgtatctacgggaaacctggcggtccactcttcaccagtgcagcctacaccgctgtgctgcatcattctcagaaccctgacttctctgacgaggtgaaaatcgagttgcccacacaactccacgaaaagcatcacatattgttctccttttaccacgtgacgtgcgacattaatgctaaggccaacgcgaagaaaaaggaggccttagagacgagtgtcggatacgcctggctacccctcatgaagcatgaccagattgccagccaggagtataatatcccaatcgctacatcgttaccccccaactatttgtcatttcaagatagtgctagcggaaaacacggtgggtcagatatcaagtgggtagacggtggcaagcctttgtttaaagtgagcacctttgtagtgtcgaccgtaaatactcaggaccctcacgttaacgccttcttccaagagtgccagaaacgcgagaaggacatgtctcagtcccccaccagcaattttatcaggtcttgtaagaatttattgaatgtcgagaagatccacgccattatgtctttcctaccaattatcctgaaccagctatttaaagttctcgttcagaacgaggaggacgagatcaccactacggttactcgcgtcctgaccgatatcgtggccaaatgccacgaagaacagttggaccactctgtccagtcttacataaaattcgtgtttaagacccgggcatgcaaggaaagaaccgtgcacgaagaactcgcaaaaaatgttacaggactgttgaagtctaatgactcaacaaccgtgaaacatgtactgaagcattcatggttcttttttgccatcattttgaagtccatggctcagcatctcatcgataccaataagatacagctacccagaccccagaggttcccagaaagttatcagaacgagctcgacaacctggtgatggtgctgtcagaccacgtgatctggaaatacaaggacgcccttgaggaaacaaggcgcgccaatcactccgtggcccgatttttaaagcgttgcttcacgttcatggacaggggctacgttttcaagatggtaaacaattatatttcaatgttttcgagcggggatttgaaaaccttatgtcagtacaaattcgacttcctccaagaagtgtgccagcatgagcactttatcccactgtgcctgcccatccgatcagccaatattccagaccccctcacaccatcggagagcacccaggagcttcacgcctccgacatgcccgagtattccgtcacgaacgaattttgcaggaaacactttctaatcggaatcctgctgcgagaagtgggctttgccttgcaagaagatcaggacgttcgccatctggccctagctgtgcttaaaaatcttatggctaagcatagttttgacgacagatatcgggagccaaggaagcaggcgcagattgcctctctctacatgccattgtatggcatgctgctggataacatgccacgcatctacctgaaagatttgtatccgttcacagtaaatacgtcgaaccagggttctcgcgatgatttaagcactaatggcggtttccagtcacagaccgcaatcaagcacgctaattcagtcgacacctctttcagtaaagacgttttaaattccatagccgcatttagcagcatagcgatatctactgtgaatcatgctgactcgcgagctagcctggcaagtttggattccaatcccagcaccaacgagaagtctagcgaaaaaaccgataattgtgagaagattcctaggccactgtccctgatcgggagcaccctcagattcgataagcttgatcaggcagaaactcgttccctacttatgtgttttctgcacattatgaaaacgatatcatacgaaacacttattgcatattggcaacgagcccccagtccggaggtgtctgacttcttctccatcctggacgtgtgtcttcagaactttcggtatttagggaagaggaatatcatccggaagatcgccgctgcatttaagttcgtgcagagcacccaaaataacggaacgctgaaaggttcaaacccctcatgccagacatcagggctgttgagtcagtggatgcactctacttcttctcacgaaggccataagcaacatcgttcccagacactgccaatcattagaggcaaaaatgcgctgagcaatcccaaacttctgcagatgctggataacaccatgacctctaattccaacgagatagatatcgttcaccacgtggatacagaagcaaacatagctacagaagtgtgtctgacgatcttggatctgctgtccctgttcacgcagacccaccagaggcagttgcagcagtgtgattgccagaatagtttaatgaagcgagttttcgacacctacatgctcttttttcaggtgaatcaaagcgctaccgcgctaaagcatgtcttcgctagcttaaggcttttcgtatgtaaatttccatccgcattttttcaaggtcccgctgacctctgcggcagtttctgctacgaggtgctgaagtgttgcaaccatcggagccggtctacacagaccgaagcctctgctctgctgtacttctttatgcgcaagaactttgaatttaataaacagaagtccattgtgaggtctcacctgcagctgataaaagccgtctcccagctaatcgcagatgctggaattggaggtagtagatttcagcacagcctagccataacgaacaatttcgcaaatggcgataaacagatgaagaattccaacttccccgccgaggttaaagacttaacgaaacgcatccggacagttctaatggctaccgctcaaatgaaagaacatgaaaaagatccggaaatgctcgttgatctccagtattcgctggctaatagctacgcctctacgcctgagctgagaaggacatggctggagagcatggctaagatccatgcccgcaatggcgaccttagcgaagcggccatgtgttacattcatatcgctgccctcatcgccgaatacctaaagcgcaaaggttattggaaggttgagaaaatctgtactgccagtctactcagcgaggatactcacccctgtgactctaattctctgttgacaacaccaagcgggggaagcatgttcagtatgggttggccagccttcctcagcatcacacctaacattaaggaggagggagcaatgaaggaggattccgggatgcaggacacaccatataatgagaatattctcgtggaacaactgtacatgtgtgttgagttcctttggaagtccgagagatacgagttgattgccgacgttaacaaacccattatcgccgtctttgagaagcagcgagattttaaaaaactcagtgatctgtattatgatatacatcgatcgtacctgaaagtggccgaggtggtaaatagtgagaaacggttgtttggtcggtactatcgggtggctttttatggacaagggttcttcgaggaggaggagggtaaagaatatatctacaaggaacctaagctgacaggcctgagtgagatctcacaacgacttctgaaactgtacgcggacaaatttggcgctgataacgttaagatcattcaggattccaacaaggtcaatccaaaggacttggaccccaagtacgcatacatccaggtgacttacgtgacgccatttttcgaagaaaaggaaattgaggatcgcaaaaccgatttcgagatgcaccacaatatcaaccggttcgtgtttgagaccccattcaccctgagcggtaagaagcacggcggagtggctgaacaatgtaagcgccgaacaattttaacgaccagccatctgtttccatatgtcaagaagaggatccaggttatatcacaatcgtcgaccgaacttaacccaatcgaggtcgcaatcgacgaaatgtcaaaaaaggtcagcgagttaaaccagctgtgcactatggaggaagtggacatgattaggttacagctgaagctgcaaggctccgtaagtgtaaaggtgaatgcaggtccaatggcctacgcccgagccttcctcgaagagacaaatgcaaagaaatatccagataaccaggtgaagctccttaaagaaatctttcggcagttcgccgatgcctgcggacaggccctggatgtgaacgaaagactgatcaaggaggatcagctggagtatcaggaagagctgaggtcacattataaggacatgctgtccgaactctctaccgtcatgaacgagcagataaccgggcgggacgatctctccaagcggggggttgaccaaacctgcacacgtgtcatctccaaagctacccctgctctacctacagtcagcatttcttcctccgctgaggtgtag

SEQ ID NO: 185045 - DNA, 5493 bp, Artificial Sequence
  Description of Artificial Sequence: Synthetic coding sequence
atggccccctggcggaaggccgacaaggagcggcacggcgtggccatttacaactttcagggcagcggcgctccacagctctcattgcagataggtgacgtggtgcgtatccaagagacttgcggagactggtatcgcggttacctcatcaaacataagatgctacagggcatctttccgaaatcattcatccacatcaaggaagtcacggtagagaagagaaggaataccgagaacattatccccgcggagatccccctcgcacaggaagtgaccactaccctatgggagtggggcagtatttggaaacagttgtacgtggctagcaagaaggaacggttcctgcaggtccagtccatgatgtatgatctgatggagtggcgatcacagttgttgtccgggaccctcccgaaggacgaactgaaggaactgaaacagaaggtaacgtcaaagattgattacggcaacaaaatcctcgagctggacttaattgtccgggacgaggatggcaatatcctggaccccgataatacgtcagttatttccctcttccatgcccatgaggaagcgaccgacaaaatcactgagaggatcaaagaagaaatgtccaaagaccagcctgattacgctatgtactcgcgtatttcctccagccctacacactctctctatgtgttcgtgcgcaactttgtgtgcaggattggcgaagatgctgaactgttcatgtccctgtatgacccaaacaaacagacagttatttcagagaactacctggtgcgttggggaagcagaggtttccccaaggagatagagatgctgaataatcttaaggtggtgttcactgatttggggaataaagatttgaaccgcgacaagatctacttgatttgtcagatcgtgagagtggggaagatggacttgaaagacacaggcgcgaagaagtgtacacagggactgaggcgtcctttcggagtggcagtaatggatattactgacatcattaaaggcaaggccgaatcagacgaggagaagcagcatttcatcccatttcatcctgttacagccgaaaatgatttcttacacagtctgctgggaaaggtgattgccagtaagggggattctggcggacagggcctctgggtcaccatgaagatgctggtcggagatataattcagattcgaaaggactatccacacctcgtggaccgtacgaccgtagttgcgcggaaactgggcttccctgaaatcatcatgcccggcgacgtacgcaacgatatttatatcactttgctgcagggcgatttcgataaatacaacaaaaccactcagagaaatgttgaggtgatcatgtgcgtgtgtgctgaggacgggaagactcttccaaatgccatctgtgttggcgccggcgacaaaccaatgaatgagtaccggtccgtggtgtattaccaggtgaagcaaccccggtggatggaaaccgttaaagtggccgtccctatcgaagatatgcagcgcatacatctgcgctttatgttcagacaccgctcaagcctcgagtccaaggataagggagaaaagaacttcgcaatgagctacgtgaaactgatgaaagaggatggcaccaccttacacgacggatttcacgacttggttgtgcttaagggagacagcaagaagatggaagatgcatctgcttacctcaccttaccctcgtatcgacaccacgtggaaaataagggagctacactgtcccggtcttcctcgtcagtcggggggctgagcgtgagctcccgggacgtgttttctatctcaaccctcgtttgttccactaaactgactcagaacgtgggcctgctcggcctgctaaaatggcgcatgaagccccaactcctgcaggaaaacctcgagaaactgaagatcgttgatggtgaagaggtagtgaaatttttgcaagatacactggatgctctgttcaatatcatgatggagcatagtcagtctgatgaatacgacatcctggttttcgacgcccttatctatattatcgggctcatcgccgaccgtaagttccaacacttcaatactgtgctcgaggcttacatccagcagcactttagtgcaactctagcctacaaaaagttgatgacggtgctcaagacctaccttgatacctcttccaggggcgagcagtgtgagccaattttaaggaccctgaaggcactcgagtacgtgttcaaattcattgtgcgctccagaactctattcagccagctttacgaaggcaaagaacagatggagtttgaggagtctatgcggaggttgttcgagagtataaacaatctcatgaaaagccagtacaagaccaccattcttttgcaggtggcggcactgaaatatatcccgtctgtgctgcatgatgtggaaatggtgtttgatgctaagctactgtcccagcttctttacgagttctatacctgtataccccctgtgaagctgcaaaaacaaaaggtccagtcaatgaacgagatcgtccagagtaaccttttcaagaaacaagaatgcagggacattctacttcccgtcatcactaaagagctgaaggaactgctagagcagaaggatgacatgcagcatcaggtgttagaaaggaaatactgtgtggaactgctgaactctattcttgaggtcctttcataccaggatgcagccttcacctatcaccatatccaagaaattatggtgcagttgcttaggaccgtcaaccgtaccgtgatcacaatgggcagggatcacatcttgatttcacactttgtggcttgtatgactgcaattctgaaccaaatgggggaccagcactattctttttacatagagacatttcagacttcaagcgagcttgtagacttcctcatggagacatttattatgttcaaagacctgatcgggaaaaatgtctacccaggagactggatggccatgagcatggtgcagaacagagtgtttctaagggccattaacaagttcgccgaaacaatgaaccagaagtttctggaacacacaaatttcgagtttcaactatggaataattattttcatctggcagtcgccttcattacccaggatagcctccagctggaacagtttagtcatgcaaagtataacaagatactaaacaaatatggggatatgaggcgccttataggtttttctattcgcgatatgtggtataagctcgggcagaataagatctgcttcattcccggtatggtcggcccaatactcgaaatgaccctgataccagaagctgaactgcggaaagccaccatcccaatcttctttgacatgatgctttgcgagtaccagaggagtggcgatttcaagaagttcgagaacgaaatcatccttaaactggaccacgaagttgagggcggccgcggtgacgaacagtacatgcagctgcttgagtctattctgatggaatgtgcggcagagcatcccacaattgcaaagtctgtagaaaattttgtcaatttggtgaaggggctgttagagaaactgctcgactatcgcggtgtaatgacagacgagtccaaagacaatcgaatgtcttgtacagtaaatctgctgaacttctacaaggacaacaatcgggaggagatgtacatccggtacctgtataagttgagggacctgcacctggattgtgataactataccgaggctgcttataccttgctcctccatacttggctgctaaaatggtcggatgaacagtgtgcctcccaggtcatgcagactggccaacaacacccgcaaacacacagacagctaaaggagacactctatgaaaccattatcggctatttcgacaagggtaagatgtgggaggaagccatttcactttgcaaagagctcgctgaacaatacgagatggagatctttgattacgagctgctgagtcaaaacctgatacagcaggcaaaattttacgaatctattatgaaaattctgaggccaaaaccagactatttcgcagtgggttactacggtcaggggttcccctctttcctgcgtaataaagttttcatatatcggggaaaagaatacgagcgcagggaggactttcagatgcaactcatgacacagttcccaaatgccgagaaaatgaatacaaccagtgcccctggggatgatgtcaaaaatgcccccggtcagtatattcagtgctttactgtccagcctgtgctggatgaacacccgagatttaagaataagccagttcctgatcagattattaacttttacaaaagcaattacgtgcagcggtttcattacagtagaccagtgcgtcgtggaacagtggaccccgagaatgagtttgcatcaatgtggatcgagcgaacctcattcgtgactgcctataaacttccaggaatacttagatggttcgaagtcgtgcatatgtctcaaacaaccatcagtcctctggagaatgcaatcgaaactatgagtacagcaaatgaaaagatccttatgatgataaaccagtaccagagcgacgaaaccttacccatcaaccccttgtcaatgcttctgaacggaatcgtggacccggccgtaatgggtggatttgctaagtacgagaaggccttttttaccgaggagtatgtccgggaccatcccgaagaccaggataaactgacccatctcaaggatttgatcgcttggcaaatccccttccttggtgccggtatcaagattcatgaaaagagagtctcagataacctaaggccctttcatgaccggatggaggaatgtttcaagaacctgaaaatgaaagtcgagaaagaatatggtgtgagagaaatgccagacttcgacgacagaagagtgggacgcccgagaagcatgttgaggagctacaggcagatgtccatcataagtctggcgtctatgaactctgattgcagcacccccagtaagcctaccagcgagtctttcgatctggagctggcaagcccaaagactcccagagtagaacaggaagagccaattagcccgggtagcaccctgccggaggtcaaactcaggcgaagcaagaagcgaactaagagaagctcagtagttttcgcggatgaaaaggctgcagctgagagtgacctcaagaggctgtcaagaaagcatgagttcatgtcagacaccaacctcagcgagcatgctgctatcccactaaaggcctcagtgctgtctcagatgagtttcgcaagccagtccatgcctactatccctgcacttgctctcagcgtggctggtatccccggcttggatgaggctaacacaagccccaggctgagccaaacatttctccaactatccgatggcgataagaaaacactgacacggaaaaaagttaatcagttttttaagacaatgctcgccagtaaaagcgccgaggagggtaagcaaattccagattcactgtccaccgacctctag

SEQ ID NO: 185046 - DNA, 1011 bp, Artificial Sequence
  Description of Artificial Sequence: Synthetic coding sequence
atgtgcgtgtgcgccgaggacggcaagaccctgcccgtggccgtgccaatagaggatatgcagagaatacacctgagattcatgtttagacatagatcaagccttgaatccaaggataagggagagaagaactttgcaatgtcatacgtgaagctgatgaaagaagacggtaccaccctccatgacgggtttcatgacctagtcgtgttaaaaggcgactccaagaagatggaggacgcctctgcctatcttacattacccagctacagacaccatgtagagaacaaaggggccactctgtcacgatcgtcctctagtgttggaggccttagcgtcagctccagagacgttttctccatttctacccttgtatgcagcacaaaacttacccagaacgtaggtctccttggtctgctgaaatggcggatgaagccacagctggaagagtccatgcggcgtctcttcgaatctattaacaacttgatgaaatcccagtataagacaacaatcctgctgcaggtagcggctttaaagtatatcccatccgtactccacgacgtcgagatggtgttcgatgccaaacttctgtcccagcttctctacgagttctatacctgcatccctcccgtgaagctgcagaaacagaaggttcaaagcatgaatgagattgtgcaatctaatctgtttaagaagcaggagtgcagggacattttgctgcccgtcatcacgaaagagctgaaagagctgctcgagcaaaaggacgacatgcagcaccaggtcctggagcggaagtattgcgtcgagctgctgaatagtatcctagaggttctctcttaccaggatgcggctttcacgtatcatcacatccaagaaataatggtgcaactgctgaggacagtgaaccggaccgtgatcacaatgggcagggaccatatcttgattggcgcttgttgcaattgtggattcccctcatctaccccgcattcacttatacaatggctgtgggggtag

SEQ ID NO: 185047 - DNA, 2676 bp, Artificial Sequence
  Description of Artificial Sequence: Synthetic coding sequence
atgaccgccatcctgaaccagatgggcgaccagcactacagcttctacattgagaccttccagacgtcttcagagcttgtggacttcctcatggagaccttcattatgtttaaagatctcatagggaagaatgtctatccaggcgactggatggcaatgagtatggtccaaaatagagtgttcctccgtgcgatcaacaagtttgccgagaccatgaaccagaagttccttgaacacaccaacttcgaattccagctgtggaataactacttccacttggctgtggccttcatcacacaggactccttacagctcgagcagtttagtcatgcaaaatacaacaagattctgaataaatacggcgatatgcggaggttgattggattttccattcgtgacatgtggtataaactgggacagaacaagatctgctttataccggggatggtggggcccattctcgaaatgaccttaattccagaggccgagcttcggaaagccacgattccgatcttcttcgatatgatgctgtgcgagtatcagcggtctggcgacttcaagaagtttgagaacgagatcattctgaagctggaccatgaggtcgaaggaggacgcggagatgagcagtatatgcaattgcttgaaagcattctcatggaatgtgcagcagagcaccctaccattgcaaaatctgttgagaattttgttaatctggttaaaggtctcctggaaaagttgcttgactatcgcggagttatgacagacgagtccaaggataatcgcatgtcctgcaccgttaatcttttgaatttctacaaagacaacaatcgcgaggaaatgtatatccgctacctctataaactgagggaccttcatctggactgcgataattataccgaggcagcctacactctgctccttcatacgtggctgcttaaatggagcgatgagcaatgcgcctctcaggttatgcagaccggtcaacagcaccctcagacccacaggcagctgaaagagactctgtatgagacaattattgggtatttcgataagggaaagatgtgggaggaggccatatctttgtgtaaggaattagctgagcagtatgagatggagattttcgactacgaactgctgagccagaacctgatccagcaggctaaattttatgaatccatcatgaagatcttgcgccctaaaccagattacttcgcagtgggttactacggccagggctttccttcgtttctccgtaataaggtgtttatatatagaggaaaagagtatgagagaagggaggatttccagatgcagcttatgacacagttcccgaacgctgaaaagatgaatacaaccagcgcccccggagatgatgtgaaaaacgcccctggacagtacattcagtgctttaccgtgcagcccgtcctggatgagcacccgcgctttaaaaacaagcccgttcccgatcagatcatcaatttctacaagtcaaattacgtccagagattccattactcccgccccgtgcgtcgtggaacagtggaccctgaaaatgaatttgcttcgatgtggatagagaggacttcattcgtcaccgcttacaagctgccgggcattctccggtggtttgaagtcgttcatatgtctcagaccaccatctctccgctggagaatgccatagagacaatgtctaccgcgaacgaaaagattctgatgatgattaatcagtatcagtctgatgagaccctcccaataaaccctttgtctatgcttttgaacggaatcgtcgatcccgccgtgatgggcggttttgctaaatacgagaaggccttcttcaccgaagaatatgtgagggaccatcccgaggatcaggataaactgacccacctaaaagacctgatcgcctggcagattccgttccttggagcggggataaagatacatgagaagagagtctctgacaatctgcgtcccttccatgatcgaatggaagagtgctttaaaaatctgaagatgaaagttgagaaggagtatggggttcgggaaatgcctgacttcgatgaccggcgagtgggaaggcctcggagcatgctaagaagctatcgccaaatgtccatcatttctctggcttcaatgaattcggattgctcaacacctagcaaaccaacatcagagtcatttgatttggagctcgcctcaccgaaaaccccccgcgtggagcaggaggagcctattagtccaggcagcacgctgccagaggtgaaattaagacgttccaaaaaacggacaaaacgatcatcagtggttttcgcagacgagaaagctgccgccgagtctgaccttaagaggctatcccgcaaacatgagttcatgtccgacaccaacctgtcggagcacgccgccattccactgaaagcgagtgtcttgtcccagatgagcttcgcaagccagagtatgcccacgatacccgctcttgccctaagtgtcgccggaatacccggtcttgatgaagccaatacaagcccacgcctgtcacagaccttcctgcagctgtccgacggtgataaaaagaccctcactcggaaaaaggtaaaccagttctttaagaccatgcttgcctcgaagagtgctgaagagggcaagcaaatccctgactctttgtcgaccgatctgtag

SEQ ID NO: 185048 - DNA, 6093 bp, Artificial Sequence
  Description of Artificial Sequence: Synthetic coding sequence
atgtggacccccaccgaggaggagaagtacggcgtggtgatctgctcctttcgtggcagcgtgccccaaggtctggttttagagatcggggagactgtacaaattctggaaaaatgcgaaggatggtacaggggagtctcaacaaagaaaccgaacgtaaaaggcatttttcccgccaactacattcacctcaagaaagctatcgtgagtaatcgaggtcaatatgaaacagttgtgccattggaagattccatcgtgactgaagtcacagcaactctacaggagtgggcctcactgtggaaacagctgtacgtgaagcacaaggttgacctgttttacaagctacggcacgtgatgaatgagttgatcgatctacggcggcagctgcttagcggacacctcactcaagaccaggttagggaggtgaagagacatataacagtgcggctagactgggggaacgagcacctcggactcgacctggtcccacgaaaggacttcgaagtagtggactcagatcaaatctcagtgtcggacctttataagatgcacctgagcagtcgacagtcagttcagcagtccactagtcaagttgacactatgaggcctcgccatggagagacgtgcagaatgcccgtgcctcatcatttttttctatccctgaagtcattcacgtacaatacaataggtgaggacacagacgtcttcttcagcctgtatgacatgcgcgagggcaaacaaatatcagagcgctttctcgttcggttgaacaaaaatggaggcccgaggaatccagaaaagattgaaaggatgtgtgccctgtttaccgacctttcttccaaagacatgaaaagggacctgtacattgttgcccatgtgatacgaataggaagaatgttgttgaatgacagcaaaaaggggccaccacacctacattataggaggccctacggctgtgctgttctatccattctggacgtccttcagagtctgacagaagtgaaggaggaaaaggatttcgtgctgaaagtatacacctgcaataatgagtccgaatggagccagatccacgaaaacataataagaaagtccagcgccaaatactccgctcctagtgccagccatgggctgatcatcagcctgcaactcctgagaggcgacatggaacagattcggcgagaaaacccaatgatatttaataggggactggctataactagaaagctcggttttccagatgtcattatgccaggcgacatcaggaacgacttatacctgactctcgagaagggtgatttcgagaggggcggaaaatctgtgcagaagaacatagaagtgaccatgtatgtgctgtacgcggacggagagatactgaaggattgcatctctctgggttcaggtgaaccgaaccgctccagctatcactctttcgtactgtatcatagtaactccccccgttggggcgaaataatcaagctgcctatccctattgacaggtttaggggttcccatttgcgatttgaatttaggcattgctcaacaaaggacaagggcgaaaagaagttgtttggttttgcattctctacacttatgagagacgatggcaccaccctcagcgatgacattcatgaactctacgtttacaagtgtgacgaaaactctactttcaataaccacgcgctatacctcggactgccatgctgcaaggaggattacaacggatgtccaaacattccgtcctcactgatctttcagaggtccaccaaggagtcgttctttatcagtactcagctctcatcaacgaagttaactcagaacgtggacctcttggctcttctcaagtggaaggcctttccagatcggattatggacgttctcggaagactgagacacgtgtcaggcgaggagattgtcaagtttctgcaggatatcctggatacactattcgtgattctggacgacaacacagaaaagtacgggctgctggtgtttcagagcctggtgttcatcattaacctgctaagagacatcaaatattttcacttccgccccgtgatggatacctacatacaaaagcatttcgcaggcgcgctggcttataaggaactcattcgctgcttgaagtggtacatggattgcagcgccgagctgattcgacaggatcacatccaggaggcaatgcgggcactggaatatcttttcaaatttattgttcagtcacggatcctgtactcccgagctacctgtgggatggaggaggagcaattcagaagcagcattcaagaactctttcagtccatccgattcgtgttaagcctcgatagcagaaattctgaaacactcctattcacacaggccgcactacttaactcctttcctaccatctttgatgaactcctccaaatgtttacggtgcaagaggtcgccgagtttgttagaggaacactcggcagcatgccatccactgtgcatatcggtcagtctatggacgtggtgaaactgcaaagcattgctcgtaccgttgactcacggctgtttagcttctcagaaagtcggcgtatcctgttgcccgtggtgctccatcacattcatctccatctgcggcagcaaaaggagctcctgatctgctccggcattctgggaagtatcttttcaattgttaagacgagttcattggaagccgacgtgatggaggaagtggagatgatggtcgagtcgctgcttgatgtgctcctgcagactttgctcacaatcatgtccaagagccatgctcaggaagcagtcaggggtcagcggtgcccacaatgtaccgctgagataaccggggagtacgtcagttgtctgctgagtctgctccgacaaatgtgtgacacacactttcagcatctgctggataattttcagtctaaggatgagctgaaggagtttctgctgaaaatcttctgtgtctttagaaatttaatgaaaatgagcgtgttccctcgtgactggatggttatgagactgttaacttccaacattattgtaaccaccgtgcagtatctctcttctgccctgcataaaaacttcactgaaacggacttcgactttaaggtttggaattcctacttttctctcgccgtgctgttcatcaatcagccatcattgcagctcgagattatcacaagcgctaagcgtaagaaaatcctagataagtacggcgatatgcgagtcatgatggcatacgagttatttagcatgtggcagaatttgggagagcacaagatccactttatacccgggatgatcgggccttttctcggcgtaacgcttgttccacagcccgaggtccggaacattatgattcctatttttcacgatatgatggactgggaacaacgcaagaatggaaattttaagcaggtggaagcagagcttatagacaaattggattctatggtctctgaaggcaaaggcgacgaatcgtaccgtgaacttttcagtctgctgacacaactgttcgggccttacccttcactgctggagaaagttgaacaggagacatggagagagactggaatatccttcgtcaccagcgttacccgacttatggagcggctgctggattacagagactgcatgaaaggagaggaaactgagaacaaaaagatcggttgtactgtgaatctgatgaacttctacaagagcgagatcaataaagaggaaatgtacatacggtacatacacaaactttgtgatatgcacctccaagccgagaactacactgaggccgcgttcacattgcttttgtattgtgaactgcttcaatgggaagaccggcctctgcgcgaatttctccattatccgagccagacagagtggcagcgtaaagaggggctctgccgtaaaattattcactactttaataaggggaagtcgtgggaatttgggatcccactctgccgcgaactggcctgtcagtacgagtcactgtatgactaccagtccttaagctggatccgcaaaatggaagcgtcttactatgacaacatcatggagcagcagcggttggagcccgaattttttagagtaggcttttacgggcggaaatttcctttttttctgcgcaacaaagagtatgtctgccgcggacatgattatgaacgactcgaggcctttcagcagcggatgttgtccgaattcccacaagccgtggcaatgcaacacccgaaccatccagatgatgcaattttgcagtgtgacgctcagtacttgcaaatttacgccgttaccccgatcccagactacgtggacgtgcttcagatggatcgtgtgcctgaccgggtcaagtccttctacagagtgaataatgttcgaaagtttaggtatgatcgtccctttcacaagggtccgaaggacaaggagaacgagtttaagtccctttggatcgaacggactactctcacgctgacccactctctacccggcatcagcaggtggttcgaagtcgaacgccgcgagctggtagaggtgagtcctttggagaatgctatacaggtggtggaaaacaagaaccaggaactgagaagcctgatttctcagtatcagcataagcaggttcacggcaacatcaacctcctcagcatgtgcctgaacggagtcatcgatgcagctgttaacggcggcatcgctaggtatcaggaggctttctttgacaaagattatatcaataaacatcctggcgatgcagagaaaattactcagcttaaagagctgatgcaggaacaggtgcatgtgttaggcgtcggcctcgcagtgcatgagaagttcgtgcatcctgagatgcggccactacataaaaagcttattgatcaatttcagatgatgagggcctcactgtatcacgaatttcctgggctggacaagctgagtcctgcgtgcagcggaacctccacccctcggggcaacgtgctcgccagccacagccctatgtccccagaaagcatcaagatgacccacaggcacagcccaatgaatttaatgggcaccggacgacacagctcttctagtctgagttcccacgcgtcttcagaggctgggaacatggtgatgctcggcgatgggtccatgggggatgccccagaagatctctatcaccacatgcagcttgcctatccgaatcctaggtaccagggcagcgtgaccaacgtcagcgtcctgtcaagtagtcaggccagtccctctagtagtagcctttcctcgactcacagcgcaccttcccaaatgatcacgtcggctccttcaagtgcacgtggatccccaagccttcctgacaagtaccggcatgcccgtgagatgatgctacttctgccaacttatagggataggccatcatctgccatgtatcctgccgctattctcgagaacggccagcccccgaactttcagcgagcgctcttccagcaggtcgtcggcgcttgtaagccttgctctgatcctaacctgtccgtcgctgagaaaggtcactattcactgcattttgatgcatttcatcaccctttgggcgacacccctcccgctttaccagccaggacgctccggaaatcgcctctccatcctatccctgcgagcccgactagcccccagagcggactcgacggctcgaactccactctaagcggctccgcaagcagtggagtttccagtctcagtgaatccaactttggccacagttcagaagccccacccaggacagacacaatggacagcatgccgtcgcaggcctggaatgcagacgaggatctggagccaccataccttcccgtgcattatagcctcagcgagagcgcagttctcgactcgatcaaagcccagccctgtagaagccactctgcaccgggatgcgtaattccacaggaccctatggatccccctgccctgcccccgaagccataccatcctaggttgcctgcactcgagcacgacgagggcgtcctcctgcgtgaggagaccgaacgtccccgaggactccacaggaaagctccactgcctcctggctccgcgaaagaagaacaggcaaggatggcctgggagcatggaaggggagagcagtag

SEQ ID NO: 185049 - DNA, 1785 bp, Artificial Sequence
  Description of Artificial Sequence: Synthetic coding sequence
atgcccaagtggctggaggagaccgagaacaagaagatcggctgcaccgtcaatctgatgaatttttataaaagcgagatcaacaaagaagagatgtatatacggtacatccacaagctctgtgatatgcacttgcaggccgaaaactatacagaagcagcgtttaccctgctgctgtactgcgagcttcttcaatgggaggatagaccgctccgagagttcttacactacccttctcagactgaatggcaaagaaaggaaggcctgtgccggaagatcatccactacttcaataagggaaagtcttgggagtttggcatcccactatgcagggagctggcatgtcagtatgaaagtctgtacgattatcagtcattaagctggattagaaaaatggaagctagctactatgacaacatcatggagcagcaacggctggaacccgagttcttcagggtgggcttctatggccggaaatttcctttctttctgagaaataaggaatatgtatgcaggggccacgattatgaacgcctcgaagctttccagcagcggatgctgagtgagtttccacaggccgtggctatgcaacatcctaatcatccagacgatgctatcctgcaatgtgatgcacagtaccttcagatttatgctgtaactcccataccggattacgtagacgttctccaaatggacagagtgccagaccgggtaaagagcttttatcgcgtaaacaatgtccgtaaattcagatatgaccggccttttcacaaaggacctaaagataaggaaaatgagttcaagagtttgtggattgagaggactacacttacactgacccattcactcccaggaatctcaaggtggttcgaagtagaaaggagagagttagtggaggtgtctcccttggaaaacgcgatccaggtggtggagaacaagaaccaggagctcagaagtctcataagtcagtatcagcacaagcaggtccacgggaatattaacttgctttctatgtgtcttaatggggttatcgacgcagccgttaacgggggaatcgcccgctatcaggaggcattttttgataaggattacataaataagcaccctggcgacgccgagaagatcacacagttaaaggagctcatgcaggaacaagtgcatgtcctcggcgtgggactggcggtgcatgagaagtttgtgcatcctgagatgaggcctctccacaagaaactcattgatcagtttcagatgatgcgcgcatctctgtaccacgagtttccgggactggataagctgagtcctgcttgttctggaactagcacaccccgggggaacgtgctcgcaagtcattcaccaatgagccccgagagcattaagatgacccaccggcattcacctatgaacctcatgggtacaggcagacactcatcctctagtctctcgagtcatgcatcaagtgaggccggcaatatggtgatgttaggcgacgggtctatgggtgatgctccagaggacctataccatcacatgcaactggcctacccgaaccctcggtaccaggggagcgtcactaatgtatcggtgctttctagttcccaagcgtccccctcaagttcctctctttcaagcactcatagcgcaccaagccagatgattacatcggctccctcctccgccagagggtctccatccctgcctgacaaatacagacacgcgcgggaaatgatgcttctgcttccaacttacagagacagaccttctagtgctatgtatcctgcggcatag

SEQ ID NO: 185050 - DNA, 5778 bp, Artificial Sequence
  Description of Artificial Sequence: Synthetic coding sequence
gtgatcgccagcttccggggcaccgtgccctacggcctgagcctggaaatcggagatacagtgcagatcctggaaaaatgcgacggctggtacagagggtttgccctcaagaacccaaacatcaaaggcatctttccaagttcttacgtgcacctaaaaaacgcttgtgtcaagaataaagggcagttcgaaatggtcatcccgaccgaggattccgtaatcaccgaaatgacaagcacccttcgggattgggggacaatgtggaagcagctctacgtgagaaacgaaggggacttgttccaccgattgtggcatataatgaacgagattctcgacttacgacggcaggtgctcgtggggcatctgacacatgatcgtatgaaggacgttaagcgacacattacagctagactcgactgggggaatgaacagttgggattggacctggtgccgcgcaaagagtacgcgatggtagatccagaagatatctcaattaccgaactctaccggctaatggagcaccgccaccgcaagaaagacaccccagttcaggcctcttcacaccacctgttcgtccagatgaagagcctgatgtgtagtaacctgggcgaggaactggaggtaatattttcactatttgactcaaaggagaatcgtcctatttcggagaggttcttcttacgactgaacaggaacggactgcccaaagcccccgacaagcccgaaagacactgcagtctgttcgtcgacttaggatcgtctgagttgagaaaggatatctatattacagtgcacatcatccggatcggacggatgggtgccggggagaaaaaaaacgcctgctcggttcagtatagaagaccttttggctgcgcagtgctgtcaatcgccgatctcctgactggggagacaaaagatgatctgatccttaaggtatatatgtgcaacaccgagtcggagtggtaccagattcacgaaaacatcattaaaaagctgaatgccagatacaacctgaccggcagcaacgccggacttgctgtctctctccagctactacatggtgatattgaacagatccgtagagagtactctagtgtgttctcccatggagtgtccatcacacgcaaactcggtttttcgaatattattatgccaggcgagatgcgaaacgatttgtatattacaatagaaagaggggagtttgaaaaggggggaaagtcagttgcgcgcaatgtggaagtgaccatgttcatcgtggacagtagtggtcagactctgaaagatttcatttcctttgggtctggggaaccccccgcctccgagtaccactctttcgtgttgtaccataacaattcaccacggtggagcgagctgttgaagctgccaattccagttgacaagtttcggggcgcccacatccgttttgagtttaggcactgctccactaaggaaaaaggggaaaagaagctatttggtttctcatttgtgccgctgatgcaagaggacggtcggacactgcctgatggcactcacgagctaattgtgcataaatgcgaggaaaataccaatctgcaggatacgactaggtacctgaaactgcccttttccaagggcattttcctggggaataataatcaggccatgaaggcaaccaaagagagcttttgcattacatcgttcctgtgctccacaaagctcactcagaacggcgatatgctggatctgctcaaatggcggactcatcccgataagattacaggctgcttatccaagctgaaagaaattgacggatctgagattgtgaagtttctccaagatactctagatacactgtttggcatactggacgaaaattcccaaaaatatggcagcaaggttttcgatagcctcgtacacataatcaacctcctccaagattctaagttccatcacttcaaaccagttatggacacctacatagaatcgcacttcgctggtgctctcgcgtaccgggatctcatcaaggttcttaagtggtatgtggaccggattacagaggcagagaggcaagagcatatccaagaggtgctcaaggcacaggaatacatcttcaaatatatagtgcagtcccggcgtctctttagccttgccactggtggccagaatgaggaggagttccgttgttgtatccaggagcttttgatgagcgtccggttttttctgtcccaggagagtaagggcagtggcgccctgagtcagtctcaggccgtgtttctctccagcttcccggccgtctactccgaattgctgaaactatttgatgttagggaggtggcaaacctggtgcaggatacccttggatcgctgcccacaattttgcatgtggacgacagtttgcaggccattaagctgcagtgcatcggcaaaaccgtcgaatctcagctgtatacaaatcccgattcccgatatattctcctgccggtggtcttgcatcatttacacatccatttacaggaacagaaagacttgattatgtgtgctcggatcttgtcaaacgtcttctgccttatcaagaaaaactcttctgaaaagtcagtgttggaagagattgatgtgattgtggcgtcactgctcgatatccttctgcgcaccattctggagatcacgtcacggcctcagccgtccagttctgccatgcgctttcagtttcaagatgtcacgggggagttcgtagcatgcctactgagcctgctgcgccagatgactgaccggcattatcagcagctgctggacagtttcaatacaaaggaagagttacgggatttcttgctccagatcttcacagtattccgaattctgatcaggcctgaaatgtttcctaaagattggaccgtcatgcggttggtcgcaaataatgttatcatcaccacagtgctgtacctatctgatgccctgagaaaaaacttcctgaatgaaaacttcgactacaaaatctgggattcttatttctatctggctgtgattttcatcaaccagctgtgtctccagttggagatgttcaccccttccaaaaaaaaaaaggtactggaaaagtacggggacatgcgagttaccatgggctgtgagatatttagtatgtggcagaatctcggggagcacaaattgcactttatccctgctttgatcggtccatttctagaggtcaccctcatcccccaacctgacctgcgcaatgtgatgatccccatctttcatgatatgatggattgggaacaaaggcgatcgggcaatttcaaacaagtcgaagctaagctgatcgataaactggactcattgatgtcagaagggaaaggcgatgaaacctatagggagctgtttaacagcataattcccctcttcggcccttaccccagcctgcttaaaaaaatcgaacgcgagacttggagagaaagtggcgtgagcctgatcgcaacggtaacaaggcttatggagaggctgctggactatcgggactgcatgaaaatgggcgaagttgacggaaagaagattggctgtaccgtgtcgttgctgaatttttataagacagagttgaacaaggaggagatgtatattcgatacattcataaactgtatgatctgcacttaaaggcacaaaattttaccgaggccgcatacaccctgttgctgtatgacgaactgttggagtggagcgacaggccactcagggagttcttgacctatccaatgcagaccgaatggcaacgcaaggaacacctgcacttgactatcatccaaaattttgatcgaggcaaatgttgggagaacggcatcattctttgcaggaagatcgctgagcagtacgagtcatattatgactaccggaacttgtcaaagatgcgcatgatggaggcttccctgtacgataaaatcatggaccagcaacggctggagcccgaattttttagagtgggattttacggaaagaaatttccatttttccttcggaacaaggagtttgtctgccgcgggcacgattacgagagactcgaagcatttcagcagcgaatgctcaatgaatttccccatgccattgccatgcaacacgccaaccaaccggacgaaactatttttcaggccgaggctcaatacttacagatatatgcggtgactcccatcccagagtctcaggaggtactgcagcgggagggggttccagacaatatcaaatctttttataaagtgaaccatatatggaaatttcggtacgaccgtcccttccacaaggggacaaaggacaaagaaaacgagtttaaatcattgtgggtcgaaaggacctctttatacctcgtgcagtccctcccagggatcagccgttggttcgaggtcgagaagcgtgaggtggtggagatgtctccactggagaatgctatcgaagttctcgaaaataagaaccagcagttgaagacattaataagtcagtgccaaacaagacagatgcaaaacattaaccccctcacaatgtgtctcaatggcgtgattgacgccgcagtaaatgggggcgtgagtaggtaccaagaggcattttttgtgaaggagtacatcctgagccaccctgaagacggggagaaaatcgcccggttaagggaactcatgctagagcaagcacaaatactcgagtttggcttggcagttcatgagaaattcgtgcctcaggatatgaggcctctgcataaaaaactggtcgatcaattttttgtgatgaagtcgtccctgggaatccaggaattcagtgcttgcatgcaagcgagccctgttcactttcccaacggtagcccaagagtctgtaggaactctgcccccgcatccgtcagcccagacggcacccgggtaattcccaggagaagcccactatcatatcctgccgtgaatagatactcctcttcatccctgtcttcacaggcctccgcggaggtatccaatataacaggacaaagcgaatctagcgacgaagtgtttaacatgcagccatccccttcaacatccagtctgagtagcactcacagcgcttctcccaacgtcacttccagtgcccctagttcagctcgcgctagcccactgttgagtgacaagcacaagcactctagagaaaacagctgcctctctccccgcgagcggccctgctctgccatataccccacacctgtggaacctagtcagagaatgttatttaaccacatcggtgacggggccctgcccagatccgatcccaatttgagtgcaccggaaaaagcaagccccgctagacacactacgtctgtttctcctagtccagctgggagaagcccattaaaaggttccgtgcagtcatttaccccctctccagtcgaataccacagccctgggttaatttccaattcaccagtactgagcggatcgtacagtagcgggattagttcactgagtaggtgttcaactagcgagacaagcgggtttgagaatcaagtcaatgagcagagtgccccccttcctgtaccggttcctgtacccgttcctagctatggcggcgaggaaccagtgagaaaggagtcaaagacacctccgccttattcggtgtacgaaagaacgctccgccggccagtgcctcttcctcattccctgagcatcccggtgactagtgagccacctgccctgccacctaaaccattggctgcgagaagcagtcacctggagaatggcgcccgcaggacggatccaggaccacgcccgcggcccctgccccgcaaagtgtcccagctctag

SEQ ID NO: 185051 - DNA, 5865 bp, Artificial Sequence
  Description of Artificial Sequence: Synthetic coding sequence
gtgatcgccagcttccggggcaccgtgccctacggcctgagcctggagattggcgataccgtccagatcctcgagaaatgcgatggatggtatcgaggcttcgcgctgaagaaccccaatatcaagggtatttttccctcttcctacgtgcacctgaagaatgcttgtgtgaagaataaagggcaatttgagatggtcatcccaaccgaagatagcgtgatcaccgagatgactagcacattgagggactggggaacaatgtggaaacagctgtacgtgcgcaacgagggcgatctgtttcaccgactgtggcatataatgaacgaaatcctcgaccttaggcgccaggtgctggtcggacacttgacccatgaccgtatgaaggacgtgaagcgccatatcaccgcccggctggactgggggaacgagcagctgggtctagacctcgtcccaagaaaggaatacgcaatggtggatcctgaggacatctctattaccgaactgtaccggttgatggaacacaggcacagaaaaaaggatacgcctgtgcaggctagtagccatcatttatttgtgcagatgaagtctctgatgtgtagtaatttgggagaggagctcgaggtgatctttagcttgttcgactccaaggagaaccgccctatcagcgaacgcttcttcctgcgtcttaaccggaatggactgcctaaggcccccgacaaaccagagaggcactgttccctgtttgtggatctcggcagttccgagcttcggaaggacatctatattactgttcacattattcggatagggcgtatgggggctggggaaaagaaaaatgcttgttccgttcagtaccgtagaccttttggctgtgcggtgctgtcaattgccgatctactgactggcgaaacaaaagacgatctgattctgaaggtgtacatgtgtaatacagagagcgaatggtaccagatccacgagaacattatcaaaaagctgaatgctagatacaatctgaccggcagcaatgccggcctggccgtatctctgcagctcctgcacggggacatcgaacagattcgccgggaatactcatcagtgttctctcacggagtgtcaattactagaaaactcggcttctctaacatcataatgcccggagagatgcggaacgatctctatattacgatcgagcgcggagaattcgagaagggcgggaagtcagtggcccgcaacgtcgaagttaccatgtttatcgtcgactctagtggacagactttaaaggatttcataagtttcggaagtggagagcctcctgccagcgaataccacagctttgtgctctaccacaacaacagtcccaggtggtcagagctgctcaaactacctattcctgttgacaaatttcggggcgcgcacattagattcgagtttcggcattgcagcacaaaggagaagggggagaaaaagctgtttgggttttccttcgttcctctcatgcaggaggatgggcgaaccctcccagacggcacacatgaattgattgttcacaagtgcgaggaaaatacgaatctacaggataccacgcggtacctaaagctcccttttagcaagggcatctttctcggaaataacaaccaggccatgaaggctaccaaggagagcttctgcattaccagctttctctgctctaccaaactcacccagaatggtgacatgctggatctactgaagtggagaacccatcccgataagataaccgggtgtctgagcaaactgaaggaaattgatgggagtgagattgtcaagtttctgcaggatacactggatacgctctttggcattttggacgagaactcccagaaatatggttctaaagtgttcgatagcttggtgcacattatcaatctactgcaggactcgaaattccaccatttcaagccagtgatggacacctacattgagagtcattttgcaggcgcattagcttacagagacctgattaaggtcttgaaatggtacgtggaccgcatcaccgaggccgagagacaggaacacatccaggaagtgcttaaggcacaggagtatattttcaagtacattgtccagtctaggaggctattttccctcgctacaggcgggcaaaatgaggaggagttccggtgttgcatccaggagcttctgatgtccgtccggttcttcctgtctcaggagtctaagggcagtggtgccttatcacaatctcaagctgtctttctgtcttctttccccgccgtgtactcagaactgctgaagctgtttgatgtgcgagaggtggccaatctcgtccaggatacattaggctccttgcccactatacttcatgttgatgattctctgcaggctatcaagctccagtgcattgggaaaactgtggaatctcaactatacacgaaccccgactccaggtacattttactgcccgtggtcttgcaccacctccatatccatctgcaagaacagaaagatctcatcatgtgtgccaggatcttgtctaacgtcttctgtctgatcaaaaagaactcaagcgagaaatcggtcctcgaggaaatcgatgtgattgtcgcatctctcctggatattttgcttcgaacgattttagaaatcacaagccgccctcagccaagttcttctgcaatgagattccagttccaggatgttactggggagttcgtggcctgcctgttaagtcttttaagacagatgaccgatcgtcattatcagcagctactggatagctttaatacaaaagaagaattaagggattttctgctgcaaatcttcacggtatttcgaattttaataaggccagagatgttccccaaggactggaccgtgatgcgactagtggcaaacaacgtaatcatcactacagtgctatacctttccgatgctttgcgtaaaaatttcttaaacgaaaattttgactacaaaatctgggattcatacttttacctcgccgtgattttcatcaatcaactgtgtttacagctggaaatgtttacacccagcaaaaagaaaaaggtgctcgagaagtatggggacatgcgggttactatgggctgcgaaatttttagcatgtggcagaatttgggtgagcacaaacttcatttcattcctgcactgataggaccattcttggaagtgacattgatacctcagccggacctcagaaatgtaatgatccccatcttccacgacatgatggactgggaacagcgcaggagtggcaattttaagcaagtggaggctaagttaatagataagctggactcattgatgagtgaaggcaagggagacgagacttaccgcgagctgtttaatagtattttgctaaagaagatcgagagggaaacctggagagagtctggggttagtctgatagccacagtgacgagactgatggaaaggctcctggactacagagattgcatgaagatgggcgaggtggatgggaaaaagatcggttgtaccgtttccctgcttaacttctacaagactgaactcaacaaggaggaaatgtatatccgatatatacataaattgtatgacctccatttgaaagcccagaatttcacagaggccgcatacacgttactactgtacgacgagctactggagtggtctgatagacccctgagggagttcctgacgtatccaatgcagacagagtggcagcgaaaagagcatctacatctgaccattattcagaattttgataggggaaaatgctgggagaatgggatcattctgtgccggaagattgctgagcagtacgaaagttattatgactaccgcaacctctcgaaaatgcgcatgatggaagcaagcttgtacgataaaattatggatcagcagagactggaacccgaattcttccgggttggcttttatggtaagaaatttccctttttccttaggaataaagaatttgtgtgcagaggacacgactacgaaaggcttgaggcattccagcagcgaatgctgaacgaattcccacacgctattgccatgcagcatgcaaaccagcccgacgaaacgatcttccaagccgaagcccagtacttacagatctatgctgtcacaccaatccccgaaagccaagaagtgctgcaacgcgagggagtccccgacaacatcaagtctttttataaagtcaaccacatctggaagtttcggtacgaccggcccttccacaaaggcaccaaggacaaggagaacgaattcaaatccttgtgggtcgagcgaacatccttatacctcgtccagagccttcccggtatctctagatggtttgaagttgagaaacgggaggtagttgagatgtcacctcttgagaacgccatagaagttcttgaaaataagaaccagcagctgaagacactgatctcacagtgtcagacccggcagatgcagaacatcaatcctttgacaatgtgtcttaatggcgtaatcgacgcggctgtcaacgggggtgtgtcgaggtatcaggaggcttttttcgtgaaggagtatatactgtcacacccagaagacggagaaaagattgctcgattgagagagctgatgttggagcaggcacaaatcctcgagtttggactggctgtacacgagaagtttgttccacaggacatgaggcctctacataaaaaactggtggaccaattctttgtgatgaagagcagcctggggatccaggaattcagcgcttgcatgcaagcaagtcctgtgcacttccctaacgggtctccccgcgtgtgcaggaattcagctcccgctagtgtcagcccagatggcactcgggtaattcctaggcggagtcctctgtcctatccagccgtcaacagatacagttcttcttccctctcatcccaggctagtgccgaagtgagtaatattactggacagtccgaaagctccgacgaggttttcaatatgcaacctagcccctcgacaagctccctgtctagtacgcattctgcatctcctaatgttaccagcagcgccccgtcttccgcgcgagccagccctctgctctcggataaacataagcacagcagagaaaactcatgtctatcccccagagaacgaccctgttcagcaatctacccgactccagtagagccttctcagcgcatgctgttcaatcatatcggggatggggcgctcccacggagtgatccaaacctcagcgcacctgagaaggcagtgaatccgactccttcatcatggagcctagattctgggaaggaggccaaaaatatgtcagactctggaaagctgatttcccccccggtgcctccaaggcccacccagacagcaagccccgcacggcacaccacctccgtgtctcctagccccgctggtcgctctccgctcaaaggatctgtacagtcattcaccccatctcccgtggagtatcacagtccgggcctgatttcaaattccccagtgctgagtggctcctattcgagcggcatctcctccctaagccgctgctccaccagcgagacaagcggattcgagaaccaggtaaatgaacagtctgcccctctgcccgtgccggtccctgttccagtgccaagctacggaggtgaagagccagtcagaaaggaatcaaaaacaccaccaccttactcagtatacgagagaactttgaggcgacctgtcccgcttccccactctctgagcattcccgtgacgtctgagccaccagccctgccgccgaaacccttggctgcccgaagcagtcacctcgagaacggtgcccggcggactgacccaggtcccagacctcgtcccctgcctaggaaagtgtctcagctctag

SEQ ID NO: 185052 - DNA, 5928 bp, Artificial Sequence
  Description of Artificial Sequence: Synthetic coding sequence
atgtggatccccaccgagcacgagaagtacggcgtggtgatcgccagctttcgcgggacggttccatacgggctgagtctggaaataggtgacacggtacagattcttgagaaatgcgatggctggtatcgggggtttgcactgaagaaccctaacatcaaggggatcttcccaagctcttatgtgcacctgaaaaatgcctgcgtcaagaataagggacagtttgaaatggtgattcctactgaagattcagtgatcacggaaatgacttcaactctccgtgattggggcacaatgtggaaacagctctatgtcaggaatgagggcgatctctttcataggttgtggcacattatgaatgagattctggatctgaggcgtcaagtgctggttggacatttgactcacgaccggatgaaggatgtcaaaagacacatcaccgcccgcctcgactggggaaatgagcagttgggtctggatttggtgcccagaaaagagtacgccatggtcgacccagaagatatatcaataactgaactgtatcgcctgatggagcatcggcatcgtaaaaaagacacacctgtccaggcgtctagtcaccatctgttcgtgcaaatgaaatctttaatgtgttccaacctgggcgaagagctcgaagtgatcttttccttgttcgatagcaaggagaaccgtcctatctccgagagattctttctccggctgaataggaacggcctgcccaaagctcccgataaaccggagaggcattgctcgttattcgtggatttgggtagctcagagttgcgaaaagacatatacataaccgtgcatataatcagaatagggcgaatgggtgccggcgaaaagaaaaacgcctgttcggtgcagtatcggagaccctttgggtgtgcggtgctttccatcgccgacttactgaccggggaaacgaaggatgatctgattttgaaagtatatatgtgcaatacagagtccgagtggtaccagattcatgaaaacatcattaagaaattgaatgcacgctacaatcttacaggctccaacgcaggcctcgcagtgagcttgcaattattgcatggagatatcgagcagatccgccgcgagtacagctcagtattctcccacggagtttctatcaccaggaagttggggttcagcaacattatcatgcccggtgagatgagaaatgacctctacatcacaattgaaaggggtgaatttgagaaaggcgggaagagtgttgcccgtaacgtggaggttaccatgttcatagtggattcttcaggacagacccttaaggatttcatctcttttggaagtggagagcctcctgcctccgagtatcattcattcgtgctctaccacaacaactcccctagatggtcagaactgctcaagctacccatccccgtagacaagttcaggggtgctcatatccgctttgagtttcggcattgtagcacgaaggaaaaaggggagaaaaagttgttcggattttcatttgtgcccttgatgcaggaagatgggaggacactcccggatgggactcacgaactgatcgtacataagtgcgaagaaaacaccaacctccaggacactactaggtacctgaaacttcccttcagcaagggcatatttctgggaaataataaccaagctatgaaagcaacaaaagagtccttttgtatcacaagctttttgtgttccacaaagctgactcaaaacggcgatatgctcgatctgcttaaatggcgcacgcatccagataagataactgggtgcttgtctaagctgaaggagatcgacgggtctgagatcgtcaagttccttcaggacactctggacaccctctttggcatcctcgatgagaattcgcagaagtatgggtctaaagttttcgattcacttgtacacataatcaacctgctgcaggactccaagttccaccactttaaacccgttatggatacctacatcgagtcacatttcgccggcgcgctggcctatagggaccttattaaggtgctgaagtggtacgtggacaggatcacagaggcggaacggcaggaacacatccaggaagtgttaaaagcacaggaatacatttttaagtacatcgttcagtccaggcgactcttttctttagccacaggcgggcaaaacgaggaggagtttcgctgctgcatccaggaactgctgatgagcgtaaggttcttcctctcacaggagagcaagggctctggtgcactcagtcagtcccaggccgtgttcttgtcttcttttcccgcggtgtactctgaactgcttaagcttttcgacgtgagagaagtcgccaacttggtgcaggacacactcggaagcctccctaccatccttcacgtggacgactccctgcaggcgatcaagttacaatgtattgggaaaactgtggaatcgcaattgtacaccaatccggacagtagatacattctgctgcccgttgtgctgcatcacctgcatatccatctgcaggaacaaaaggaccttattatgtgtgctcgcatcctcagtaatgttttttgcttgatcaaaaaaaactcatcagaaaagtccgtcttagaggaaatcgatgtgatcgtcgcatcactcctggatatactgttgagaacgattctagagataacttcccgtccccagccgtcttcttccgcaatgcgtttccagttccaggatgtgaccggtgaattcgtggcctgtctgctcagtcttctgaggcaaatgacagatcgccactatcagcagctcctggattcattcaacactaaagaagaactgcgggactttctgctccaaatcttcacagttttcagaattctgataagacccgagatgtttccgaaggactggacagtcatgcgccttgtggccaacaatgtaatcataacaacagtcctgtatctgtctgatgctctacggaagaactttctgaatgagaacttcgattataaaatttgggactcttacttttacttggccgtgatcttcatcaaccagttgtgtttgcagctagaaatgttcactccatccaaaaagaagaaagtgctagaaaaatatggcgacatgagagtcaccatggggtgtgaaatctttagcatgtggcagaacctcggcgaacataaattacatttcattcctgcactgatcgggcctttcttagaggttacgcttattccgcagcctgacctacgcaacgttatgattccaatttttcatgatatgatggattgggagcagagacgttctggcaacttcaagcaggttgaagccaaactgatcgacaaactggacagtctcatgagtgaaggcaaaggcgacgaaacctaccgcgaactgttcaactccataatcccacttttcggaccttacccaagcctgctgaagaaaatcgagcgggagacctggagggagagcggtgtgtccctcatagccactgtgacgcggctgatggaaagactcttggactaccgcgactgtatgaaaatgggcgaggttgatggcaagaagatcgggtgtacggtttccctattgaacttttacaagacagaattaaacaaggaggaaatgtacatacggtacattcataagctgtacgacctgcacctgaaagcccagaacttcacagaggcggcctataccttgctgctttatgacgagctgctcgagtggtctgacaggccattaagagagttcttgacataccctatgcagacggaatggcaaaggaaagagcacttgcacctcaccataattcaaaacttcgaccgaggcaaatgttgggaaaatggaatcatactttgtaggaagattgccgagcagtacgaatcctactacgactacaggaatctaagcaagatgcgcatgatggaggcttctctgtacgataaaattatggatcagcagcggctggaacccgagttcttccgcgtaggcttttatggaaagaaattcccttttttcttacgaaataaggagtttgtttgccgtggtcatgactacgaaagactcgaggcttttcagcagagaatgttgaatgagttcccacacgcgatcgctatgcagcacgcaaatcagccggacgaaaccatcttccaggccgaggctcagtatctgcagatctatgctgtgaccccgattccagagagtcaagaggtactgcagcgggagggagtccccgataacataaagtccttctacaaggtcaaccatatttggaagttcagatatgaccggcctttccacaagggtaccaaagacaaagagaacgaattcaaatctctgtgggtggagcgcactagcttgtaccttgtgcagtctctgcctggaattagtagatggtttgaggtcgaaaagcgcgaggtggtggaaatgtccccattagagaacgcaatcgaagtcctggagaacaagaatcaacagctgaaaacattgatctcacagtgccaaactagacagatgcagaacatcaaccccctgaccatgtgcttgaacggcgtgatcgatgccgctgtcaacgggggggtgtcccgttaccaggaggcattcttcgtcaaggaatatatactaagccatcccgaggatggagaaaaaatcgctagattgcgggagctcatgctggaacaggctcagatattagagttcggacttgccgtgcatgagaagtttgttccccaagatatgcgtccactgcacaaaaagctcgtcgaccagtttttcgtgatgaaatcttcattggggatccaggaatttagcgcctgcatgcaggcctcgcccgtacattttccgaacggtagtccaagggtgtgtagaaactcagccccagccagcgtgagccccgatggaacccgagtgattcctagacgcagtccactgtcctatcctgcagtaaaccgttacagctcatcgtccctgtcttctcaagcttccgctgaagtgagcaatattacagggcagagcgagtcttccgatgaggtatttaacatgcagcccagtccttccacttcgtcattgtcttccacacactcggcgtctccaaacgtgactagctctgcccccagttccgctagagcgagcccactgctctcagataaacataaacacagtagggagaattcctgcctgagtccgcgtgaaaggccgtgctctgccatctatcctacccctgtggaaccatctcagaggatgctgtttaaccacattggggatggtgcgctcccccgctcagacccgaatctgagcgccccagagaaagctgttaatcccaccccctcatcgtggtctctagatagcggaaaagaggccaaaaacatgtctgactccgggaaacttataagtcctcccgtgcctccaagacccactcagactgccagtccagcccgccacacaacgagtgtgtccccatccccggccggtcggagccccctgaaaggctccgtgcagtctttcaccccttctcctgtcgagtatcatagtcccggactgatttcaaactctcccgtactgtcaggcagctatagctccggcatcagctctttatcccggtgctccacgtcagagaccagcggctttgaaaaccaggtcaatgagcagagtgctcccttaccagtgcctgtgcccgtgcccgtgccatcctatggcggggaagagcctgtgcgcaaggaaagtaagacaccgccgccctacagcgtgtatgaacggactcttcggaggcctgtaccactccctcactctttaagcattccagttacttctgaacctcccgccctcccccctaaacctctcgctgcccgctctagccatcttgaaaatggcgcccgcagaactgatccagggccgaggccccggcccctgccccggaaggtttcacagctgtag

SEQ ID NO: 185053 - DNA, 5901 bp, Artificial Sequence
  Description of Artificial Sequence: Synthetic coding sequence
atgtggatccccaccgagcacgagaagtacggcgtggtgatcgcctcatttaggggtacagtcccctacggcctgtctctggagatcggggacacggtgcagatactggagaagtgtgacggctggtaccgcggcttcgccctgaaaaacccaaacattaaagggatcttcccaagctcctatgtccacctgaaaaacgcttgtgtgaaaaataagggtcaatttgaaatggtaataccaaccgaggacagtgttatcactgaaatgacgtccaccctgcgcgattggggaactatgtggaagcagctttacgtgagaaatgaaggcgatctctttcatcgtctttggcacattatgaacgagatcctggacttgcggcggcaggtcctcgttggacatctcacacacgaccgcatgaaagatgtcaagcggcacatcacagccaggctcgattggggcaacgaacaattggggctggacttagtgcccagaaaggagtacgctatggtggacccagaggatatcagcattacagagctttaccgactgatggagcatagacaccgcaaaaaagacacacctgttcaggcgagcagtcaccatctgtttgttcaaatgaagtcattgatgtgctcgaatctgggagaagagcttgaagtcatcttcagcctgttcgatagcaaggaaaacagaccgatatcagagcggttcttcctgcgcctgaacaggaacggtttaccaaaagcccccgacaagccagagagacattgtagcctctttgtagaccttgggtcctccgagcttaggaaggacatttacatcactgtgcacattatcaggatcggccggatgggagcgggggaaaagaagaacgcctgtagtgttcagtatcgccggcctttcgggtgcgcagtgctgtctatcgctgatctgttgactggagagactaaggatgacctcattttgaaggtttacatgtgcaacaccgaatctgagtggtaccagatccacgagaacatcattaaaaagctgaacgcgaggtacaacttgacaggaagcaacgccggactcgcagtttccctccagttgctgcatggcgacatcgaacagatccgacgcgaatactcatccgttttctcgcatggagtatcaatcacccgcaaactggggttttccaacataatcatgccgggcgaaatgaggaatgacctctacattaccatcgagaggggggagttcgagaaggggggcaagtcagtcgctcgaaacgtggaggtgacaatgtttatcgttgacagctccggacagacactaaaagacttcataagcttcggcagcggcgaaccgccagccagcgagtaccacagctttgtcctgtaccacaacaactccccccggtggtctgagttgctcaaattgcctatcccggttgataagtttaggggggcccacatcaggtttgaattcagacactgcagtactaaagagaagggagaaaaaaagctctttggctttagcttcgtgccactgatgcaggaggatggccgtacactcccggacggcacacacgagctaattgtacataagtgcgaggagaacaccaatctgcaggatactacccgctaccttaaattgcctttttcaaagggcattttcctggggaataacaaccaggccatgaaagctaccaaagagagcttctgcataaccagtttcctgtgcagcacaaagctgactcaaaacggcgatatgctcgatcttctaaagtggcggacccaccccgataagatcacagggtgtctgagcaagctgaaggagatcgacgggtccgaaatcgtgaaatttcttcaggacactcttgacactttgtttggaatcctcgatgagaattctcagaaatacgggagtaaggtattcgactcgcttgtgcatatcataaacctgttgcaagattccaagtttcatcactttaaaccagttatggatacttacatagagagccattttgccggagctctggcataccgagatctaatcaaagttctcaaatggtacgtggaccggattactgaggcggagcggcaggagcacatccaagaggttttaaaggcccaggagtatatcttcaagtacatagtgcagagcagacgcttattctctctggcgactggaggacagaacgaggaggaattccgctgttgtattcaggagctgctgatgagtgtccggttttttttgagtcaggagtcaaaaggttcaggggctctaagtcagtctcaagcggtgttcctctcctctttccctgcggtgtatagcgaactcctgaagctgttcgatgtaagagaagtggccaacctcgtgcaggatacactgggctccctgcctaccattctgcacgtcgatgacagtctgcaagccattaaattgcagtgtatcgggaaaaccgtggaaagtcaactgtacaccaaccccgactctaggtacatcctgctcccggtggttctccatcacttgcacatccacctgcaagagcagaaggatctcataatgtgtgcaagaattctctcaaatgtgttctgtttgatcaaaaaaaattcctctgagaaatcagtgctcgaggagatagacgtgatcgtggcaagtcttcttgatatcctcctgcgcacaattttagagataaccagccggcctcagccttcgtctagcgccatgagatttcagttccaggatgtgaccggggagtttgttgcttgtctcctcagcctgctgcgccaaatgaccgaccggcactatcagcaactcctcgacagcttcaacacaaaggaggaattacgggacttcctgctgcagatttttactgtgtttaggatcctcattagacctgaaatgttcccaaaggactggactgtcatgcggttagtggcaaataacgtgataattaccaccgtgctgtacctgagcgacgcgctcaggaaaaatttccttaacgaaaatttcgactacaagatctgggattcatatttctatcttgctgtgatattcatcaaccagctgtgtctgcagctggagatgttcactccctcaaagaagaagaaggtgctcgagaagtatggagatatgagagtgaccatgggttgtgagattttttcgatgtggcagaacctgggcgagcataagctacacttcattcccgccctgatcgggcccttcctggaggttaccctgattccacagcccgacttgcgcaatgtgatgatccccatctttcatgacatgatggactgggagcaaaggaggagcgggaattttaaacaagtagaagctaaattaatagataagctggattctctcatgtcagagggtaaaggagatgaaacctatcgcgaactgtttaactccattttattgaaaaagatagagagggagacctggcgcgagagcggggtctctcttatcgctaccgtaacacgcctaatggaacgactactggactatcgggattgtatgaaaatgggcgaggtggacggcaagaagattggctgcactgtgtccctgttgaatttctataagacggaactcaataaggaggagatgtatatcagatatatccacaagctgtacgacctacacctgaaggcccagaactttacggaggccgcctataccctgctgctttacgacgagctccttgaatggtccgaccgtccgctgcgtgaatttctgacctatcccatgcagaccgagtggcaaaggaaagagcatcttcatttgactatcatccagaactttgaccgagggaaatgttgggaaaacggcattatactctgccgcaagatagccgaacagtacgagtcctattacgactaccgcaacctgtctaagatgcgaatgatggaggcatccctgtacgataaaataatggaccagcaacggctagagccagagtttttcagagtggggttctacgggaaaaaatttccattcttcctgagaaataaggaattcgtgtgtcggggccacgactatgagcgcctggaagcctttcaacagaggatgttaaacgagttccctcacgccatcgcaatgcagcatgcgaaccagccagacgaaacgatcttccaggccgaagcccagtacctgcagatttatgcagtcactcccatcccagagtcccaggaggtgctgcagagagagggcgtgcccgataatatcaagtcattttacaaggttaaccacatatggaaatttagatacgaccgccccttccacaagggaacaaaggacaaggagaacgagtttaagtccctgtgggtggagagaacctctctgtacctcgtccagtcactccctggtatttccaggtggtttgaagtggagaagagagaggtcgtcgaaatgagtcccctggagaacgccattgaagttctggagaataaaaatcaacagcttaagaccctcatcagccaatgtcagacccggcagatgcagaatatcaaccccttgaccatgtgtctaaatggagttattgacgcagccgtcaatgggggtgtgagccgctatcaagaggccttcttcgtgaaggagtatattctgtctcatcccgaggacggcgaaaaaattgcccggttaagagagcttatgcttgagcaggctcagatcttggagtttgggctcgctgtgcacgagaagtttgtgccacaagatatgcgaccgctgcacaaaaagttggtagatcaattttttgtgatgaagagctccttaggtattcaagagtttagcgcctgtatgcaagcatctccggtgcatttccctaatggttccccgagggtctgtaggaatagcgcccctgcatcagtctctccagacggaaccagggttatccctcgacggtctcctctgagttacccagccgtgaacagatacagcagctctagtctttcctcacaggcctctgccgaggtttccaatatcactggacagtcagagagctcagacgaggtttttaacatgcaaccctctcccagtaccagttcactgagctctacgcattctgcttctcctaacgtgacttcctctgctccaagcagtgctagagctagtcctctactcagcgacaagcacaagcactctcgggaaaactcctgcctgtcaccgcgggagcggccctgttctgcaatataccctacaccagtggagccctcccagaggatgctctttaatcatatcggagacggagctcttcctagaagcgatccaaacctctcagcccctgaaaaagcagtgaatcctacccccagttcctggtctctggactccgggaaggaggcgaaaaatatgtctgactcgggcaaactcatatcccctcccgtgccaccacggcccacccagaccgcgtctcctgccagacacacgacgtccgtgagtccttccccggccggacgatccccactaaaaggatccgtccagagtttcactcctagccctgtggagtatcattctccaggactgattagtaacagtcccgtcttatctggcagttattcgagcggaatttctagtttaagccgctgctccacaagcgaaaccagcggcttcgagaaccaagttaatgagcagagtgctcccttgcccgtgcctgtacctgtccccgttcctagttacggtggggaggaacctgtgcgaaaggaaagcaagacacctccgccgtattcggtctacgagaggacacttcggcgcccggtgcccctcccccacagcctctccattcctgttacatcggagcctcctgccttgccaccaaagccccttgccgcacgctcctcccacctggagaacggcgctcggaggactgatcccggacctaggcctaggcctcttccgcggaaagttagtcagctgtag

SEQ ID NO: 185054 - DNA, 2550 bp, Artificial Sequence
  Description of Artificial Sequence: Synthetic coding sequence
atgaagatgcacagcaccgagcggatccccctgttcggcccctacccatctctgttaaagaagattgaaagggagacatggagggagagcggagtgtctctcatagccacggtgacccggcttatggagaggctgttagactatagagattgtatgaaaatgggggaggtggacggtaagaaaattggttgtacggtatctctgctgaatttttataaaaccgagctgaacaaagaagagatgtacatccgctacattcataagctctacgacctgcatctgaaagcacaaaacttcacggaagccgcgtatactttgctgttgtatgacgaactgctggagtggagcgaccgcccccttcgggagttcctgacataccccatgcagactgagtggcaacgtaaggaacatttgcacctcaccatcattcaaaattttgaccgcgggaagtgctgggaaaatgggataattctgtgccgtaaaattgcggaacagtacgagagctattacgattatagaaacttatcaaagatgcgcatgatggaggcttcattatacgacaaaatcatggaccagcaacggcttgagcccgagttcttcagagtgggattctatggaaagaaattcccttttttcctgagaaacaaggaatttgtgtgtagaggacatgactatgaaaggctagaggctttccagcagcgtatgctgaacgaattcccgcatgctatcgctatgcagcacgcaaaccagccagatgagactattttccaggccgaggcgcaatatctccaaatttatgccgtcacacctatacctgaatctcaggaagttctgcaacgggaaggcgtgcctgacaacattaagtcattctataaagttaaccatatatggaagtttaggtacgatcggcctttccacaaggggaccaaggacaaagagaacgagttcaaatccctctgggtggaaagaactagcctttacctggttcagagcctccccggcataagtcgctggtttgaggtggaaaagcgcgaagtcgtggagatgtcccctctggagaatgcgatagaggtgctggagaacaagaatcagcagctgaaaacactaattagccagtgtcaaacaagacagatgcagaatattaatcctctgactatgtgtctaaatggcgtcatcgatgcagctgtgaacggaggggtaagcagatatcaggaagcattctttgtgaaggaatacatcctgtcccacccagaggatggcgagaagatcgcccggttacgggagctcatgctagagcaggctcagatcctggagtttggactcgccgtacacgagaaattcgtgccccaggatatgaggcctctgcacaaaaaactggttgaccagttcttcgttatgaagtctagcttggggatccaggagttctcagcttgcatgcaggcatcaccagtccactttcccaacgggtctccaagggtgtgtcggaattctgcaccagcctccgtctctcccgatggcacacgcgtaattccgcgtcggagcccactatcatatccagctgtcaaccgctattcttcttccagcctgtcctctcaggcaagcgcggaagtgtccaacatcactgggcagagtgaaagtagcgatgaggtcttcaacatgcagccctcacccagtaccagctctctgtcaagcactcacagcgcgagccctaacgtgacatcctcagcaccgtcttctgctagagcaagtcccttgttatcggacaaacacaaacattcccgggaaaactcttgtctgtcaccaagagagaggccgtgtagtgccatctatcccacccccgtggagcccagccagcgaatgctgtttaatcatatcggtgatggagccctgccaaggtctgaccctaatctgagtgcgccagaaaaggcagttaatcccacaccaagctcctggtctctggactccggtaaggaagccaagaatatgtccgactcaggaaagctgatcagccccccggtgccaccgcgccccacacagaccgcgagtcctgcaagacacactacctccgtgagtccatcccccgccgggagatcgccccttaaagggagtgtgcagtcctttaccccgtcgccagtagaataccacagccccgggctaatcagcaacagccccgtattgtcaggcagttattcttctggcatctcatctttaagtcgatgcagcacatcggaaacctcgggtttcgaaaaccaggtgaatgagcagagcgctccactgcccgtgcctgtgcccgtccccgtaccatcctacggcggggaagagcctgtcaggaaagagagcaagacgccccctccctacagtgtgtatgagcgaacactacgacgccctgtgcccctaccgcatagcttgtccatcccggttacctcagagcctcccgctttaccccccaaacctcttgccgcccgctcaagtcatctggaaaatggagccagacgaactgaccccgggccccgacccaggcctctacccaggaaggtgagtcagctttag

SEQ ID NO: 185055 - DNA, 3318 bp, Artificial Sequence
  Description of Artificial Sequence: Synthetic coding sequence
tggatccccagcgagaagcagaccttcttcaccgtgatcgccagcttcaggggcacggtcccctacggcttgtctctggaaattggggacaccgtgcaaattttggagaagtgcgacggctggtaccgaggtttcgctttaaagaatcctaacatcaagggaattttccccagcagctatgtgcatctgaagaatgcttgcgtcaaaaacaagggccagttcgagatggtgatccccaccgaggacagcgtgattacagaaatgaccagcacactcagagactggggaacgatgtggaaacagctgtatgttcgaaacgaaggtgatctctttcatcgcctgtggcacataatgaacgaaatattagacctcagacggcaggttttggtgggacacctcacacacgaccgaatgaaagatgtgaaaaggcatatcactgctaggttggactggggcaatgaacagttaggtcttgatctagtgccgagaaaagagtatgccatggtggaccctgaagatatctctattaccgaactgtaccgcctgatggaacaccggcataggaagaaggacactcctgtgcaggcgagcagccatcatctgttcgtacagatgaaatctttgatgtgctctaacctcggcgaggagctggaagttatcttctccctcttcgacagtaaggaaaacagacccatctcagagcgtttctttctgaggctgaacaggaatgggctacccaaagcacctgataagccagagcggcactgcagcctcttcgttgacctcggcagcagtgagcttagaaaagacatttatatcactgtgcacattatccgtatcgggagaatgggcgcaggcgaaaaaaagaatgcgtgttcagtgcaataccggcgaccttttgggtgtgccgtgctgtctatcgcggatctgctgactggagagactaaggacgatttgatactcaaggtctacatgtgtaacacagaatctgagtggtatcagatccatgagaatattatcaagaaactgaacgcacgctacaatctgacagggtccaacgccggattggctgtatctctacagctgctccacggggacattgaacagatcaggcgcgagtattcaagcgtgttcagtcacggagtgtccattaccagaaaattaggcttttctaatattatcatgcctggcgagatgaggaatgatctctatatcaccatcgaacgtggcgagtttgagaagggggggaagtccgtcgccagaaacgtagaggtaaccatgttcatcgtggactcctcagggcagacacttaaggacttcatctcattcgggtccggcgagccacctgcaagcgaataccacagctttgtgctctaccacaacaactcccctagatggagtgagctgctcaaactgcccattcccgtagacaaatttagaggggcgcacatccgatttgagttcaggcattgcagcacgaaagaaaagggagaaaagaagctgttcgggttctctttcgtgcccctgatgcaagaggatgggcgcactctgccagatggaacacacgagcttattgtgcacaaatgtgaagagaacactaacctgcaggacacgacccgatatctgaagttaccttttagcaaggggattttccttgggaacaacaaccaggccatgaaagcaaccaaagaaagcttttgcatcacatcatttctctgcagcacaaaactgacgcagaatggagacatgttagacctactcaagtggcggacccatccggataagattacaggatgcctgagtaagctgaaggaaatcgatggttcagagattgtcaagtttctgcaagacacccttgacaccctttttggcatcctggatgagaatagccagaagtacggatcgaaggtgttcgacagcttggtgcatattatcaacctactgcaagatagcaagttccaccactttaagcccgtgatggatacctacattgagagtcacttcgctggggctttggcttacagggatctgattaaagtgctgaagtggtacgtcgaccgcatcacagaagctgaacgccaggagcacattcaggaggtgctcaaagcccaggagtatatatttaagtacattgtccagtcacggagacttttctccctggccaccggtggtcaaaatgaagaggagtttagatgctgcatccaagagttgttgatgtccgtgcgctttttcctatcccaggaatccaaggggagcggagctctgtctcaatcacaggccgtgttcctgtcctcctttccagcagtctacagcgagctgctgaaactattcgacgtgagagaagtggcaaacctggtgcaagacactctgggatccctccccactatcctgcatgtggacgactcactgcaggcgatcaaactccagtgcattggcaagaccgtggaatcccagctctatacaaaccccgactcgcggtatatactgctgcccgtagttttgcaccacctgcacatccatttgcaggagcagaaggatctgataatgtgtgctagaatcctcagtaatgtgttctgcctgattaagaaaaactcttctgagaagagcgtactggaggagattgatgtgatcgtggcctctctgctggatatcttgctcagaaccattctggagatcacatcccgccctcagccctcctcctctgctatgcggttccaatttcaggacgtgactggtgagttcgtggcctgtcttttaagcctgttgcgtcaaatgaccgatcgacattaccagcagctgctggactcatttaatactaaggaggaattaagggacttccttctgcagattttcacagtcttcaggattttgatcagaccagagatgtttccgaaggattggacagtcatgagactggtagctaataatgtcatcataactactgtgctctatttatctgacgctctcagaaagaattttctgaatgagaattttgactataagatttgggatagctacttttacttagccgtgatcttcattaatcagctgtgcctccagctcgaaatgtttaccccctcaaagaaaaagaaagtcctcgagaaatacggtgatatgcgagtcacaatggggtgtgagattttcagtatgtggcagaatctgggcgagcacaaactgcacttcattccggccctgcgacaggaaaatcgcttgaacctgggcggcggcgggtgctcagaaccacgcgcctgccattgcactccggcttgggccactaagcgcgattgtgtttccaaaaagaaagaaaagaagacatag

SEQ ID NO: 185056 - DNA, 6144 bp, Artificial Sequence
  Description of Artificial Sequence: Synthetic coding sequence
atggccgccagcgagcggcgggccttcgcccacaagatcaaccggactgtagcagcggaggtgaggaaacaggtgtcccgtgagcgcagtggtagtccccacagtagtcgaaggtgctcaagctctctcggcgtcccattaacagaggtcgtcgaacccctggatttcgaagatgtgttgctaagcagacctcctgatgcagaacctggaccccttagggacctggtggaattccccgcggatgatctggagctcctcttacagcctcgcgaatgcaggacaacagaaccagggatcccaaaagacgagaaactggacgctcaggtgcgagccgccgttgaaatgtatattgaggattgggtaatcgtccaccgaagatatcagtacctgtcagcagcctatagcccagtcactaccgatactcagcgggagcggcagaaagggctgcctagacaggtgtttgagcaggatgccagcggcgatgagcggagtggccccgaagactctaacgactccagaaggggatcaggcagccccgaggatacccctaggagttccggagcgagctccattttcgacctcaggaacctcgcggcggattctttgctgccttcgcttcttgaacgcgcggctcctgaggacgtggaccggcgcaacgagaccctgcgcaggcagcatcgcccaccggccctgctcaccttgtacccagcgcctgacgaagatgaggcggtggaacggtgctctaggcccgaaccaccccgggaacactttggacagagaattttagttaaatgtctgtccctgaagttcgaaatcgagattgagccaatctttgggatcttggcactctacgacgtgagggagaagaaaaagatctccgaaaacttttattttgacctgaattcggacagcatgaaaggcctgctgagagctcacggaacccatcccgctatttctactctcgctaggtccgctattttctccgtcacctacccttctccagacatattccttgtcatcaagctggagaaagtgctccaacaaggcgacatttcggagtgttgcgagccatatatggtgctcaaagaggtggacacggctaagaataaagagaaattagaaaaactacggctggcagcagagcagttttgcacaagactggggcgatacagaatgccgttcgcatggaccgccgtgcacttggccaacattgtttcctccgctggccagctggacagggattcagacagcgagggcgagaggaggcccgcgtggacagacagacggcggagaggtccccaggatcgggcaagctctggtgacgacgcctgctcattttcaggcttcaggccggccacactgacagttactaacttctttaaacaggaggcagaacgcctcagcgacgaagaccttttcaagttccttgcggatatgcgtcggccctccagtctactacgtcggctgagaccagtaaccgcccagctaaagattgacattagtcctgccccagagaacccacacttttgcctctcccctgaacttctgcatatcaaaccataccccgatcctcgtggcagacccactaaggaaattctggagttccctgcgcgtgaagtgtatgcgccacacacatcctatcgaaatctgctgtacgtgtacccccactccttgaatttctcctcacgacagggttctgtccggaacttggccgttcgggtgcagtatatgacaggcgaagacccaagccaggccttgccggtgatctttggtaaatcttcctgttccgagttcacaagagaggcctttaccccagtggtctaccacaataagtcaccagaattctatgaagaattcaaactccatcttcctgcctgcgtgaccgagaaccaccatctgctgtttactttttatcatgtgtcttgccagccccgaccaggcaccgctctagagactcccgtgggctttacatggatccccctcttgcagcatggaagattaaggacaggaccattctgcctgcccgtgagtgtggatcagccccctccatcctattccgtcctaactccagacgtggccttacccggcatgcgctgggtggacgggcataaaggcgtgtttagtgtagagctgactgccgtgtcctcagtgcatccccaggacccgtatttggacaagttcttcactctcgtgcacgtgctcgaggaaggagcgtttccatttcgcctgaaggacacggtattgtccgaggggaacgtggaacaggagttgagagcgagtttggccgccctcaggctcgcctcccccgagccactcgtagcctttagtcatcatgttctcgataaactagtaagactggtcatccggcctcccatcatcagcgggcagatagtgaacctgggcagaggagcctttgaggccatggctcacgtggtgtcacttgtccaccgcagccttgaggccgctcaggacgcccggggacactgcccacagttggcagcatatgtccattacgcgtttcggttacccggcacagaacccagcctgcccgatggggcgccacctgtcaccgtgcaagcagccacactcgctagaggatctgggcgccccgcatctctgtaccttgcccggtccaagtcaatatcttcaagtaacccagatctagccgtggctcctggatccgttgatgacgaggtatcccggattctggcttcgaaactcctgcatgaagaactagccctccagtgggtcgtctccagctccgcggtgcgggaagccattctgcagcacgcctggtttttctttcagctcatggtcaaatcaatggcacttcacttattgctgggtcagcgccttgatacacctaggaaacttagattccctgggcggtttctagatgatatcactgccctcgtgggcagtgtcggacttgaagtcattactcgggtgcataaagatgtggagctggctgagcatctgaatgcctctctggctttcttcctgtccgatttactatcccttgtggaccgcggatttgtcttctccttggttagggcccactataagcaagtggctacacggcttcagtcgagcccaaaccctgcagctctgctgaccttgaggatggaattcaccaggattctgtgcagccacgaacactatgtaactctgaatctgccctgttgccctctgtcccctccagcatcaccttcaccttcggttagcagcaccacgtcccagtcttctacctttagctcccaggcgcctgatcctaaagtaactagcatgtttgagctcagcggacccttccggcagcagcatttccttgccgggctgctcctgactgagttggccctggccctggagcctgaggccgagggcgcttttctgctgcacaagaaggccataagcgcagtccatagtctcctctgcggccatgacactgaccctcgctacgcagaggccactgtcaaggccagagtggcagagctctaccttcctcttctctcgattgcacgcgacaccctcccaagattgcacgatttcgcggaaggcccagggcagcggtctagactcgcgagcatgcttgactcagatacagagggggagggcgatattgcaggcaccataaacccctcagttgcaatggcgattgccggtgggcccctggccccaggtagtcgcgcctcgatcagccagggaccaccgacagcttctcgggctggctgcgccctttcagccgaatcgtcacggaccttacttgcctgtgtgctgtgggtcctgaaaaataccgagcccgccttactccagaggtgggccaccgacctgacattgccgcagctgggccgattgctggacctactatatctgtgtctcgcggccttcgaatacaaaggcaaaaaagcctttgagcgcataaattcactgacctttaaaaagtccctagacatgaaagctaggctggaggaggctattctgggtaccattggggcacgccaagaaatggtccgccgcagcagagagcggtcaccctttgggaatccggagaacgtccggtggaggaagagcgtcacccactggaagcagaccagtgatcgagtggataaaacgaaggacgagatggaacatgaggccttggtcgagggtaacttggctactgaggcaagcttggttgtgctcgatacgcttgagatcattgtgcagaccgtgatgctttccgaggcgcgtgaatcagtccttggggcagtgctgaaggtcgtcctgtactctctcggctcggcccagtccgctctttttctccaacatgggttagccactcagagagccctggtctcaaagtttccagagctcctctttgaagaggacacagagttgtgcgcagacctctgcctcaggctgttacgccattgcggatccaggataagcaccatccgaacccacgccagtgccagcctgtacctgcttatgagacagaatttcgagatagggcacaatttcgctcgggtgaagatgcaggtcacgatgagcctatcaagcttagtcggtactactcagaacttcagtgaggaacacctgcgcaggtctctgaaaacaatcctgacttatgccgaagaagatatgggtttacgagatagtacattcgcagaacaggtgcaggatctcatgttcaatcttcatatgatcttgacggacacagttaaaatgaaggagcaccaggaagaccctgaaatgctcattgatctgatgtatcgaatagcacgcggctatcagggcagccccgacctgcggctgacatggctccagaatatggcaggcaaacatgccgagctgggaaatcatgctgaggccgcacagtgcatggtgcacgccgcagccttagtagctgaatatctcgccttactggaagaccatcgccatctgcctgtggggtgcgtaagttttcagaacatatccagtaacgtcctggaggaaagcgccatttctgatgatatcctcagtccagacgaggaggggttctgtagcggaaagcatttcaccgagctagggctagtcgggctcctcgagcaggccgctggatactttacgatgggaggtttgtacgaggccgtgaatgaagtatataagaacctgatccctattctggaggcccaccgggattataagaagctggctgctgtgcacggcaaactccaagaggcctttactaagattatgcaccagtcaagcggttgggagagggtttttggaacttactttagggtgggattttatggcgcacacttcggtgacctggatgagcaggaatttgtatacaaggagccctctatcacaaaactcgctgagatctctcaccggttggaagagttttatactgaacggttcggggacgacgtggttgaaataatcaaagattccaatcccgtggacaaatcaaaactagatagccaaaaggcatatatccagatcacctacgtcgaaccctacttcgatacgtatgaactgaaggatcgggtgacctacttcgatcgcaattacgggctgcgcacttttctgttctgtacaccatttacacctgacggacgggcacacggcgagctccctgagcagcacaagcgaaagactctattatctaccgatcacgctttcccttacattaaaacccggattcgcgtctgccatcgggaagaaaccgtgctgacacccgtcgaggtggccatcgaggacatgcagaagaaaacaagggagctggcattcgccacggagcaggatccgcccgacgcaaagatgttgcaaatggtactgcagggctcagtgggccccaccgttaaccaggggccactcgaggtcgcccaggtgttcctggcagagatccctgaagaccccaagctgtttcgccaccacaataaactccgcctctgcttcaaggatttctgcaagaagtgtgaagatgcccttcggaaaaataaggccctgatcggcccggatcagaaggagtaccatcgggagcttgaacgaaactactgtcgcctcagggaggccctacagccattactgacacagcgccttccacagttgatggcaccaacaccccccggactcagaaattccctcaaccgggcaagctttagaaaagctgatctttag

SEQ ID NO: 185057 - DNA, 4161 bp, Artificial Sequence
  Description of Artificial Sequence: Synthetic coding sequence
atgcggtgggtggacggccacaagggcgtgttcagcgtggagctgacggcggtgtcctctgtgcatccccaggatccatacttggataaattctttaccctcgtgcatgttctcgaggaaggcgcctttccttttcgcttaaaagacacagtcttaagcgagggaaatgtggagcaggaactccgcgcgagtctggcagcactgcggctggcctcgcctgagccgctggtggcattttcccatcacgtgctggataagttggtccgtttggtgattcgcccacccattatctccgggcagattgtgaacctcgggcggggtgctttcgaggctatggcccacgtggtgagccttgtccatcgctcactcgaggcggcccaggatgccagaggacattgccctcagctggccgcttacgtgcactatgctttcagacttcccggcaccgagcccagcctgccagatggagccccccctgtgacggttcaggctgccactcttgcccgcggcagcgggcgccccgctagcttatatttagcccgcagcaaatccatttcctcctctaatccggatcttgcagtggccccaggcagcgtggacgacgaagttagcagaatattagctagcaaaggcattgataggtcccattcgtgggtcaactctgcttacgcgcctggtggcagtaaggccgtcctgcgtcgcgcccccccttattgtggagctgacccacgccagcttttacacgaggaattagccttgcagtgggtcgtcagctcttccgctgtcagggaagccatcctgcagcacgcatggttcttctttcagctgatggttaaatcgatggccttgcacctgctccttggacagagactggacacccccagaaagctcaggtttcccggcagatttctcgacgatatcaccgcccttgttggctccgtcggcctagaagtgattacgagggtccacaaagacgttgaactggccgagcacttaaatgctagtttggcattttttcttagcgacctgctgtccctggtagaccggggcttcgttttcagcctggtcagggcccattataagcaagtagcaactagactccaatcttcccctaacccagcagcgctcttgacgctgagaatggagttcacacgtatcttatgctcccatgagcactatgttacactgaatctaccgtgctgccccttatctccccctgctagtcccagtccctcagtgagcagtaccacttcacaaagttctacattttcttcccaagcaccagacccaaaggtaacatcaatgtttgagctctcaggccccttccgacaacagcatttcctcgccgggctcctacttacggaattggcgcttgctctagagcccgaggcagagggtgcatttctcctccacaaaaaggcaatcagtgccgtccacagcctcctgtgcgggcatgacaccgacccgcggtacgccgaagccaccgtcaaagccagagtcgccgaactatatctgccactgttgtcaatcgcacgggatacactgcctcggctacacgattttgctgagggtccaggtcaacgctctcgcctcgccagtatgctggattcagataccgagggcgagggggatattgccggcacaattaatccctccgtcgccatggcgattgccggggggcccttggcccccgggagtagggcttccatatcccagggaccgcctaccgcctctagagcaggctgtgccctgtcagccgaaagcagccgtacccttttggcctgcgtgctgtgggtgctgaaaaataccgaacccgcgctacttcagagatgggccaccgatttgacgctgccccagctgggccgcctgttggacctactgtacttatgcctcgccgccttcgagtataaggggaaaaaagcattcgaaagaattaattccctgacttttaaaaagtcacttgacatgaaggcaaggctcgaggaggcaatactggggaccatcggagcacggcaagaaatggtgagaagaagtcgggaacgtagcccatttgggaatcccgagaacgtgaggtggcgcaagagtgtcacacactggaagcagaccagcgatcgtgtggacaaaacaaaagatgagatggaacacgaagcactcgtcgagggaaacctggccaccgaagcctctttagtcgtgctggacaccctggagatcatagtacagacagtaatgctatcagaggcccgtgagagtgtgttgggcgctgtgcttaaggtggtgctctatagcctgggcagcgcccagtccgccctgtttcttcagcacggcctggctacccagagggcgctggttagcaaattccccgaactcctgtttgaggaagacaccgagctatgtgctgacctgtgcttgcgcctgctccggcattgcggctctcggatatccacaattcggacacatgctagcgcctccctctaccttctcatgagacaaaactttgaaatcggccataacttcgcacgagtgaagatgcaagtcactatgagtcttagttccttggttgggaccacccagaacttttctgaggagcacttaaggcggagcctgaaaaccatccttacctacgccgaggaagacatgggtttacgtgactctaccttcgcagaacaggtgcaggacctgatgtttaacctgcacatgattctgaccgacacggtgaagatgaaggaacaccaggaggatcccgaaatgctgatcgacctaatgtacaggattgctcgcgggtaccaggggtctccagacctccggctgacatggctgcaaaatatggcaggtaaacacgctgaactgggcaaccatgccgaagcagcccagtgcatggtacatgccgctgcgctggtcgctgagtacttggccctactcgaggaccatcggcacctgcctgtcgggtgtgtgtcatttcagaatatatcatccaacgtcctcgaggagtctgcaattagcgacgatatattgtcgcccgatgaagaagggttctgttccggaaagcatttcacagagttgggcctggttggattgctggagcaagcggccggctactttaccatgggtggcctgtacgaagcagtgaatgaggtatataagaatttgattcccattttggaagcacacagggattacaaaaaactggccgcagtgcacggaaaactgcaggaggctttcacaaagatcatgcaccagtcgtcgggatgggaacgggtgttcggcacctactttagagtaggcttttatggcgctcatttcggagacctggatgaacaggaatttgtatacaaagagcccagcatcaccaagctcgcggaaatcagccacagactggaagagttctataccgagcgctttggagacgacgtcgttgagattatcaaggattcaaatccggtggacaagtccaaattggactcacagaaggcatatatccaaataacctatgtggagccatactttgacacctacgaactgaaggatagagtaacgtacttcgatcggaattatggccttcgcaccttcctcttttgtaccccattcacacctgatggccgtgcccatggggaacttcctgagcaacataagcgaaagaccctcctgtccacggaccatgccttcccatacatcaagacccgaatacgcgtctgccatcgggaagaaaccgtgcttacacctgtcgaggtggccatagaggacatgcaaaagaagacacgggaactagcatttgccaccgaacaagatcctccggacgccaagatgctccagatggtcctacagggctccgtgggccctaccgtgaaccaaggcccccttgaggttgcccaggtgtttttggctgagatcccagaagatcccaagctctttcgtcaccacaataaacttaggctctgttttaaagatttctgcaagaaatgtgaggatgcccttcgtaagaataaagctctgatcggccctgatcaaaaagaataccacagagaactggaaagaaactattgcagactgagggaagcacttcaaccactcctcacacagagattaccacagttgatggccccaaccccccccggtttaaggaatagcctgaaccgggcgtcatttaggaaggctgacctttag

SEQ ID NO: 185058 - DNA, 5973 bp, Artificial Sequence
  Description of Artificial Sequence: Synthetic coding sequence
atggccaccctgcccagcgccgagcggcgggccttcgccctgaagatcaatcgttatagctccgcagagattcggaagcaatttacgctgccacccaatcttggccagtaccaccgtcaatccatttctacctcagggttcccctctttgcagctacctcagttctacgatcccgtcgagcccgtcgatttcgaaggccttctgatgacgcacctgaacagcttggatgtgcagctagcgcaggagctgggcgactttactgacgatgatcttgatgtggttttcactccgaaggaatgccgcaccttacaaccctcattgccggaagagggagtggagctggaccctcacgtgcgagattgcgttcagacatacattcgagagtggctgatcgtgaaccggaagaaccaggggagccccgagatctgtggattcaagaaaacgggcagccgcaaagacttccacaaaactttgcctaaacagacttttgaatcggaaacactggaatgttccgagcctgcggcccaagccggcccccgccatttgaacgtcttgtgcgatgtgtctggtaagggtcccgttactgcctgtgattttgacctgagaagtctgcagcccgacaagaggctggagaatctccttcagcaggtttccgctgaggatttcgaaaaacagaacgaggaagcccggcgtactaatcgccaggccgaattatttgcactgtatcccagcgtggacgaggaggatgcggtggagatccgacctgtccctgagtgccccaaggagcacctcggcaataggatcctggtgaagctgctcaccctcaaattcgagattgagattgaaccactgttcgccagcatcgccctttacgacgtaaaagagcgcaaaaagataagcgagaactttcactgtgacttaaatagcgaccaattcaaagggttcctccgcgcccacaccccctcggttgccgcgtcctcacaggcccgaagcgcagtgttttccgtcacgtatccctctagcgatatctatctggtggtcaaaatcgagaaggtgctgcagcagggcgaaatcggcgattgtgctgagccctataccgtcatcaaagagtcagacggtgggaaaagtaaggagaaaattgagaagctgaaacttcaggcagaaagtttctgtcagcgcctaggcaaatatcgcatgccgttcgcatgggctccaataagcctcagctcttttttcaatgtcagcacgctggaaagggaagtcaccgacgtggatagtgtcgtcggccgcagttctgtgggagagcggagaaccctcgcgcagtctcggcgcttgagtgaaagagccctttcgcttgaagagaatggtgtggggtcaaactttaaaaccagcaccttgtccgtctcttctttcttcaaacaagaaggcgatcggctgagtgatgaggacctatttaagtttttggcagattataaacgatcctcttcactgcagaggcgtgttaagtcaattccgggtcttctcaggctcgaaatctccaccgccccggagataattaactgctgtttaacacctgagatgctgcccgtgaagccctttcctgaaaacagaaccagacctcacaaggaaatcttggaattcccaacccgggaggtctacgtgccgcatactgtgtaccgcaatttactgtatgtgtacccgcaacgtctgaacttcgttaacaagcttgctagtgcccgtaacatcaccattaaaatccagttcatgtgcggggaggacgcatcaaatgccatgccagtcatctttggaaagtccagcgggccagaattcctgcaggaggtatatactgcagtcacttaccacaacaaaagccctgacttttatgaggaggtgaaaattaagctgcctgccaaacttacagtcaaccaccacctgctcttcaccttttatcatatctcctgtcagcagaaacagggagcgagtgtggagactctcctcggttactcatggctgccaatcctgctaaatgaacggctgcagactggctcctattgcctgcccgtggctctggagaagttgccacctaactatagtatgcactcagctgaaaaggtgcctcttcaaaacccgccaataaagtgggccgaaggacataaaggcgtgttcaatatcgaagtccaggcagtgagtagcgtccacactcaagataatcacctcgagaaattctttaccctctgccactctctggaaagtcaggtgaccttcccgattcgtgtgctggaccagaagatatcagagatggcactggagcacgagctgaagctgtctattatttgcttgaattcctcccgtctagaacccctcgtgttgtttctgcaccttgtgctggataaactgttccaactctccgttcagccaatggtgatcgcagggcaaaccgctaatttttctcagttcgcgttcgaaagcgttgttgcaatcgccaattcccttcataattcaaaagacttatctaaggaccagcatggcagaaactgcctattggcttcatacgttcattacgtgttcaggctccctgaggttcagcgagatgtgccaaagtcgggggcacccaccgccttgctggacccacgctcataccatacctacggtcgtacctcagctgccgccgtgagttcgaaattactccaggctagagtgatgagcagctccaacccagatctagcaggcacacattcagccgctgacgaggaggttaagaacatcatgagctccaagcattttcatgaagaactggctctgcagatggtggtcagcacaggcatggtcagagagacagtgtttaagtatgcttggttcttctttgagctgcttgtgaagtcaatggcccaacatgtgcataatatggacaagcgtgacagcttccgaagaacgaggttttccgatagatttatggatgatattacaacaattgttaacgtggtgacgtctgagattgccgcacttctggttaagccccagaaggaaaatgaacaggctgagaagatgaacattagtttggctttttttctgtacgatctgctgagtctgatggaccggggctttgtgttcaatctcattcgccactactgttcacagctttcagcaaaactcagtaatctgcctactcttatttccatgagactggagttcctgcggattctctgctcccacgaacattacctaaatctgaatctatttttcatgaatgccgacaccgcgcccactagcccatgtccgagcatctctagccagaatagcagcagttgtagcagttttcaggatcaaaagatcgccagcatgttcgatttaacttccgagtatcgccagcaacacttcctgacaggcctactgtttaccgaattggctgcggccctcgacgcagagggggagggcatcagcaaagtgcagcgcaaagctgtcagcgccatccacagcctgttgagcagccatgatctcgaccccagatgtgttaagccagaggtcaaggtcaaaattgctgctctctacctaccgctggtggggattattctagatgccttaccccagctttgcgactttacagtggctgacaccaggcggtacagaacatctggaagtgacgaagagcaggaaggggccggtgccattaatcagaatgtggccctcgccattgcaggcaataactttaacttgaagacttccgggatcgtcttgtcctcactgccatataaacagtataatatgctgaatgccgataccacaaggaacctcatgatctgcttcctctggatcatgaagaatgctgatcagagccttatcagaaagtggattgcggatctcccgtccacccaattgaatagaatactggacctgctttttatctgcgtactctgcttcgagtacaaaggaaaacagagcagcgacaaggtgagtactcaggttctgcagaagtcacgagatgttaaggcacgcctagaggaagctttacttaggggcgaaggagcccgcggcgaaatgatgagaaggagagctccaggcaacgacagattccccggattaaatgagaatctccggtggaaaaaagagcaaacccactggcgacaggcaaatgaaaaactagacaaaactaaggccgaactggaccaggaagccctgatttcaggcaacctggcaacggaggctcacctgatcatattggatatgcaggagaacatcatccaggccagctctgccttggactgtaaggacagtctcctggggggtgtgctgagggtccttgttaactctctgaattgcgaccaatccacaacatatctaacccattgttttgccacattgcgtgccctgatcgccaaatttggcgacctcctgtttgaggaagaagttgaacagtgttttgatctgtgccatcaagtgcttcaccattgctcttctagcatggatgtaacacgctctcaggcatgtgcaaccctgtacctcctgatgaggttctcgttcggggctacgagcaacttcgctcgagtcaaaatgcaggttaccatgtctctggcgagcttagtgggacgggcccctgactttaatgaggaacacctccgacgatccctgaggaccatccttgcctactccgaggaagacaccgccatgcaaatgactccattcccaactcaagttgaagaactcctttgcaatcttaactccatcctgtatgacactgtcaagatgcgggagttccaggaggaccccgaaatgctcatggaccttatgtacagaatcgccaagtcataccaggcatcacctgatctcagactcacatggctgcagaacatggcagaaaaacataccaagaaaaagtgttataccgaggcagcaatgtgcttggtgcatgctgcggccctggtggccgagtacctgtcaatgcttgaggatcactcttacttgccggtggggagcgttagctttcaaaacatctcttccaacgtgctggaagaaagtgtcgtgagcgaagatacactgagtccggacgaagacggggtctgtgccggtcaatactttaccgaatccggcctggtgggcctgttagaacaagccgctgagttgttctcaaccggcggcttgtacgagacagttaacgaagtttataagctcgtcattcccatcctcgaggcacaccgggaattcaggaagctgacacttacacactctaagctgcagagggcctttgactctatcgtgaataaggaccataagcgcatgttcggcacttatttcagggtgggtttctttggctctaaatttggcgatctggacgaacaggaatttgtgtataaggaacctgcaattactaagctccccgaaatatcacacagactggaagccttctacgggcagtgctttggcgccgaattcgttgaggttattaaagatagtaccccagtggataaaacgaagttggatcccaacaaggcgtacattcagatcactttcgtggaaccctatttcgacgagtacgagatgaaggatcgtgtcacatacttcgagaagaatttcaatctgcgcaggtttatgtacacaacgcccttcaccctggagggacgaccaagaggagagttgcatgaacaataccgccggaacaccgtccttactacaatgcatgccttcccgtacattaagacccggatctcagtcatccaaaaggaggaatttgtgctcacccccattgaggtggcaatcgaggatatgaagaaaaaaacactacagctggccgtggccatcaatcaggagccacccgatgctaaaatgctgcaaatggtcctccagggatcagtgggtgccacagtcaatcagggccctctggaagtggctcaggtttttctggcagagatccccgccgaccccaagctgtatagacatcataataaattgcggctgtgcttcaaggagttcattatgtag

SEQ ID NO: 185059 - DNA, 6096 bp, Artificial Sequence
  Description of Artificial Sequence: Synthetic coding sequence
atgacccacctgaacagcctggacgtgcagctggcccaggagctgggagacttcactgacgacgacctggacgtggtgttcactccgaaagagtgcagaaccctgcagccttctctccccgaggaaggagtcgaactcgaccctcacgttagagattgcgtacagacatatatccgagaatggctgattgtcaacaggaagaaccaagggtctccggaaatttgcggcttcaagaagaccgggtcccggaaggactttcacaaaacactacccaaacagacatttgagtccgagaccttggagtgctccgaaccggccgcccaagctggcccacgccatttaaatgtgctctgcgatgtgtccggtaagggccccgtgacagcttgtgattttgacctgagatctttgcagcccgataagagactggagaatttgttgcagcaggtgagtgctgaggactttgaaaaacagaacgaggaggcgcgaagaacgaacaggcaggccgaactcttcgctctctaccctagtgtggacgaggaggacgccgtagagatacgccctgttccagaatgtccaaaggaacaccttggtaatcgtattctggtaaaacttctgacactgaagtttgaaatcgaaattgagcccctgttcgcaagtatagccctgtatgacgtgaaagaaaggaagaaaatatctgagaacttccattgcgatctgaactcagatcagttcaaaggtttcctacgtgcccacactccaagcgttgctgcaagctcacaggcacgaagcgctgtgttctccgttacctatccaagtagcgatatttacctggttgtaaaaattgagaaggtgcttcaacagggtgagataggcgactgtgccgagccgtacaccgtgattaaggagtctgacgggggaaaatccaaagaaaagatagaaaagttgaagttgcaggccgaatccttctgtcagcggcttggaaagtacaggatgccatttgcctgggcacccattagcttaagcagcttcttcaacgttagtactttagagagggaagtgactgatgttgactctgtggttggcaggagcagcgtgggagagcgacggaccctagctcagtcgcgacgcctcagcgagcgggctcttagcttggaagaaaacggtgtggggtccaacttcaagacatcaacactcagcgtgtccagcttctttaagcaggagggagacagactgagcgacgaagatctatttaagtttttggcagactacaaacgctcttctagtctgcagagaagggtcaaatccatacccgggctcctgagactagagatcagcaccgcaccggaaatcatcaactgctgcctgactccggaaatgctgcccgtcaaaccctttccagaaaatcgcacgcgtcctcacaaagaaatccttgaatttcccacacgcgaggtgtatgtgccgcacaccgtatacagaaatctactgtatgtttatccacaacggctcaattttgtgaataagttagcctccgctagaaacattaccattaagatccaatttatgtgcggtgaggatgcctcgaacgccatgcctgtcatctttggaaagagctccggcccagagtttttgcaggaagtgtatacagcggtgacctaccataacaaaagccccgacttttacgaggaggtgaagataaaactgcctgcaaagttgacggtcaaccaccacctgttgttcactttctatcacatcagctgccaacagaagcagggtgcttctgtggagacactcctgggatattcctggcttccaatcctgctgaacgaacgcctccagaccggatcttactgtttacccgtcgccctggaaaagctgccccccaactattccatgcactcggcggagaaagtgcctctgcaaaacccaccaatcaagtgggctgagggtcataaaggggtgttcaacattgaagtgcaggcagtaagtagcgtacacacacaggataatcaccttgaaaagttttttaccctgtgtcactcactggaatcccaagtaacgtttcccattagagtgctggatcagaagatcagcgaaatggccctcgaacacgagctgaagctctccatcatatgtctcaatagttcccgattggagcccctcgttctcttcctgcacctggtcctcgacaaactttttcagctgtccgtgcagcctatggtcatcgctggacagacggcaaacttcagccagttcgcctttgaatccgtcgttgccatcgctaactcactgcataacagcaaggacttgtccaaggaccaacacggcaggaattgcctgctagcaagttacgttcactacgtgtttcggctcccagaagtgcagcgcgacgtgccaaaaagcggtgcgcctacagcactgcttgatcctcgctcctatcacacctatggaagaacgtctgcagctgctgtgagttcgaagcttctgcaggcgcgggttatgtctagttcaaaccccgatctggcaggcacgcattccgcagctgatgaggaagttaagaatatcatgagttctaagatagcagacagaaactgctcacgaatgtcctattactgctcaggttccagtgacgcaccaagtagtcccgcagctcccaggcccgcaagcaagaagcatttccacgaggaactggctctgcagatggtggtgtctacagggatggtgagggagactgttttcaagtacgcatggtttttcttcgagctgctggtcaagtctatggcccaacatgtgcacaacatggacaaaagagactcttttcgaagaaccagatttagcgaccgctttatggacgacataaccaccattgtgaacgtcgtgaccagcgaaatcgccgcccttttagttaaaccgcagaaagagaatgagcaggccgaaaaaatgaatatctctctggccttcttcctttacgatctgttgagcctgatggatcgcggatttgtgttcaacctgatcagacattactgcagccaactatcagccaagctgtctaatcttccaacccttatctctatgcggctcgaatttctgagaattctgtgttcccatgagcactacttaaatctgaatctgttctttatgaatgccgatactgcccctacttccccctgcccctcgatatcttcccaaaactcgtcatcgtgttcatcgtttcaggaccagaaaattgcaagtatgttcgatttaaccagtgaataccgtcagcaacacttcctgacggggttgctgttcaccgaactggcagcagccttagacgctgaaggcgaggggataagcaaggttcagcgaaaagcagttagcgccatccattctctgctctccagtcacgatttggatcctagatgcgtcaagcccgaggtcaaggttaagattgctgccctgtacttgcctctggttgggatcattctggatgcgctcccgcaactgtgtgactttaccgttgccgacacccgacggtatcgaacgagcggatcagatgaagagcaggagggtgccggggccattaatcagaatgtggctttagccatcgctggtaataatttcaacctcaaaacctctggaattgtcctttcttcactgccttataagcagtacaacatgctgaatgctgacaccactaggaatctgatgatttgcttcctgtggatcatgaaaaacgcagaccaatctctgattcgcaaatggatagcggaccttccatccacccagctcaaccgaatcctcgatctgcttttcatctgcgtgctctgtttcgaatataaagggaagcaaagctctgacaaagtaagtactcaggtgctgcaaaaatcccgggatgttaaggcccgccttgaagaagccctcctgcggggagagggggcccgaggagaaatgatgcgaaggcgagctccaggcaatgatcgttttccgggactcaatgagaatctgcggtggaagaaagaacagacgcattggcgtcaggccaatgagaagctagacaaaacaaaggccgagctcgaccaggaggctttgatctccggaaaccttgccacagaagcacacctgatcattcttgacatgcaggaaaacatcattcaagcgagctcagccttggattgcaaggatagtcttctgggcggggtgcttcgggtactggtgaactcactgaattgcgatcagagcacgacctatctcacacactgcttcgctaccctccgcgccttgatagccaagttcggagacttactgtttgaggaagaagtggagcagtgtttcgacttatgccatcaggtgttgcatcactgttcgtcctccatggacgtgactagatctcaggcatgtgcaacattgtatctcctcatgcggttctctttcggcgccactagtaattttgctcgggtgaaaatgcaagtgactatgtcgctcgcctctctcgtgggaagagcacctgatttcaacgaggaacatttacgcagaagcctacggaccatcctggcatactctgaagaggataccgctatgcagatgacgccctttccaacacaggttgaggaactattgtgcaatctgaattcaatcctgtatgacactgtgaagatgcgggagtttcaggaggacccagaaatgctcatggaccttatgtatagaatcgccaagagctaccaggcctcaccagacctgaggctaacctggctgcagaacatggccgagaagcataccaaaaagaaatgttatactgaggccgcaatgtgtttggtgcacgccgccgcgctcgtagctgaatacctgtctatgctagaggatcactcttatcttccagtagggtccgtcagctttcagaacatctcctccaacgttttggaggagagcgtggtgagcgaagacactctctcaccagacgaggacggcgtttgtgccggtcagtatttcacagagagtggtctggtcggactgttagaacaagctgcagagctgttctccaccggagggctgtatgagactgtcaacgaagtttataagcttgttataccaatcctggaagctcatagagagttccggaaattgactttgactcactccaagctgcagagggcctttgatagcatcgtgaataaagatcataaaagaatgtttggtacatatttccgcgtgggcttcttcggcagcaaattcggagatttggacgagcaggagttcgtctataaggaaccggcaattacaaaactgcccgaaattagccatcgtctggaggcgttttacggtcagtgcttcggagccgaattcgttgaggtcattaaggactcaacccccgtggacaagaccaagttggaccccaacaaggcgtacatccagatcacattcgtcgaaccttacttcgacgagtatgagatgaaagatagggtcacatatttcgagaagaactttaacctgcgtcgtttcatgtacactaccccctttaccttggaggggcgcccccgaggtgagctccacgagcagtatcggcgcaacactgtgcttaccaccatgcacgcttttccgtacatcaagacgcgcatttccgtgattcagaaggaggagtttgtgttgactcctattgaggtggccatcgaggatatgaaaaagaagacactacagcttgccgtggcaatcaatcaggaacctcctgatgctaaaatgctccagatggtgctgcagggctcagtcggggctactgtcaaccaaggcccgctggaggttgcacaggtatttctggctgagatccctgccgaccctaagctctatcgccaccacaataaactcagactgtgttttaaggagtttatcatgaggtgtggcgaggccgtggagaagaacaagcgtttgattactgctgaccaaagagagtaccagcaggagttgaagaagaactacaacaagttaaaagaaaatctgagacccatgatcgaacggaagatcccagagctgtataaacccatctttagggtggagtctcaaaagagagattcttttcaccgcagcagctttaggaagtgcgaaacacagctatcacagggctcctag

SEQ ID NO: 185060 - DNA, 6300 bp, Artificial Sequence
  Description of Artificial Sequence: Synthetic coding sequence
atggccaccctgcccagcgccgagcggcgggccttcgccctgaagattaatagatattcatctgcagagattcgcaaacagtttactttaccacccaacctgggacagtatcatagacagagcatctcaaccagcgggtttccaagtctacagctgccacaattttatgatcccgttgagccggtggatttcgaagggctgttgatgacccacctcaatagcctcgacgtgcagctggcacaagagctcggcgattttacagacgatgaccttgacgtggtttttactcccaaggaatgccgcacacttcagccctcattacccgaggagggggtggagttggacccccacgtcagggattgtgtccagacatacattcgcgaatggctgatcgtgaacaggaagaaccagggctctccagaaatctgcgggttcaaaaaaacggggagcagaaaagacttccataaaaccctgcccaagcagactttcgagtctgaaaccctggagtgttccgagcctgccgctcaggccgggcctcggcacctcaacgtgttgtgcgatgtgtcaggaaaagggcccgtgacggcatgtgatttcgatctgagaagtctccagccggacaagcgactggagaatcttctgcagcaggtctccgccgaggactttgaaaaacagaacgaggaggcccgccgcacaaatagacaagctgaactgttcgctctttacccttctgtggacgaggaggacgcggtggaaatccggccagtgcctgaatgcccaaaggagcacttgggtaaccgcattcttgttaaactgttgaccttaaagtttgagatagagatcgaacccctgttcgcctccatagccctgtatgatgtgaaagaacgaaaaaagatctctgagaacttccactgcgacctgaatagtgaccagtttaaaggatttcttagagcacacacaccctccgtcgctgccagttctcaggcaagaagcgccgtttttagtgtcacctatccaagttctgatatctacctggtagtaaagatagagaaggtcctacagcagggtgaaatcggggactgtgctgaaccatatacagtcattaaagaatccgacggtggcaaatctaaagaaaagatagagaagcttaagctgcaagccgagtctttctgccagaggctcggcaaataccgcatgcccttcgcttgggcccccatttccctctcctcattttttaatgtgagcacccttgaacgggaggtaactgatgtggatagcgtggtaggccggtcgagcgttggggagaggcgtacactcgcccaaagcaggcgactgtctgagagggccttaagtttggaagagaacggcgtgggcagtaatttcaaaacttcgacgttgagtgtgagctctttcttcaagcaggaaggagatcggttaagcgatgaggacttattcaaatttctggccgactataagcgctcctcgagcctccagagacgggtcaagtcaatccccggtctgctacgtttggagatctctacagccccagaaatcatcaactgctgtctgacacccgaaatgctgcccgtgaaaccatttccggaaaatcgcactcgccctcataaggagattctggagtttccgacacgtgaggtttacgttcctcatacggtttaccggaatttgctgtacgtctacccccagcgactgaattttgttaacaagcttgccagcgcaagaaatatcactatcaaaatccaattcatgtgtggggaagatgcctcaaatgccatgcctgtgatctttgggaaaagctcaggacccgagtttcttcaagaggtctatacggctgtaacttatcacaataaaagcccagatttttacgaggaggtcaagatcaagctccccgcaaagctcacagtgaaccaccaccttctgttcacattttaccacatcagctgccagcagaagcagggggcaagcgtggagactttattaggctacagttggctacctatccttctgaatgaacgactgcagacaggatcttactgtctcccagtggctcttgagaagctgcctcccaactactcgatgcattccgctgagaaagtgccgctgcagaatcctccaattaagtgggcagaggggcacaaaggggtgtttaatatagaggtgcaggccgtttctagtgtccatacccaggacaaccacctggagaagttcttcaccttatgtcactcattagagtcgcaggtgacttttcccattagagtcctggatcagaaaatcagcgagatggctttagaacatgagctgaaattatctatcatttgtctcaactcaagtcggctcgaacccttagtgctgttcttacacttggttctggataaactatttcagctaagtgtgcaaccaatggtcattgcgggtcagaccgccaacttctcccagttcgcctttgagtccgtagtggctatcgcgaacagtcttcataactccaaggacttatctaaagatcagcatggacgcaattgcctgctggcctcatacgtgcattatgtgtttcgcttgcctgaagtacagcgcgatgtaccaaaatccggggcaccaacagcgttgcttgaccctagaagttatcatacttacggccggacttcggcagccgcggtgtcttctaagctgctgcaggctcgggtgatgagttccagcaatcctgatctcgctgggacccatagtgcagccgatgaggaggtgaagaacattatgagctccaaaatcgcggacaggaactgttcaagaatgtcttattattgtagtggatcttccgatgctccgtcttccccagcagccccgcggccagcgtctaaaaaacatttccacgaagagctggctctgcagatggtggtttcgaccgggatggtgagagaaactgtgtttaagtacgcatggtttttcttcgaactgctggttaagagcatggcacagcatgtgcataacatggacaaaagggacagcttcaggagaactagattctcagaccgctttatggacgacataaccactatcgtgaacgtcgtgactagcgaaatcgccgcacttctggtaaagccacagaaggagaacgagcaagcagagaagatgaatatctccctggcattcttcctgtatgatcttttaagtctaatggaccggggctttgtgtttaatctcatcagacattactgtagtcaactgtcagctaagcttagcaacctacccaccctcatatcaatgcgccttgagttcctgaggatcctgtgttcccatgaacactacctaaacctaaacttgttctttatgaatgctgacacggcccccacgagcccatgtccgtccatcagcagtcaaaactctagctcctgcagctctttccaagaccagaagatcgcttctatgtttgacctgacctcagaataccggcagcagcattttctgacagggctcctgttcactgagcttgcagcggctctagatgccgaaggtgagggaatctccaaggtgcagcgaaaggccgtgagtgcaattcactcattgctgagttctcacgatctcgaccctaggtgtgtaaagcccgaagttaaagttaaaattgctgcactgtacctgccccttgttggcattattttagacgctctgccacaattatgtgactttaccgtggccgacactaggaggtacaggacctccggctccgacgaggagcaggagggtgccggcgcgatcaatcagaacgttgccttagcgattgctggcaacaatttcaatctgaagacctccggtattgtgctgagctctctgccttataagcagtataacatgctgaatgcagacaccaccagaaacctcatgatttgttttctctggatcatgaaaaacgccgaccagtccctaataagaaaatggatagcagaccttccgtcaacgcagctgaatcgcattctggacctcctgtttatttgcgtcctctgctttgagtataagggaaaacaatcatcggacaaagtctccactcaagtgcttcagaaatctagggatgtgaaagcgcggctcgaggaggccttgctccggggggaaggagcacggggggagatgatgaggagacgggcccccggtaatgatagattcccaggtctgaatgagaatctgcgctggaagaaagagcaaacgcattggcgccaggccaacgagaagctggataaaacgaaggctgaactggaccaggaggccttgatctctggtaatctggcaactgaagctcacttaattattctggatatgcaggaaaatatcattcaagccagcagcgcgcttgattgtaaagacagccttctcgggggagtgcttagggtcctcgtcaatagtctgaactgtgaccagtctacgacctatctgacccattgctttgctacactccgtgcccttatcgccaaattcggagacctcttgttcgaggaagaggtggaacagtgcttcgatctctgtcaccaggtgctgcatcactgttcctcttccatggatgtgacccgcagccaggcctgtgcgactctgtacctgcttatgaggtttagttttggagcaacttccaattttgcccgcgtcaagatgcaagtcactatgtccttagccagcctggtaggccgggcgcccgatttcaatgaagaacatctacggcgctcactgaggacaatcctcgcatactcagaagaggacaccgcgatgcaaatgacacccttcccaacccaggttgaggaattactttgtaacctcaacagtattctttacgataccgtgaaaatgcgcgaatttcaggaagatccagagatgctgatggatcttatgtacaggatcgctaaatcatatcaagcgagccctgatttacgacttacttggctgcagaatatggctgagaagcatacgaaaaagaagtgttatactgaggcagccatgtgcttggtgcatgcggcagctttagtagccgagtaccttagcatgctggaggaccactcctacttgccggtggggtcagtaagttttcaaaacattagctctaacgtgttggaggaaagcgttgtcagcgaagacacactaagcccggatgaagatggcgtttgcgcaggacagtattttaccgagtccggactggtgggtctgctggagcaagctgctgagctgttttccactggggggctgtacgagaccgtgaacgaagtctacaaactagtcattcccatcttagaggcacatcgggagttccgaaagctgacccttacgcactccaaattacagcgagcttttgacagtatagtcaacaaagatcacaaaaggatgttcggcacttactttcgggtggggttcttcgggagcaaattcggcgatttagatgagcaggagttcgtctataaagagcctgcgatcacaaagcttcccgagatctcgcaccggttggaggcgttctatggccagtgtttcggcgctgaatttgtggaggtcatcaaagactctacccccgtggataaaacaaagctcgatcccaataaggcctatatccagatcacttttgtggaaccatatttcgacgagtacgaaatgaaggatagagtcacatatttcgagaaaaacttcaatctgagacggttcatgtacaccactccctttacactcgagggacgtcctaggggcgagctgcatgagcagtaccgtagaaataccgttctgacgacaatgcatgcatttccctacattaagaccagaattagcgtgatccagaaggaagaattcgtgctcacccctatcgaggtcgcaatagaagacatgaagaagaagactttacagctcgctgtagccatcaatcaagagccccctgacgctaagatgcttcagatggtgctgcaggggtcagtcggagccactgtcaaccaagggcctctagaagtggcacaggtttttttagctgagattcctgccgatcccaagctttaccgtcaccacaacaaactccgtctatgtttcaaagaattcatcatgcgttgtggggaggccgtcgagaagaacaagcggctgattaccgccgatcagcgagaataccagcaggagctgaagaaaaattacaacaagctgaaagagaatttgcgacccatgatagaacgaaagattcccgaactgtacaaaccgatattcagggtggagtcccaaaagcgggactcctttcaccggtcgagcttcagaaagtgcgagacccaattatcacaaggcagttag

SEQ ID NO: 185061 - DNA, 6000 bp, Artificial Sequence
  Description of Artificial Sequence: Synthetic coding sequence
atgacccacctgaacagcctggacgtgcagctggcccaggagctgggcgacttcaccgatgacgacttggacgtggttttcactcctaaagagtgcagaacccttcagcctagcctcccggaggaaggagttgagctggatccacacgtcagggattgtgtgcagacgtacatcagggaatggctcatagtcaaccgtaagaaccagggatcccctgaaatttgcggcttcaagaaaactgggtcccgcaaggatttccacaagacactgcctaagcagacattcgagagtgagaccctggaatgtagcgagccagccgcccaggctggtccgagacatcttaacgttctatgtgatgtcagtggaaagggtccagtgacagcctgcgacttcgacctccgcagcctgcaacccgataagaggctggagaatctgctacagcaagtgagtgccgaggatttcgagaagcagaacgaagaggcccgacgaacaaatagacaggcggagctctttgccttgtatccatcggtggatgaagaagacgcagtggagatcagacccgtgcccgagtgccctaaggaacacttgggaaacaggattttagttaagttattgaccctgaagtttgaaattgagatcgagccactcttcgccagcatcgctctctatgacgtgaaagagcggaagaagatttctgaaaactttcattgcgacctcaacagcgatcagttcaaggggttcctccgggcccacacaccatctgttgccgcgagcagtcaagcccgaagtgctgttttctcagtcacgtaccccagctccgatatatatttggttgtgaaaatagaaaaagttttacagcaaggtgaaattggggactgcgcggagccttatacagtgattaaggaatcagatgggggcaaaagcaaggagaagatagaaaaattgaagcttcaggctgagagtttctgtcagagattagggaaatatcgcatgccttttgcttgggcgcccatctccctttcctccttctttaacgttagcaccctggagcgtgaggtcacggatgtagattctgttgtgggccgatctagtgtgggcgagagacgcacactcgcgcagtcacggcgcttaagtgagagggccctgtccctcgaagagaacggcgtcggctcaaactttaagaccagtacgctatctgtctcctccttttttaagcaagaaggcgacagactcagcgatgaagaccttttcaagtttctggcggactataaaaggtcttcaagcctgcagcggagggtgaagtccattcccgggctcctccggctggaaatctccaccgcccccgagataatcaattgctgcctgacccctgaaatgctgcccgtcaaacccttcccagagaaccgtaccagaccacacaaggaaatattggagttccccacgagggaagtttacgtcccccacactgtctacagaaacctcctctacgtctatcctcaacgacttaattttgtgaataagctggcttctgctcggaatatcacaatcaaaattcagttcatgtgcggcgaggacgcctccaatgcaatgcccgttatattcggtaagagttctgggcctgaatttctgcaagaggtatacactgccgtgacctaccataacaagagccctgatttttacgaggaggtgaagattaagttgcccgctaaactgaccgtcaatcatcatcttctcttcactttttaccacatttcttgccagcagaaacaaggcgcctctgtcgagacgcttctgggatacagctggctacccatattattgaacgaaaggctgcagaccggtagctattgtctcccggtcgcactggaaaaactaccaccaaattattcaatgcatagtgcagaaaaagtgccattacaaaacccaccaatcaagtgggccgagggacataagggcgtgtttaatatagaagtgcaggcagtgtcaagcgtacatacgcaggacaatcacctggagaagtttttcacgctctgccacagcctcgaatctcaggtcacatttcccatccgagtgcttgatcagaagatcagtgagatggctttggagcacgaattgaagctctcgattatctgcctgaactcttcccggctggaaccactggtcctatttctgcacttggtgctcgacaagttattccagttgagtgtgcagccaatggtgattgcaggacaaacagccaacttctctcagttcgcctttgagtctgtggtggcgatcgccaatagcctgcataattctaaggatctgagcaaagatcagcatgggcgtaattgccttctcgcctcatacgtccactatgtgttcagacttcctgaagtgcaacgcgatgtgcccaagtccggagcacccaccgccctgttagaccccaggtcataccatacgtatggacgaacgagcgcagcagccgtctctagcaagctgctccaggcaagggtgatgtcctctagcaaccccgacctagcgggaacgcatagcgcggcagacgaggaagtaaagaatataatgagcagcaagcattttcacgaagaactagcactgcagatggttgtctctacaggtatggtgagggagactgtttttaaatatgcttggttctttttcgaactgttggttaaatccatggcccagcatgttcacaacatggacaagcgcgacagtttcagacgcacgcgcttcagcgatagattcatggatgacattacaacaattgtcaacgtggtgacgagcgagattgcagcactgctggttaagccacagaaagagaatgagcaggctgaaaagatgaatatttccctcgcatttttcctttatgatctgctgtccctaatggacagggggtttgtgtttaatctcatccgccattattgctcccagctgtcagccaagctctcaaatcttccaaccctaataagcatgagactggagttcctcaggatactgtgctctcacgagcattaccttaaccttaacctctttttcatgaatgccgacaccgccccgacatcaccttgcccctctatcagctctcagaactctagctcctgtagctcctttcaggaccagaaaattgccagcatgtttgaccttacatctgagtatcggcagcagcattttttgactgggctgctgtttaccgagctcgctgcggctctggacgcagaaggggagggcatcagcaaggtgcaacgcaaagctgtgagcgcaattcattcgctgctgagtagccatgatctcgacccgcgctgcgtgaagcccgaggtgaaggtcaaaatcgccgccttatatctgccgttagtcgggataatcttagacgcactgccccagctatgcgattttactgtcgctgatacgcggaggtatcgaacatccgggagtgacgaagagcaggaaggtgccggggcaattaaccaaaatgtagcattagctatcgcaggtaataattttaatcttaagacttctgggattgtgctttcctcactgccatacaagcagtacaatatgctgaacgcagacactaccagaaacctgatgatatgcttcctttggattatgaagaacgcggaccaatctttaatccgtaagtggattgctgacctcccttccacacaactgaaccggatcctcgatctcctgttcatttgcgtgctgtgctttgagtacaaaggtaaacaaagctctgacaaggtgtctactcaggtcctccaaaagagccgtgatgttaaagcccgactggaagaagccttgctgaggggcgagggagcccgcggcgaaatgatgcggcggagggcaccagggaacgatagatttcccggtctgaacgagaatttgcgatggaaaaaggaacagacccactggcgccaggcaaacgagaaattagacaagaccaaggcagagcttgaccaggaggccctgatcagcgggaacttagcaactgaagcccaccttatcattctggacatgcaggaaaacatcattcaggctagctccgccctggattgtaaagactcactgttgggtggggtgctgcgagttctcgtcaacagtttgaattgcgaccaatcaactacgtacctgactcactgtttcgctacactgagggctctcattgccaagttcggcgatctgctgtttgaagaagaagttgagcagtgttttgacttatgccaccaggtgctccaccactgcagctcttccatggatgtcacccgatctcaggcctgcgccacactgtatctgctcatgcggttctctttcggggcgacgagcaatttcgcaagagtcaagatgcaggtgaccatgagtcttgcatctctggttggtagggcaccagacttcaacgaggagcacctgcgtaggtcactgcgtacaatcctggcttactccgaggaggataccgccatgcagatgacgccttttcctacccaggtagaggaactgctttgcaacctgaatagtatcctgtacgacaccgtaaagatgcgcgaattccaggaggatcctgagatgctcatggacctcatgtacaggatcgccaaaagctaccaggctagccccgatttgagactaacttggctgcaaaatatggcagagaagcatacgaagaaaaagtgctatacagaagccgctatgtgcctcgtgcacgcagccgctctagtcgcggagtacttaagtatgctggaggatcactcgtacctgcctgttggctcagttagtttccagaatatttcgagtaacgtgctggaggagagtgtagtctctgaggacaccctaagccccgacgaagacggggtgtgcgcaggtcagtacttcacagagagcggtttagtgggattgctggaacaggccgcggaactgttctctaccggggggctctacgagacagtcaacgaggtgtacaagttggtgatacccattttggaggctcatcgagagttccgcaaactcacactgactcattctaaattacagcgagcctttgactctatcgtaaacaaggaccacaaaaggatgtttggaacttatttccgggtcggctttttcggaagcaagttcggcgatttagatgagcaggagttcgtttataaagaacccgccatcacaaagctgcctgagatttcccaccgcctggaagccttttatggtcagtgcttcggggcggagttcgtcgaggtcataaaagattccacaccggtagacaaaactaagctagatcctaataaagcctatatccagatcacctttgtggagccttattttgacgaatatgagatgaaggaccgcgtaacatattttgagaaaaactttaaccttcgccggttcatgtacaccacacccttcaccctggagggccggccaaggggagagcttcacgagcaataccgaagaaacaccgtgctgacaacgatgcatgccttcccatacattaaaactcgcatctccgtgatacaaaaggaggagttcgtgctgacaccgatcgaggtcgctatcgaagatatgaagaaaaaaactttgcagctggccgtggccattaaccaggaaccccctgatgcaaaaatgttacagatggttctgcaaggtagtgtcggtgcaaccgttaatcagggaccacttgaagtggctcaggttttcttggcagagatcccagctgaccctaagctttatcggcatcataataagcttcggctgtgtttcaaagaatttatcatgagatgtggggaagctgtggaaaagaacaaaagattgatcaccgccgatcaaagggaataccaacaggagcttaaaaaaaactacaataagctgaaggaaaacttaagaccaatgatagagcgcaagatacctgagctatacaagcccattttcagggtggagagtcagaaaagggactcgtttcaccgctcctcattccggaaatgcgagacccagctgtcccagggaagttag

SEQ ID NO: 185062 - DNA, 1182 bp, Artificial Sequence
  Description of Artificial Sequence: Synthetic coding sequence
atgaagcggacccgggacgaggtggacgccaccctgcagatcgccaaattaaacgccgcagagctgctccccgccgtccattgcctgggttttggccccggagccagtggtgcagcggcaggagacttctgtctcttagaactagaaccaaccctctgtcagcagctggaggatggacattctctggttatcaggggcgacaaagatgaacaagcagtgctctgttctaaggacaaaacttacgatttgaaaatcgcagacactagtaatatgctgctttttatccctggttgcaagacacctgatcagctcaaaaaggaagactctcattgcaatattatacacactgagatctttggtttctccaacaattattgggagctccggagacgtagaccaaaactgaagaagctgaaaaaattgttaatggaaaacccttacgagggaccagattctcagaaggaaaaagactcaaacagttcaaaatataccaccgaggacttgctcgatcagatccaggctagtgaagaagaaatcatgacccaactccaggtattgaacgcttgcaaaatcggaggctattggcgaattttggaattcgactatgagatgaaacttctcaatcacgtgactcagctcgtggatagcgagtcatggagtttcggaaaggtgcccctgaacacctgcttgcaggaactcggccccttggaacccgaagagatgatcgaacactgtttaaagtgctatgggaagaaatacgtagatgagggagaggtatactttgagctcgacgccgacaagatctgccgggccgccgcaagaatgctcctacaaaacgccgtcaagttcaacctggccgagtttcaagaggtgtggcagcagtccgtccctgagggaatggtgacaagtctcgatcagctgaaaggccttgcacttgttgaccggcattcccgaccagaaatcatctttctcctcaaggtagatgatctaccggaagataaccaagagcgcttcaattctctcttttcactcagagagaagtggaccgaggaagacatcgctccatacattcaggatctgtgcggcgagaagcaaacgatcggcgctctgctgactaagtactcccattccagcatgcagaacggagttaaagtgtacaatagccggcgaccaattagttag

SEQ ID NO: 185063 - DNA, 342 bp, Artificial Sequence
  Description of Artificial Sequence: Synthetic coding sequence
atgagcgccagcgtggtgagcgtgatcagccggttcctggaggagtacctgtcttctaccccacagagattaaagcttttagatgcttacttattatacattttgttgaccggtgccctgcagtttggctattgcctgctggtgggcactttcccctttaattccttcctttcagggtttatcagctgcgttggttcctttatcctggcagtgtgtcttagaatccagattaatccacagaacaaggcagactttcaggggatcagtcccgaacgtgcttttgccgacttcttattcgcctccactattctgcacctggtggtgatgaattttgtgggctag

SEQ ID NO: 185064 - DNA, 285 bp, Artificial Sequence
  Description of Artificial Sequence: Synthetic coding sequence
atgcggaccctggccatcctggccgccatcctgctggtggccctgcaggctcaggccgagccgctgcaggcgcgcgctgatgaggtggccgccgctcccgaacaaatagctgcagatatccctgaggtagtggtctccctagcttgggacgagagcctggcacctaagcatccaggttctcgaaagaacatggcgtgttattgtaggattcccgcctgcattgccggcgaaaggagatacggcacatgcatctaccagggcaggctgtgggccttctgctgttag

SEQ ID NO: 185065 - DNA, 285 bp, Artificial Sequence
  Description of Artificial Sequence: Synthetic coding sequence
atgcggaccctggccatcctggccgccatcctgctggtggccctgcaggcgcaggccgaaccactgcaggccagggctgacgaagtggccgctgcgcctgagcagatcgctgctgatattcccgaagtggttgttagtctcgcatgggacgaatcgttggcccccaagcaccctggcagcaggaagaatatggcgtgctactgcaggataccagcatgcattgcgggagagagaaggtacggcacctgtatatatcagggccgcctctgggcattttgctgctag

SEQ ID NO: 185066 - DNA, 294 bp, Artificial Sequence
  Description of Artificial Sequence: Synthetic coding sequence
atgcggatcatcgccctgctggccgccatcctgctggtggccctgcaggtgcgagcaggtcccctacaggccaggggagacgaggcccccggccaggaacagagggggcccgaggatcaagacatctctatctccttcgcctgggataaaagctctgccctgcaggttagcggatctacaagaggaatggtgtgttcatgtcgtttggtgttttgcagaagaactgagctgagagtgggaaattgtctgatagggggcgtctcattcacgtattgttgtactcgagttgattag

SEQ ID NO: 185067 - DNA, 285 bp, Artificial Sequence
  Description of Artificial Sequence: Synthetic coding sequence
atgcggaccatcgccatcctggccgccatcctgctggtggccctgcaagcgcaagcagaaagtctgcaggaacgcgccgatgaggccaccactcaaaaacagagtggagaagataatcaggatcttgccatctcatttgcaggaaacgggcttagtgccctgcgtacaagcgggagccaggcccgggccacatgctattgccgcacaggccgatgtgccacccgggaaagtctcagtggcgtgtgcgaaatcagcgggagattgtatcggttatgctgtcggtag

SEQ ID NO: 185068 - DNA, 303 bp, Artificial Sequence
  Description of Artificial Sequence: Synthetic coding sequence
atgcggaccctgaccatcctgaccgccgtgctgctggtggccctgcaagcaaaagcagaaccgttgcaggctgaggacgatccactccaggccaaagcttacgaggctgacgcccaagaacagcggggcgcaaatgatcaggacttcgccgtaagctttgcagaagatgcctccagcagcttacgagcccttggttcaaccagagcctttacgtgccattgcaggcggtcatgctacagcaccgagtactcctatgggacgtgcactgtaatgggaatcaaccatcgattttgctgtctgtag

SEQ ID NO: 185069 - DNA, 207 bp, Artificial Sequence
  Description of Artificial Sequence: Synthetic coding sequence
atgcggaccagctacctgctgctgttcaccctgtgcctgctgctgtccgagatggcatcaggcgggaacttccttaccggactaggccatcgctctgaccactacaactgcgtgtccagtggggggcagtgcctctactccgcgtgtcccatctttacaaagatccaggggacttgctaccggggaaaagccaagtgttgtaagtag

SEQ ID NO: 185070 - DNA, 372 bp, Artificial Sequence
  Description of Artificial Sequence: Synthetic coding sequence
atgaagctgctgctgctggccctgcccatgctggtgctgctgccccaagtgattcccgcctatagcggcgaaaagaaatgttggaacaggagtggtcattgccgcaaacaatgtaaagatggcgaggctgtaaaagacacatgtaaaaacttgagagcctgctgcatcccatctaacgaggatcatagacgcgtgcccgccacaagtcctacaccattatccgacagcacccctgggattattgacgatatcctgaccgtcaggtttacaaccgactattttgaggttagctcgaaaaaggacatggtggaggaatcagaagccgggcgcgggaccgagacctcactgccgaatgtccaccatagttcttag

SEQ ID NO: 185071 - DNA, 1002 bp, Artificial Sequence
  Description of Artificial Sequence: Synthetic coding sequence
atgagctggatcaaggagggcgagctgagcctgtgggagcggttctgcgccaacatcatcaaggctggaccaatgcccaagcacatcgccttcataatggacggtaaccgacgctatgccaagaagtgtcaagtggagaggcaagaaggacacagccaggggttcaacaaactggctgagacactgcggtggtgtctgaacctggggatcctagaggttacggtatatgcatttagtattgagaactttaaacggagcaaatcagaggtggatggactaatggaccttgcaagacagaagttctcccgcctgatggaagaaaaggagaagctgcagaagcacggggtgtgtattcgtgttttgggagacctgcatttactgcccctagatctgcaggagctaattgcccaggccgtccaagcgacaaagaactataataaatgtttcctcaatgtctgtttcgcatataccagccggcacgagataagcaacgccgtgcgggagatggcctggggcgtcgagcaaggcctcctggaccccagcgacatcagcgagagtctgcttgacaagtgcctgtacactaaccgatcaccacaccccgacatccttattagaacctccggggaggtcaggctcagcgactttctcttgtggcaaacctctcacagctgcctggtgttccaaccagtgctttggccggaatacacattttggaatctgttcgaagccattctgcagttccaaatgaaccattccgtactgcagaaagccagggacatgtatgcggaggaaagaaaaaggcagcagctggaacgcgaccaagccactgttaccgagcagcttctgcgcgaaggtctgcaggcttcaggtgacgcacagctgcggcggacgcggctgcacaagctgtccgccaggcgagaggagcgcgtccaagggttcctgcaggcattagaactgaaacgggccgactggcttgcgcgtctcggtactgccagcgcctag

SEQ ID NO: 185072 - DNA, 1005 bp, Artificial Sequence
  Description of Artificial Sequence: Synthetic coding sequence
atgagctggatcaaggagggcgagctgagcctgtgggagcggttctgtgccaacataatcaaagcaggtccaatgcccaagcatatcgcctttatcatggacgggaatagaaggtatgcgaagaagtgtcaagtggagcgccaggaggggcactcacagggtttcaacaaactcgccgaaacccttcgctggtgtctaaacttagggatcctggaagtgactgtatacgcgttctcgatcgaaaattttaagcgctctaagtctgaggtcgacggccttatggatctggccaggcagaaattctccaggctcatggaagaaaaagaaaagttgcagaaacacggcgtctgcattagagtgctgggcgacttgcatctgctccccctggatcttcaggagctgatagcacaggcagttcaggcaacaaagaattataacaaatgcttcttaaacgtttgcttcgcttatacgagcaggcacgagattagcaacgcggtaagagaaatggcttggggcgtggaacagggcttgttagacccctcggatatctccgagagcctgctggacaagtgcctctatactaatcgatccccccacccagatatcctaattcggacttcaggcgaggtcagactatcggactttctgctttggcagacctcacactcatgcctggtctttcagcctgttctgtggccggagtacactttttggaacctgtttgaggcgattctgcagttccagatgaaccactctgttctccagcaaaaggcccgggacatgtatgccgaggagagaaagcggcagcagctggaacgcgaccaggcaaccgtgactgagcagctgttgcgcgagggactgcaggcatctggggacgctcaactgcgccgcacccggttacacaaattgtcagctcgacgagaagagcgggtacagggattccttcaggccctcgagctcaagagagccgattggctggctaggcttggaactgcaagcgcatag

SEQ ID NO: 185073 - DNA, 516 bp, Artificial Sequence
  Description of Artificial Sequence: Synthetic coding sequence
atggacctggcccggcagaagttcagccggctgatggaggagaaggaaaaactgcaaaaacacggagtgtgtatacgggttctgggtgacctgcatttgttaccgctggatctccaggaactgattgcccaagcagtacaggccactaaaaactacaataatgacatcagcgagagtctcctggacaaatgcctttacactaatcggagtccgcacccagacattctgatccgcaccagcggcgaggtgcgtttaagtgatttcttactctggcaacaaaaagctcgcgacatgtatgctgaggaacgcaagcggcagcagttagaacgtgaccaggccactgtcactgagcagctgctgcgggagggtcttcaggcctccggagacgcccagctgagacgcacccgcctgcataaattatctgctaggcgagaagagcgagtgcaggggtttctccaggccctcgagctcaagcgggctgactggcttgctcgactcggaaccgcaagtgcttag

SEQ ID NO: 185074 - DNA, 501 bp, Artificial Sequence
  Description of Artificial Sequence: Synthetic coding sequence
atggacggcaaccggcggtacgccaagaagtgccaggtggagcggcaggagggccactcacaggggtttaataaactcgccgagaccttaaggtggtgtctgaacctcggtatcctggaagtgacagtgtatgccttctctatcgagaacttcaagcggtctaaatccgaggtggacggcttgatggatttggcccgtcagaagttctctaggctgatggaggaaaaagagaagctacagaaacatggagtgtgcattcgtgtgctgggcgaccttcatctgctgcctctggacttgcaagaactgatcgcacaggccgtgcaggccactaagaattacaacaaatgttttctcaacgtgtgtttcgcatacacaagcaggcacgaaatcagcaatgctgttcgagaaatggcttggggagtagagcaggggctactcgacccctcccgggacagattccaccacattgggcaggcttctctggaattgctaactagctag

SEQ ID NO: 185075 - DNA, 546 bp, Artificial Sequence
  Description of Artificial Sequence: Synthetic coding sequence
atggaggagaaggagaagctgcagaagcacggcgtgtgcatccgggtgctgggcgacctacacctgttgcccttggacttacaagagttgatcgcccaggctgtccaggccaccaagaattataataagtgcttcttgaacgtctgcttcgcctacacttcgagacatgagattagcaacgccgtgagagagatggcctggggagttgaacagggcttgctggaccccagcgatatttccgaaagcctactggataaatgtctgtatacgaacagaagccctcatcctgatatccttatccgtactagtggggaagttcgcctgtcagactttctcctgtggcagaccagccattcttgcctggtattccagcccgtgctttggccggagtacacattttggaatttgtttgaggccatcttgcagttccagatgaaccattctgtcttacagcatccaggcagtctgctgaccaaggcctggaagaagccatttcagcaagacggcgagctctacggcaactgttcttccccaaaaagttcatag

SEQ ID NO: 185076 - DNA, 669 bp, Artificial Sequence
  Description of Artificial Sequence: Synthetic coding sequence
atgagctggatcaaggagggcgagctgagcctgtgggagcggttctgcgccaatatcatcaaggccggacctatgccgaaacacatagccttcatcatggacggcaacagaagatacgcaaagaaatgtcaagtggaacgccaagaaggccattctcagggcttcaacaagctggccgagaccctgagatggtgcttgaatctcgggatccttgaggttaccgtgtacgccttctccattgaaaacttcaaacgctccaaatcagaggtagatggattgatggacctggctaggcagaaattcagtcgcttaatggaggaaaaggaaaagctccagaaacatggagtttgtattcgcgtgctgggagatctccatctcctgccactcgacctccaagaactcattgcccaggcagtccaggccacaaaaaactataacaagtgttttcttaatgtgtgctttgcttacacaagccgtcatgagatctccaatgccgtgcgcgaaatggcatggggcgtcgaacagggtttgttggacccgagatatccggatgatatcagtgagtctcttctcgacaaatgtctctacaccaacaggtctccccatcccgacattctcattcggacatcaggggaggtcagactttctgacttcctgttgtggcagtag

SEQ ID NO: 185077 - DNA, 369 bp, Artificial Sequence
  Description of Artificial Sequence: Synthetic coding sequence
atgagctggatcaaggagggcgagctgagcctgtgggagcggttctgcgctaacattatcaaagccggcccaatgccaaaacatattgcatttatcatggacggaaacagaaggtatgccaagaagtgccaagttgaacgtcaggagggccactctcagggatttaataagctggccgagaccctgcggtggtgccttaatctggggattctggaggttactgtctacgccttctccatcgagaacttcaagcggagtaaatctgaggttgacggtcttatggatctcgccaggcaaaagttttccaggttgatggaggaaaaggaaaagctgcagaaacacggcgtttgtatcagggtgcttggatag

SEQ ID NO: 185078 - DNA, 216 bp, Artificial Sequence
  Description of Artificial Sequence: Synthetic coding sequence
atgagctggatcaaggagggcgagctgagcctgtgggagcggttctgcgcgaatattatcaaggctggaccaatgcctaagcacatcgcattcattatggacgggaacagaaggtacgccaaaaagtgtcaagtggagcggcaggaaggccatagtcagggatttaacaaattagcggagaccctccgctggtgtcttaacctgggaattctgtag

SEQ ID NO: 185079 - DNA, 258 bp, Artificial Sequence
  Description of Artificial Sequence: Synthetic coding sequence
atgagctggatcaaggagggcgagctgagcctgtgggagcggttctgcgccaatatcatcaaggccggacccatgcccaagcacatcgcatttattatggacgggaaccgaaggtacgctaaaaagtgccaggtcgaacgccaggagggccattcccaaggattcaataaactcgccgaaactctaaggtggtgcttgaacctcggcattctcgaagtaaccgtctatgccttctccatcgaaaattttaagagatag

SEQ ID NO: 185080 - DNA, 885 bp, Artificial Sequence
  Description of Artificial Sequence: Synthetic coding sequence
atgagctggatcaaggagggcgagctgagcctgtgggagcggttctgcgccaacatcattaaggctggcccgatgcccaaacacatcgccttcataatggatggcaatcgaaggtacgctaaaaaatgccaggtggagagacaggaaggccactcacaggggtttaataagctcgccgaaacactcagatggtgccttaatctcggtattctcgaggttactgtctatgccttctcaatcgagaacttcaagcgcagtaaatctgaagtcgatggcctgatggatctggcgaggcagaagttctcccgcttgatggaggaaaaatgctttctcaacgtctgcttcgcgtataccagccggcatgaaatttccaatgccgtgcgggaaatggcatggggtgtggaacagggcctgctggatccaagcgatatctctgaaagtttactggataaatgtctgtatacaaatcgctctcctcaccctgacatccttattcggacatccggtgaagtgcgcctctcagacttcctgctgtggcagacgtcccattcatgtctggtatttcagcccgtcttatggcctgagtacacattctggaacctgttcgaggccattttgcagttccaaatgaatcattccgtgctgcagaaagcccgggatatgtatgccgaggagaggaaacgacagcagctggaacgagatcaggctaccgtgaccgaacaactgttacgcgagggcctccaagcttccggggatgcccagctacggaggacccgactgcacaaattgagcgccaggagggaggagcgcgttcagggttttctgcaggctttggaactaaagagggctgattggctggccaggcttggcaccgcctccgcatag

SEQ ID NO: 185081 - DNA, 183 bp, Artificial Sequence
  Description of Artificial Sequence: Synthetic coding sequence
atgagctggatcaaggagggcgagctgagcctgtgggagcggttctgtgctaacatcatcaaggccggtcccatgcctaaacacattgccttcatcatggatgggaatagaaggtacgctaaaaaatgtcaggtagagagacaagaggggcatagccagggcttcaacaaactggctgaatag

SEQ ID NO: 185082 - DNA, 396 bp, Artificial Sequence
  Description of Artificial Sequence: Synthetic coding sequence
atgagctggatcaaggagggcgagctgagcctgtgggagcggttctgcgcaaatattatcaaggccggtcctatgccaaagcacattgctttcattatggacgggaaccggcgatacgccaaaaaatgtcaggtcgaacgacaggaagggcattcccagggtttcaacaaactggcagagactctgcgttggtgcttgaatttggggattctggaagtgaccgtgtacgcgttctccattgagaactttaaacggtctaagagcgaggtggatggtctgatggaccttgcgagacagaagttcagcagattgatggaagagaaggagaaactgcagaagcatggggtttgcatccgggtgctaggggatctgcatcttttgcctctggatctgtag

SEQ ID NO: 185083 - DNA, 501 bp, Artificial Sequence
  Description of Artificial Sequence: Synthetic coding sequence
atgagctggatcaaggagggcgagctgagcctgtgggagcggttctgtgctaatattattaaagccggcccaatgccgaaacatattgcctttatcatggatggcaaccgcaggtatgctaagaaatgccaggtggaaagacaggaggggcacagccagggatttaataaactcgcagaaacattgcgctggtgtctcaacctgggcattctggaggtgacagtgtatgcatttagtattgaaaacttcaaaagatccaagagcgaagtcgatggactcatggacctagctaggcagaaattcagtcgcctcatggaggagaaagaaaagcttcaaaagcatggagtctgtatcagagtgctgggagacttgcacctcctgcctttggacctgcaggagttgatcgcccaagcggtgcaagccaccaagaattacaataaatgcttcttgaacgtttgcttcgcctacacttccagacacgagattagtaatgctgtgtag

SEQ ID NO: 185084 - DNA, 909 bp, Artificial Sequence
  Description of Artificial Sequence: Synthetic coding sequence
atggtgtggaagcggctgggcgccctggtgatgttccccctgcagatgatatatcttgtggtcaaggcagccgtgggcttggtgcttccagccaagctcagagatctttctcgggagaacgtgctcataaccggcggtgggaggggaatagggcggcagctagcacgggagtttgctgagcgaggggctaggaaaatcgtactttggggaagaaccgagaagtgcctgaaggaaactaccgaggaaatccgacagatggggacggaatgccactacttcatttgcgacgttggcaaccgtgaggaagtgtatcagaccgcaaaggctgttagagagaaagtgggcgacatcaccatccttgtcaacaatgcggcagtggtgcatggaaagtctctgatggatagcgatgacgacgctctgctgaaatctcagcacattaacaccctgggccagttttggactacgaaagcctttttacctcgcatgttggagttacagaatggccacatagtctgccttaatagtgttctcgctctcagcgctatcccgggggctattgactactgcacctcaaaagcttccgcttttgcattcatggagtctctcaccctgggtctacttgattgtcctggggtgagcgcaaccactgtcttgcccttccatacgtcaaccgagatgttccaaggcatgcgagtacgctttcccaacctgttccctccactgaaaccagagacagtcgcccggagaacagtggaggctgtgcagctaaatcaagccctcttgctgttgccctggactatgcacgctctcgtgatccttaaaagtatccttccccaggcggcgctggaagagatacacaaattttccgggacgtacacctgtatgaatacctttaaaggtagaacatag

SEQ ID NO: 185085 - DNA, 444 bp, Artificial Sequence
  Description of Artificial Sequence: Synthetic coding sequence
atgggcaccgagtgccactacttcatctgcgacgtgggcaaccgggaggaggtgtaccagacggcaaaagcggtgcgagaaaaggtaggcgatatcacaattctcgtcaataatgctgccgttgttcatggaaagtctttgatggattccgatgatgacgccctgctgaagagccaacatataaacactctcggacagttctggactacaaaagctttcctgcccaggatgttggaactccagaacggccacatcgtctgtctgaactcggtgctcgctctatctgcgatacccggggccattgactactgcactagcaaggcatcggcatttgcttttatggaaagccttactctgggtttgcttgactgccccggtgtatctgccacaactgtcctgccctttcacactagcacagaaatgttccaaggcatgagagtgtag

SEQ ID NO: 185086 - DNA, 423 bp, Artificial Sequence
  Description of Artificial Sequence: Synthetic coding sequence
atggccagcagcggcatgacccggcgggaccccctggccaacaaggtagccctagtcacagcttctaccgacggaattggattcgccattgcccgccgcctggcacaggacggtgcccacgttgtcgtttcttctcgtaagcagcagaatgtcgaccaggcagtcgccactttacaaggggaggggttgagtgtgaccggcacagtatgccatgtcggaaaagctgaagatcgggaacgcctggtggctacattgtggatggataaagaaaaagaagagtccatgaaagagactctgcgtattaggagactgggtgagccagaagattgcgcaggaattgttagcttcctttgcagcgaagacgcaagctacataaccggcgaaacagtggtagttggtggaggtaccccctctagactctag

SEQ ID NO: 185087 - DNA, 837 bp, Artificial Sequence
  Description of Artificial Sequence: Synthetic coding sequence
atgcacaaggccggcctgctgggcctgtgcgcccgggcctggaactctgtgcgcatggcctccagcggcatgactagacgcgaccctctggcaaataaggtcgcgctcgtcacagccagcaccgacggcattggttttgcgatcgctagacgcctggcccaggatggcgctcacgttgtggtctcttcacgcaaacaacaaaatgtggaccaagcagtggcaactctgcaaggagaaggacttagtgtgactgggacggtctgtcacgtgggaaaggctgaggatcgcgagaggctggtggccactgctgttaagctccacggagggattgatatactggtatcaaacgccgccgttaaccctttttttggctctataatggacgtgaccgaagaggtgtgggacaaaactttagatataaatgtcaaggccccagctctcatgaccaaagctgtggttcctgaaatggaaaagcgcggcggcggaagcgtggtgatagtgagttcaatagcagcctttagcccctcccccggattcagcccatataatgtttcaaagaccgcccttttaggtttgacaaagaccttggccattgaactagccccgcgaaacatccgggtcaactgtctagcacccggtctcatcaaaacatcattctcgaggatgctttggatggataaggagaaagaggagagcatgaaggagaccctgcgcattagacgcttgggagagccagaggattgtgccggcatcgtctcattcctgtgttccgaagacgcctcttacattacgggagaaaccgtagttgttggaggtggtacgcctagtagactatag

SEQ ID NO: 185088 - DNA, 513 bp, Artificial Sequence
  Description of Artificial Sequence: Synthetic coding sequence
atggccagcagcggcatgacccggcgggaccccctggccaacaaggtcgccctggtcaccgccagtaccgatggtattggtttcgccatcgcccgccggctcgcacaggacggagcccatgtggtcgtgtctagccgcaaacagcaaaatgtcgatcaggccgtggccaccctccagggcgaggggctgagcgttacaggtaccgtgtgccatgtgggtaaggccgaggatcgagagaggcttgtggccacagcagtcaaactacacggcggcattgacattttggtctctaatgctgccgtcaaccctttctttgggtcaatcatggacgtcactgaggaggtatgggataagcgccgtctgtctggcgacagggtattccactcttccctgcagtcaatttcttctctggacggacaaggcaagcggggaaagcatgaaagaaaccccgccgacaagaaggtacggagggcgcgaggtctgtgttggcaccgggtgtttccggtgctgtag

SEQ ID NO: 185089 - DNA, 546 bp, Artificial Sequence
  Description of Artificial Sequence: Synthetic coding sequence
atggccagcagcggcatgacccggcgggaccccctggccaacaaggtggccctggttactgcctccaccgacggcattggatttgccattgctcgccggctggctcaggatggagcccacgttgtggttagcagtcgcaagcaacagaacgtggaccaggctgtggccaccttgcagggtgaaggcctgtctgttaccggaaccgtgtgtcacgtcggtaaggcggaagatagagagcgcttggttgctacaactctggacatcaatgtgaaggctccggcgctcatgacaaaggcagtggtcccagagatggagaagcggggcggaggcagcgtggtcatcgtgtcgagcatcgccgcgttctctccaagccctttgtggatggacaaggagaaggaggagtcaatgaaggagaccctgaggatcagacgcctcggcgagccggaggattgcgccggcatagtctcgtttctctgcagcgaggatgcctcctatataactggcgaaactgtcgtcgtcggtgggggaaccccctcccgcttgtag

SEQ ID NO: 185090 - DNA, 477 bp, Artificial Sequence
  Description of Artificial Sequence: Synthetic coding sequence
atgcacaaggccggcctgctgggcctgtgcgcccgggcctggaactcggtcagaatggccagctccggcatgacaagacgggaccctttggcaaacaaggtggccttagtcactgcctccactgatggtattggattcgctattgctaggagactagctcaagacggagctcacgtggtggtgtcctcccgcaagcagcaaaatgtggatcaagccgtggcgaccctgcagggcgaagggctttccgttacaggcaccgtatgtcatgtggggaaggcagaggatcgggaacggttggtagccacgctatggatggacaaggaaaaggaagagtctatgaaagagaccctgaggatcagacgcctgggcgagcccgaggattgcgccggcatcgtgtctttcctgtgttccgaggacgcctcctacatcacaggagaaaccgtggtcgtgggaggcggcacaccttcccggttatag

SEQ ID NO: 185091 - DNA, 579 bp, Artificial Sequence
  Description of Artificial Sequence: Synthetic coding sequence
atgcacaaggccggcctgctgggcctgtgcgcccgggcctggaactctgtgcgaatggcatctagcggcatgaccagacgtgacccattagccaacaaggttgcccttgtcactgcatccactgatggaatcggtttcgctatcgcgaggcgactggcccaagatggtgcacacgtggtggtgtctagcaggaaacagcaaaacgtcgaccaggcagtggcaacgctgcagggcgaggggctttccgtgacagggactgtttgtcacgtcggcaaggcggaagacagagagcgcctcgttgccacagccgtgaaactccatggtggcatcgatatattggttagcaacgctgctgttaatccgttctttggtagcattatggacgtgactgaggaagtctgggataaactgtggatggacaaggaaaaagaggagtctatgaaggagaccttgagaatccgccggctaggggagcctgaggattgtgcggggatcgttagctttttgtgttctgaagatgctagctacataactggcgagacagttgtggtggggggggggacgcccagtaggctatag

SEQ ID NO: 185092 - DNA, 681 bp, Artificial Sequence
  Description of Artificial Sequence: Synthetic coding sequence
atggccagcagcggcatgacccggcgggaccccctggccaacaaggtcgcactggtaaccgcaagcacagacgggatcggattcgccatcgcccgtagactggcacaggacggcgctcacgtggtagtgtcaagccggaaacagcaaaacgtggaccaagccgtggcaacgctgcaaggcgaaggcctgagtgttaccggaaccgtatgccacgtcgggaaagctgaggacagagaaaggctggtagccactacgctggatatcaatgtgaaggctccagctctcatgaccaaggctgtcgtccccgaaatggaaaagcggggtggcggatcggttgtgatcgtgagcagcatcgctgctttctcaccttcccccggcttttctccctataacgtgtccaaaacagctttactgggccttaccaaaacgcttgcaatcgagctggctccacgcaatatccgcgttaattgcctggccccaggcctcataaaaaccagtttttctaggatgttatggatggataaagaaaaagaagagagtatgaaggagacgctaagaatccgccggctcggagagccagaggattgcgctggcatcgtcagctttttgtgttctgaagacgcctcttacattaccggtgaaaccgtcgttgtaggcggcggcacccctagccgtctttag

SEQ ID NO: 185093 - DNA, 567 bp, Artificial Sequence
  Description of Artificial Sequence: Synthetic coding sequence
atgcacaaggccggcctgctgggcctgtgcgcccgggcctggaacagtgtcagaatggcttcttcgggcatgaccagacgggatcccctcgccaataaggtggcactggttaccgcttctactgatggcattggcttcgccatcgcccgtagactcgcacaggacggcgcccacgttgtggtgtccagccggaaacaacaaaacgttgatcaggctgtcgctaccctacagggtgaaggactctcagtcacaggcactgtgtgccacgttggcaaagcggaggaccgggagagattagtcgccactgccgtgaagttgcatggagggattgatattctggtttccaacgccgccgtgaacccgttctttgggtcaattatggacgtcactgaagaagtgtgggataaaaggcggctgagtggggacagagtgttccatagttcattgcagtcaatctcctccttggacggacagggtaagagggggaaacacgagaggaatcccgccgacaagaaagtcaggagagcacgtggactctgctggcatagggtattcccagtactgtag

SEQ ID NO: 185094 - DNA, 600 bp, Artificial Sequence
  Description of Artificial Sequence: Synthetic coding sequence
atgcacaaggccggcctgctgggcctgtgcgcccgggcctggaacagcgttcggatggctagcagtggcatgaccaggagagacccacttgcgaacaaggtggctctggtgacagcttctactgacggaattggatttgctattgcgcgcaggctggctcaggatggggctcatgtcgttgtatccagccggaagcagcagaacgtagatcaagcagtggcaaccctacagggcgaaggcctctcggtgactggtacagtgtgtcatgtgggtaaggcagaagatagagaaagactggtggcaactactcttgacatcaacgtgaaagcgcccgcgttgatgactaaggctgtcgttccagaaatggagaaaagagggggtggcagcgtcgtgatagtatctagcattgctgcctttagtccctcaccactctggatggataaagaaaaggaggagtcaatgaaggagaccctgcgcataaggaggctgggtgaacccgaggattgtgctggcatcgtcagcttcttgtgttccgaagacgcctcatacatcacaggagaaacagtggtcgtgggcggtggtacacccagccgcctgtag

SEQ ID NO: 185095 - DNA, 1374 bp, Artificial Sequence
  Description of Artificial Sequence: Synthetic coding sequence
atgcggagcgccgccgtgctggccctgctgctgtgcgccggccaggtcacagctcttcctgtaaatagtccaatgaataagggcgacactgaggtcatgaagtgcatagtcgaggtaatttctgacactctcagcaagccttcccccatgccagtctctcaggaatgtttcgagacactgcggggcgacgagcggatcctgtccattctgaggcaccaaaacttgctgaaggagttacaggacctggccctgcagggtgctaaagagcgggctcaccagcaaaagaaacactctggcttcgaagacgaacttagtgaggtactggaaaaccagtcctcacaagccgagctcaaagaggcagtcgaagagccgtcttctaaagacgtgatggagaagcgggaggacagcaaagaggctgagaagtcaggcgaggcgactgatggcgcccgcccgcaggcactcccagagccaatgcaagaaagcaaggccgaagggaataaccaggcccccggtgaggaagaggaggaagaggaggaagccactaatactcatcctccagcttcactgcccagccagaaatatcccggcccccaggccgagggggattccgagggcctgtcgcaggggctggtggaccgagaaaaaggcctatcagcagagcccggctggcaggccaagcgcgaggaggaagaggaagaggaggaggaggccgaggctggggaagaggcggtgcccgaggaagagggtcctaccgtagtcctgaatccccacccctctctcgggtataaggagattcgaaaaggagaatcaaggtccgaagccctcgctgtggatggcgcaggtaaacccggtgcggaggaagctcaggatcccgaagggaagggcgagcaggaacacagtcagcaaaaagaggaagaggaggagatggccgtggtaccccaaggattgttccgcgggggcaaatccggagaactagaacaagaggaggagcgcttatccaaagagtgggaggactctaaaagatggtccaagatggatcagctagcaaaagaactgactgccgagaaacggctagagggacaggaggaagaggaggataacagagacagctcaatgaagctgtcatttagggcgcgtgcctacggattcagggggccaggaccacagctacggcggggctggagaccaagttctcgagaggactcgttagaagcaggccttccattacaagtgcgcgggtatccagaagagaaaaaggaggaagagggaagcgcgaacaggagaccagaggatcaggaacttgaatccttgtccgccatagaggctgagctcgaaaaagttgcccatcagctccaggcactcaggcggggatag

SEQ ID NO: 185096 - DNA, 1128 bp, Artificial Sequence
  Description of Artificial Sequence: Synthetic coding sequence
atgaactgggagctgctgctgtggctgctggtgctgtgcgccctgcttttactgctggtgcagctactcagattcctgagagcagatggcgatcttacgcttttgtgggccgagtggcagggacggagaccagagtgggagctcacagacatggtggtttgggttacaggcgcatcctctggaataggagaagagcttgcatatcagctgtccaaactgggggtgagcctggtactgtctgcaagacgggtacacgaactagagagagtcaagcgcagatgtcttgaaaacggtaatttgaaggagaaagatatcctggtccttcctttggacctcaccgatactggatcacatgaagctgcgactaaggcagttctgcaggaattcggaagaatcgacatcctggtcaacaatggtgggatgtctcagcggtcactctgcatggatacctctcttgatgtttaccggaagctaattgaactcaactatctgggaacggtgtccctgacgaagtgcgttttgccgcatatgattgagcgcaagcagggtaaaatagtaaccgtgaacagcattctcggcatcatatctgtccctctttctattggctactgcgcgagtaaacatgctctccgtggtttttttaacgggttgagaacggaactggcaacctatccaggtattattgtgtctaacatatgtcctggccccgtccagagcaacatcgtggagaatagtttggctggcgaagttaccaagaccatcgggaacaacggcgaccagagtcacaaaatgaccacctctcgttgtgttcgactaatgctaatatcaatggctaatgacctgaaggaagtttggatctcggagcagccatttctgctagtgacatacctgtggcaatatatgcctacttgggcttggtggatcactcgttggggccgcaagggactccgcactttgcgggttgtctggatgcagactctcctgatcttgaaaagcctgcgccagaacatgacagagaaaagcacatgtacattccaggcgaccggaggacgcaacggaaagcacgagaattcaaatcttcttatgttgctgaacaatcagcgcctgatatgcgacttcactttttag

SEQ ID NO: 185097 - DNA, 870 bp, Artificial Sequence
  Description of Artificial Sequence: Synthetic coding sequence
atggtggtgtgggtgaccggcgccagcagcggcatcggcgaggagctggcttaccagctttctaaactcggagtgagtctggtgctgagcgcccgccgcgtgcatgagctggaaagggtcaagaggcgctgcttggaaaatggcaacctcaaggagaaagacatcctcgtcttacccctcgacctaaccgatactggctctcacgaggctgctacaaaagccgtacttcaggagttcggccggattgacatcctcgtgaacaatgggggaatgtcccagaggagtctgtgtatggatactagcctggacgtatatcgcaagctaattgagctgaactacctggggacagtatctctgacaaagtgcgtgctgccacacatgatcgagcgaaaacagggaaagatagtgacggtcaatagcatactgggcatcattagtgttcccctatcaatcgggtactgcgcctcgaagcacgcgctcagaggtttcttcaatggactcaggaccgagctggccacctatcccgggatcattgtcagcaacatctgtcccggacccgttcagtcaaatatcgtcgagaacagtcttgcaggagaagtcactaagaccatcggaaataatggcgaccagagccataagatgaccacgtcaaggtgtgtcaggctgatgctaatcagcatggcgaatgatctgaaagaggtatggatctctgagcagccattcctgttggtgacatatctctggcagtacatgcccacctgggcatggtggataacaaacaaaatgggtaagaaacggatcgaaaacttcaagagcggcgtggacgcagattctagctactttaaaatttttaaaacgaaacacgattag

SEQ ID NO: 185098 - DNA, 1020 bp, Artificial Sequence
  Description of Artificial Sequence: Synthetic coding sequence
atgaactgggagctgctgctgtggctgctggtgctgtgcgccctgctgttactactggtgcagttactccgatttcttagagccgatggtgatttgacgctgctgtgggccgaatggcaaggcagaaggcctgagtgggagctgacagatatggtggtgtgggtcacgggagctagcagcgggataggggaggaactcgcgtaccaactttcaaagttgggagttagtctcgttctaagcgcgcggagggttcacgagctggagcgcgtcaaacggcgctgtctggagaacggcaatcttaaggagaaggatattttggtgctccctctggacttgactgacacgggaagtcatgaagcggccaccaaggccgtcctgcaggagttcggcaggattgacatactggttaataacggtggaatgtcccaacgctctctgtgcatggacactagtcttgacgtatataggaaactgatagagctgaactacctcggcaccgtcagtcttactaaatgtgttctgccccacatgattgaaagaaagcaggggaagatcgttactgtgaactccattctagggattatcagcgtacctttgtctatcggctattgtgcgtcaaaacatgcgctccgaggatttttcaatgggctgcggacagagctggcaacatatcccggaattattgtctccaacatctgtcctgggcctgtgcaaagcaacatcgtcgagaatagtctggccggtgaggtgaccaaaacaatcggcaacaatggtgaccagtctcacaaaatgaccacgtccagatgcgtgagactgatgcttattagtatggccaacgatctcaaggaagtgtggatcagcgaacaaccgttcctattggtgacatatctgtggcaatacatgcccacctgggcatggtggatcaccaataaaatgggcaaaaagaggatagaaaatttcaagagcggcgttgatgctgacagcagttacttcaagatctttaaaactaaacacgattag

SEQ ID NO: 185099 - DNA, 186 bp, Artificial Sequence
  Description of Artificial Sequence: Synthetic coding sequence
atgaactgggagctgctgctgtggctgctggtgctgtgcgccctgctactgctgctggtacaattgctccgttttttgagagccgacggcgacctaacgttgctgtgggcagagtggcagggacggcggccagaatgggagctaacagatatggttgtgtgggtgaccggagcctcctctggctag

SEQ ID NO: 185100 - DNA, 960 bp, Artificial Sequence
  Description of Artificial Sequence: Synthetic coding sequence
atgctgttctgggtgctgggcctgctgatcctgtgcggcttcctgtggacccgtaaggggaagcttaagatagaagacataacggacaaatacatctttattacggggtgtgacagtggcttcgggaatctggctgcccggacattcgataagaagggttttcacgtaatcgctgcctgtttgactgaatcaggaagcactgctctgaaagctgaaactagtgagcgtctccgcacagtgcttctagacgtgacagatccggaaaatgtaaagcgcaccgcacagtgggtgaagaaccaggtgggcgaaaaggggctgtggggtctgattaataatgcaggcgtgccgggggtgctggcccctaccgattggttaacactggaagattacagggaacctattgaggtgaacctgttcggcctgatctccgtgactctgaacatgttgccactggtgaagaaggcacaagggagagtgataaacgtcagctcagtcggaggccggctggccatcgtgggcgggggatataccccgtccaaatacgccgtcgaaggatttaacgacagtctccggagggacatgaaggcatttggggttcatgtcagctgtattgagccaggactattcaaaaccaatctcgccgatccggtcaaagttatcgagaaaaagctggctatttgggaacagttgtcaccagacattaaacagcagtacggagaaggatacatagagaaatctctggacaaactcaagggtaacaaaagctacgtgaacatggacctgagtccagttgttgaatgcatggaccacgcactgacttccctcttccccaaaacccactacgcagccggcaaagacgctaaaattttttggatcccactcagccacatgcccgcggctctgcaagatttccttctccttaaacaaaaagctgaactagccaatccaaaagccgtatag

SEQ ID NO: 185101 - DNA, 960 bp, Artificial Sequence
  Description of Artificial Sequence: Synthetic coding sequence
atgctgttctgggtgctgggcctgctgatcctgtgcggcttcctgtggaccaggaaaggaaagctgaaaatcgaggacataacagacaagtatatcttcataacagggtgcgactcgggttttggcaacttagctgcaagaactttcgacaagaagggcttccacgtaattgctgcttgtctgacagagtcggggtctaccgcattgaaagcagagacctcagagcgcctgagaaccgtgctccttgacgtgacagatcctgaaaatgtgaagcgcaccgcgcagtgggttaagaatcaagtgggcgagaaggggctgtgggggctcatcaataacgcaggggtccctggtgttctggctcctacagattggcttacgctcgaggattaccgagaacctatcgaagtcaaccttttcggtcttatctccgttacgcttaacatgctgccactggtcaagaaagctcaggggcgcgtgatcaacgtgtcctctgttggcgggcgtttggcaattgtgggaggaggctacacgccatccaaatacgccgtggagggctttaatgattccctgcggagagacatgaaagcattcggagttcacgtgtcatgtatagagccggggttgttcaaaactaatctggctgaccccgtgaaggtgatcgagaagaagctggccatctgggagcagctgtcccccgatatcaagcagcagtacggcgagggttacatcgagaagagtctggataaattaaaaggaaacaagagttacgttaatatggacttgagccccgtagtcgagtgcatggaccacgctctgacttcactgttcccaaagacccactatgctgccggaaaggacgccaagatcttctggatcccgctctcccatatgcctgcggctctgcaggacttcttattattaaagcagaaggctgagttggccaatcccaaagccgtgtag

SEQ ID NO: 185102 - DNA, 960 bp, Artificial Sequence
  Description of Artificial Sequence: Synthetic coding sequence
atgctgttctgggtgctgggcctgctgatcctgtgcggcttcctgtggacgcgtaaagggaagctaaaaatcgaggatatcacagataaatacattttcattacaggatgtgattctggctttggcaatttggcagcaaggactttcgacaagaagggatttcacgtgatcgcggcttgtctcaccgagtcagggtctacagccctgaaggccgaaacctctgagaggctccgaacagtcctattggatgtgactgatccagagaacgtgaagcggaccgcacagtgggtgaagaatcaagtcggagagaagggcctgtggggcttaataaacaatgccggagttcctggcgtgctcgcaccaactgattggctaacgctcgaggattacagagaaccaatagaggtaaatttgttcggtctgatctcagtcaccctgaatatgttgcctctggttaaaaaggcccagggtagagtaattaacgtgtccagcgtgggaggcagactggccatagtcggaggtggttacacgcctagcaaatacgctgtcgaaggattcaatgactctcttcgaagggacatgaaagcctttggggtgcatgtgtcgtgtatcgaacccggtttgtttaagactaacctggcagatcccgtgaaagtgattgaaaaaaagttggccatctgggaacaactgagccccgacataaaacagcagtacggcgaaggctatatcgagaaatctctggacaaattgaaaggcaataaaagttatgtgaacatggacctcagcccagtcgtggaatgcatggatcacgcccttacctctctgttccccaagactcattacgccgccggcaaagacgccaaaatcttctggattcccttaagtcacatgcctgccgccctccaagactttttacttctgaaacaaaaagcggaactggctaatcccaaggctgtgtag

SEQ ID NO: 185103 - DNA, 519 bp, Artificial Sequence
  Description of Artificial Sequence: Synthetic coding sequence
atgctgcccctggtgaagaaggcccagggccgggtgatcaacgtgtcgagcgtgggaggcagactggccatagtgggtggtgggtacactcccagcaaatatgcagttgagggcttcaacgactctctgagacgagatatgaaggcattcggggttcacgtgtcttgcatcgagcctgggctgttcaagacaaacctagctgatccagtgaaggtgatcgaaaagaagctagcaatttgggagcaactttcccctgacattaagcagcagtacggggaagggtacatagagaagagcctggacaagctcaaaggaaacaagtcatacgtcaatatggatctttcacccgtggttgagtgtatggatcacgccttgaccagtcttttcccaaagacgcactacgcggccgggaaagatgccaaaatattctggattcccctgagccatatgcctgccgcacttcaggatttccttttgctgaaacagaaggccgaattggccaaccccaaagccgtgtag

SEQ ID NO: 185104 - DNA, 960 bp, Artificial Sequence
  Description of Artificial Sequence: Synthetic coding sequence
atgctgttctgggtgctgggcctgctgatcctgtgcggcttcctgtggacccgcaaggggaagcttaagatagaagatattacagacaagtatattttcattacaggctgcgattcaggttttggcaacttagcagcccgcacattcgacaaaaagggatttcatgtcatcgccgcttgcctgacagagagcggctctactgccctaaaggctgaaacatctgagcgactgcggactgtactcctcgatgtcactgatccagagaatgtcaagcgtactgcccaatgggtgaaaaatcaggtaggcgaaaaaggattgtggggtctgattaataatgctggtgttcccggcgtactggccccgaccgattggctgactctggaagattatcgtgaaccaatcgaagtaaatctgtttgggctcattagcgtaaccctgaatatgctaccattggtcaagaaggcccagggcagggtgattaacgttagctccgtggggggccgtttagccatcgttggagggggctatacccctagtaagtacgcagtcgagggatttaacgacagcctgcgtagagatatgaaggcttttggagtgcacgtcagctgcattgagccagggctgtttaaaaccaatcttgcggacccggtgaaggttatcgagaagaagctggccatctgggaacaactgtctcctgacatcaaacagcagtatggggaaggctacattgaaaagagcctcgataagctgaaagggaacaagtcatacgtgaatatggacctctcacccgtggttgaatgcatggaccacgccctcacatccctgtttcctaaaacccactacgctgccggaaaagacgccaagattttctggatcccgcttagccacatgccggccgcacttcaggactttcttcttctaaagcagaaagctgaactggccaatcctaaggcagtgtag

SEQ ID NO: 185105 - DNA, 1140 bp, Artificial Sequence
  Description of Artificial Sequence: Synthetic coding sequence
atgcccgagggccggagccactgcgcctgcagcatcaccagcctgacactattagtgtccctaacaagggtaacactcgatattctgcaaaaattagacccacctcaaccagctcattggagacaccaccttctagtcctatacaagaagggcgtgtatctcagccacaccggcggaaagatgcttttctgggtcctcggtcttctcattctgtgcggttttctgtggaccaggaagggtaagctcaagatagaagatattaccgataaatatatcttcatcaccggctgcgactcaggctttggcaacctggcagcaaggacgttcgataaaaaaggctttcacgtgatcgctgcatgtctgactgaaagcgggtctacagctctgaaggcagagacttctgagaggttaagaacagtccttctggacgtgaccgatcctgagaacgtgaagcgaacagcccagtgggtgaaaaatcaggtgggcgaaaagggtctttggggcttgattaataatgcaggcgtacccggggttctggcacctaccgactggctcacactggaggattacagggaaccaatcgaagtcaatttgtttgggctcatcagcgtgaccttgaacatgcttccattggtcaagaaggcccaaggccgggtgattaatgtgtcttctgtcggagggaggctggcaatcgttgggggaggatacactccgtctaagtacgcggttgagggcttcaacgactctctgcggcgggacatgaaggcgtttggtgtgcacgttagctgtattgaacctggactctttaaaaccaatcttgctgaccccgtgaaggtgatcgaaaagaaactggccatctgggagcaactttcccccgatattaagcaacagtatggagaaggttacatcgaaaagagcctagacaagctgaagggcaacaaaagctacgtgaatatggatctgtcgcctgtggtggagtgcatggaccacgcgttaacatcactgtttcccaagacacattatgcagccggaaaagacgctaagatcttttggattcctctgagtcacatgccggcagcattgcaggattttctacttctgaaacaaaaggccgagctggctaacccaaaagccgtctag

SEQ ID NO: 185106 - DNA, 960 bp, Artificial Sequence
  Description of Artificial Sequence: Synthetic coding sequence
atgctgttctgggtgctgggcctgctgatcctgtgcggcttcctgtggactcgcaagggcaagctcaagatcgaggatattaccgataaatacatcttcattaccggctgtgactctgggttcgggaatttagctgcgaggaccttcgataagaaaggatttcacgtcatcgccgcttgtctaactgagagcgggagtactgctttaaaagctgaaacctcagagcgactgagaactgtattgctggacgtgacagacccagaaaatgtaaagaggaccgcccagtgggtgaaaaaccaggtcggggagaaaggcttatgggggctcatcaataacgctggggtaccgggagttctcgcccccacagactggctgacgctggaagactacagggaaccaatcgaggtaaacttgtttggattgatttcagtgactctgaatatgctgcctctggtgaagaaggctcaggggcgcgtcattaacgtcagcagcgtcggcggaagacttgctatcgtggggggtggatatactccctcaaagtacgccgtcgagggcttcaatgactcacttagacgagatatgaaggccttcggagtccacgtgtcttgtatcgagcccggactgttcaagaccaaccttgcggatcccgtgaaggtgatcgaaaaaaagctggccatttgggagcagctctccccagacatcaaacagcagtacggggaagggtacatagagaaaagtctcgacaagctgaaaggtaataaatcctatgtgaatatggacttgtctcctgttgttgaatgcatggatcacgctcttaccagtctgtttcccaagacgcactatgctgcgggcaaggatgccaagatattttggattcctttgagtcacatgcccgccgcgctgcaagacttcctgctcctgaaacagaaggctgagctggccaaccccaaggccgtctag

SEQ ID NO: 185107 - DNA, 201 bp, Artificial Sequence
  Description of Artificial Sequence: Synthetic coding sequence
atgctgttctgggtgctgggcctgctgatcctgtgcggcttcctgtggacaaggaaggggaaactcaaaattgaagacatcacagacaaatacatcttcattaccgggtgcgattccgggttcgggaacctggctgcaagaacttttgacaaaaaaggttttcacgtgattgctgcctgcctgacagagtccggaagctag

SEQ ID NO: 185108 - DNA, 486 bp, Artificial Sequence
  Description of Artificial Sequence: Synthetic coding sequence
  Description of Combined DNA/RNA Molecule: Synthetic coding sequence
atgggcctgccccagcccggcctgtggctgaagcggctgtgggtgctgcttgaggtggctgtacatgtggtggtgggaaaggtgctgctgatcctgttccccgatcgggtcaagagaaatattctggcaatgggtgagaagacgggcatgacccgaaatccacacttttcacacgacaactggatacccacttttttcagcacccagtatttttggttcgttttaaaggtgagatggcagaggttggaggacaccaccgaactcggcgggctggcccctaattgccctgtggtgcgtcttagcgggcagcgatgtaatatttgggagtttatgcagggtaacagacccctggtgctgaactttggatcttgtactugaccatcgttcatgtttaagttcgaccagtttaagaggctgatcgaagatttttccagtatcgcagatttcctggtgatctatatagaggaagcacatgcctcaggttag

SEQ ID NO: 185109 - DNA, 750 bp, Artificial Sequence
  Description of Artificial Sequence: Synthetic coding sequence
  Description of Combined DNA/RNA Molecule: Synthetic coding sequence
atgggcctgccccagcccggcctgtggctgaagcggctgtgggtgctgctggaagtggctgttcacgtggtggttggtaaggtgctgctgatcctcttccccgatcgagttaagcgcaacatcttagcaatgggagaaaaaacaggcatgacacggaaccctcatttctctcacgacaattggattcccacgttctttagcacccagtacttctggtttgttttgaaggtgcgttggcaaagactggaggacaccactgagcttggaggcctggccccaaattgccccgtggtccgattgtctggccagcggtgtaacatatgggaattcatgcagggaaatcggcctctcgtgctcaactttggcagctgcactugacccagtttcatgttcaaattcgatcaatttaaaagactgattgaagacttctcatcaattgcagattttttagttatttacatcgaggaggctcatgcctcagatggatgggcctttaagaacaatatggacatccgcaaccaccagaacttgcaggaccgcctccaggccgctcacctgctcctcgccagaagtccccagtgtcccgtggtggtggatactatgcagaatcagtcttcacaattgtacgctgcccttcctgaacgcctgtacatcatccaggagggaaggattctgtacaaggggaaatccgggccatggaactacaaccctgaagaggtacgggcagtcctggaaaagttacactcttag

SEQ ID NO: 185110 - DNA, 606 bp, Artificial Sequence
  Description of Artificial Sequence: Synthetic coding sequence
atgggcctgccccagcccggcctgtggctgaagcggctgtgggtgctgcttgaagtagccgtccatgtcgtggttggaaaagttctactgatactgttccccgacagggtgaagcgaaacattctcgccatgggggagaagaccggcatgacccgcaaccctcacttttcgcacgataactggattccaacctttttttctacccagtatttctggttcgtgttgaaagtgaggtggcagaggcttgaggataccactgaactggggggactagcccctaactgtcccgtcgtcagactgtccggccagagatgcaatatctgggaattcatgcaggatggctgggcatttaagaacaacatggacattagaaaccatcagaacctgcaggatagactccaggcggcccacctgctcctggcaaggtctccccagtgtccagtcgttgtggatactatgcagaaccaaagttctcagctgtatgccgctctaccagagaggctgtacatcatccaagagggccggatactgtacaaggggaagtctggaccttggaattataatccagaggaagttagagctgtcttagagaaactgcactcatag

SEQ ID NO: 185111 - DNA, 363 bp, Artificial Sequence
  Description of Artificial Sequence: Synthetic coding sequence
atgttcaagttcgaccagttcaagcggctgatcgaggacttcagcagcattgcggatttcctggtgatctatattgaagaagcccacgcttccgatgggtgggcgttcaaaaacaacatggatatcaggaatcatcaaaatcttcaggaccggctgcaggccgcccacctgctactcgctcgcagtccccagtgccccgtcgtagttgatacaatgcagaatcagtcatcccaattatatgcggcgttgcccgagagactgtacattatacaggaggggcgcatcctgtataaggggaagtcgggtccatggaactacaatccggaggaggtgcgagcagtactggaaaaactccacagctag

SEQ ID NO: 185112 - DNA, 558 bp, Artificial Sequence
  Description of Artificial Sequence: Synthetic coding sequence
  Description of Combined DNA/RNA Molecule: Synthetic coding sequence
atgggcctgccccagcccggcctgtggctgaagcggctgtgggtgttactagaggttgcagtgcatgtggtcgtggggaaggtcctcttgattctgtttcccgatcgcgtcaaaaggaacattctcgccatgggcgaaaagactggaaatcgccccttggtcctcaattttgggagctgcaccugaccatctttcatgtttaagttcgaccaattcaaacggcttatcgaagacttttcttctatcgcggactttcttgtcatctatatcgaggaggcccatgcctccgacgggtgggctttcaaaaacaatatggacatccggaatcatcagaatttgcaggatcgactgcaggccgcccatctactattggccagaagcccccagtgtcctgttgtggtcgatacaatgcagaaccagtcttcccagttgtacgccgctttgcctgagcgactttacataatccaggaaggccgcattttatataagggcaaatcgggcccctggaactacaatcccgaggaggtacgcgccgtgttggaaaaactgcattcgtag

SEQ ID NO: 185113 - DNA, 342 bp, Artificial Sequence
  Description of Artificial Sequence: Synthetic coding sequence
atgggcctgccccagcccggcctgtggctgaagcggctgtgggtgctgttagaagttgcagttcacgtggtcgtcggcaaggtcctcctgatcctctttccagaccgcgtcaagcgcaacattttggccatgggagagaagactgggatgacacggaaccctcactttagtcatgacaactggatacctaccttctttagcacacaatacttttggttcgtgctgaaagtgcgatggcagcgccttgaggatacaactgaactgggtggcttagcaccgaactgcccggtggtgcggcttagtgggcagagatgcaacatctgggaatttatgcagggctag

SEQ ID NO: 185114 - DNA, 270 bp, Artificial Sequence
  Description of Artificial Sequence: Synthetic coding sequence
atgggcatcctgagcgtggacctgctgatcaccctgcagatcctgcccgtttttttcagcaattgcctgttccttgctctgtatgattccgtgattctcctcaaacatgtagtgttgctcctctcacgctccaaatctacccgcggcgaatggaggcggatgcttacttcagaaggcctacggtgcgtttggaaatcctttctgctcgacgcctataagcagttgaactgtccgcccagtggttttagtaaggatggtcatattttgtag

SEQ ID NO: 185115 - DNA, 399 bp, Artificial Sequence
  Description of Artificial Sequence: Synthetic coding sequence
atgggcatcctgagcgtggacctgctgatcaccctgcagatcctgcccgtgtttttctccaattgcctgtttctcgcgctctacgacagcgttatcttgcttaagcatgtagtgctgttactctcgagaagtaagagtacccgaggtgagtggcgcagaatgttaacgagcgagggcctgcgctgcgtgtggaagtcatttctacttgatgcctataaacaggtcaagcttggggaagacgcccccaattcctccgtagtccatgttagttcaaccgagggcggcgataatagtggtaacggtactcaggagaaaatcgctgagggcgccacatgtcatcttctggattttgcttctccagagagacctctggttgtgaatttcggcagcgccacctag

SEQ ID NO: 185116 - DNA, 822 bp, Artificial Sequence
  Description of Artificial Sequence: Synthetic coding sequence
  Description of Combined DNA/RNA Molecule: Synthetic coding sequence
atgggcatcctgagcgtggacctgctgatcaccctgcagatcctgcccgtattcttttcgaactgcctcttcctcgccctgtatgatagtgtgattctgctcaaacatgttgtgctactcctttctcggagcaagagtacacggggagaatggcgacgtatgctgacttcagaggggctcagatgcgtgtggaaatcctttttgctggatgcttacaagcaggtgaagcttggtgaggacgctcctaatagttccgtggtacacgtctcctcaaccgagggcggggataacagcggcaacggaactcaagaaaagatcgcagagggggccacctgccacctgctggactttgcctccccagagaggccacttgtggttaacttcgggtccgccacgugacctccttttaccagccagctgcctgcctttcgcaaacttgtcgaagaattctctagcgttgctgatttcctgttggtgtacatagatgaggctcacccctctgacggttgggcaatccccggagattcttctctctcctttgaggtaaaaaagcaccagaatcaagaggatcggtgtgctgctgcccagcagctactggaaaggttcagtcttcccccccaatgccgtgttgtggccgaccggatggacaataatgcaaatatcgcctatggcgtggccttcgaacgcgtctgtatagtgcagcgccagaaaatcgcctacctcggcggaaagggccctttctcttacaacctacaggaggtccgccattggctggaaaaaaacttctctaagaggugaaagaaaacaaggctggccggatag

SEQ ID NO: 185117 - DNA, 21 bp, Artificial Sequence
  Description of Artificial Sequence: Synthetic coding sequence
atgggcatcctgagcgtgtag

SEQ ID NO: 185118 - DNA, 21 bp, Artificial Sequence
  Description of Artificial Sequence: Synthetic coding sequence
atgggcatcctgagcgtgtag

SEQ ID NO: 185119 - DNA, 168 bp, Artificial Sequence
  Description of Artificial Sequence: Synthetic coding sequence
atgggcatcctgagcgtggacctgctgatcaccctgcagatcctgcccgtgttcttcagcaattgccttttccttgctctgtacgattccgtgattctgctaaaacacgtggtgcttcttctgagccgaagcaagtctacccgcggagagtggcggcgcatgctgtag

SEQ ID NO: 185120 - DNA, 930 bp, Artificial Sequence
  Description of Artificial Sequence: Synthetic coding sequence
  Description of Combined DNA/RNA Molecule: Synthetic coding sequence
atgggcatcctgagcgtggacctgctgatcaccctgcagatcctgccagtgttcttctccaactgtttatttctcgctttatatgattcggtgatcctcttaaagcacgtagtcttgctgctcagccgaagtaaatcaacccggggggaatggcggagaatgctcaccagcgaaggcctaagatgcgtctggaaatcattcctgcttgacgcgtataaacagttgaactgcccgccaagcggattttcaaaggacgggcacattctaugactcgtgtacgaggcctataagagcaggctgcttgtgtactcacatttagacctgtggatggtgaagttaggcgaggacgctccaaactctagtgtggtacatgtatcttccaccgagggaggagacaactccggcaacggaacccaagagaaaatcgcagagggtgccacctgtcacctcttagatttcgcctcccctgaaaggcccctggtggtgaatttcgggtcggccacaugaccaccttttacttcccagctacccgcatttcgcaaactggtggaagagttttcatctgtcgcggacttcctcctcgtctatattgatgaggcacacccctccgacggctgggccataccaggtgatagtagcttatccttcgaagtgaaaaagcaccagaaccaagaggacaggtgcgcagccgcacagcagctcttagaacggttttcactaccacctcagtgcagagtggtggccgacaggatggacaataacgctaacattgcatacggagtggcattcgagcgggtctgtatcgtgcagcggcagaagatcgcctatctggggggaaagggtccattctcctataatctgcaggaagtcagacattggctggagaaaaacttcagcaaacgtugaaagaagacccggttagccggttag

SEQ ID NO: 185121 - DNA, 822 bp, Artificial Sequence
  Description of Artificial Sequence: Synthetic coding sequence
  Description of Combined DNA/RNA Molecule: Synthetic coding sequence
atgggcatcctgagcgtggacctgctgatcaccctgcagatcctgcccgtgttcttcagcaattgtctgttcctagccctatacgacagcgtaatactattaaagcatgtcgtcctgctcctcagtagatcaaagtcaacgcgaggggagtggcgccggatgttgacgtcagagggactgagatgcgtatggaagagtttcctgctagatgcctataagcaggtgaaacttggcgaagacgctcctaatagctcagtggtgcacgtgtcctccaccgagggcggagacaacagcggaaatggtacccaggaaaaaatcgcagagggtgccacatgccacttgctggacttcgcatctcccgaaagaccactggtggtgaacttcggttcagcaaccugacccccttttaccagtcaactacccgcatttagaaagttagttgaggagtttagctctgtcgccgatttcctactggtttacatagacgaagcccacccctctgacggctgggctattccgggagactccagtctctcattcgaggtgaaaaagcaccagaatcaggaggatcgctgcgccgctgcacagcagctccttgaacgcttctcactgccaccacaatgccgagtggtggccgatcgaatggataacaacgccaatatcgcctatggtgtggcgtttgaaagggtttgcattgtgcagcggcaaaagatcgcctatctgggtggcaaaggacctttcagttataacctgcaagaagtccgccattggctggagaagaacttctccaaacgcugaaaaaagactcgcctagcagggtag

SEQ ID NO: 185122 - DNA, 915 bp, Artificial Sequence
  Description of Artificial Sequence: Synthetic coding sequence
  Description of Combined DNA/RNA Molecule: Synthetic coding sequence
atgccccggcaggccaccagccggctggtggtgggcgagggcgagggcagtcagggggccagtggcccagccgccaccatgctccgcagcctattgttgcattcattacggctttgcgcgcaaacagcttcctgcctcgtactcttcccaagattcttaggaaccgcattcatgctgtggctgctcgacttcctctgcattcggaagcatttcttgggccggcggcgacggggacagcctgagcctgaagtggaactgaactcagagggcgaggaggttcctcctgacgatccccccatctgcgtgagcgatgacaacaggctctgtactctggcaagtcttaaagccgtgtggcatggccagaaattagattttttcaagcaggcacatgaaggcggaccggcaccaaacagcgaggtggttctccctgacgggtttcaatcccaacacattctggattatgctcagggtaatcgccctctggtgctgaactttggctcctgcaccugaccgccattcatggcgaggatgagtgctttccagcgcttggtgactaagtaccagcgggacgtcgacttcttgattatctacattgaggaggcgcacccgtctgacggttgggtaacaactgacagtccatacattattccccaacatcggtccctggaggacagagtgagcgctgcccgggtgctccagcagggcgctcctggatgtgctctggtgttagatacaatggcaaatagtagtagttccgcctacggcgcatatttcgagagattgtatgtcatccaaagcggaactattatgtaccagggcgggaggggcccagacggataccaggttagcgagctgaggacctggttagagagatacgatgagcagttgcacggggctaggccccggcgggtatag

SEQ ID NO: 185123 - DNA, 1026 bp, Artificial Sequence
  Description of Artificial Sequence: Synthetic coding sequence
atgagcgccagcgcccccgccgccgagggcgagggcacccccacccagccggcttccgaaaaggagcccgagatgccggggccccgcgaggagagtgaggaagaggaggacgaggacgatgaagaagaagaggaagaagagaaggggaaaggacagaagctttgcgagatagagagaatccatttttttttgtcaaaaaagaagaccgacgagctgcggaacctgcataagcttctgtataaccgccctggaaccgtctcttccctgaagaagaacgtgggacagttttccggctttccattcgaaaaaggcagcgtccaatacaagaaaaaagaagaaatgctcaaaaagttccggaacgctatgttgaaatctatttgcgaggtgttggacttggaaagaagtggcgtcaacagtgagctggtcaagagaatcctaaatttcttaatgcaccccaaaccttccggaaagccactgcccaaaagcaagaaaacatgtagcaaggggtctaaaaaagagagaaactcaagcgggatggctagaaaggcaaaacgtacgaagtgtcccgaaattctgagtgacgagtcatcttcagacgaggatgagaaaaaaaacaaagaggaatcttcagacgatgaggacaaagaaagtgaagaagaacccccaaaaaagaccgctaagcgcgagaaacctaaacagaaagctacatctaaaagcaagaagtcagtgaagagtgcaaacgtaaaaaaggctgattccagtaccaccaaaaagaaccagaactcttctaaaaaagagtctgagtccgaggactcctcagatgacgagcccttgattaagaagctgaaaaagccgcccactgacgaggaactaaaggagactattaagaagctattagcctctgcgaatctggaggaagtaacgatgaaacagatctgtaagaaggtctacgagaattatcctacatacgacctgactgagcgtaaagatttcatcaaaactacagtcaaagaattaatttcatag

SEQ ID NO: 185124 - DNA, 1128 bp, Artificial Sequence
  Description of Artificial Sequence: Synthetic coding sequence
atgagcgccagcgcccccgccgccgagggcgagggcacccccacccaaccggcctcagaaaaagagcccgagatgccagggccccgggaagagtcagaggaggaagaggacgaggatgacgaagaggaggaggaagaggagaaagaaaaaagcctgatagtggaaggcaagcgggaaaaaaagaaagttgaacgccttacgatgcaggttagtagtcttcagagggagccgtttactatcgcacagggcaaaggacagaaattgtgcgagattgaaagaatacacttctttttgtccaaaaaaaagactgacgagctaagaaatctgcacaaactattgtacaatcggccaggcacagtgagctcactgaagaagaatgtaggccagtttagtggctttccgtttgagaaaggctcggtgcagtataagaaaaaagaggagatgctaaagaagttccgcaatgccatgctcaaaagcatctgcgaggttctggacctggagagatcaggcgtgaactccgaactggtaaaaagaattttaaactttctgatgcacccaaaaccatctggcaagccactcccgaaatcaaagaagacctgctccaaggggtccaagaaagagagaaattcaagcggaatggccaggaaggccaagcgcactaagtgtccagagattttgagcgatgaaagcagcagcgacgaggacgaaaagaagaataaggaagaaagctccgatgacgaggataaggagtccgaggaggaaccacccaagaaaacagctaaaagggagaagccgaaacagaaagccacttccaaaagcaagaagtcagtgaagtctgcgaacgtgaagaaggctgatagctccactactaagaagaaccaaaatagcagtaagaaggagtccgagagtgaagacagttccgacgatgaacccttaatcaagaagcttaagaagcccccaacggatgaggaattaaaggagacaatcaagaaattgttggcctctgcaaacttagaagaagtcacaatgaaacagatctgcaaaaaggtgtacgagaattacccaacatacgacctcaccgaacgcaaggactttataaaaaccacggttaaagagcttatctcatag

SEQ ID NO: 185125 - DNA, 1101 bp, Artificial Sequence
  Description of Artificial Sequence: Synthetic coding sequence
atgagcgccgccaaccccgagacccccaacagcaccatcagccgggaagcttccacccaatcctcatctgcagcagcaagccaggggtgggtcctgcccgagggcaaaatcgtgcctaacacagtgtttgttggcggcatcgacgcccggatggacgagaccgagattgggtcttgctttggccgatatggctccgtgaaagaagtgaagattattacaaacaggacaggggtgagcaagggatatggcttcgtgagttttgtaaatgatgtggacgtgcagaagatcgtggggagccagattcatttccacggaaaaaagctgaaactaggtcctgcgattcggaaacagaaactctgcgccaggcacgtccagccaagacccctcgtggtaaaccctccaccacccccgcagtttcagaatgtgtggagaaatcccaacactgagacatatttgcaaccccagatcacccccaatcccgtcacccaacacgttcaggcatactctgcatatccacactcaccaggacaggtcattacggggtgccagttgctggtgtacaactaccaggaatacccaacctaccccgactcggcattccaggttacaaccgggtaccaactgccagtctacaattaccaaccctttccagcctacccatcatctcccttccaggtgacggcaggctaccagctcccagtctacaactaccaagccttccctgcataccctagcagcccttttcaggtcacaaccgggtaccagttgcctgtgtacaactatcaggctttccctgcatatccttcttcccccttccaggttacaacgggataccagctgccagtctacaactaccaggcctttccggcatatcctagcagtccctttcaggttaccacagggtatcagctgccagtctataattatcaggcattccctgcctaccctaatagcgcggtgcaagtgacaaccggctatcagttccacgtttataattaccagatgcccccccagtgtccagtgggtgaacagcgtcgcaacctgtggacggaagcatacaagtggtggtacctggtgtgcctaatccaacgtagagactag

SEQ ID NO: 185126 - DNA, 1605 bp, Artificial Sequence
  Description of Artificial Sequence: Synthetic coding sequence
atgagcgccgccaaccccgagacccccaacagcaccatcagccgggaggcgtcgactcagagttcaagcgccgccgcttcccaagggtgggtcctgcccgagggaaagatagtgcccaacaccgtcttcgtaggtgggattgacgcccgaatggacgagacagagatcgggtcctgtttcgggcgatacggttcagtcaaagaggtgaaaatcatcacaaataggacgggtgtttccaaggggtatggctttgtctcttttgtcaacgacgttgatgttcagaagatcgtcggcagtcagatccactttcatggaaaaaagctcaaactggggccagcaatccgaaaacagaaactttgcgctcggcatgttcagcctcgccctctggtcgtgaaccctccccctccaccccagtttcagaacgtgtggaggaaccctaataccgaaacgtacctccaaccccagatcacccctaatcctgtgactcagcacgtgcaggcttacagtgcctacccacactctccaggccaagtgattacgggttgccagctgctggtatataactatcaggaatatccaacttacccagactccgcttttcaagtgactaccggttatcaactccccgtttacaactaccaaccatttccggcctaccccagatccccctttcaggtgaccgccggctatcagcttccagtttataattatcaggctttcccagcctatccgaacagcccctttcaggtagctacagggtaccagtttcctgtttataactatcagccctttccggcatacccttctagcccctttcaggtaacagccggttaccagctacccgtatacaactaccaggctttccctgcctatcccaacagtcccttccaggtcgcaacaggttaccagttcccagtgtacaactatcaggccttcccggcgtaccctaattccccagttcaagtgaccactggttatcagcttccagtgtataattaccaggctttccctgcatacccatcttctcctttccaggttacaaccggctaccaactgccagtgtacaactaccaggcctttcccgcctacccgtcatccccatttcaagtgaccacagggtaccagttgcctgtgtataattaccaagcttttcccgcttacccatctagcccctttcaggtgactaccgggtaccaactgcccgtctataattaccaggcattccccgcttacccctccagtcctttccaggtgaccacagggtatcagctacccgtctacaactatcaggcatttcctgcctaccctagttcccctttccaggttacaaccgggtaccagctgcctgtgtataactaccaggcctttccagcatatccctccagtcctttccaggtgactacggggtaccaactgcctgtgtacaattaccaggcttttcctgcctacccaaatagtgctgttcaggtcactacagggtaccagttccatgtctacaactaccagatgcccccccagtgccctgtcggcgagcaacgtagaaatctttggacagaggcatacaaatggtggtacttggtgtgtctcatccagcggcgcgactag

SEQ ID NO: 185127 - DNA, 1821 bp, Artificial Sequence
  Description of Artificial Sequence: Synthetic coding sequence
atgagcgccgccaaccccgagacccccaacagcaccatcagccgggaggcctcaactcaatcctctagcgccgcggcttcgcaaggatgggtgctgccagagggaaagattgttcctaatacggtgttcgtgggcggcatcgacgcaaggatggacgaaaccgaaattggtagctgtttcgggagatatggttctgtgaaggaggtcaaaatcattactaacagaaccggagtgtccaaaggctatggtttcgtgagcttcgtaaacgatgtggacgtgcagaaaatcgtgggcagccagattcattttcacggcaaaaaactgaagctcggcccagccattagaaaacagaaactgtgcgccagacacgtgcagccgcggcctctggtggttaacccaccaccgccacctcagttccagaacgtctggcgaaacccgaataccgagacctatctgcagcctcagattacacctaaccccgtcacccaacacgttcaagcttattcagcctaccctcacagtcccggtcaggtcattaccggctgtcagctgttggtgtataattaccaagagtatccaacctatcccgactcagcctttcaggtaaccaccggctatcagcttccagtgtacaactaccagccattccccgcctatcccaggtccccctttcaggtgacagctggataccagctgcccgtgtacaactatcaggcctttccagcttatcccaactcgcctttccaggttgcgacagggtaccagtttccggtgtacaactatcagccttttcctgcgtatccctctagtcctttccaagtaactgctggttaccagctgccagtctataattaccaggcattcccagcctaccctaacagtccctttcaggtggccaccggttatcagttcccggtctacaactatcagccgtttccagcttatcccagctccccgttccaggtgacggcaggttatcagctgcccgtctataactaccaagcttttcccgcatacccgaattcacccttccaagtagccaccgggtatcagtttccagtctacaactaccaggcgtttcccgcctacccaaactctccagtgcaggtcacaactgggtaccaactgccagtctataattaccaggctttccccgcataccctaattcacctgtccaggtgactacagggtaccagctgcctgtctataactatcaagcgttccctgcttacccttcttcccctttccaggtcacaaccgggtaccaacttcccgtttataattatcaggccttccccgcgtacccaagcagcccatttcaagttacaactgggtatcaactgcccgtctataactaccaggccttcccggcttacccttcatccccattccaggttactaccggctaccagctgcctgtgtataactatcaagcatttcccgcctatccctcctctccctttcaagtgacaaccggttatcaactccctgtgtacaattatcaggcttttccagcctatccttccagcccttttcaagttaccacagggtatcagctacctgtttacaattaccaggcattcccagcctacccaagctcaccgtttcaggtgaccaccggataccaactgccggtgtacaactatcaggcttttcccgcataccctaatagcgccgtgcaggtgacgacaggataccagttccatgtctataattatcagatgcctccccagtgtccagtgggtgaacaaagacgcaatctgtggacagaggcatacaagtggtggtacctggtgtgcctgatacagaggagagactag

SEQ ID NO: 185128 - DNA, 1461 bp, Artificial Sequence
  Description of Artificial Sequence: Synthetic coding sequence
atgagcgccgccaaccccgagacccccaacagcaccatcagccgggaagcatccactcagagtagtagcgccgccgcaagccaggggtgggtattgcctgaaggcaagatcgtgccaaacaccgttttcgtgggaggaattgacgctagaatggatgagacagagatcgggagctgcttcggaaggtacggcagcgtgaaagaggtgaagattattacgaatcgcaccggggtgtcgaagggctacggtttcgtctcttttgtcaatgatgttgacgtgcagaaaatcgtaggctcccagatccactttcatggaaagaagctaaagctggggccggcaataagaaaacagaagttatgtgcccgacacgtacagcctcgcccactagtggtgaaccctcccccgccccctcagtttcagaatgtgtggagaaaccctaacaccgagacttacctacagccacagattacgcctaatccagtgacccagcatgtccaggcttactctgcatatcctcactctcccggccaggtaataaccggatgtcagctacttgtgtacaactaccaggagtatcctacttatccagattcagccttccaagtcactactggttatcagttgcccgtctacaattaccagccttttcccgcttacccccgcagccccttccaagtgacagctggctatcaactcccagtgtacaattaccaggccttccctgcttaccccaacagcccatttcaggttgctactgggtatcagttccccgtgtataactatcagccttttcctgcctaccctagcagtccatttcaagtaacagcgggataccagttgcctgtttacaattaccaggcattcccagcttaccccaacagcccattccaagttgcaaccggctaccaattcccagtctataattaccagccattcccagcctacccgtcctcaccatttcaagtgacagccggatatcagttgcccgtctacaactatcaggcattcccggcctatcccaattcaccttttcaggtggccaccggttatcagtttcccgtgtacaattaccaggcctttcccgcttaccccaacagccctgttcaggttacgaccggttaccagctgcccgtgtacaattatcaggcattccccgcttaccctaactctccctttcaggtggcgacggggtaccagttccccgtgtacaactaccaggcctttcctgcatacccgaactcacctgtgcaggtcacaactggctaccagttgccggtttacaactaccaggcattccccgcgtatcctaattctgccgtccaagtcaccactggttatcaatttcacgtttataactaccagatgccaccacagtgtcccgtcggggaacaacgtagaaacctttggacagaggcgtacaagtggtggtatctggtatgtcttatacagaggcgggactag

SEQ ID NO: 185129 - DNA, 1677 bp, Artificial Sequence
  Description of Artificial Sequence: Synthetic coding sequence
atgagcgccgccaaccccgagacccccaacagcaccatcagccgggaggctagcacccaatctagctcagccgctgcctcgcagggatgggttctgcccgaggggaaaatcgtgccgaacacagtcttcgtgggaggcattgacgccagaatggatgagaccgaaattggatcgtgttttggccgatacggtagtgtgaaagaggtaaagattatcacaaaccgtaccggggtctcaaagggctacggattcgttagtttcgttaatgacgtggatgtccagaaaatcgtcggatcccaaatacattttcacggcaagaagctcaaattaggccccgcgatccggaagcaaaagctgtgcgctcggcacgtgcagcccagaccacttgttgtgaacccccccccgcccccccaattccagaacgtgtggaggaatcccaacacagagacttatctgcagcctcagatcacgcccaatcccgtcacacaacacgtgcaggcatactctgcctacccccattcaccgggccaggtgataacggggtgccagctgttggtctacaactaccaggagtatccaacctacccggatagcgcgtttcaggtcaccacaggttaccagctcccagtgtacaattatcaaccattcccagcctatccgcggtcacccttccaggtaaccgctggttaccagctgccggtttacaactaccaggcattccctgcttatcccaatagtccatttcaggtggctacaggataccagttccctgtctacaattaccagccctttccggcgtacccatccagcccattccaggtaacagcagggtatcagttacctgtgtacaactaccaggcatttcccgcataccccaactccccatttcaagtggccactggctatcagttccctgtgtacaattaccaggcattccctgcctatccgaactcccctgttcaggtgaccactgggtaccagctccccgtgtataattaccaggcgttccctgcttaccctaacagtccagtacaggtgacaacaggatatcagttaccagtgtacaactaccaggcattccctgcatacccttcttccccttttcaggtcacaacgggctatcagctgcctgtctacaactatcaggcgtttcctgcttatccctcgtctcccttccaagttacaaccggataccagctacctgtgtacaattatcaggccttcccagcataccctagtagcccctttcaggtgactacaggataccagctgcctgtctataattatcaggcatttccggcttatccgagctccccctttcaagtgacaacaggctaccagctacctgtctacaactaccaagccttccctgcctatccaagcagcccctttcaggtgacaaccggctaccagctcccagtgtacaactatcaggctttccccgcctacccaagctccccattccaagtcactactggatatcagctgcccgtttataattatcaggccttcccggcatacccaaacagtgccgtccaagtgactactggatatcaatttcatgtttataactaccaaatgcctcctcagtgccccgtgggggagcagcggcgcaatctgtggactgaggcgtacaagtggtggtacctggtgtgcctaatccagcgtagagattag

SEQ ID NO: 185130 - DNA, 1086 bp, Artificial Sequence
  Description of Artificial Sequence: Synthetic coding sequence
atgagcgccgccaaccccgagacccccaacagcaccatcagccgggaggcctccacccagtcatcctctgctgcagcatcacagggatgggtcctgccagaaggaaagatcgttccaaataccgtgttcgtgggcggcatcgacgcccgcatggatgaaacagagatcggtagctgcttcggtcgatacgggagcgtgaaggaggtgaagatcattacaaatcgtactggagtgtcgaaaggctatgggtttgttagctttgttaacgacgttgatgtgcaaaagatcgtagggtcacagatccacttccatgggaagaagctgaagttgggtccggcaattaggaaacagaagctttgcgctagacacgtgcagccaagaccccttgtggtgaatccgcctccacctccccagttccagaatgtctggaggaatccaaacaccgaaacctatttgcagccacagattacaccgaacccagttactcagcacgtacaggcctactcagcgtatcctcacagccccggacaggtaatcacaggctgccaattgctcgtgtataactatcaggagtatcctacctaccccgactccgcctttcaggtgaccaccgggtatcagctccctgtatataactaccaaccatttcctgcatatccacggtcccctttccaagtgacggcaggataccaactgcctgtctataactaccaggccttcccagcatacccaaacagtccatttcaagtcgcgaccggatatcaattcccagtttacaattaccagccattcccagcctatccctcctctccattccaggtgaccgctggttaccagctccccgtgtataactatcaagctttccccgcatacccgaactccccgtttcaggttgctaccggctatcagttccccgtctacaactatcaagcgttcccagcctatccgaattcccccttccaggtggcaactggctaccagttccccgtctataattaccaggcttttcccgcttacccaaactctcccgtgcaggtcacgactggataccaactccctgtgtacaactatcagatgcccccatag

SEQ ID NO: 185131 - DNA, 1965 bp, Artificial Sequence
  Description of Artificial Sequence: Synthetic coding sequence
atgagcgccgccaaccccgagacccccaacagcaccatcagccgggaggctagtactcaaagctccagcgcagccgcatcacaaggctgggtgctacccgagggaaagatcgtgcccaacaccgttttcgtcgggggcattgacgcaaggatggacgaaactgaaattggtagttgctttggcagatacggcagtgtaaaagaggtgaaaatcatcactaaccggacaggggttagtaagggttacgggttcgtgtcgtttgtgaacgacgtggatgttcagaagattgtggggtctcagattcattttcatgggaagaagctcaaattgggacccgcgatcagaaagcagaagctttgtgctagacacgtgcaacctcgccccctggtagtaaatcccccacctccgccacagtttcaaaacgtttggagaaaccccaatacagaaacgtacctccagccccagatcacccccaaccctgtcacccaacatgtgcaggcctacagtgcttacccacacagccctgggcaggttattacaggatgccaactgctggtatataactaccaggagtacccaacctacccagactcagcgtttcaggtgaccaccggatatcagctcccggtttacaactatcagccctttccagcttaccctaggagcccgtttcaagtgacagccgggtatcagctcccagtgtacaattaccaagcatttcccgcttatcccaactcaccgttccaggttgctacaggctatcaattccctgtctataactaccagccattccccgcttaccctagctctcccttccaggtgaccgccgggtatcagctgccagtttacaattatcaagcattccctgcctatcccaacagtccttttcaggtggcaacaggctaccaatttccagtttacaactaccaaccatttcccgcatacccttccagcccatttcaggtgaccgctggctaccagctgcccgtgtacaattatcaggcattccctgcatatcccaactccccatttcaggtagccactggataccagtttcccgtttacaactatcaggccttccctgcttatccaaactccccggtgcaggttaccactggttaccagctgcctgtttacaattaccagcccttccctgcataccccagaagccccttccaggtcacagccggttatcaactcccagtctataattatcaggctttcccagcatatccaaactctccttttcaggtcgccacaggctaccagttccctgtttataactatcaggcattccctgcctatcccaactcgccggtgcaggtcactactggctatcagttaccagtatacaactaccaggcattccctgcttatccgtcttcacccttccaggtgactaccgggtatcagttacccgtgtataactatcaggcatttcctgcctacccctccagtccatttcaggtgaccaccggctaccaactgccggtgtacaactatcaggcctttcccgcatatcccagctcccccttccaagtgaccacagggtatcagctgcctgtgtataattatcaggcctttccggcctacccatcctccccttttcaggttacaactggataccaattgcctgtgtataactatcaagctttcccagcttacccgagctcgcctttccaagtgacaaccggctatcagttgccagtctataactaccaggcgttccctgcctatccctctagccctttccaggtcaccacgggataccagctgcccgtctataactaccaggcctttcccgcttaccccaactcagcagtccaggtcaccacgggctaccagttccacgtttacaactatcagatgcctcctcagtgccctgtgggtgaacagagacgaaatctgtggacggaggcctacaagtggtggtacctcgtctgcctaatccaacgccgtgattag

SEQ ID NO: 185132 - DNA, 1605 bp, Artificial Sequence
  Description of Artificial Sequence: Synthetic coding sequence
atgagcgccgccaaccccgagacccccaacagcaccatcagccgggaggcttcaacgcagtcctcttctgcagccgcttcccagggctgggtacttcctgaaggtaagatcgtgcctaatacggtgtttgtcggcggtattgatgctcggatggacgagaccgagatcggatcctgttttgggcgatacggttccgtgaaggaagtgaagatcattacaaaccgcaccggggttagcaagggttatggattcgtcagctttgtaaacgacgttgatgtccagaaaatcgtggggagccagattcactttcacggcaaaaaactcaagctggggcccgccatccgtaagcagaagctttgcgcaaggcatgtgcaacccaggcccttagttgtgaatccccctccaccaccacagttccagaatgtgtggcggaaccctaacactgaaacgtatcttcagccacagatcactccaaacccagtcacgcagcatgtccaggcctattccgcatatcctcactcaccaggccaagtgattacggggtgccagctcctcgtatataactaccaggagtaccccacctaccctgacagtgcttttcaggtcactaccgggtaccagcttcccgtgtacaattatcagcctttccctgcttatcctcggtcaccgtttcaggtgaccgctggatatcagctacctgtctataactaccaagcttttcccgcttacccgaactcaccctttcaagtggccacaggctaccaattcccagtttacaactatcagcccttcccagcctatcctagttctcccttccaggttaccgcaggttaccagctaccagtttataactaccaggcctttcccgcctaccccaattctccgttccaggtggccaccgggtaccaatttcctgtttataactaccaggccttccctgcctacccaaattctccagtgcaggtgacaacaggttatcagctccccgtgtacaattaccaggccttcccagcatacccatcttccccctttcaggtgaccaccggctaccagttacctgtgtacaactaccaggcgtttccggcttacccctcatctcctttccaggtcaccactggctaccagctcccggtctataactaccaggcatttccagcctacccctctagccctttccaggtgaccacaggctaccagttgcccgtgtataattatcaggcattccccgcctacccttcctccccttttcaagtaaccaccggatatcaattgccagtctacaattaccaagcttttccagcttacccgtcatcacctttccaagtgacaaccgggtatcagcttccagtttacaattaccaagcctttccggcataccctagcagcccttttcaggtaaccactggctaccagttgcctgtctacaactaccaagccttccccgcctaccctaacagtgcggtacaggttaccaccggataccagttccatgtctataactatcaaatgccccctcagtgcccagtcggagaacaaagaagaaacctctggaccgaggcctacaaatggtggtacttggtctgtttgatccaacgccgcgattag

SEQ ID NO: 185133 - DNA, 1317 bp, Artificial Sequence
  Description of Artificial Sequence: Synthetic coding sequence
atgagcgccgccaaccccgagacccccaacagcaccatcagccgggaagctagtacgcaatcctcttccgccgccgcttcccagggatgggtgctgcccgagggcaagatagtccctaatacagtctttgtcggtgggatcgatgcacggatggatgagaccgagatcggttcctgcttcggccgctatggaagcgtgaaagaggttaagattatcacgaatagaacgggtgtttcgaaaggttacggttttgtgagtttcgtgaatgatgtggacgtgcagaaaattgtgggctctcagatacatttccatggcaagaaactcaaattgggtcccgctatccgcaagcagaaactctgcgccagacatgtccagcctcgtccactcgtcgtgaatcctccaccacctccgcagttccagaatgtatggcggaatccaaatacagaaacctacctacagccccaaatcacgcccaatcccgtcacacaacacgttcaggcctatagcgcgtacccacactcccctggacaggtgatcacaggatgccagctgctggtgtacaattaccaagaatatcccacctaccccgatagcgctttccaggttactactggctatcagctccctgtgtataactatcaacccttcccagcctaccctcgctccccatttcaagtgaccgccggttaccaattgcccgtgtacaactaccaggcctttcccgcgtaccccaactcaccttttcaggtggcgaccggctaccagttcccggtttataactatcaggccttccccgcgtatccaaattcaccctttcaggtcgcaacaggctatcaatttcccgtctacaactaccaagcattcccggcatacccaaacagcccatttcaggtggccacaggataccaatttcccgtctataactaccaagcctttccagcttacccaaattcacccgtccaggtcaccactggctatcaattgcctgtgtacaattatcaggcctttcccgcctacccaaacagtcccttccaagttgccaccggttaccagttccctgtttacaattatcaggccttccccgcctatccaaactctcctgtccaggtgactacaggttaccagctgcccgtttacaattatcaggcattcccagcatacccgaactctgccgttcaggtgacgaccggctaccaatttcacgtctacaattaccaaatgcctccccagtgcccagtgggcgaacaacgaagaaacctttggaccgaggcatacaagtggtggtatctcgtatgtttgatccagagaagagactag

SEQ ID NO: 185134 - DNA, 1173 bp, Artificial Sequence
  Description of Artificial Sequence: Synthetic coding sequence
atgagcgccgccaaccccgagacccccaacagcaccatcagccgggaagctagtacccaaagtagctcagctgctgccagccagggctgggtgcttccggaggggaagattgtaccgaatactgtgttcgtggggggcatagatgcccggatggacgaaaccgagatcggcagttgcttcggcaggtacggaagtgtcaaggaggtcaaaattattactaacaggactggagtgtccaaaggttacggttttgtgtcattcgtgaatgatgttgatgtacagaagattgtgggcagccagatccacttccacggtaagaaattgaagttgggcccagctatacgtaaacagaaactgtgtgcaagacacgtgcagccacgtcctctggtagtgaaccccccaccccctcctcaattccagaacgtgtggcgcaaccccaatacagagacttacttacagcctcaaatcaccccaaacccagtgacgcagcacgtgcaggcttattccgcttacccacattcccctgggcaggtgataaccggctgccagctgcttgtctacaactatcaagaatacccaacatatccggattccgcattccaagtcaccactggctaccagctccctgtgtataactaccagccatttcccgcttacccgagaagtcccttccaggtcaccgcgggctatcagttgccagtgtacaactatcaggcctttcctgcgtatcccaatagccccttccaagttgccacagggtaccagtttccagtgtacaattaccaaccattcccggcgtacccatcaagcccttttcaggttacagcgggctaccagctacccgtctataattaccaagctttcccagcctaccctaattccccattccaggtggcaacagggtaccagttccccgtttacaattatcaggccttcccagcctatccaaatagccctgttcaggtaaccacgggatatcagctgccagtatataattaccaggccttccctgcctatcccaactcggctgttcaagtgacaacagggtaccaatttcatgtttacaactaccagatgccaccccagtgtcctgtgggagagcagaggagaaacctctggaccgaagcctacaagtggtggtatctggtgtgtctaattcagcgaagagactag

SEQ ID NO: 185135 - DNA, 1746 bp, Artificial Sequence
  Description of Artificial Sequence: Synthetic coding sequence
atgatggacgagaccgagatcggcagctgcttcggccggtacggcagcgtgaaggaggttaaaatcataacaaaccgaacaggcgtttcaaaagggtatggctttgtgagctttgtcaatgacgtcgatgtgcaaaagattgttggatcacaaatccattttcatggcaaaaagttgaaattggggccggctatacggaagcagaagctctgtgcacgccatgtccagccaaggcccctcgtcgtcaatccccccccaccgcctcagtttcaaaacgtgtggcgcaatcctaataccgaaacatatttgcagcctcagataacccctaacccagttacacagcatgtgcaagcatacagtgcctacccccattctccaggacaggtcattacaggatgtcagctcctagtgtataattaccaagagtatcccacctaccctgacagcgcttttcaggtgaccactggctaccagctgccagtttacaattaccaacccttcccagcctaccctagatccccctttcaggtcacagctgggtaccagctgcccgtgtacaattatcaggcatttcccgcataccccaacagccccttccaggtggcaactggctaccagttcccagtgtacaactaccagccctttcctgcctacccctccagcccattccaggtgactgctgggtaccagttgcctgtttacaactatcaggcttttcccgcctatcctaattctccattccaagtggctaccggctaccagttccccgtgtataactaccaggccttccccgcataccctaactcacctttccaggttgccaccggataccagttcccagtgtacaactaccaggcattcccagcttatcccaacagcccagtgcaggtgaccaccggataccaattacctgtttacaactaccagccctttcctgcatatccacggtccccatttcaagtgaccgccggttatcagctgcctgtgtacaattatcaagcgttccctgcctaccctaactcaccctttcaagtcgccaccggataccagtttccagtatacaactaccaggcattccccgcctaccctaacagcccggtacaagtcaccactggttatcaactcccagtttacaactaccaggcgtttccagcctacccttcaagtccatttcaagtgacaaccgggtaccagctgcctgtttacaattaccaggcattccctgcctacccctcaagcccttttcaggtgacaacaggctatcagcttcctgtttacaattatcaggcttttccagcatacccatcatctcctttccaagttacaacaggatatcaactgccagtgtacaactatcaggcctttcctgcgtatccctccagtcccttccaagtgactacagggtaccagcttcctgtgtacaattatcaggcgtttccagcttacccgtcaagtccttttcaggtgactacaggctatcagctgccagtgtataactatcaggcgttccctgcctacccctcatctcctttccaagtgactactggttatcagcttcccgtctacaactaccaagccttccctgcctatccgaacagcgctgtgcaggtaaccaccggataccagtttcacgtgtataattaccagatgccaccccagtgcccagtgggcgagcaacgccgtaacctctggactgaggcatacaagtggtggtacctggtttgtctgatccagaggagggattag

SEQ ID NO: 185136 - DNA, 1014 bp, Artificial Sequence
  Description of Artificial Sequence: Synthetic coding sequence
atgagcgccgccaaccccgagacccccaacagcaccatcagccgggaggcatcaacccaaagtagttctgctgccgcctcccaaggttgggtcctgcccgagggcaagattgttcccaacactgtattcgtgggcgggatagacgccagaatggacgaaaccgaaatcgggagctgcttcggaagatacggcagcgtcaaggaggtcaaaatcattaccaataggacaggcgtgtcaaaaggttatggctttgtgagtttcgtgaatgatgtcgacgttcagaaaatcgtcggttcccaaatccatttccacggtaagaagctgaaactcgggcccgccatacgaaagcagaagctatgcgcgaggcatgtgcagcccaggccgttggtggtgaatcccccccccccccctcaattccagaatgtctggcgaaatcctaatacagagacctacctgcaaccgcagattactcccaatccagtcacgcagcatgttcaggcctatagcgcatatccgcattcacccggccaagttatcactggttgtcaactactggtgtataattatcaggagtaccctacttatcccgatagcgcattccaggtgaccacaggctatcaactcccggtttacaactatcagccttttcccgcttatccacgatccccatttcaagtcacagcaggctaccaactccccgtatacaactaccaggcttttcccgcttaccctaattcaccctttcaagtggctacaggctatcagttccccgtgtacaattaccaggctttccccgcttacccaaacagccccgtgcaggtgaccactggataccagctgcctgtctacaactaccaggcattcccagcctatcccaactctcccttccaggtagccacaggataccaatttccagtgtacaattaccaggcctttcctgcgtatccaaactcacctgttcaggtaaccactggttatcagctccccgtgtataattaccagatgccaccatag

SEQ ID NO: 185137 - DNA, 1101 bp, Artificial Sequence
  Description of Artificial Sequence: Synthetic coding sequence
atgagcgccgccaaccccgagacccccaacagcaccatcagccgggaggcctcaacccaaagttcatcagctgccgcatcacagggatgggttctcccagagggtaagatcgtgcctaataccgtgttcgtgggaggaattgatgccaggatggacgagacagaaattggttcttgttttggacgatatggctccgtgaaagaggtgaagattataacaaacaggacgggtgtttctaagggctacggattcgtgtcatttgtaaatgacgttgatgtgcaaaaaatcgtgggctcccaaattcacttccatggtaagaagctgaagctcggtcctgccataaggaaacagaaattgtgtgcgaggcatgtccagccacgccctctggtggtgaatccccccccacccccccagtttcagaatgtgtggagaaaccccaatacagaaacatacctgcaaccccagattacccctaacccggtgacccagcacgttcaagcttattcagcctatcctcattccccggggcaggtaattactggttgtcagcttctagtgtataattaccaggagtatcctacctaccctgactctgctttccaagtcactacaggctaccagctgccagtctacaattaccagcccttcccagcctaccccagaagtccatttcaggtgactgctgggtaccagttaccggtgtacaactaccaggcttttcccgcctatccaaactctccagtgcaggtgactactggctatcagctgcctgtgtacaattaccaggcttttcccgcctaccctaatagccccgtgcaggtcaccaccggatatcagttgccagtttataactaccaagctttccctgcctatcccaatagccccgttcaggtaacaacaggctatcagctgcctgtgtataattaccaggcttttcccgcctaccccaactctgctgtgcaggttacaacaggctaccaattccacgtctataattaccaaatgccaccccagtgtccggtcggggagcagcgacgcaatctctggaccgaggcctacaagtggtggtacctggtgtgcctgatccaaaggcgtgattag

SEQ ID NO: 185138 - DNA, 1317 bp, Artificial Sequence
  Description of Artificial Sequence: Synthetic coding sequence
atgagcgccgccaaccccgagacccccaacagcaccatcagccgggaagccagcactcagtcgagctctgctgccgcttctcaggggtgggttctgccagaggggaagatcgtgcctaacacagtgttcgtgggagggatagatgcgagaatggatgaaacagaaatcggttcctgttttggtcgctacggctctgtaaaggaggtcaaaatcattactaaccgcaccggagtctcgaaagggtacgggttcgtgagcttcgtcaacgacgttgacgtgcagaagatcgttgggtctcaaattcattttcatggcaaaaaactgaagctggggcctgcgatcaggaagcagaaactgtgtgcccggcatgttcagcctcggccgttagttgtgaatcctccccctccccctcaattccaaaacgtgtggaggaatcccaatactgagacatacttacagcctcagattaccccaaaccccgtcacacaacacgttcaggcttactccgcctacccacacagcccaggccaggtgatcactggttgccagttgctggtgtataactatcaggaatatcctacatacccagacagtgcttttcaggttactaccggttaccagcttccggtgtataactaccagcccttccctgcatatcccaggtcgccatttcaggtaacggccggttatcaattacccgtctataactaccaggcatttcctgcttacccgaatagcccatttcaagtggcaacaggatatcagtttcccgtgtacaactatcaggccttccccgcttatccaaattccccggtacaggttaccaccggctaccagttacccgtctataactaccaggctttcccagcgtatcccaatagccccttccaggtggcgacgggttatcagtttccagtctataactaccaggcctttccagcttacccgaattcccctgtccaggtgacgacaggctaccagctgcctgtgtataattaccaggcttttccagcctaccccaactcaccttttcaagtagccaccggataccaattccctgtgtacaattaccaggcgtttccagcctatcctaatagcccagtgcaagtcacaaccggctatcaactgccagtttacaattatcaggcttttcctgcctaccccaatagtgccgttcaggtgacgacaggataccagtttcacgtctacaactatcaaatgcctccacagtgccccgtgggcgagcagcgtcgcaacctgtggacggaggcgtacaaatggtggtatctggtttgccttattcagaggcgagactag

SEQ ID NO: 185139 - DNA, 1086 bp, Artificial Sequence
  Description of Artificial Sequence: Synthetic coding sequence
atgagcgccgccaaccccgagacccccaacagcaccatcagccgggaggcctccactcagtcaagttctgcggcagcgagccagggctgggtgctgcccgagggcaaaatagtgcccaataccgtatttgttggtggaatcgacgctcgtatggatgagactgaaataggctcctgctttggtagatatggctccgtgaaggaagtgaagattatcaccaatcggacgggcgtaagcaagggttacgggtttgtttcctttgtaaacgatgtagatgtgcagaagatcgttggctctcagatccattttcacggcaagaagcttaagcttggccccgctattcgcaagcagaagctgtgtgcacgccacgttcaaccccgccctttagtggtaaacccccctcctccaccccagttccagaatgtatggcgaaatcccaacacagaaacctacctgcaacctcagataacccccaatcccgtcacccaacacgttcaggcttactccgcttacccacatagtccaggacaggtcattaccggttgccagctcctcgtttacaactatcaagagtaccctacataccccgactcagcattccaggtgacaactgggtatcaattgccagtgtacaactaccaaccttttccagcatacccccgatccccattccaagtcaccgccgggtaccagctgccggtgtataattaccaggccttccctgcctaccctaactcaccatttcaggtggccaccggttatcaatttccagtgtataattaccaggcatttccagcatatccaaactcgcccgtccaggtgacgaccggttatcagcttccggtgtataattaccaggccttccctgcctatcccaacagcccctttcaggtggctacgggctaccaattccccgtctacaactatcaggcattcccagcctaccctaactcacctgttcaggtgaccaccggatatcaactccctgtgtataactaccaggccttccccgcttatccaaactctcctgtacaagtgaccacaggctatcaactccctgtgtacaattatcaaatgccgccttag

SEQ ID NO: 185140 - DNA, 1173 bp, Artificial Sequence
  Description of Artificial Sequence: Synthetic coding sequence
atgagcgccgccaaccccgagacccccaacagcaccatcagccgggaggcaagcacccaatcttcatctgcggccgcttcccaaggctgggtgctcccagaagggaaaattgttccaaatacagtattcgtcggcggaattgatgccaggatggacgaaaccgaaataggatcctgtttcgggcggtatgggtctgtgaaggaagtgaagatcatcactaaccgcaccggagtgtccaagggatacggcttcgtaagctttgtgaatgatgtggatgttcagaagattgtcggtagtcagattcacttccatggcaagaaattgaaattaggacctgcgattcgcaaacaaaagctctgtgcccgccacgtacagccccgaccactggtcgtcaaccctcctccacccccgcagttccagaacgtttggaggaacccaaacactgagacatacctgcaacctcagatcacccccaacccggtgactcaacacgttcaggcctacagcgcttatcctcattcgccaggccaggtgatcaccggctgtcaacttctagtctataactaccaagaatatcctacctaccctgacagcgctttccaggttaccactgggtatcagctgccagtgtacaattaccagccatttcctgcctaccctcggtccccgttccaggtaacagccggataccagctgcccgtgtacaattaccaggcgttccccgcttatccaaatagccccttccaggtcgccaccggctaccagttccctgtctataactaccaagccttccctgcttatcccaatagtcctgtgcaagtgactacaggctaccagttgcctgtctacaattaccaggcctttcctgcttatccgaattctccctttcaggtggcaaccggttaccaatttcctgtttataattaccaggcctttcctgcatatccaaactctcccgttcaggtaactacaggctatcagctgcctgtctataactaccaagcttttcctgcctaccctaactctgcggtgcaagtcaccactggctaccaattccacgtttacaattaccaaatgcccccccagtgtccggttggggaacaaaggagaaatttgtggaccgaagcctataaatggtggtaccttgtttgcttgattcagagaagagattag

SEQ ID NO: 185141 - DNA, 948 bp, Artificial Sequence
  Description of Artificial Sequence: Synthetic coding sequence
atggccgcccccagctgcggcggcgaccggaaggcccggctgaccccatcattaccccacgagtccacagcaaatccggagaccccaaacagcacgatcagtcgggaggcctccacccagtcctctagtgctgccactagtcaaggctacatcctccccgaaggcaagattatgcccaacacagtttttgtgggaggaatcgatgtacgcatggacgagaccgaaattcgatcttttttcgcaaggtatggaagcgtgaaagaggtaaaaatcatcacagatagaaccggtgtctctaaaggctatggctttgtttccttttttaatgacgtggatgtccaaaagatcgtcgagagtcaaatcaacttccacggcaagaaactgaagctagggcccgcaatccgcaaacagaatctgtgtgcctaccacgtgcaacccagacccctggtgtttaaccatccgcccccccctcaatttcaaaatgtgtggaccaacccgaacacagagacctatatgcagcctaccaccactatgaacccgatcactcagtacgtgcaggcgtaccccacatacccaaactccccagttcaggtgattaccgggtaccagttgcccgtgtacaactaccagatgcctccacaatggcctgtgggagagcagagatcatacgtggtgccgccagcctactctgcagtgaactatcattgcaatgaagtggatcccggggctgaggtggtaccgaacgaatgtagtgtgcatgaagcgacaccccccagtggcaacggaccacagaaaaaatctgtcgaccggagcattcagactgtggtctcctgcctctttaaccccgagaacaggttgcgaaacagcgtcgtgacccaagacgactatttcaaagataagcgagtccaccacttccgtcgctccagagccatgctgaagtcagtgtag

SEQ ID NO: 185142 - DNA, 888 bp, Artificial Sequence
  Description of Artificial Sequence: Synthetic coding sequence
atgagcaccgccaaccccgagacccccaacagcaccatcagccgggaagcctccacccagagtagtagcgcggccacctctcaaggctatattttgcccgagggcaaaattatgccgaatactgtgtttgttggcgggatcgacgtccggatggatgagacggaaattagatctttctttgctcgatacggctcagtgaaggaagtcaaaattataacagacagaactggggtctctaagggatatgggttcgtctctttctttaatgacgtggatgtgcaaaagatagttgagtctcagataaacttccacggcaagaagctgaaactgggaccggctattaggaaacagaatttgtgtgcctatcatgtgcaaccaaggcccctcgttttcaaccacccgccaccaccccaatttcagaacgtttggacaaaccctaacactgagacatacatgcagccaacaacgactatgaacccaattacccaatatgtccaagcgtatcctacgtaccccaactctcctgtgcaagtaattacaggctaccaattgcccgtgtataactatcaaatgccaccccagtggcctgtgggcgagcagcgctcttacgtggtccctcctgcctatagcgccgtaaactaccactgtaacgaagtcgatcccggtgctgaggtggttcctaatgaatgttctgttcacgaagcaactcccccctctgggaacggcccacagaagaagtctgtcgacagatctatacagacagtggtatcttgtttattcaacccggaaaatcggctgcggaatagcgtagtgactcaagacgactactttaaagataaacgcgtgcatcacttcagacgctcacgggccatgttgaaatcagtatag

SEQ ID NO: 185143 - DNA, 2286 bp, Artificial Sequence
  Description of Artificial Sequence: Synthetic coding sequence
atgaactggcggttcgtggagctgctgtacttcctgttcatctggggcaggatcagcgtgcagcctagccaccaggagcccgccggtaccgatcagcatgtgagcaaggaattcgactggttgatatccgatcgtggtccattccaccatagccgcagctacttatcatttgtggaaaggcaccgacagggattcacaacacggtacaagatttatcgagagtttgccagatggaaggtacggaataccgccattgaaaggcgggacctggtgaggcatccagttccccttatgcccgaattccaacggtccattaggctgctgggccgccggcccactactcagcagtttatcgacaccatcatcaaaaagtacgggacacacctgttgatcagcgccacattaggtggagaggaggcactgacgatgtatatggacaagagtcgccttgatcggaaatccggtaacgcaacccagtctgtcgaagctttacaccagttagcttcaagttattttgtcgatcgcgacgggaccatgcgccggcttcatgagatccagatctccaccggagccataaaggtaacggagacaagaactggacctctggggtgtaacagctatgacaatctagatagcgtgtcatcagtgctcttacagtctacagagagtaagttgcacctgcagggcctgcaaatcattttcccgcagtatctccaagaaaaatttgtacagtcagccctctcttatatcatgtgtaacggggagggggagtatctgtgccagaatagccaatgcagatgccagtgcgccgaggagttcccgcagtgcaattgcccaatcacagatatccagatcatggaatacactctagcaaatatggcgaagtcttgggctgaggcttacaaggatctcgaaaactccgacgaatttaaatcttttatgaaacggctgccttcaaatcactttctgacaattggctcaatacaccagcactggggaaacgactgggacttgcagaacaggtacaagctgctccagagcgctactgaagcacagcgacagaagatccagagaaccgcccggaagttatttggcctctccgtgcgctgtcggcataaccccaaccaccaactcccgcgggagcgaactatccagcagtggcttgctcgggttcagtctctgctctattgtaacgagaatggtttctggggaactttcctggaaagccagcggtcatgtgtttgccacgggtccacaacattatgccagaggcctatcccctgtgtgatcggtggaaacaactcctgtgctatgtgctcactggccaatatatctctgtgtggaagttgtaacaaagggtacaagttgtacagaggaaggtgcgaaccccagaacgtggacagtgaacggtccgaacagttcatcagcttcgagaccgacctcgattttcaagatttggagctgaaatacctcttgcagaagatggattccagactttacgttcatacaacctttatctcaaatgagatccgactggacactttctttgacccgaggtggcgaaagcggatgtctctgactctgaaatccaataaaaatcggatggactttattcatatggtgatcgggatgtccatgaggatctgtcaaatgcgcaacagcagcctcgaccctatgttcttcgtctacgttaatcccttcagcgggtcccactctgagggctggaatatgccctttggagagtttgggtatccacgttgggaaaaaattcggctgcagaacagccagtgctataattggacactcctcctcggaaaccgttggaaaactttcttcgagactgtgcacatctacctgagaagcaggactcgactgcccactctgctgagaaatgaaaccggccaaggtccggtcgatttgagtgacccttctaagagacagttttacattaagatttcggatgtgcaagtgttcgggtacagcttgcggtttaacgcagatcttctccgcagcgcggtccaacaagtcaatcagagctatacacaaggaggacagttttactcatcctcctcagtgatgctgctgctattggatatccgcgacaggattaacaggctagcaccccctgtggcccccgggaagccgcagctggatttatttagctgcatgctgaaacaccgccttaagttgacaaattcagagataattcgcgtaaaccacgccttggatctatacaataccgaaatcctcaaacaaagtgatcaaatgacagccaaactctgctag

SEQ ID NO: 185144 - DNA, 963 bp, Artificial Sequence
  Description of Artificial Sequence: Synthetic coding sequence
atgaactggcggttcgtggagctgctgtacttcctgttcatctggggaaggatttccgtgcagccatcccaccaggagccagctggcaccgatcagcacgtgtccaaggagtttgattggctaatctctgataggggtccattccatcacagtaggagctatctgtccttcgtcgaacgacaccgccagggatttaccacccggtataaaatttaccgcgagttcgccagatggaaagttaggaacactgccatcgaacggcgcgacctggttcgccatccagtacccctgatgcccgaatttcagcgtagtataaggctcctggggcgacgacccacaacacagcagtttatcgacactatcatcaaaaagtacgggactcacttacttatttccgctaccctaggcggagaagaagcactgaccatgtacatggacaaaagtcggctggaccggaagtcaggcaatgccactcaatccgtggaggcactccaccagctggcatcttcatactttgtcgaccgcgatggcactatgaggcgactgcacgagatccagatctccacaggggcaatcaaagttaccgagacgcggactggccctctcggctgcaattcttatgacaaccttgactcagtcagcagtgtcttgctgcaaagtacggaatcgaagcttcacctgcaaggtctccagatcatctttccccagtatctgcaagagaagtttgtgcagtctgcactgtcctatatcatgtgcaacggagagggggaatatttgtgccagaatagccagtgcaggtgccaatgtgctgaggaattcccacagtgcaattgcccgatcactgatattcaaataatggaatatacattggcaaacatggcaaaatcttgggcagaggcctataaagacttggagaatagtggacgtgagtctcattccgtgccgctgcatgagtggccctag

SEQ ID NO: 185145 - DNA, 2286 bp, Artificial Sequence
  Description of Artificial Sequence: Synthetic coding sequence
atgaactggcggttcgtggagctgctgtacttcctgttcatctggggaaggattagcgttcagccttcacaccaagagcctgcaggaactgaccagcacgtctcgaaggagttcgattggctgatttccgaccgcgggcctttccatcactcgcgcagctatctgtcttttgtggagcgacacagacaagggttcacaaccagatacaaaatctatcgggagttcgcaaggtggaaggtcaggaatacggcaatcgagcgaagagatttggtccgacatcccgtgcccctgatgcctgaattccaaagatccattagattgctgggcagaagacccaccacacagcaatttattgacacaattattaagaagtatggaacccacctattaatatccgctaccctggggggcgaggaggccttgactatgtacatggacaaatcccgactggacaggaagagtgggaacgccacacagtctgtagaggctttgcatcagctcgcctccagctacttcgtggatcgcgacggcacaatgcgcaggctccatgaaatacagatctcaactggggcaattaaagtcaccgagaccagaaccgggccattaggttgcaatagctacgacaatctcgactctgtgtctagcgtgttgctgcagtcgacagagtcaaaactccatttacagggactccaaatcatctttcctcagtatctgcaggaaaagtttgtgcaatccgccctttcgtacatcatgtgtaatggcgaaggagagtacctctgccaaaatagccagtgcagatgccaatgtgctgaggagttcccccaatgtaactgtccaattaccgacattcagatcatggaatacactctcgccaatatggctaagagctgggccgaggcctataaggatctggagaatagcgacgagttcaaaagcttcatgaaacggctccctagcaaccattttttgacaataggttccatccaccagcactggggcaatgactgggatctgcagaatcggtacaagctgctccaatccgctactgaggcacagcggcagaagatccaacgaacagcaagaaagctttttggtctctctgtgcgttgcaggcacaaccctaaccaccagctgccacgcgagcgcaccatacagcagtggcttgcccgtgttcagagccttctgtactgtaatgaaaatggcttttggggcacgtttctggagtcccagagaagctgtgtgtgccatggttctaccactctgtgccagcgccctataccatgcgtgattgggggaaacaactcttgtgctatgtgtagcttagcaaatattagcctttgcgggtcatgtaacaagggttacaaactgtaccgaggtcgatgtgagccccagaacgtggacagcgagaggagcgaacagttcatcagctttgaaaccgacctggatttccaagatctagagcttaaataccttctgcaaaaaatggactctcgactgtacgtccacaccacgtttatcagcaatgaaatacgactagatactttcttcgacccacggtggagaaagcggatgtcactgaccctgaagagcaacaaaaacaggatggatttcatccacatggttattggcatgagtatgcgcatttgccaaatgcggaattcaagcctggacccgatgtttttcgtttacgtgaaccccttctctggctcacactctgaggggtggaatatgccttttggcgagttcggatacccccgttgggagaagatacggctgcagaacagtcagtgctataattggacactgcttcttggcaatagatggaaaactttctttgagaccgtgcacatatacttgagaagccggacacggctcccaacactgttacgaaacgaaactggccagggacccgtggacctgtcagacccttcgaagagacaattctacattaagatctccgacgtccaagtttttggctactctcttcggtttaacgccgacctcctacggagcgcggttcagcaggttaaccagagctatacccagggcggccagttctatagtagctcaagcgtgatgctgctcctcctcgacatcagagaccgcatcaatagactcgccccacctgtggcccccggaaagccccagctggatctgttctcctgcatgcttaagcacagattaaagcttaccaacagtgagatcattagagtcaaccacgctttggacctctataacaccgagatactgaaacagtccgatcaaatgacagctaaattgtgttag

SEQ ID NO: 185146 - DNA, 1404 bp, Artificial Sequence
  Description of Artificial Sequence: Synthetic coding sequence
atgaagcggatcaaggtgcccgactacaaggaccggagcgtgttcggcgttccccttaccgttaacgtgcagaggacaggacagcccctcccccagagcatccagcaggctatgcgttatttaaggaatcactgtttagaccaggtggggttattccggaagagtggagtgaagtccaggatacaagctttaaggcagatgaatgaaggcgccattgattgtgtcaactacgagggtcagtctgcctatgacgtggctgacatgctgaagcaatattttagagatctgcccgaacccctaatgaccaacaaactcagcgagacgtttctccagatttatcaatatgtcccaaaggaccagaggctgcaggcaatcaaggcggccattatgctgcttcctgatgaaaacagagaggtgctgcaaactctgttgtatttcctctctgatgtgaccgctgccgtgaaagagaaccagatgacccctacaaacctggcggtgtgtcttgccccctcgttgttccacctgaacactctgaagcgtgagaattcctcccccagagtcatgcagaggaagcagagcctcggcaaacccgatcaaaaggacctgaacgaaaacttggcagcgacccagggactagcccacatgattgcagaatgcaagaagctgtttcaggtaccggaggagatgtcccggtgtcggaactcctatacagagcaagagctgaagcccctgacactcgaggctctcgggcatctgggcaatgacgattccgctgactaccagcactttcttcaggactgcgtggacggattatttaaggaagttaaagaaaagtttaaaggctgggtttcttacagtacctcagagcaggccgagctaagttataaaaaggtttctgaaggcccgccactccgcctgtggaggtcagtcatagaagttcctgcagtgccagaagagatactgaagcggcttctgaaggaacagcatctttgggacgtggaccttttggacagcaaggtcatcgagatcctggatagtcagacagaaatttatcagtacgtccagaacagcatggcacctcatccagcacgggactatgtggtactacggacgtggcggacaaatctgccaaagggcgcatgtgcgctcctgcttactagcgtggaccatgaccgcgctcctgtggtaggagttagggtgaatgtcctcctcagtagatacctcatcgagccatgtggacctggtaaaagcaagctgacttatatgtgtagggtggatttacgggggcacatgccagagtggtatacaaaaagctttggccatctgtgcgctgcagaagtcgttaaaattcgagacagcttctctaaccagaataccgaaactaaggatactaagagcaggtag

SEQ ID NO: 185147 - DNA, 3378 bp, Artificial Sequence
  Description of Artificial Sequence: Synthetic coding sequence
atgggcgaccccaaggcccacgtgatggcccggcccctgcgggccccactgcgccgcagcttctccgaccatatccgggatagcaccgcacgagctcttgatgtgatctggaagaacaccagagaccgacggctggcggaaatcgaggccaaagaggcgtgcgattggctgcgggctacaggctttccacagtatgcacagctctatgaggatttcctcttcccaattgatattagcctggtgaaaagagaacatgatttcttggacagggacgcaatcgaggccctctgtcgtagactgaacactcttaataaatgcgccgttatgaaactggaaatctccccacaccggaagcgcagtgatgatagcgatgaagatgaaccctgcgccattagtggcaaatggacttttcagagagacagtaaaagatggtctaggctcgaggagtttgacgtattctcgccgaagcaggacttagtacccggttcacccgatgactcccaccctaaagatgggcctagccccggaggcacactgatggacctctctgaacggcaagaggtaagcagcgttcggtctctatcgagcaccggatcactcccatcccacgctcccccgagcgaagatgcggccacaccgcggacgaatagcgtcatctcagtatgtagcagctctaacctcgcagggaacgacgattcctttggatcccttccctcccccaaggaactgagcagtttcagcttctccatgaaagggcacgagaagaccgccaagtcaaagaccaggtctctactcaaacgcatggagtctcttaagcttaaaagcagtcatcacagcaaacacaaggccccctctaagctaggtctgattatttcagggccaattctccaggagggcatggatgaggagaagctgaagcaactcaactgtgttgagatctcggcacttaacggaaatagaattaacgttccaatggttaggaagcgaagcgtcagcaatagtacacagacatcgtcatcttcatcacagagtgaaactagcagcgctgtatccaccccgtccccggtcaccagaactagaagcctcagcgcttgcaataaaagggttggaatgtaccttgaggggttcgatcctttcaatcagtcaacattcaacaacgtggtcgagcagaacttcaagaatcgggagagctacccagaagacacagtcttctacattcccgaagaccacaaacctgggaccttcccaaaagcgttgacgaatgggagtttctctccgtctggcaacaacggttccgtgaactggagaaccggatcttttcatggcccaggccacatctccctgcggagagaaaattcatcggacagtccaaaggaactgaagcgaaggaatagttccagcagcatgtccagcaggctttcaatctatgacaatgtccccggttccatactgtatagttcatccggtgacctagcagacttggagaatgaagacattttccctgaactggacgatatcctgtaccacgtgaaaggaatgcaaaggattgtaaatcaatggtccgagaagttctcagacgagggagacagtgactccgcactagactcagtgtccccttgtccttcttctccgaaacagattcatctggacgtcgacaatgaccggaccacaccttcagatctggatagtaccggaaactccttgaatgaacccgaggagccctcggagatcccagagcggagagatagcggagtcggggcatcactcacacgtagcaacagacacaggctgaggtggcactccttccagtcctctcatcgaccctcacttaatagcgtctccctgcagatcaactgtcagtccgttgcccagatgaacctcctgcagaaatactccctgttgaaactaacagcgctgcttgagaagtatacaccctccaataagcacggctttagctgggcggtcccaaaattcatgaagaggatcaaggttccggactacaaagatcgaagtgtctttggtgtcccgctgaccgtgaatgttcagcgaacaggacagccactccctcagagtattcagcaagccatgcgatacctaagaaaccactgccttgatcaggttggcctgttccggaagtcaggggtgaagagcagaatccaggcattgagacagatgaatgaaggggcaatcgattgcgttaactatgagggtcagagtgcctacgacgttgccgatatgctgaaacagtattttcgagatctcccagagcctctgatgaccaataagctgtctgagaccttccttcagatctatcaatatgtgccaaaggaccagcgcctgcaggccatcaaggccgccatcatgctcctccccgacgagaatcgcgaggtgctccaaactctcctgtacttcttaagtgacgtcactgccgccgtgaaggagaatcagatgaccccgactaatttagctgtttgcttggcgccatccctgttccacctcaacaccctaaagcgagagaattcaagtccaagggtcatgcagcgtaagcagagccttggtaaaccagatcaaaaagatctaaacgaaaatctggctgctacacaggggctggctcacatgattgctgaatgtaagaagctgttccaggtgccagaagaaatgtcaaggtgtcgcaattcatacacggagcaggagcttaaaccgctcacactggaggccctcggccatctcggaaatgacgactctgccgactatcagcactttttacaggattgtgtggatggtttgttcaaggaggtgaaggaaaagtttaagggctgggtgagctattccacttccgagcaggctgaactatcctacaagaaagtgtccgagggtccaccgttgcgcctctggcgttccgtgatagaggtgccagccgtgccggaagagattctaaaaagattgctgaaagaacagcatctatgggatgtagacctgctggactccaaggtgatcgaaatcttggatagccaaaccgaaatttaccaatatgtgcagaactcaatggctccgcacccggcaagagactacgttgtgctgaggacatggaggactaaccttcccaagggagcatgcgccttgctgctcacaagtgtcgatcacgacagggcccctgtcgttggtgttcgtgtgaatgtgctccttagtcggtacctgatcgagccttgtggccccggaaagtccaaactgacatacatgtgccgcgttgacctgcgagggcacatgcccgaatggtacacaaaaagttttggacatctttgcgcagcagaagtggtgaagattcgcgattcattttccaaccaaaacactgaaaccaaggataccaagagtaggtag

SEQ ID NO: 185148 - DNA, 3054 bp, Artificial Sequence
  Description of Artificial Sequence: Synthetic coding sequence
atgaagctggagatcagcccccaccggaagcggagcgacgacagcgatgaggatgaaccgtgcgctattagcggtaaatggacatttcagcgtgacagtaaacgctggagtcggctcgaggaatttgacgtgttttccccgaagcaggatcttgtcccaggctcccctgacgattcacaccccaaggatgggccgagtccagggggtactctgatggacctctccgagaggcaggaggtcagctccgtgaggtctctaagctccacaggttcactcccatctcacgcccctccaagcgaggacgcagctactccccgcaccaatagcgtgattagtgtatgtagcagcagtaacttagccggcaatgacgattcctttgggtcactgccatctccaaaggaactctcatctttcagttttagcatgaagggccatgagaaaacagccaaaagcaagacccggtccctgctgaagcggatggagagcctgaagcttaaaagcagtcatcactcaaagcataaagcgccatctaaactcgggcttattatcagcggtcccatccttcaggagggtatggacgaagagaagctgaagcagctgaattgcgtcgaaatttcagccctgaacggaaatcggatcaatgttccaatggtccggaagcgctcagtgtctaatagcacacagacctcatcgtcttccagtcagtctgaaacatctagcgctgtgtctaccccatcccctgtgacccgtacacggtccctatccgcctgcaataagcgggtcggtatgtacctcgaagggttcgatccattcaatcaatccaccttcaacaacgtggtggagcagaattttaaaaaccgcgaatcctaccctgaggataccgtgttctacatccccgaggaccataagcccgggacctttcccaaggctttaaccaacggttcattttcgccctcaggtaataacgggtccgttaattggcgaacaggatccttccacggacccgggcatataagtctgcggcgggaaaactcaagtgactcaccgaaagagctaaaacgccgtaacagcagctcttcaatgtcctcccggctgagcatctatgacaatgttcctggtagtatcctgtacagtagtagcggcgacctcgctgacctggaaaatgaggatatattcccagaactggacgacatcctgtaccacgtgaaaggcatgcaacgaatcgttaatcagtggagcgaaaagttcagcgatgaaggagactccgatagtgcactagacagcgtctccccttgtccatccagccccaagcagattcaccttgatgtggacaatgatagaacaacgccatcagacctggacagcacagggaattccttgaacgagcctgaggagccgtcagagattccagagcgtcgggactccggagtgggcgcgagcctaacccggtccaatagacacaggctgcgctggcattcgttccagtcatcccatcgtccttctctgaatagtgtcagcctgcaaatcaattgccaatccgtcgcccagatgaacctgctgcagaaatactcgctgctcaagctcactgcattgctcgaaaaatacaccccaagcaacaaacatggctttagctgggctgtgcctaaatttatgaagcgaatcaaagttccagactacaaagatcggagcgtcttcggcgtgccactgactgttaacgtccagcgcactggccagcccctgccccagtccattcagcaagccatgagatatctgaggaatcattgcctggatcaagtgggactatttagaaaatcgggcgttaaaagtcggattcaagctctccgtcagatgaatgagggtgcaattgactgtgttaactatgaaggccagtccgcgtacgatgtagcggacatgcttaaacaatactttagagatctccctgagcccctgatgacaaacaagctgtccgagactttcctgcagatctatcaatatgtgcctaaggatcagcggcttcaggcaatcaaggcagcaatcatgctgctgcccgatgagaaccgagaggtgctccaaacacttctgtactttttatcagatgtgaccgcagcggtaaaagaaaatcagatgacacctacgaacctcgctgtgtgcctcgctccctccctgttccacctgaacactttgaagcgggaaaattcttcaccacgtgtgatgcagagaaaacagtcactgggaaagcctgatcaaaaagacctgaatgagaacctggcggccacccagggcttagctcacatgatagcagaatgcaagaagctgttccaagtgcctgaagaaatgtcacgttgccgcaactcatacaccgagcaggagctgaagcccctcacattagaggctcttggtcacctcggtaatgacgattcagccgattatcagcatttcctgcaagattgcgttgatgggcttttcaaagaagtaaaagaaaaattcaagggctgggtgagctactccacatcagagcaggctgagctgagttacaagaaagtcagcgagggaccccccctgcggctgtggaggtctgtaattgaggtgccagctgtgcccgaggaaatactgaaacggctgctgaaggagcagcatttgtgggacgtggacctcctagacagcaaggtgattgaaatcttggattcacagactgagatttatcagtacgtccagaactctatggccccacatcccgctagagactatgtggtcctgcgaacatggcgcacaaacttgcctaagggagcctgcgccctgctcctgactagcgttgaccacgatagagcccctgtggtgggcgtcagggtgaatgtgttgctttcgcggtatctgatcgaaccctgtggcccgggtaaatccaagctcacctacatgtgcagggtagatctgcgtggacacatgcccgaatggtacaccaagtccttcggccatttgtgtgccgccgaggtggtgaagatccgggactctttttccaaccagaacaccgagactaaggataccaagtcgcgatag

SEQ ID NO: 185149 - DNA, 972 bp, Artificial Sequence
  Description of Artificial Sequence: Synthetic coding sequence
atgggcaacagcgccagccggagcgacttcgagtgggtgtacaccgatcaaccgcacactcagcgaaggaaggaaattttagctaagtatcctgctattaaagccctgatgcgcccagacccacgcttgaagtgggccgtgctggtgttagttctggtgcagatgctggcctgctggttagtgaggggtctggcctggcggtggttgctgttctgggcttacgcgtttggcgggtgtgttaaccattctcttacactggccatccatgatattagccacaatgccgcattcgggaccggcagggctgccagaaaccgttggttagcagtctttgccaacctgcccgtgggtgtgccttatgcggcaagctttaaaaagtatcatgtagatcatcacaggtatctggggggagatggactcgatgtggacgtgccaactcgtctggaggggtggtttttctgcacccctgcacgtaagctcctctggctggtgctacagccttttttttacagcctgcggcctttatgcgtacatcctaaagccgtgactcgaatggaagttttaaacacactcgtccagctggctgctgatctggctatctttgcactttggggcctgaagcccgtagtttacctccttgcctctagcttccttgggctgggtctacatccaatttctgggcacttcgtagctgaacattacatgtttctcaagggccacgagacgtatagctactacggccctctgaactggatcacgttcaacgttggttaccacgtagagcaccatgatttccctagcatcccaggctataatctccctctcgtccgcaagattgcccccgagtactatgatcacctgcctcagcaccactcttgggtaaaggtcctgtgggactttgtgttcgaggattccttgggtccatacgccagggttaaacgggtgtataggctcgcgaaagatgggttgtag

SEQ ID NO: 185150 - DNA, 2214 bp, Artificial Sequence
  Description of Artificial Sequence: Synthetic coding sequence
atgcagccccggcgggcccaggcccccggcgcccagctgctgcccgccttggctctgctcctcctgcttttgggcgcaggacccaggggcagttctctggcaaacccagttccagccgcgcctctgtcagcacctggaccctgtgccgctcagccctgtcgaaacggcggcgtgtgcaccagcaggcctgagcccgacccccaacaccctgcccctgccggtgagcctgggtactcctgtacctgccctgctggcatcagcggggcgaattgccagctggtggctgatccctgtgcttcaaatccttgtcatcacggcaactgttccagttcttcctcctcgtcatccgacggctatctatgtatctgcaacgagggctatgagggccccaattgcgaacaggccttgccatccctgcctgcgaccggctggaccgagtctatggcccctcgtcagctccagcccgtcccagccacccaggagcccgataaaattctcccacgcagccaggctaccgtgacactccccacttggcagcccaaaacgggacagaaggtcgtcgaaatgaagtgggatcaagtggaggtgatcccagatattgcatgcggaaatgcgagttcaaattcatccgctggtggccgattagtgagctttgaagtgccacagaataccagtgtgaagatcaggcaggatgccactgctagtttaattctgctctggaaagtgacagccacaggcttccagcagtgctcgttaattgatggtagatccgttacacctcttcaggcctccggcgggttagtccttctggaagaaatgctagcccttggcaacaatcattttatcgggtttgtgaatgatagtgtcaccaagtccattgtggctctccgcctgaccctcgttgtgaaggtgtctacgtgcgtgcctggggagtctcatgcgaacgacttggaatgctctgggaagggaaagtgcacaacgaagccttcggaagccacgttttcgtgcacctgcgaggaacagtatgttggtaccttctgtgaagaatatgatgcatgtcaacgaaaaccctgtcagaataatgccagctgtatcgatgcaaacgagaaacaggatggctccaactttacttgcgtttgcctcccagggtacaccggagaactgtgccaaagtaagatcgactattgtatcctcgacccctgcagaaacggagccacctgcatttcttccctgagcgggtttacctgtcagtgccccgaaggctattttggaagtgcttgcgaggaaaaggtcgacccttgcgccagctccccctgccagaacaatggtacatgctatgttgacggcgtccacttcacctgcaattgctcccccgggtttacaggtcctacatgtgcgcagttgatagatttctgtgccttgagcccttgcgcacacggaacctgccgcagcgtgggtacaagttataagtgtctatgtgacccaggatatcacggcctgtattgcgaggaggagtataacgagtgtcttagcgctccatgtctgaatgccgcaacttgccgtgatttagtgaacggttatgagtgtgtatgtctggccgagtacaaaggaacccattgtgagctttataaagatccttgtgctaatgtgtcttgcctgaacggggccacttgtgacagtgatggactcaacggcacttgcatttgcgcaccaggctttaccggagaagagtgcgatattgacatcaacgaatgcgattccaacccttgccaccatggcggaagctgcctggaccagcccaacgggtacaactgccattgccctcacggttgggtcggcgccaactgcgagattcacctccagtggaagtctggacacatggcagagtctctgaccaatatgccacggcacagtctgtatataatcattggggccctgtgtgtggcttttattctgatgctcatcatactaatcgtcggaatttgtcggatttccaggatcgagtatcagggctcatcacggcccgcatacgaggaattttacaattgtcgctctatcgattccgagttctccaacgccattgccagcatacgccatgcccggttcggcaagaagtcacggcccgccatgtacgacgtcagccccatcgcatatgaggactacagcccagacgacaagccactagtcactctgataaaaaccaaggatttgtag

SEQ ID NO: 185151 - DNA, 1368 bp, Artificial Sequence
  Description of Artificial Sequence: Synthetic coding sequence
atgctggccctgggcaacaaccacttcatcggcttcgtgaacgacagtgtaacaaaatcaattgtagccctgcgcctaacattagtggtgaaagtgtcgacttgcgtacccggggagtctcacgccaatgatttagaatgctcagggaaaggtaaatgcactacgaagcctagcgaagctacattcagctgcacctgtgaggaacaatatgttggcaccttctgtgaagagtacgatgcatgccagaggaagccatgtcagaacaacgcaagctgcatcgatgctaacgagaaacaggacggttctaatttcacctgcgtctgtctcccaggatacaccggggaattgtgtcagtccaaaatagactattgcattctcgacccatgccgaaacggggcaacctgtatttcctcactgtccggcttcacctgccaatgcccagaaggctacttcggctcggcttgtgaggagaaggttgatccttgtgcctcaagcccttgccagaacaacggaacctgttgctctcccggattcactgggcctacttgtgcgcaacttatagatttttgcgccctgtctccttgtgcccacgggacttgcagatcagtcggaacttcctacaagtgtttatgcgacccaggttaccacggcctctattgcgaagaggaatataatgagtgtctaagcgcaccatgcctcaacgcagctacatgcagagacttggtgaatggctatgaatgtgtgtgcctggctgagtacaaaggcacacactgcgaactctacaaggacccctgtgcaaatgtgtcatgtctgaacggggccacctgtgattcagatggactcaacggcacctgcatctgtgccccgggattcaccggggaggaatgtgacattgacataaatgaatgtgactctaacccatgccaccacggcggttcgtgcctcgatcagccaaatgggtacaattgccattgcccccacggatgggttggtgctaactgtgagatccacctacagtggaagagtgggcacatggcagaatccctgacaaatatgcctaggcacagtttatacatcatcatcggagcgctctgcgtggccttcatactgatgctcattatccttattgtgggaatatgcagaatttctagaatcgagtatcagggcagcagtagacccgcctacgaagagttttacaactgtcggagcatcgactctgaattctcaaacgcgatcgccagtatccgccatgccaggttcgggaaaaaaagtcgacccgccatgtacgacgttagccctatagcttacgaggattattcgcccgacgacaagcctctagttaccttgatcaaaactaaagacctttag

SEQ ID NO: 185152 - DNA, 933 bp, Artificial Sequence
  Description of Artificial Sequence: Synthetic coding sequence
atgaccgccaccgaggccctgctgcgggtgctgctgctgctgctggcctttgggcacagtacctatggagccgaatgcttccctgcctgcaacccacagaatggattttgtgaggatgacaatgtatgccggtgccagccaggctggcagggccctctgtgcgatcagtgcgtgacttccccagggtgcctgcatgggctctgtggcgagcctggccaatgcatatgtaccgacggttgggatggagagctctgcgacagagacgtcagggcttgctcaagtgcgccttgtgctaataatcggacctgtgtttccctagacgatgggctgtacgaatgtagttgcgcccccggctacagcggcaaagattgtcaaaaaaaggacgggccatgtgttatcaatggtagtccctgtcagcatggcgggacatgcgtggatgatgaggggcgggctagccatgccagctgcctctgccctccaggttttagcgggaacttctgtgagattgtggccaactcatgcacacccaacccttgtgaaaatgacggggtgtgcacagatatcggcggcgactttcgctgtcggtgcccggctggatttatcgacaagacatgctcccgacctgttacaaactgcgcgtcctctccctgtcagaatgggggcacttgtcttcagcacactcagggtcaggcaatctgcttcaccatcctcggcgtgctgaccagcctggtggtgctggggacggtcggtattgtcttcttaaacaaatgcgagacttgggtgtccaacctgcggtacaaccacatgcttaggaagaagaaaaacttactgctgcagtacaactcaggagaagatctggccgtaaatatcatcttccctgagaaaatcgacatgactaccttctctaaggaggctggtgatgaagaaatatag

SEQ ID NO: 185153 - DNA, 1152 bp, Artificial Sequence
  Description of Artificial Sequence: Synthetic coding sequence
atgaccgccaccgaggccctgctgcgggtgctgctgctgctgctggcttttggccatagcacatatggcgcagagtgcttccccgcttgcaatccccagaatggtttctgcgaggatgacaatgtatgccgatgccagccaggatggcagggtcctctctgcgaccagtgcgtgacatcacccgggtgcctccatggtctgtgtggggaacccgggcaatgcatttgcaccgacggttgggacggggaactctgcgacagagatgtgcgggcatgctcgagcgctccctgcgccaataatcgaacctgcgtctcattagatgacggtctgtatgaatgctcatgcgctcctggatacagcggcaaggattgtcaaaagaaagatggcccctgcgtgatcaacggctcaccttgtcagcatggtggaacttgcgttgacgatgaaggtagagcaagccatgctagctgcctgtgccccccaggcttcagcggaaatttctgtgaaattgtggccaactcgtgtacccccaatccatgcgagaatgatggtgtatgtacagatataggaggcgattttaggtgcagatgcccagcagggtttatagataagacttgtagccgccccgtgaccaattgcgcctctagcccgtgtcagaacggagggacctgtctccaacacactcaggttagttatgagtgtctgtgtaaacccgaattcactggactgacatgcgtgaagaaaagggctctgagtcctcagcaggtgactaggttacctagcggttacggtcttgcatatcgcctgacaccaggggttcatgagttgccggttcagcagcccgagcatcgtatcctgaaagtgtcaatgaaggagttgaataagaaaacacctctgcttactgagggacaggctatttgcttcaccatcctgggagtgcttacttctttggttgtcttggggaccgtcggcatcgtgttcctgaacaaatgcgaaacttgggtgtcgaatcttagatacaaccacatgctgcgcaaaaaaaagaacctcttactgcaatacaatagcggagaggatttggcagtgaacattattttcccggagaaaattgacatgaccactttttcaaaagaggcaggagacgaggaaatctag

SEQ ID NO: 185154 - DNA, 294 bp, Artificial Sequence
  Description of Artificial Sequence: Synthetic coding sequence
atgaccgccaccgaggccctgctgcgggtgctgctgctgctgctggccttcggacactctacttatggggccgaatgttttcctgcatgtaatcctcagaatggattctgtgaagatgacaacgtatgtcgctgccagcccggctggcaaggcccactgtgcgatcagtgcgtgacttccccaggatgcctgcacggcctatgcggcgagcctggccagtgcatatgcacagatggatgggatggtgagctgtgcgaccgggatgtgagagcatgctcaagcgcaccttgttag

SEQ ID NO: 185155 - DNA, 3612 bp, Artificial Sequence
  Description of Artificial Sequence: Synthetic coding sequence
atggccgcctgcggccgggtgcggcggatgttccggctgagcgccgccctgcatctgttgctgttgttcgctgccggtgctgagaaactgcctggccagggagtgcatagtcaaggtcagggaccaggagccaactttgttagctttgtgggccaagccggtggcgggggtcctgccggccaacagcttccgcaactgcctcaaagctcccaattgcagcagcagcagcagcagcagcagcagcaacagcagccacagccacctcagccacctttcccggcggggggcccaccagcccgacgtggtggcgctggagccgggggcggttggaaacttgcggaagaagagtcctgtcgggaggacgtgacacgggtgtgcccaaagcacacctggagcaataatttggctgttctcgagtgtctgcaggacgtgcgggagcccgaaaatgaaataagttctgactgcaaccatctactgtggaattataagcttaacctcacgacggacccaaagtttgagagcgtggctagggaagtgtgcaaaagcactataacggagattaaggaatgtgcggacgaacctgtgggaaaagggtatatggtcagctgcttagtggatcatagaggtaacatcactgaataccagtgtcatcagtacatcacaaaaatgacagctataatcttctccgactatagattaatatgcggattcatggacgattgcaagaatgatattaacatcctcaaatgtggcagcattcggctgggagagaaagacgcccacagccagggcgaagtcgtgagctgtctggagaagggcctcgtgaaagaagctgaagaacgagaacctaagatccaggtcagtgagctatgcaagaaagccatactaagagtggcggagctcagctctgatgactttcatcttgatagacacctctactttgcttgtagggacgatagagaaaggttttgtgagaatacacaggccggagaaggccgcgtctacaagtgcctgtttaatcacaagttcgaggagagcatgtctgaaaagtgtcgggaagcactaaccacccgccagaagctgattgctcaggattacaaggtgtcctatagtctcgctaaatcttgtaaaagcgacctgaaaaagtatcggtgcaacgttgaaaatctccctaggtcccgagaggcccgcttatcctatctgctgatgtgtctggaatctgccgtgcacagaggaagacaagtgtcatcggagtgccagggtgagatgctcgactaccgacgcatgctgatggaagactttagcttatcccctgagataatcctgagctgccgaggcgagatagaacaccactgcagtggccttcacaggaagggcagaaccctccactgcctgatgaaggtcgtgcggggggagaaaggcaatcttggtatgaattgtcaacaggctctacaaactttgatccaggaaaccgatcccggagccgattatagaattgaccgggccctgaatgaagcctgtgagagtgtaatccagaccgcttgcaaacatattagatccggagacccaatgatcctgagttgtctcatggagcacctgtatacagaaaaaatggttgaggattgcgagcaccggcttctggaattgcagtactttatcagtagggactggaagctcgacccagtgctctatcggaaatgtcagggggatgcctcacgcctttgtcacactcatgggtggaacgaaacaagtgaatttatgcctcaaggtgccgtgttcagttgcctctaccgccacgcttacaggactgaagaacagggacgcaggctaagcagagagtgtcgcgccgaagtacagcgaattctacaccagagggccatggacgttaaactcgaccctgccctgcaggacaaatgtctaatcgatctgggaaaatggtgttctgagaaaaccgaaaccggacaggagttagaatgtctgcaggatcacctcgatgatctggtggtagagtgtcgggacatcgtgggcaatctgactgaattagagtccgaagatattcagattgaagccctgttaatgcgtgcgtgtgaaccaataattcagaacttctgccacgacgttgccgacaaccaaattgacagcggcgacctgatggaatgtctgattcagaataagcaccagaaggacatgaatgaaaagtgtgccattggtgtgacgcactttcagttggtccagatgaaggactttcgcttctcttataagttcaagatggcctgtaaggaggatgtccttaagctctgtccgaacatcaaaaaaaaggtggacgttgtaatctgcctcagcacaacagtgaggaacgacacccttcaggaagccaaggagcacagagtgagtctgaaatgtcgaagacaacttcgtgtggaagaactagagatgaccgaggatattagactcgaacctgacctctacgaagcttgcaaatccgacataaaaaatttttgcagtgctgttcagtacggcaacgcacagatcatagaatgccttaaagaaaataagaaacaactttcaactaggtgtcatcagaaagtattcaagctccaggagactgagatgatggacccagaattagattatacattgatgagggtgtgcaagcagatgatcaagagattctgccccgaagctgatagcaagaccatgctccaatgtctgaaacagaataagaattccgaactcatggaccctaagtgcaagcaaatgatcacgaagagacagattacacagaataccgattaccgcctaaatcccatgctccgaaaggcgtgcaaggcagacattccgaaattttgccatgggatcctgactaaagccaaggacgacagcgaactcgaggggcaggtgatcagttgcctgaagctgaggtacgccgatcagcgactgagtagcgactgtgaggatcaaattcggatcataattcaggaatctgctctggattaccggctcgaccctcaactgcagttgcactgcagtgatgagatatcctcgctctgtgcggaggaggctgctgctcaggaacagacaggtcaggtggaggaatgcctgaaggtgaatctcctgaaaattaagacagaattatgtaagaaagaagtgcttaatatgctgaaagagtccaaggcagatatctttgtggatccggtgctgcataccgcatgcgccctggacatcaagcatcactgcgccgccatcacgcctggacgtggaaggcaaatgtcatgccttatggaagccctcgaggataaacgggtgcgattgcagcctgaatgcaagaaacgtctgaatgaccgtatcgaaatgtggagttacgcagcaaaggtcgccccagctgatggatttagcgatctagctatgcaggtcatgacttccccgagcaagaattacattctctctgtcatttctgggagcatttgcattctgttcctgattgggcttatgtgtggccggatcacaaagcgggtgactagagagttaaaagacagactccaatatcgatctgagaccatggcttacaaaggcctcgtatggagccaagacgtcactggaagccccgcatag

SEQ ID NO: 185156 - DNA, 1764 bp, Artificial Sequence
  Description of Artificial Sequence: Synthetic coding sequence
atggtgagcccccggatgagcggcctgctgagccagaccgtgatcctggccctgattttcttgcctcagacaaggccggcaggtgtgtttgagctacagattcactccttcgggcctggaccaggccctggagccccgcggtccccctgctcggcacgcttaccttgccggctgttcttccgtgtctgtttgaagccaggattgtccgaggaagccgcagaatccccttgtgcgctgggcgccgctctgagcgcccgtggacccgtttataccgagcaacccggagctcctgcccccgatcttcctctccccgacggattgctccaggttccattccgcgatgcctggccgggtactttctcatttatcattgaaacctggcgcgaggagctaggcgatcaaattgggggtcccgcgtggtccctccttgccagggttgctggacggcgtcgtctcgcagccggtggtccatgggcgcgcgatatacagagagcgggcgcctgggaattgagatttagctacagggcgcgatgcgaaccccccgccgtcgggactgcttgcacccggctgtgtcgaccgcgttcagccccgtctcggtgtggacctggactgcgcccctgcgcacccttagaagacgagtgtgaggctcctttggtgtgcagggccgggtgttctccggaacacggcttctgtgaacagcctggtgagtgtaggtgtctggaggggtggacaggcccgctgtgcacggtgcccgtctctactagcagctgcttgagccctcgcgggccctctagtgcaaccacaggttgtttagtgccagggcctggcccttgtgatgggaacccctgcgctaatggggggagttgtagtgagacacctagatcctttgagtgcacatgtccacgtggcttctacggcttacggtgcgaagtgtccggggtgacatgcgccgacgggccatgcttcaacggcggactatgcgtgggaggtgccgatcctgactccgcctatatttgccactgccctcctggcttccagggctccaactgcgagaagagagtggaccgatgcagccttcagccatgtcgcaacggggggctgtgcctggacctcggccatgcactgcggtgccgatgcagggccggcttcgccggcccaaggtgtgagcacgatctcgacgattgtgcggggcgcgcctgtgccaatgggggaacatgtgtcgaggggggaggcgctcaccggtgctcatgcgccctggggttcggagggcgcgattgcagagagcgcgcagacccatgtgccgcaagaccttgcgcccatggcggtagatgctacgcccacttttctggcttagtgtgtgcgtgcgccccagggtacatgggagctcggtgtgaattcccggttcatcctgacggcgcaagcgctctgcctgcagcgcccccgggccttcgccccggtgatccacagaggtatttgctcccaccggcactgggactgctggtggcagctggcgtcgcgggagctgccctgttgcttgtccatgtaaggaggcgtggtcatagtcaggatgccgggagtaggttgctagccggcactccagagcctagtgttcatgccctgccagatgctctgaacaacctcaggacgcaggaaggaagtggggacggcccatcgtcttccgtggactggaaccgtcccgaagatgtggacccccaaggaatctacgtgatctccgcccctagtatctacgcacgtgaagcatag

SEQ ID NO: 185157 - DNA, 2058 bp, Artificial Sequence
  Description of Artificial Sequence: Synthetic coding sequence
atggccgccgccagccggagcgccagcggctgggccctgctgctgctggttgccctctggcagcaaagggcggctggctctggcgtattccagttgcagttacaggaattcataaatgaaaggggtgtgctagcaagtggcagaccctgcgaacccggctgccgcactttttttcgcgtgtgtttaaagcatttccaggctgttgtgtccccagggccatgtacctttggcactgtgagcacacccgtgctgggaaccaactcttttgctgtgcgggatgacagcagcggcggaggaagaaaccctctgcaactgcccttcaactttacatggcctgggacttttagcctgataatcgaggcttggcatgcacccggggacgatctgaggcccgaagccctgccccccgatgcgctgatctccaagatagctatccaagggtcactagccgttgggcagaattggctcctggatgagcagacctctacactaacccgcctgcggtacagctatcgtgtgatttgtagcgacaattattatggtgacaactgctccagactgtgcaagaaacgcaacgaccacttcggccactacgtgtgtcaacctgacgggaacctgtcctgcctacccgggtggacaggggaatactgccagcagcctatctgtctgagcggatgtcacgaacagaacgggtattgttccaagccggctgaatgtctttgtagaccagggtggcagggccggctctgtaatgaatgcatcccccacaatggctgccgtcacggcacttgttcaacgccttggcagtgtacttgcgacgaaggatggggcgggctcttttgcgatcaggacttaaactattgcacacaccatagtccgtgcaaaaacggcgcgacatgctctaacagcggacagcggtcctatacctgtacatgccgtccaggctataccggggtcgattgtgagctggagttgtcagaatgtgactctaacccatgtcgcaacggcggaagttgtaaagatcaagaagatgggtaccactgtctgtgcccccccgggtattacggactgcattgcgagcactccaccctctcctgcgccgatagcccatgtttcaatggcggatcttgccgagagcgcaatcagggcgctaactatgcctgcgaatgtccaccaaactttactggcagcaattgcgagaaaaaggtggatcgttgcacgagcaacccctgcgctaacggaggccagtgccttaaccggggacctagccggatgtgcagatgtcgccccggattcaccggcacctattgcgaactgcacgtgtccgactgcgccagaaacccttgtgcacacggaggcacctgtcacgatctggagaacggactcatgtgtacttgccctgctgggttctcaggaagaaggtgcgaagtccggactagcattgacgcttgcgcatcctcaccatgcttcaacagagctacgtgttatacggacctgtctacagatacttttgtttgtaactgtccctacgggttcgtgggcagtaggtgcgagtttcccgtgggcttgcctccgagcttcccctgggtcgcagtgtcactgggcgttgggttggccgtcttgctggttctgcttggcatggtcgctgtagccgtacgccagctgagacttcgtcgcccagacgatggatctagagaggcgatgaacaatctctctgattttcagaaggacaatctcattcctgcagctcagttgaaaaacaccaaccagaagaaggagctcgaggtagactgcggactagataagtccaactgtgggaaacaacaaaatcacaccctggactataacttggcacctggccctctgggccggggcaccatgccaggcaagttccctcactcagataagagtctgggtgaaaaagcacccctgcggttgcactcagagaagccagaatgccgcattagcgccatatgctctccacgggattccatgtaccagtccgtctgcctaatatctgaagagcgtaatgaatgcgtcattgccaccgaggtttag

SEQ ID NO: 185158 - DNA, 2223 bp, Artificial Sequence
  Description of Artificial Sequence: Synthetic coding sequence
atggccagccacctgcggccccccagccccctgctggtgcgggtgtacaaaagcggacctagggtcaggagaaaactcgagtcatacttccagagcagtaaatctagcggtggcggggaatgcacagtcagcacccaggaacacgaggctccaggcacctttcgagtggagttctcagagcgagctgccaaggaacgggtcctgaaaaaaggcgaacaccagatccttgtagacgagaaaccggtgccaattttcctggtgcctactgaaaactctattaaaaagaacacccgacctcagattagctctctgactcaatctcaagccgagactcctagcggggacatgcaccaacatgagggacacatcccaaatgcagttgattcctgtctgcagaagatttttctgaccgtgaccgcagacctgaattgtaacctcttttccaaggaacagcgcgcatacattacgacgctgtgcccatccattcgcaaaatggaaggccatgacgggattgagaaagtctgcggggatttccaggacattgaacggatccatcagttcctgtcagagcagttcttggaatcggagcaaaaacagcagttttcgccttccatgaccgaaagaaaaccgctgagccaacaggagagagattcatgtatctccccttcagaaccggagacaaaagccgagcagaaaagtaattacttcgaagttccactgccctattttgaatactttaagtacatttgccccgacaagatcaattcaatagagaagagattcggcgtcaatatcgagatccaggagtcttctcctaacatggtctgcctggactttacaagctccagatcaggtgacttggaagcagctagagagagcttcgctagtgaattccagaagaatacggaacccctgaaacaggaatgcgtaagcctagcagactctaaacaggccaacaaatttaagcaggaattgaaccaccagtttaccaaactgctgatcaaggaaaaggggggcgaattaaccttgctcgggacacaggacgatatctcggcagctaagcaaaagatatccgaagcatttgtgaaaattccagtaaaactctttgcggccaattatatgatgaacgtgatagaggtagattcggcccactataaattactcgagaccgaactgctccaggagatttcggagatcgagaaacggtatgacatatgctcaaaagtgagcgagaaggggcaaaaaacttgcattctgtttgaaagtaaggacagacaagtcgatttatccgttcatgcatatgccagtttcatcgacgccttccagcacgctagttgccagctcatgcgtgaggtgctactgttgaagtccttgggcaaggagagaaagcatctacaccaaacaaagtttgcagacgattttcgaaagcgtcatccaaacgtccacttcgtcctgaaccaggagtctatgactttaactggtctgccaaaccatctggccaaagccaaacagtacgtgctcaagggcgggggaatgtcttctctggctggtaagaaattaaaggagggacacgaaaccccaatggatattgacagcgacgactccaaagccgccagtccacctcttaaaggctccgtttcaagcgaggcctctgaactcgacaagaaggagaaggggatctgcgtcatctgcatggacaccatcagtaacaaaaaggtcttacccaaatgtaaacacgaattttgtgccccttgtataaacaaagccatgagttacaagccgatttgtcccacatgccagacatcctatggcattcagaaaggcaatcagcctgaggggtccatggtgtttactgtgagcagggacagcttaccaggatacgaaagcttcgggacaattgtaatcacctattcaatgaaggcggggatccagaccgaggaacacccaaatcccggaaagcgctacccaggtatacaacgaacggcttatctcccagacaacaaggagggacgtaaagtgctgaaactgttgtacagagcctttgatcagaagttgatcttcacggttgggtattctcgggttcttggggtgagtgacgtgatcacctggaatgacattcatcacaagacctctaggtttggcggcccagagatgtatggatacccagatcccagctaccttaagcgggtgaaagaagaactgaaggccaaaggaatcgagtag

SEQ ID NO: 185159 - DNA, 1863 bp, Artificial Sequence
  Description of Artificial Sequence: Synthetic coding sequence
atgagccggcccggccacggcggcctgatgcccgtgaacggcctgggtttcccgccacagaatgttgcccgcgtggtagtgtgggagtggctgaatgagcactctagatggcgtccttatacagctactgtgtgtcaccacattgaaaatgttctgaaggaagatgcaagaggctcagtagtgctcggccaggtggacgctcagctcgtgccttatatcatcgatctgcagtcaatgcaccagtttcgccaggatactggaacgatgcgaccggtgcgccgaaatttctatgaccccagctcggcaccaggcaagggtatagtgtgggaatgggagaacgacggcggagcttggacagcatacgacatggacatttgcattaccattcagaatgcctacgagaagcagcacccttggctcgacctgtcctccctggggttctgttacctcatctacttcaactccatgtcacagatgaataggcagacacgaaggcgaagacgtcttagacgccgcctggacctcgcctatccccttactgtcggttccataccaaaatctcagagttggcccgtcggcgcgtcatctggccagccgtgctcatgccagcaatgcctgctggtcaatagtacccgggcggcttctaatgccattctcgcttcgcagcggcgaaaggccccaccggctcctcctctcccgccaccccctccacctggcggaccacctggagcacttgccgtacgaccatctgccacctttacaggtgcagccttatgggctgcacccgccgccgggcccgcagagcccgcaccccctcccggagctcctcccagatctcctggcgctcccggaggagcccggacccctgggcagaacaacctgaatcggcctgggcctcagcgcacaacttctgtttcagccagagcctctatcccacctggagtgcccgccctaccagtcaagaacctgaacggcaccgggcccgtgcacccagcgctcgccggcatgactggtatcctactgtgtgcggctggccttcccgtgtgcttaacccgggcccctaaaccgatcttacatccaccgccagtgtccaaatccgatgtcaagccagtgcccggggtcccgggcgtgtgccgtaaaacaaagaaaaagcacttgaaaaaatccaaaaatccggaagacgtggtgcgccgctacatgcagaaagtcaaaaacccacccgatgaagattgtaccatctgcatggaacgtctggttacagcaagcggctacgagggtgtcctccggcacaagggcgtgcgccccgagctggtcggaagacttggcagatgcgggcacatgtaccatctcttgtgcttagtggccatgtactcaaacggaaacaaggacgggagccttcaatgcccgacgtgcaaggctatttatggtgagaaaactggcacccaacctccaggaaagatggagttccacctgatcccacatagcctgcctggattccccgatacccaaacgatccgtatcgtttacgacatccccaccgggatccaaggtcccgaacatcccaatcccggaaagaagttcacagcgcgcgggtttccgcgccactgctacttgccaaacaacgagaagggacgtaaagtgttgaggctacttattaccgcttgggagcggaggctaatattcacaatagggacctctaacacgacgggtgagtctgatacagtggtgtggaacgaaatccaccataaaacagaatttggcagcaacctgaccggacatgggtaccccgatgccagctatctggacaacgttctcgcagaactcaccgcccagggcgtgagtgaggctgctgccaaggcttag

SEQ ID NO: 185160 - DNA, 1044 bp, Artificial Sequence
  Description of Artificial Sequence: Synthetic coding sequence
atgagcttcgtgctgagccggatggccgcctgcggcggcacctgcaagaacaaagtgacagtgtccaaacccgtgtgggacttcctcagcaaggaaactcccgcccgcttggctaggctaagggaagagcatagggtgtccattctcattgatggcgaaacctcggatatctacgtgttacaactgagcccacagggcccgccccccgctcccccaaatggcctgtacctcgcgaggaaagccctgaagggtcttctcaaagaggcggaaaaggagctcaagaaggcccagcgtcagggagagttaatggggtgtctggcattagggggcggcggggaacatccggagatgcatcgggccggaccaccaccactaagagctgctccccttctcccacctggagcccgtggacttccccctccacccccaccccttcctcctcctctgccacctagactgagagaagaagctgaagaacaggagagtacttgtcccatttgcctgggagaaattcaaaatgcaaaaaccctcgagaaatgcagacactcattctgtgagggctgcatcacccgggctctccaagtcaagaaggcatgccctatgtgtggacggttctatggtcagctggtaggcaaccagcctcaaaacggacgaatgcttgtgtcaaaggacgctaccttgctgttgcccagctacgagaagtatggcacgattgttattcagtacgtattccctcccggggtgcagggtgctgagcacccaaatcctggagtgcgctatcctgggaccacacgggtggcatacttgccggactgccctgaaggaaataaggtactgacactctttcgcaaagcttttgaccaacgtttgaccttcacgattgggacatccatgaccaccggcaggccaaatgtgattacttggaacgacattcaccataagacttcttgtacaggaggcccccagctgttcggctatcctgaccccacatatcttacacgggtccaggaagaattgcgtgcaaaggggattaccgatgactag

SEQ ID NO: 185161 - DNA, 1044 bp, Artificial Sequence
  Description of Artificial Sequence: Synthetic coding sequence
atgagcttcgtgctgagccggatggccgcctgcggcggcacctgcaagaacaaggtgaccgtgtcaaaacccgtgtgggattttctttccaaagagacccctgcaaggttagctcggctgagagaggagcaccgcgtctccatactgatcgatggggagaccagtgatatctacgtcctgcagctcagtccacaaggtccgccacctgcaccccctaacgggctctaccttgcccgaaaggctctgaagggccttttgaaagaagctgaaaaggaattgaaaaaggctcagcgtcagggagaattgatggggtgccttgccctgggcggagggggtgagcaccccgagatgcaccgagccggcccacccccattgcgcgcagctcctcttctgccacctggcgctcggggcctgcctccacccccaccgcctctgccccctcccctgccaccgagactccgggaagaggccgaggagcaagaatctacatgtcccatctgtctcggtgagatccagaacgctaagaccttggaaaagtgccgccattcattctgtgagggatgcataacgcgcgcactgcaggttaaaaaagcatgtcctatgtgtggtaggttttacggacaacttgtgggaaaccaaccacagaacggtcggatgcttgtatctaaagatgccacactattactgccatcatatgagaaatatggtactattgttatccagtacgtatttcccccaggcgtgcaaggcgccgagcatcccaatccaggagtccgctatcccggaaccactagggtggcttacctgcccgactgtcctgaggggaacaaggttctgaccctttttagaaaagcgtttgaccaaaggctgacgttcaccataggaacatccatgaccacaggaaggcccaatgtcataacgtggaacgatatccaccataaaacatcatgcaccgggggaccgcagttattcggctatcccgaccctacataccttacaagggtgcaagaagagctgcgcgcgaaaggcatcacagatgactag

SEQ ID NO: 185162 - DNA, 1044 bp, Artificial Sequence
  Description of Artificial Sequence: Synthetic coding sequence
atgagcttcgtgctgagccggatggccgcctgcggcggcacctgcaagaacaaagtgactgtgagcaagcctgtgtgggacttcttatccaaggagacgcccgctcggctagcccgtctgcgggaggaacatcgggtcagtattctaatagatggagagactagtgacatatatgtattacagctctcacctcaggggcctccccctgctccgccaaatggcttgtatctggctcgtaaggccctgaagggactgctgaaggaggccgagaaagagctcaaaaaagcgcagagacagggagagctaatgggctgccttgctctgggaggagggggagaacaccccgagatgcatcgtgccggcccacccccacttcgggcagctcctttgttgccccctggcgcgaggggcctgcccccaccgccaccccctttaccacctcctctgcccccaagactccgggaggaggccgaggagcaggagtccacatgtcctatttgtttgggcgagatccaaaatgcaaaaactctcgaaaagtgccgccactcgttttgcgaaggatgcattactcgggccctgcaagtcaaaaaggcctgccctatgtgcggccgcttctatggccagctggtcgggaatcagccgcaaaacggacgcatgctggtgagcaaggatgcaactctcctcctgccatcctacgagaagtatgggacaatcgtcatccagtatgtgtttcctcccggtgtacagggcgcggaacatccaaatccgggggtcagataccccggcaccacccgagttgcttacctgcctgattgtcccgagggaaataaggtgttgacgctgttccgaaaggcgtttgaccagaggctcaccttcaccattgggaccagtatgaccaccggtagacccaacgtgatcacatggaacgacatacatcacaagacttcctgcactggaggcccgcagttgttcgggtacccagatcccacttacctcacccgcgtgcaggaggagctaagagccaaagggataacagacgattag

SEQ ID NO: 185163 - DNA, 615 bp, Artificial Sequence
  Description of Artificial Sequence: Synthetic coding sequence
atgcccatcctgagcagcagcggcagcaagatggccgcctgcggcggcacctgtaaaaataaggtgactgtgtcaaagcccgtatgggattttttaagtaaggaaactcctgcccgtttggcacgattgcgggaggaacacagagtgagcatcctcatcgatggcgaaacttctgacatatacgtgttgcagcttagccctcaggggccgccgccagccccaccaaatgggttgtatttggccaggaaggcgttgaagggcctactaaaagaggccgagaaggagctgaagaaggcccaaaggcaaggagaactcatgggttgtctggcactgggtggggggggcgagcatccggagatgcaccgcgccggcccaccacctctcagagctgcaccactcttgccccctggagctcgcggccttcccccaccacccccaccgctccccccccctctgccccctaggctaagggaggaagcggaggaacaggaatcaacgtgtcccatctgtcttggggagattcaaaatgccaagacactggagaaatgccggcacagcttctgtgaaggctgcatcacccgcgcattgcaggtaaagaaggcgtgccccatgtag

SEQ ID NO: 185164 - DNA, 24 bp, Artificial Sequence
  Description of Artificial Sequence: Synthetic coding sequence
atgcccatcctgagcagcagctag

SEQ ID NO: 185165 - DNA, 1053 bp, Artificial Sequence
  Description of Artificial Sequence: Synthetic coding sequence
atgcccatcctgagcagcagcggcagcaagatggccgcctgcggcggtacatgtaagaataaggtgactgtatcaaagccagtatgggatttcttgtctaaagagactcctgcccggctcgccaggcttagggaagagcatcgggtgtcgatccttatcgatggcgaaactagcgacatctacgttttgcagctttctcctcagggacctcctcctgcgccacccaatgggctgtatctcgcacgcaaagctctcaaaggactcctgaaggaggctgaaaaggagctgaagaaagcacaaagacagggcgaactgatgggatgtctggctctggggggcggcggggaacatccagagatgcaccgggccggtcctccccctttacgcgctgctcctctgttgccgccaggcgcgcgcgggctacctccaccccccccacccctgccacctcccctcccaccaaggttgcgagaggaagccgaggaacaagagagcacttgccctatctgcttgggagaaatccagaatgcgaagacactagagaaatgtcgccattctttctgtgagggatgtatcactcgtgctctgcaggtcaagaaagcctgtccaatgtgtggtcggttttacggtcaactcgtcggcaaccaaccccagaacggcaggatgcttgtgagcaaagacgcgactcttctcctgccttcttacgaaaagtacgggactatcgttattcagtatgtatttccacctggggtgcagggagccgaacatccaaacccaggtgtgcgatatcctggaacgacacgggtggcttatctgccagactgtcccgagggcaacaaggtgcttacgctgttcagaaaggcttttgatcagcggctaacttttactattggaaccagtatgactaccggtaggcccaatgtgataacatggaacgatatccaccataagacgtcttgcactggcggacctcagctgtttggataccccgaccctacttaccttacgagagtgcaagaggaactgcgggccaaggggatcaccgatgactag

SEQ ID NO: 185166 - DNA, 150 bp, Artificial Sequence
  Description of Artificial Sequence: Synthetic coding sequence
atgagcttcgtgctgagccggatggccgcctgcggcggcacctgcaaaaacaaggttacagttagtaagccagtctgggatttcctctcaaaagagacacccgcaaggctggctcgactgcgtgaggagcatcgagtctccattctgtag

SEQ ID NO: 185167 - DNA, 2136 bp, Artificial Sequence
  Description of Artificial Sequence: Synthetic coding sequence
atgctggacggccccctgttcagcgagggccccgacagcccccgggaactccaagatgaggagagcggatcctgcctatgggttcagaagtccaagctcctcgtgatcgaggtcaaaaccatttcttgtcactattcccgaagagccccgagccggcagcccatggattttcaagcctctcattgggcacgaggatttcagaaccggacgtgtggacctagaccaggctctcctcagccgcctcctcgccgcccatgggcatcccgagtgctgcaggaagctaccaattggagagccggccccctggcagaagtaagggcacgcgagcaagagaagcgcaaagcggctagccaggagagagaggcaaaggagacggaacgcaaacgcaggaaggccggaggggcacgacgtagcccccccggtcggcctcgacctgaaccccggaacgcaccccgggttgcccagctcgccggcttacccgcccccttgagacctgagcgactggctcccgtgggccgagcacctcgaccgagtgcacaaccacagagtgaccctggaagcgcgtgggccggcccgtgggggggacggcgccctggccccccttcctacgaagctcacttgctgctccgcggtagcgccggcacagcaccacggcggagatgggacagaccccctccctacgtagcacctccttcgtacgaagggccccacaggactctaggaacgaaaaggggacctggcaattcacaggtgcctacctcctccgcccccgcagcgactccggcgagaaccgatggcggccgaacaaagaagcggctggatccaaggatatatcgtgatgtcctaggagcttggggcttgcggcagggccaggggcttctgggagggagtcccggctgcggagctgcgagggcgagaccagagccagggaaaggggtcgtggaaaagagcttaggcctcgccgccgctgacctcaacagtggatctgactcgcaccctcaggccaaagcgacgggctcagcaggcacagaaattgcccccgccgggtctgcaactgccgccccctgtgcaccgcaccccgcccctaggagccgccaccatctcaaaggttcaagagagggcaaagaaggcgaacaaatctggttccccaagtgttggattccctccccgaagaaacagccccctaggcactcccagaccctgcccaggccctgggctcctggaggaacgggctggagggaaagcctgggtcttggagaaggggccgggcccgagaccctcgagggctggaaggcaacacggcgcgctcacaccctgccgcgcagtagccagggcttgagccgcggtgagggcgtcttcgtcattgatgctacatgtgtcgtaataagaagtcagtatgtgccaacgccccgaactcagcaggtacagctgttgccatcaggggtgacacgagtggtcggagattctccatcacagtcaaagcccggcaaggaggaaggcgagggagcaacagtgttcccatcgccttgccagaaaaggttatccagctcacgactgctgcaccagcccgggggcgggcgtgggggcgaagccgaaggcggaaggcctggagactccaccctggaggaaaggaccttccggatcttaggtctccctgcccctgaggttaatctgcgggatgcgcctacccagcctgggtctccagagcatcaggctctgggacctgcggcctccggagcccagggacgcgctgagggatcggaggtagcagttgtgcagagacgcgccggaagaggctgggcccggactccgggaccctatgcaggagcactgcgggaggcggtctcccggatccggcgacatactgcgccggacagcgataccgatgaagccgaggagctttcagtccattcaggatcttcagacggcagcgacaccgaggcccccggcgcttcatggaggaacgagcggacattgcctgaggttggaaatagctccccagaggaagacggaaagaccgccgaacttagtgacagcgtgggggagatattggacgtgatcagccagacggaggaggtgttgtttggagttcgcgacattagaggtacacagcaggggaaccgaaagcgccagtag

SEQ ID NO: 185168 - DNA, 852 bp, Artificial Sequence
  Description of Artificial Sequence: Synthetic coding sequence
atgggcatctggaccagcggcaccgacatcttcctgagcctgtgggagatatatgtttctcctcgaagccccggttggatggactttatacagcaccttggagtctgttgtctggttgccctcatcagcgtcggactgttgagtgttgcagcctgctggtttttgccttcaataattgctgcggcagcgagctggattattacctgcgtgctgctatgctgctccaagcatgccagatgtttcattctgttagtgttcctgagttgtggcttgagagaaggaaggaatgccctcatcgccgcggggactgggatcgtcatccttggccacgtcgaaaacatctttcacaatttcaaaggattgctcgacggcatgacctgcaacctaagagcaaaatccttctcaatccacttccctctgctgaagaaatacattgaagccattcagtggatatatggcctggccactccattgtctgtctttgatgatcttgtctcctggaaccagaccctcgctgtgagcctcttctcccctagccatgtgctcgaggcacaactgaatgacagcaaaggtgaggttctgagcgtgctgtatcagatggctacaacaacagaggtcctgtcttcactgggtcaaaagttactggccttcgccggattgtctctcgtactgctgggcacgggactgttcatgaaacgattccttggtccgtgtggatggaagtatgagaacatctatatcacgaggcagttcgtgcaattcgacgagagagagaggcatcagcagcgcccctgtgtactccctttgaacaaggaggagcggcgcaagtttatttctggttttcaatcttag

SEQ ID NO: 185169 - DNA, 1401 bp, Artificial Sequence
  Description of Artificial Sequence: Synthetic coding sequence
atgctgaagtggcccatccccggccaggtggccctgttccagatcctccggtgtaggggcaactctaggaggacgaccgtgacgtccctaaccgtgagccaggttggccagaattttacatttgtccttacagatatcgacagtaaacagcgttttggtttctgtcggttgtcctccggggccaagtcatgcttttgcattctgagctacctcccctggtttgaggtcttctacaaacttctaaacatcctggccgactacaccaccaagagacaggaaaatcagtggaatgaactactagagacccttcataagctgccaatccccgaccctggggtctccgtgcatctttcggtacattcctattttactgtgccagatacacgtgaacttccctcaattccagagaacagaaaccttaccgaatacttcgtggcagtcgatgtgaacaacatgctccacctatatgcttcaatgctgtacgagcgaagaatcctgattatctgcagtaagctgtccacgctgacagcgtgcatacacggtagtgccgccatgttgtatccgatgtactggcaacatgtctatatccctgtgctcccgccacacctgcttgattattgttgcgcgcctatgccatatctaattggcatccatttatctctaatggagaaggtaaggaacatggcccttgacgatgttgtgatcctaaatgtcgatacaaacacattggagacccccttcgatgatctgcagtctttacctaatgacgtgatcagtagtctgaagaataggctcaaaaaagtatcgaccactacaggtgatggagtggcccgagctttcctcaaagcacaggctgcctttttcggctcttaccgcaatgctctgaagatagaacctgaggagcccatcactttctgtgaagaggcatttgttagtcactatcggtccggcgcgatgagacagttcttgcagaacgcaacacagctccaactgttcaagcagttcatagatggccgtctggacttgctcaatagcggcgagggcttttcagacgtgtttgaggaggagataaatatgggtgaatacgccggaagcgacaaactgtatcatcagtggctctctacggtccgcaagggcagcggagctatccttaacactgtgaagactaaggccaatcccgccatgaagacagtgtataagttcgccaaagaccatgcaaagatgggtattaaagaagtgaagaacagactcaagcaaaaggacattgcagagaatgggtgtgcacctacccctgaggaacaattacccaaaacagcaccgagcccacttgtcgaggccaaggatccaaagctgcgagaggaccgcagaccaatcacagtgcactttggccaagcgctgtag

SEQ ID NO: 185170 - DNA, 1680 bp, Artificial Sequence
  Description of Artificial Sequence: Synthetic coding sequence
atgggcagccggatcaagcagaaccccgagaccaccttcgaggtgtacgttgaggtggcctatccccgaaccgggggaactctatccgaccccgaggtccagcgccagtttcccgaagactacagcgaccaggaggtgcttcagacactgaccaaattctgcttccccttttacgttgatagtcttaccgtgtcccaggtgggacaaaacttcacttttgtcctcacagacatcgactccaagcaacgcttcgggttctgtcgactgagtagtggtgccaagagttgcttttgtatactcagctacttgccttggttcgaggttttttataaacttttaaacatactcgccgactatactactaagagacaggaaaatcagtggaacgaactgctggaaactctccacaaactccctattcccgatcccggtgtgtcagtgcatctcagcgttcattcttactttacagtgcctgatactagggaactgccaagcatcccagagaaccgtaatcttacagaatacttcgttgctgtcgacgttaataacatgctgcacttgtacgcatcgatgctatacgagaggaggattctgatcatttgcagcaagctgtccaccctcaccgcgtgcattcacggctcagccgccatgctttatcccatgtactggcagcacgtgtacatccccgtgctgccaccccacttactggactattgctgtgcccccatgccttacctgataggcatccacttaagcttgatggagaaggtgcgtaacatggccttagacgacgttgtgattttgaatgtcgacactaatacccttgagaccccctttgacgacctccagagtctccctaatgacgtgatctccagcctcaagaaccggctgaagaaggtgtctaccactactggagatggagttgcccgcgcttttctgaaggctcaagcagcatttttcggatcgtatcgtaacgctctcaagatcgagcctgaagagccgatcacattttgtgaggaagcattcgtctctcactacagatctggtgcaatgaggcaatttctgcagaatgccactcagctgcagctcttcaaacagttcattgatggccgcctcgatctgctcaactcgggcgaggggtttagtgatgtgtttgaggaagaaatcaacatgggagagtatgccggctccgacaaattgtaccaccaatggctgagcactgtccggaaagggagcggtgccatcttgaataccgttaagacgaaagccaacccagccatgaagaccgtctacaaattcgccaaggaccacgctaagatggggataaaagaagtgaagaacagattgaagcagaaagacatagcggagaatggatgcgccccgaccccagaggagcagctgcccaagacagccccctccccgctggtcgaagctaaagacccaaagctgagggaagaccgcaggcccattaccgtacatttcggacaagtccgccctccacggccccacgttgtgaagagacccaaaagtaatattgcagtggagggacgtcgcacctccgtcccgtcaccagaacaaaataccattgcaacccctgcgaccctgcatatcctgcaaaagagcatcactcacttcgcagctaaatttcccaccagaggctggacctctagcagccactag

SEQ ID NO: 185171 - DNA, 3030 bp, Artificial Sequence
  Description of Artificial Sequence: Synthetic coding sequence
atgggcagccggatcaagcagaaccccgagaccaccttcgaggtgtacgtcgaggtcgcttatccgcgcacaggaggaaccttgagcgaccccgaagttcagcggcagttccctgaggactatagtgaccaagaggtgctgcagactttgaccaagttctgctttcccttctacgttgactcgctcactgtcagccaggttggccagaatttcacgttcgtactcaccgatatcgactccaagcagcgtttcgggttttgtagactgagctcgggggcaaagagctgtttctgtattctctcatatttgccctggtttgaagttttctataagctgctgaatattctggctgattacacaacaaagcggcaggaaaaccagtggaacgagttgcttgagacgctgcacaaactgcctatccctgatccgggcgtctccgtgcatttgtccgtccactcctactttactgtccccgacacccgggaacttccgtcaatcccggagaacagaaacttgacggagtacttcgtcgcggtggacgtcaacaatatgctgcacctgtacgctagtatgctctacgaaagaagaatcttaattatctgctctaagctgtccacactcactgcctgtattcacggcagtgccgctatgctgtatcctatgtattggcaacatgtatacattcccgttttacctccccatctccttgattattgctgcgctcccatgccttatcttattggtatccacttgagtctgatggagaaagtgcgtaacatggcactggatgatgtcgtaatcctgaacgtagacacgaataccctggagacacctttcgacgacctgcaaagcctgccaaatgatgtaatatcctccctaaaaaacaggctgaaaaaggtgtctacaacaacaggcgatggcgtcgcgcgggcattcctgaaggcacaggcagcatttttcggctcatatcgaaatgccctcaaaattgaacccgaggaaccaataaccttttgcgaggaagctttcgtttcccactataggtcaggtgcaatgcggcagttcctgcagaacgctacccagctccagctttttaagcaattcattgacgggcgtctggatctgctgaacagcggagaaggcttctccgacgtattcgaagaggaaataaatatgggagagtacgctggctccgacaaactgtaccatcagtggctgtcgacggttcgcaaaggtagtggtgccattctcaacacggttaaaactaaggccaacccggccatgaaaaccgtatataaattcgcaaaggaccacgctaagatgggtatcaaggaagttaaaaacaggttgaagcaaaaggacatcgccgaaaatggctgcgctccgaccccggaggaacagctgccaaagactgcaccttctcccctcgtagaggccaaagacccgaagcttcgcgaagatcggagacctattaccgtccacttcgggcaggtgcggccacccagaccccatgttgtgaagagacccaaaagcaatatcgcagttgagggccgccggacgtctgtgccatctcccgagcaaccccagccatatcggaccctgcgagagtccgacagcgcagaaggcgatgaagccgagagcccagaacagcaggttcgaaaatcaacgggtccagtccctgcgccaccggatagagcggcttctatcgacctgctggaagatgtgttctccaatctggacatggaggccgccttgcagccactgggccaggccaagtcattagaagacctgcgggccccaaaggacctgcgtgagcagccaggaacgtttgactaccaacggctcgatctcggcggcagtgagcgatcgagaggggtgacagtcgccctgaagctgacccacccatataacaagctctggtcattaggacaggacgacatggccatccccagtaagccccctgccgcttctccggagaaacctagcgctctcctggggaactccctggcgctgccaaggcgcccccagaatcgtgattctattctcaatccctccgataaggaagaggtgcctactccaaccttagggagcatcactataccgagaccccagggccgaaagaccccagagctgggcattgtacctcctccaccaattccgaggcctgccaaactgcaggcggcaggcgcagctcttggagatgtctctgaaagacttcaaactgacagggaccgcagggccgccctgtcccccggtctactgcccggggtggttccacagggcccaactgagttgctgcagcccctctcccctggccctggcgcggccggcacatcatccgacgccctgttagccctcctggatccactgagcacggcctggagcggctcaaccctcccatctaggccggcgacccccaatgtggcaactccattcactcctcagttcagcttcccccctgctggcacgccaaccccattccctcagcctcccctcaacccctttgttccctccatgcccgccgctcccccaacactgccactggtcagcactcctgcaggtcctttcggggccccacccgcttctctcgggcccgcattcgcgagcgggttactgctttcctccgctggattctgcgctccccaccgtagtcaacctaatctttccgcattatcgatgcccaacctgtttgggcaaatgcctatgggcacacatacaagtccactacaacccctgggcccccctgcagtggctccttcgcgaattcgcaccctccctttggcccggagtagcgctcgggccgccgaaactaagcagggactggccctgcggccaggagatcccccacttctaccaccacggccccctcaaggcttggagccaacattgcagccctccgccccccagcaggcgagagaccccttcgaggatcttctgcagaaaaccaagcaggatgtctccccatcccctgcacttgccccagcccctgacagtgttgagcaacttcgcaaacagtgggaaacatttgaatag

SEQ ID NO: 185172 - DNA, 1590 bp, Artificial Sequence
  Description of Artificial Sequence: Synthetic coding sequence
atgctgaagtggcccatccccggccaggtggccctgttccaggaggtgctccagaccctgactaaattctgctttcctttttacgttgatagtctgacagtgtcacaggttggacagaatttcacctttgtcttgacggacatcgattcaaagcagcggttcggcttctgtcggctgtcctccggcgctaagtcatgcttctgtatcctgagctatttgccttggtttgaggtgttttacaagttgctgaatatcttggctgactataccaccaagagacaagagaaccagtggaacgagctcctggagacccttcataaactgccaattcccgatccaggggtgtccgtccacctttcagtgcactcctactttacagtgcctgacacaagagagttgcctagcattcccgagaatcggaatctgacagagtactttgtcgccgttgacgtcaataatatgctgcacttatacgccagcatgctgtatgagaggcggattttaattatctgtagtaagttgtcaaccctgacagcttgtatccacgggtctgcagctatgctctacccaatgtattggcagcatgtgtacatccctgtcctgcctcctcacttactcgattattgctgtgctccaatgccatacctgatcggtatccacttgagcctgatggagaaagtgcggaacatggccctggatgatgtagtgatcctcaacgtggacaccaataccctagagaccccgttcgatgaccttcagtcccttccgaatgatgtgatctccagtctcaagaacagactgaagaaagtcagtacgactactggagatggagtggcccgggccttcctcaaagcacaagcggccttcttcgggagttatcggaacgctctcaagattgaaccagaagagcccattactttctgcgaggaggctttcgtatcgcactaccggagtggtgccatgaggcagtttcttcagaatgccacccaactgcagctcttcaagcaatttattgatggacggttggacctgctaaacagcggggaaggattctcagacgtgttcgaggaagagatcaatatgggagaatatgctgggagcgacaagttgtatcaccagtggctgtcaaccgtgagaaagggcagtggagctatcttaaatacggttaagacaaaagccaatcccgcaatgaagactgtttataagttcgcaaaagaccacgcaaagatggggataaaggaggtgaagaacaggttaaagcaaaaggacatcgccgagaatggctgcgcacccacaccagaagaacagcttcctaaaacagccccgtcaccactggttgaagctaaagaccccaagctccgagaagatcgccgtcccataaccgtgcacttcggccaggtccggcccccaagacctcacgtcgttaaaaggccgaagtcaaatatcgccgtcgagggccgacgtacgtctgtgccgagtccggaacagaataccattgcaactcctgctaccctgcacatattacaaaagtccattacgcactttgccgcaaagtttcccactagaggctggacctcgtcgagccattag

SEQ ID NO: 185173 - DNA, 3063 bp, Artificial Sequence
  Description of Artificial Sequence: Synthetic coding sequence
atgcggcggcccggcgaccacggcctgcaggaccaggaggtgctgcagactctgactaagttctgcttccctttctatgtggacagtcttacagtctcccaggttggtcaaaactttacctttgtactgactgatatcgactcaaagcagcgtttcggcttttgccgactgagcagtggcgccaaatcgtgcttttgtattctcagctacctcccctggtttgaagtattctataaattgctgaacatcctggcagattatacaacaaaaaggcaagaaaatcagtggaatgagctgctggagacccttcacaagttgccaattcccgatcctggagtttctgttcatttgagcgtgcacagctactttaccgtgccagatacaagggagctgccttcaatccccgagaaccgcaatttaactgagtatttcgtagcagtcgatgtgaataatatgctccacctctacgccagcatgctttatgagaggaggatcctgatcatctgttcaaagctgtccaccctcactgcgtgcatacacggatcagctgctatgttgtacccaatgtactggcagcatgtatacatccccgtattgcctccccatttactggattattgctgtgcgcccatgccttatttaataggaattcacctctcactgatggaaaaggtacggaacatggccctggacgacgtcgtgattcttaacgtcgacactaatacactggaaactccattcgatgacctacagagcttacccaatgacgtgatatcttctctcaagaacagactcaaaaaggtgtcaactactactggggatggtgttgcaagggcttttctcaaggcccaagccgctttttttggcagctatcgaaacgctttgaaaattgagccagaggagcctataacattctgtgaagaggcgttcgtatctcactataggtcaggggctatgaggcagttcttgcagaatgctacacagctgcagctgtttaagcagtttattgacgggcgcttggacctactgaattctggcgaaggattcagtgatgtgttcgaggaggaaatcaatatgggtgagtacgccggctcggacaaattataccaccagtggctgagcaccgtgcgcaaggggtctggcgctattttaaacacagttaaaacaaaagccaaccccgccatgaagacagtttacaagttcgccaaggatcatgcaaaaatgggcattaaggaggttaaaaatcggctgaaacagaaagacatcgcagagaacgggtgtgcaccaactcctgaagagcaactacccaagaccgcaccatcccctctggtggaggctaaggaccccaaactcagggaggatagaaggccaatcacagtccatttcggccaggtccgaccgccgaggccccatgtcgtgaaacgtcctaaatcgaatattgcagttgaaggtcggaggacttcggtgccttcccctgagcacctcgttaaaccgttgcgtcactatgccgtttttcttagtgaagacagtagtgacgacgaatgccaacgggaggagggcccttcttccggctttacagaaagtttcttcttcagtgcacctttcgagtggcctcagccatataggacccttcgagagtctgactcagccgagggcgatgaggccgaatcccccgagcagcaagtacgaaaatcaacgggccccgttccggcccctcctgatagagctgcgagcatagatctattggaggacgttttcagcaacttggatatggaggcagcactgcaaccattagggcaggctaaaagcttagaagacctcagagccccaaaagacctgcgcgagcaaccaggaacgttcgattaccagcgcctcgatcttgggggaagcgaaaggagtaggggcgtgaccgtcgccctcaagctgacacatccttacaataaactatggtccttgggacaggacgacatggccatccccagtaaacctcccgctgcatcccctgaaaaaccttctgccttacttggcaactccctggctctgccccggcgccctcagaacagggattccattttaaatcccagtgacaaagaagaagtccctacacctactctcggctctatcacaattccaaggcctcagggccggaaaactcccgagctgggaatcgtgccacctcctcctattcccagaccggccaagcttcaggctgccggcgccgctctcggagacgttagcgaaaggctccagacagatcgcgacaggcgcgctgccctgagtcctggactgttacccggggttgttcctcaggggcccacggagctgctgcagcccttatctccaggccctggcgctgcagggacctcatctgacgctttgttagctctgctagatcccttgtccacggcttggtctgggtccaccctgccctcgcgcccagcgacacccaacgtcgcgacccctttcactccccagttttccttcccacctgcaggaacacctaccccgttccctcaacctcccttgaacccttttgtgccaagcatgcctgctgccccccccacactgccactcgtgtccactcccgccggcccattcggtgctcctccagcatctctgggaccagccttcgcatccgggttactgctgagttctgctgggttctgcgcacctcatcgcagtcagcccaacctgtccgccttgagtatgcctaacctgttcggacagatgccaatgggaacgcacacctcaccactgcagccattaggaccaccagccgttgcaccgtccaggatccgaacattgccactcgctcgcagcagtgcacgggccgccgagacaaaacagggcttggccttgaggccaggggatccgcctcttctgcccccacgcccgcctcagggattggagcccactctacaaccaagtgccccgcaacaagcccgggaccctttcgaggatttattgcagaagacaaagcaggacgtcagtccctcgccagcgctcgcacctgcccctgattcagtcgagcagctgaggaaacagtgggaaactttcgaatag

SEQ ID NO: 185174 - DNA, 2385 bp, Artificial Sequence
  Description of Artificial Sequence: Synthetic coding sequence
atgctgtaccccatgtactggcagcacgtgtacatccccgtgctgcctcctcatttgctggactattgttgtgcgccaatgccatacttgattggcatacacctcagtcttatggaaaaagtccggaacatggccttagatgatgttgtcatactgaacgtggatacgaacactctcgagaccccgtttgacgacctccagagcctccctaacgacgtagaggagcctattaccttttgtgaggaggccttcgttagccattaccgctctggcgctatgcgccagttcctgcagaacgccacccagctgcagttgtttaagcaattcattgatggcagattagacctgcttaactcaggggagggcttctcagatgtctttgaagaggagattaatatgggcgaatacgcagggtcggacaagctctatcatcagtggctaagtactgttagaaaggggtccggcgctattctcaatacagtgaaaacgaaggccaaccctgctatgaagactgtctacaagtttgccaaggatcacgccaaaatgggcatcaaggaagtgaagaacagattaaagcagaaagatattgccgagaatggctgcgccccaacaccagaggaacagctcccaaaaaccgccccctctcccctcgtggaggccaaggatccaaagctgagggaggacaggcgcccgataacagtccacttcggtcaagtgcgaccccctcgtccccacgtggtgaaaagaccaaaaagcaatatcgccgtagagggccggagaacgtctgtcccctccccggagcatttggtgaaacctttacggcattacgctgtgtttctgagtgaagactcttctgatgacgagtgtcagcgagaggagggccctagtagtggttttactgaatcgttcttctttagcgcgccctttgagtggcctcagccatatcgcacgttgcgggagtctgactccgccgagggagacgaggctgagagccccgagcagcaagtgaggaaatcaacgggccctgttccggccccccccgaccgggccgcaagtatagatcttcttgaagatgtgttctctaatctggacatggaagcagcccttcagcctctgggccaagcaaaatctctggaagaccttcgcgccccaaaagatttaagagaacaacctgggacattcgactaccaacgactggatctcgggggctccgagagatccaggggcgtgactgtcgctttaaagcttactcatccgtataacaagctctggtccctgggacaggacgacatggccataccttcaaaaccccccgcagcctctcctgaaaagccaagcgctttgctgggcaactctctggcccttccgagaaggccacaaaacagggatagtattctcaacccatctgataaagaggaggtccccactccaaccttgggaagcattaccatccctcgcccgcaaggccggaagacacctgagctagggattgtgccgccaccccctataccgcgacccgcgaagctccaggcagccggggctgcgctcggcgacgtctcagagagactacaaactgatcgcgatcgacgcgctgctctctcccccggcttactgcctggagtggttcctcaggggcccactgaactgctgcaaccgctgtctcctggcccaggggccgccggcaccagcagtgacgcgctgctggccctcctcgatccgctcagtacagcatggtcaggctcaactctgccctctcgtccggccaccccaaatgtcgcaacgccattcaccccacaatttagcttccctcccgccggaacaccgaccccatttcctcagccaccgctaaatccgttcgtgccaagcatgccagcggctccaccaacattgccactggtctctaccccggctggacccttcggggccccgcccgccagtctaggtccagccttcgcatcagggctgttgttatcaagtgcgggtttttgtgccccccatagaagtcaaccaaacctttccgctctgtctatgccaaatctgtttggacagatgcccatgggcacccacaccagtcccttgcagcctctcggtccccccgcagttgctcccagtcgtattagaactctccctttggcgcgatcgtccgccagggctgctgagactaaacagggcctggccctgaggccaggcgatccaccgctgttaccgccccgaccaccgcagggactggagcccactctccaacctagcgctccccagcaggccagggaccctttcgaggacctgttacaaaagaccaaacaggacgtctccccatccccagccctggcaccagcaccggactctgttgagcagctaagaaagcagtgggagactttcgagtag

SEQ ID NO: 185175 - DNA, 1191 bp, Artificial Sequence
  Description of Artificial Sequence: Synthetic coding sequence
atggccgccgccccccgggaggagaagcggtggccccagcccgtgttctccaaccccgtggtgttgtggaaattcccagaggacttcggcgaccaagagattctccaaagcgtgccaaagttttgcttcccgttcgacgtcgaacgagtgagtcagaaccaggtcggccagcactttacgttcgtgctgactgatatagagagcaagcagcgctttgggttctgccggctgacatcaggaggcacaatctgtttgtgtattctgtcatatttgccttggtttgaggtctattataagctccttaacacactcgccgattaccttgcaaaagagctggagaacgatctcaacgagaccttgcgttccctctacaatcatcctgtgccaaaagccaatacacctgtgaacctttctgtgcattcctattttatcgcgccggatgtaactggcctgcctaccatccctgagtcacggaatttgactgaatactttgttgcagtagacgttaataacatgctgcagttatacgcctccatgcttcacgaaagaaggatagttatcatcagctctaaattgtccacattgaccgcttgcattcacggctctgcagcgctgctgtaccctatgtattggcagcatatttacatccctgttctgcccccccatttgttggattactgttgcgcacctatgccttatctcattggaatccactcatcgctaatcgaacgagtcaaaaacaagagcctggaggatgtcgtgatgctcaatgtagacacaaacaccctggaatctcctttttccgatctaaataatctaccgagcgacgtcgtgtccgccctgaagaataaattaaaaaagcaaagtaccgcaaccggagatggggtggcccgggcttttctgcgagcacaggccgcgctttttggaagctaccgtgacgccttaagatataaacccggcgagccaatcactttttgtgaagagtcttttgttaagcatagaagcagtgttatgaaacagttcctagagacggcaattaaccttcagctgtttaagcagttcatcgacgggagactggctaagctgaatgctgggcgggggtttagcgatgtcttcgaagaggaaatcaccagcggtggcttttgcggggggaaagacaagctccaatatgactatcctttctctcagtag

SEQ ID NO: 185176 - DNA, 1281 bp, Artificial Sequence
  Description of Artificial Sequence: Synthetic coding sequence
atggactgccggaccaaggccaaccccgaccggaccttcgacctggtgttaaaagtcaaatgccacgcttccgagaacgaggacccggtggtgctgtggaagtttccagaagatttcggcgaccaggagattctgcagtcggtccccaaattttgcttccccttcgatgttgagcgcgttagccaaaatcaggtggggcagcatttcaccttcgttcttactgatatcgagagtaagcagcggttcggtttctgtcgattgacatccggcgggactatctgcctttgcatcttgtcatatttgccttggttcgaggtttactataagctcttaaacacgttggcagattatctagcaaaggagctggagaacgatttgaatgagacacttcgcagtctgtataatcatcccgtgcctaaggctaacacgcccgttaatctgagcgtgaatcaagagatatttatagcctgtgagcaggtgctgaaggatcagccagccctagtcccccatagttatttcattgcacctgacgtgacaggactgccaacgatcccagaaagtcgcaatctcactgagtatttcgtagcagttgacgtcaataatatgctgcagttgtacgcgtcaatgctgcatgagcgaagaattgtaattatttcatctaagctgtccacacttacagcgtgtatccatggttcagccgctctgctgtatccaatgtattggcagcacatttacattccagttcttcccccccacttgcttgattattgctgtgcccctatgccctacctgatcgggattcacagcagcctcatagagcgcgtaaagaataagtctctagaggacgtggtgatgcttaacgtggacaccaacacgctcgaatctcccttctcagacctgaataatctgccttcagacgttgtgtctgccctgaaaaacaagctgaaaaagcagtctacagccactggcgacggagtggcgagggctttcctgagggcccaagcagccctattcggatcttaccgcgatgctttaaggtataagcccggcgagcctataacattctgtgaggaatcattcgtgaagcaccgcagctctgtcatgaaacaatttctggaaaccgccataaatctgcagctgtttaaacaatttattgacggtcgcctggccaagctcaacgctgggcgcggcttctccgatgtgtttgaggaggagatcacctctggaggattctgcggaggaaaggataaactgcagtacgactatcctttttcacagtag

SEQ ID NO: 185177 - DNA, 1191 bp, Artificial Sequence
  Description of Artificial Sequence: Synthetic coding sequence
atggccgccgccccccgggaggagaagcggtggccccagcccgtgttttcaaatccagtcgtgctgtggaagtttccagaggactttggtgaccaagagatactgcaatctgtaccaaaattctgcttcccctttgacgtggagagagtgagccaaaatcaggttggacagcattttaccttcgttctgactgacattgagtctaaacagcggtttgggttctgtcgtcttacatctggcgggaccatctgcttatgcatcctctcataccttccttggtttgaggtttactacaagctccttaataccctagcggattatctcgccaaggaacttgagaatgacctcaacgagactttaaggtctctgtacaatcaccccgttccgaaagctaacacaccagtcaatctttcagtccatagttatttcatagcccctgatgttaccggacttccaaccattcctgaaagtcgaaacctgacggaatattttgttgccgtagatgtgaacaacatgttacagctgtatgcttcaatgttgcacgagcggcgtattgtgatcatttccagcaaactatctactttaacagcatgtatccatggtagcgctgcgctcctctatcctatgtactggcaacatatttacatccccgtactgccacctcacttgctcgactattgctgtgcgcccatgccatacctcatcggtattcactccagtctgattgagagggtgaaaaacaagtcactagaggacgtcgtgatgctgaatgtggacactaacacattggagtctccattcagcgacctcaataacttaccgagcgacgttgtaagtgccctcaagaataagctgaaaaaacagtccactgctaccggagacggtgttgcccgagcctttctgcgagcacaagcggctctattcggcagttaccgggacgccctccgatacaaacctggcgagcccatcacattttgtgaagagtcctttgtgaagcaccgaagctctgttatgaagcagtttctggagacagccataaatctgcagctctttaaacagtttattgacgggaggcttgctaagttaaatgcagggcgggggttttcggatgtctttgaggaggaaatcacaagcggaggcttctgtggcggaaaggacaagcttcagtacgactaccccttcagccagtag

SEQ ID NO: 185178 - DNA, 2268 bp, Artificial Sequence
  Description of Artificial Sequence: Synthetic coding sequence
atcgagaccaagacccgggccaaccccgaccggaccttcgacctggtgttaaaggtgaagtgccacgcttctgaaaatgaagaccccgtggtgctctggaagttccctgaggacttcggtgatcaggaaatactgcagagtgtcccaaaattttgtttcccatttgatgtcgaacgcgtgtctcagaatcaggtcggtcagcactttacgttcgtactcacagacatcgaatctaaacaacgatttgggttttgccgcttaacatcgggcggtactatctgtctgtgcattctgagctatcttccttggtttgaggtgtattacaagctgctgaacaccctggcggactacctggcaaaagagttggagaatgatctaaatgaaactctgcgctcgttatataaccatccagttcccaaggctaacaccccggttaatctgagcgtccactcttatttcatcgctccagatgtgacgggtctgccgacaatacctgagagccgtaacttgactgagtattttgtagccgtcgatgtgaataatatgttgcagctgtacgcctcgatgctacatgaacggagaatcgtaatcatttcctcaaagcttagtactcttacggcctgtatccacggatcagctgcccttctttaccctatgtactggcagcatatctatattcccgttctgcctccccatctgctagactactgctgcgccccaatgccttacctgatcggcattcattcatcactgatcgagagggtgaagaacaagagcttggaggacgtagtcatgctgaatgtcgatactaataccctcgaatcacccttttctgacctcaataatttgccgtcagatgtcgtttccgcccttaagaataagctgaaaaaacagtcaacagctacaggcgatggcgttgccagagcattcctgagagctcaggccgccctctttggaagttatcgggatgcgttgcgttataagccaggcgaacctattaccttctgcgaggagtcgttcgtgaagcacagaagctctgttatgaagcaattcctggagaccgccatcaacttgcagctgtttaagcagtttattgatggccgcctggcaaagttaaatgcaggaagagggttctccgacgtctttgaggaagagataacttccggcggcttctgtgggggtaaccctcgaagttatcaacaatgggtccatactgtgaagaagggcggggctctgtttaacaccgccatgactaaagctactcctgcagtccggactgcttacaaatttgccaaaaatcatgctaagctgggtttgaaggaagtgaagtcgaagctgaaacacaaagagaacgaggaagactacgggacttgctcgtcttcagtccagtacactcctgtatacaagctgcacaatgagaaagggggcaactccgagaagcggaaattggcccaggcacgtctgaagcggccactcaaaagtctggacggcgctctatacgacgacgaagacgacgacgatatcgagagggcgtctaagctttcttcagaggacggggaagaggcaagcgcttacctctacgagagtgatgattctgttgagactcgtgtaaaaactccttatagtggcgaaatggacctcctcggcgagatcctcgacacactttctactcattccagcgaccaaggcaaattggcggccgctaagtcactggatttttttcgctctatggatgacattgactataagccaaccaataagagcaatgctccaagcgagaataacctggcatttctgtgtgggggctctggagaccaggccgaatggaaccttggacaggacgattctgccctgcacggaaaacacctgcccccctccccgaggaaacgcgttagctcttctggcttaacagattcgttgtttatcctgaaggaagagaactccaacaaacacctgggcgccgacaacgtttctgacccaacctctggtctcgacttccagctgacctctcccgaggtgtcacaaaccgacaaaggtaaaactgaaaagagggaaaccctgtcccaaatctctgacgacttgctcatccctgggttgggtcgtcactccagtacctttgtcccctgggagaaggaaggaaaagaagctaaggagacttccgaggatattggcctactccacgaggtagtgagcttgtgccacatgacaagcgatttccaacagagcttaaacatatccgacaaaaataccaacggcaatcagacatag

SEQ ID NO: 185179 - DNA, 2328 bp, Artificial Sequence
  Description of Artificial Sequence: Synthetic coding sequence
atcgagaccaagacccgggccaaccccgaccggaccttcgacctggtactgaaggttaagtgtcacgcctcggaaaatgaagatcctgttgtgctctggaagttccccgaggacttcggagatcaggaaatactccagtcagtgccaaagttctgttttccctttgacgttgaaagagtctctcagaaccaggtagggcaacacttcacctttgtgctgactgacattgagtccaagcagaggttcggcttttgcagactgaccagcgggggcaccatctgcctgtgcatcctctcttatcttccgtggtttgaggtgtactataagttgctgaacacgttggccgattatttggccaaagaactcgagaacgatctcaatgaaacactgcggtcactatacaaccaccccgtgcccaaggctaatacacccgtcaatttgtcagtaaaccaagaaatctttattgcctgcgagcaggtgcttaaagatcagccagctctggttccacattcgtattttattgctcccgacgtgaccgggctccccacaatcccggaaagccgaaatctgactgagtatttcgtggccgtggacgtgaataatatgctgcagctgtacgcgagcatgctgcacgagcgacgcatcgttataatctccagcaaactgagtacactgacagcttgcatccatggctcagctgctttactttatcccatgtattggcagcacatctacatccctgtgctgcctcctcaccttctagattattgctgcgcaccaatgccatatctgatcggcatacactcaagcctgatagaaagagtgaaaaacaaatctctggaggacgtggtcatgttgaacgtcgatactaacacccttgaatcacctttctctgatctcaacaatttgccctccgacgtggtctccgccttgaagaacaaactcaagaagcaaagcaccgccacgggcgatggggttgctagggctttcttgcgcgctcaagcagccctatttggctcgtaccgtgatgccctccgttacaaaccgggagagcctattacgttctgtgaggagtcattcgttaaacaccgttcatccgtcatgaagcaattcttggaaaccgccattaacttgcagctcttcaagcagttcattgatggtcgactcgccaaactcaacgccggcagagggttttctgacgttttcgaggaagaaatcacaagcgggggattctgcggtgggaacccccgatcttaccagcaatgggtgcacacggtcaaaaaagggggggccctgttcaataccgccatgacaaaagcaactcccgctgtgcggaccgcttataaatttgccaaaaatcatgccaaactgggattgaaggaagtgaaatccaaattgaagcacaaggaaaatgaggaggactacggaacctgctcaagctcagtgcagtacacaccggtgtataaactccataacgagaaagggggaaattcagaaaagcgtaagctggcccaggctcgcctgaagaggcccctcaaatctttggacggcgcactctacgatgatgaagatgacgatgatatcgagcgcgctagcaaactgtcgagcgaggacggagaagaggcatccgcgtatctgtatgagagtgatgattcggttgaaaccagagtgaaaacaccttacagcggggagatggatcttctgggcgagatcctcgacaccctgtctacccactcctcagatcaaggtaagctggccgcagctaagagcctcgatttctttaggtccatggacgatatagactacaagccaaccaacaagtcaaatgccccgtctgaaaataacctggcctttctgtgtggtggctccggtgatcaagccgagtggaatctgggacaggacgatagtgcgctgcatggtaaacacctaccaccttcaccaaggaagcgggtctcgtccagtgggctcactgactctttatttattttaaaggaagaaaattccaataagcaccttggtgctgacaacgtgtcagaccccacgagtggcttggactttcaactgacgtcgcccgaggtctcccagacagacaaaggcaagaccgagaaacgcgaaacattgagtcaaatctctgacgacctgttgatccccggattagggcgccacagtagcaccttcgttccgtgggagaaagaagggaaggaagccaaagagaccagcgaagacataggcctgctgcacgaggtagtgtccctatgccacatgactagcgactttcagcagtctctcaatattagcgacaaaaatacaaatggcaatcagacgtag

SEQ ID NO: 185180 - DNA, 1248 bp, Artificial Sequence
  Description of Artificial Sequence: Synthetic coding sequence
gtgaagcaccggagcagcgtgatgaagcagttcctggagaccgccattaatctccagctgtttaagcagttcatagacggaagattggctaaactgaacgctggacgtgggttctctgacgtgttcgaggaggagatcaccagtgggggcttttgtgggggcaatccaaggtcttatcaacaatgggttcacacagtgaagaaaggcggtgccctttttaataccgctatgacgaaggccactcctgcagtcagaactgcctacaagtttgccaagaatcatgccaaactgggcctaaaggaagtgaagtccaagctcaagcacaaggagaatgaagaagattacgggacctgttctagctcagtgcagtacactccggtgtataagctccacaacgaaaagggagggaatagcgagaagcgaaaattagctcaggctaggctgaagagaccactgaaatctctggacggggccctttatgacgatgaggatgacgatgacatcgaaagggctagtaaactgtcttccgaggatggtgaggaggcctcagcctatctatacgagagtgatgactctgtggagactagggtaaaaaccccgtactccggggaaatggatctcctcggcgagatcctggatacattgtctacacactcaagcgaccagggaaaacttgctgcggccaagtcactcgatttttttcgaagcatggatgacatcgactacaagcctacaaacaaatcaaatgctccttctgagaacaatctggctttcctgtgcggcggctcaggagatcaagcagagtggaatttggggcaggatgatagcgcgctccatggcaaacatttgcctcctagccccagaaaacgcgtgagctcttccggcctgacagactcactttttatcctgaaagaagaaaattcaaacaagcatttaggcgctgacaacgtaagcgatccaacttcaggccttgacttccagttaacatcccccgaggtgtctcaaactgacaagggtaaaaccgaaaagcgggaaactttatctcagatatctgacgatttacttatccctggacttggaagacattcgtctacatttgtcccatgggaaaaagagggcaaggaggcaaaagagacgagcgaagatatcgggctcctccatgaggtggtttctctctgtcatatgacatctgatttccaacagtctctgaatatctcagataagaataccaatgggaatcagacatag

SEQ ID NO: 185181 - DNA, 2406 bp, Artificial Sequence
  Description of Artificial Sequence: Synthetic coding sequence
atggagagccgggccgagggcggcagccccgccgtgttcgactggtttttcgaagctgcatgccccgcaagccttcaagaggaccccccaatacttcgccagtttcctcctgattttcgggatcaggaagctatgcagatggtccctaagttctgttttccatttgacgtagagcgcgaacctccctctcctgcagtccaacattttactttcgccttaacagatcttgcaggaaacaggagatttggattctgcaggctccgtgccgggacccagtcatgcttatgcatcctttcgcatctcccatggttcgaagtgttttataaactcctcaataccgtgggggacctgctggcgcaggatcaggtcacagaggccgaagagcttctgcaaaacctgttccagcagtcactgtcaggacctcaggcaagcgtgggcctggagctggggagtggcgtgacagtgagctccggacagggaatacctcctccaacccggggcaatagtaaacctctatcatgctttgtggctccagactctggacgtctgcccagcattccagaaaataggaacctaactgagctggtggtggctgtaacagatgagaacattgtgggcctctttgccgccttgcttgcagagcgtagggtattgctgaccgccagcaaactatccacactgacgtcctgcgtgcatgcaagctgcgctctgctgtatccgatgaggtgggagcacgtgctgataccgacactgccaccacacctgctggattactgctgtgccccaatgccatatctgattggcgtgcacgcgagtttggccgaaagggttcgcgaaaaggcgttagaggatgttgtggtgcttaatgtcgatgctaacactctggagacaacttttaacgatgttcaggccctcccaccagacgtcgtttccctcttaaggctgcgtctcaggaaggtcgctctggctccaggggagggcgtctccagactgtttcttaaagcgcaggcactcctgttcggcggttatagagacgctctcgtgtgcagtcctggccagccagtaaccttttctgaggaagtcttcctcgcccagaagccaggtgcacctcttcaggccttccacagacgggcagtccatctacagctcttcaagcaatttatagaggcgaggctcgagaagttaaacaaaggcgaaggatttagcgaccaattcgagcaggagatcaccggatgcggggcatcaagcggtgctctgcggagctatcagctgtgggccgacaacctcaaaaaagggggcggggcccttcttcatagtgttaaagccaaaacgcagccagctgtgaagaacatgtacagatccgctaagagtggccttaagggagtccaatctctcctcatgtacaaggacggggatagcgtactccagcgtggcggttctctcagagccccagccttgccgtctcggagcgacaggctgcagcagagactgccaatcacccagcacttcggcaagaaccggcccctccggcccagcagacgccggcagctggaagagggaacaagcgagcctcctggggctggtactcccccattgagcccggaagatgaaggctgcccttgggccgaagaggccctcgattcatcttttctgggaagtggtgaggaactagatttactttctgaaatcttggattccttgtcaatgggtgctaagtcagcaggctccttacggccgagccagtcgctagattgctgccaccggggggatctcgatagctgcttctcattgcccaacatccccagatggcagcccgacgataaaaagttgccagagcctgagcctcagcccctgagtcttccaagtctgcagaatgcctctagcctcgacgctacaagttcctcgaaagactcccgctcacagcttataccatcagaatctgaccaggaggtcaccagcccaagccagtcctctaccgcctcagccgacccatctatttggggcgaccctaaaccgtcaccattaacagagcccctgattctgcaccttacccctagccataaagcggcagaggatagtaccgctcaggagaacccaactccctggctatctactgcacctactgagccaagtcctcccgaatccccccaaattttggcccccacaaagccaaatttcgacatcgcttggacgagccagcctcttgatccatcttctgatccatctagcctggaggatcccagggcaagacctccgaaagccctgctggctgaacgcgcacacctacaacctagagaggaacccggcgctttgaatagcccagccacacccacctcgaattgtcagaagagtcagccaagtagccgccctagagttgccgacttgaagaaatgctttgaaggatag

SEQ ID NO: 185182 - DNA, 2274 bp, Artificial Sequence
  Description of Artificial Sequence: Synthetic coding sequence
atgcagatggtgcccaagttctgcttccccttcgacgtggagcgggaacctccttcccctgctgtgcagcatttcacctttgcacttaccgacctagccggaaatcgcaggtttgggttctgccgtttaagagcaggtacacagtcttgcctgtgtattttatcgcacctgccctggttcgaggttttctacaaactgctgaatacggtcggtgacctgcttgcccaagatcaagtgaccgaggcagaggaactattacagaatctgttccaacaaagtcttagtggcccacaagccagcgtggggctagaattaggttctggagtgaccgtgagctctgggcaggggatcccccctcccacccgcggcaattctaaacctctgtcctgctttgtggcaccggattccggcagactaccctctattcccgagaaccgcaatctgacagagctcgtggtcgccgttacagacgaaaatatcgtggggttatttgcagcactgttagcagaacgacgggtgcttctgactgcatcgaagctgagcaccttgaccagctgcgttcatgcaagctgcgcgctgctttatcctatgcgctgggaacatgtattaatcccaacactgcccccccacctgcttgactattgctgtgctcctatgccttacctcatcggcgtgcacgcgagcttagcagagcgggtccgggagaaagctttggaggacgtggtcgtacttaacgtcgacgccaacactctcgagaccaccttcaatgacgtgcaggccttgccacccgacgtggtatctctcctgaggttgcgactacgcaaagtggccctggcccctggggagggcgtgagcagactgttcctgaaagcacaggcacttctattcggtggataccgcgacgctctggtgtgcagcccaggacagcccgtcacattcagcgaggaggtgtttttagcacagaagccaggggctcccctgcaagcattccatcgacgggcagtacaccttcaactgtttaagcagtttatcgaggcccgactggaaaagttgaataagggcgaggggttttccgatcaattcgagcaagagatcacaggttgtggcgccagctctggtgcccttagaagctaccagctatgggctgacaacttgaaaaaaggcggcggcgccctgcttcatagtgttaaagcgaagactcagcccgctgtgaagaatatgtataggagcgccaagtctgggctcaagggcgtgcagagcctgcttatgtacaaagacggcgactctgttttgcaacgtgggggctctcttcgggcccccgccctacctagcaggagtgaccggttgcagcagcgacttcctataacacagcactttggtaaaaacaggccgctgcgccctagtagacgcaggcagttggaggaaggcacctcggagcctccaggcgccggcacaccaccgttatctcccgaggacgaaggctgtccatgggccgaagaggcactcgatagttcgtttctcggttcaggagaggaattggacctgctatcagaaattctggattccctcagcatgggagccaagtctgcaggctcactgcggcctagccagtcattggactgctgtcatcgcggcgaccttgactcgtgcttctctctcccgaacatccctagatggcaaccggacgataaaaagctgcccgaacccgaaccccaaccactgagcctgcctagtctccagaacgcttcttccctcgacgccacctcatcttcaaaagatagtaggagtcagctgataccatccgaaagtgatcaagaagtgacctcgcccagccagtcgtccactgctagcgcagaccccagtatctggggcgacccgaagccttccccgctgacggagcctctgatccttcatctgactccatctcacaaggccgccgaggattccacagctcaggagaatcctacaccgtggctgtccacagcccccacggagccttctccaccagagagtcctcaaattttggcgccaacgaagcctaacttcgacatcgcatggaccagccagcccctcgaccctagcagcgatccatccagcctggaagaccctagagctcgcccaccaaaggccttgctagccgaaagggcgcatctgcagcctcgggaggagcctggcgccttgaactcccccgcgactcctaccagtaactgccaaaaatctcaaccgagctccagaccccgcgtcgccgatctaaagaagtgcttcgaggggtag

SEQ ID NO: 185183 - DNA, 2193 bp, Artificial Sequence
  Description of Artificial Sequence: Synthetic coding sequence
atgctgttcaacagcgtgctgcggcagccccagctgggcgtgctgcgtaatggctggtcctctcagtacccacttcaaagcctgttgactgggtaccaatgcagtgggaatgacgagcacacatcctacggagagacgggtgttcccgtaccccctttcggctgcacgttctcttccgcccctaatatggaacacgttctagctgtagccaacgaggaaggatttgtgcgcctatataataccgagtcacagagcttcaggaagaagtgtttcaaagagtggatggctcattggaatgccgtattcgacctggcctgggttcctggcgagctgaagcttgtgacagccgctggtgatcagaccgcaaagttctgggatgtgaaagctggtgagttgataggcacttgcaaggggcaccaatgtagtctgaagtctgtggctttctccaaattcgagaaggcagtgttctgtaccggtggtcgcgatggaaatatcatggtgtgggacactcggtgcaacaagaaggatggattctacaggcaggtcaaccagatctccggagctcacaatactagcgacaagcagacccctagcaaacccaagaagaaacagaattcaaagggcttagctccatcagtcgacttccaacagagcgttacggtggtgctgtttcaggatgagaacacactcgtgtccgcaggggctgtggacggaattattaaggtgtgggacctgaggaagaactatacggcttaccgtcaggagcctatcgcttcgaagagctttctgtacccagggtcttcaaccagaaagcttggatacagttccctgattctcgacagtacaggatccaccctgttcgcgaattgtaccgacgacaacatatatatgtttaatatgacagggctgaagacctctccggtggctatttttaatggtcaccagaactccactttttatgtgaagagttctctgagcccagatgatcaattcctcgtgagtgggagttccgacgaagccgcatacatttggaaggtgtcaaccccatggcagccacctactgttctcctaggccactcccaggaggtcactagcgtgtgctggtgccctagcgattttacaaagattgccacttgctcagacgataatacactgaagatatggaggctgaatcgaggactggaggaaaaacctggcggtgacaagctcagcaccgtgggttgggcctctcaaaagaaaaaagagtctaggcccggactcgtcacagttacttcatcccaatccacgcccgccaaggcgcctagggcaaaatgcaatcccagcaatagcagcccttcatctgccgcgtgcgccccgagctgcgccggcgatctcccactgcctagcaatactccgacattcagtattaaaacaagtccagcaaaagctcgcagcccaatcaatcggagaggctccgtgagttccgtctccccgaagccccctagctcattcaagatgtcgatccggaactgggtgacccgcacaccgagcagtagtccccctatcacaccaccagccagcgaaaccaaaattatgagtcctcgaaaggccctgattcctgtctcgcagaagagttcgcaggccgaggcctgcagcgagagtcggaatcgggtcaaaaggcggctcgactcgtcttgtctggagagtgtgaaacagaagtgtgttaagagctgcaattgtgttacagaactcgacggacaagttgagaatcttcatctcgacctgtgctgcctggcaggcaaccaggaagacctatctaaagatagcttagggccgaccaagagcagcaagatcgaaggagccggcacgtccatctcagagccacccagccccatctctccctatgcttctgagtcctgcggtacgttacctcttcctctccggccttgcggggagggatccgaaatggtcgggaaagagaacagctcgccagaaaacaagaattggctcttggcaatggcagccaagaggaaagccgagaatccatcccctcggtctcctagtagccaaacacctaacagtaggcgccagagtggcaaaaagttgccctcccccgtgactattaccccgtcctctatgcgcaagatatgtacgtatttccaccgtaagagtcaagaagacttttgtggccccgagcacagtacagagctgtag

SEQ ID NO: 185184 - DNA, 1230 bp, Artificial Sequence
  Description of Artificial Sequence: Synthetic coding sequence
atgctgttcaacagcgtgctgcggcagccccagctgggcgtgctgaggaatggctggtcttcccagtatccactgcagtcattactgaccggctaccaatgcagtggtaacgacgaacatactagttacggggaaaccggcgtgcccgttccaccattcgggtgtacatttagttccgatgacaatacgcttaaaatctggcgcctgaatcgcggcctggaggagaagccaggaggcgacaagctgtccactgtgggctgggcgtcacagaaaaagaaggagagccggccaggattagtcactgtgacctcaagtcagagtaccccggcgaaggctccccgcgccaagtgtaaccctagtaattccagtccctcttctgccgcttgcgcaccctcctgcgctggagacctcccactgccctctaatacacctacttttagcatcaaaacgtccccagccaaggctagaagtcccattaatcgccggggttccgtcagcagcgtgtcaccaaagcccccatccagtttcaagatgtccatcaggaactgggtgaccaggaccccctcctcatcacctcctataactccacccgcctccgaaaccaagataatgtcccctagaaaagcactgatacctgttagtcaaaagtcaagtcaggccgaagcatgttcagagtctagaaatcgtgttaagcgtaggcttgattcatcttgcctggagtccgttaaacaaaagtgcgttaagtcatgcaattgcgttacagaactggacggccaggtagaaaacctacatttagatttgtgttgcctggcggggaaccaggaagacctgtctaaggattcactgggccctaccaagagctctaagatagagggcgccggcacatcgatcagcgaacctccctcacctattagtccgtacgcgagcgaaagctgtggaacattgcccctccctctacggccctgtggcgaagggtctgaaatggtcggcaaggagaacagcagcccagagaacaagaactggctcttagccatggcagccaaaaggaaagctgagaatccttcaccaagaagccctagcagtcaaactccgaactcaaggcgccagagcggaaagaaactcccttcccccgtgaccattacacccagctctatgcgtaaaatttgtacatacttccacagaaaaagccaagaagatttttgcggaccagaacattctaccgaactttag

SEQ ID NO: 185185 - DNA, 2067 bp, Artificial Sequence
  Description of Artificial Sequence: Synthetic coding sequence
atgctgttcaacagcgtgctgcggcagccccagctgggcgtgctgcgtaacgcccccaatatggaacatgtgctggccgttgcaaatgaggaaggttttgtgcgtctgtacaacacggagtctcagagctttcgtaagaagtgcttcaaggagtggatggcgcactggaatgcagtgtttgacctagcctgggttccgggggaactgaaactggtcaccgcagccggcgaccaaaccgccaagttttgggatgttaaggccggggaattgatcggcacatgcaagggccatcagtgtagccttaagagtgtcgcattttcaaaattcgaaaaagctgtcttttgtaccggcggacgagacggaaacatcatggtgtgggatactagatgcaataaaaaggatgggttttacagacaggttaaccaaatcagtggagcccacaatacttctgacaagcaaacccccagcaaacccaaaaagaaacagaacagtaaagggctggcaccctctgtcgactttcagcagtcggtgaccgtggtgttgtttcaggacgagaacacactggtgtcggctggggcagtagatggcataatcaaggtttgggatctgaggaagaattatacagcttataggcaagaacccattgccagcaagtcctttctgtaccctgggagcagtactcgaaagctgggatacagctccctcatcttagattcaacaggcagtacactgtttgccaactgcaccgatgataatatttatatgttcaacatgaccggcctcaagacatcccctgttgccatctttaacggccaccaaaatagtactttctatgtaaaaagcagcctgagccccgacgaccaatttttggtgagtggaagctccgacgaggctgcatacatctggaaggtctctacaccatggcagccacctactgttctgctgggtcacagccaagaggtaacctccgtttgctggtgtccaagtgattttactaagatagcgacttgttccgacgacaacaccttgaagatctggcggctgaaccgcggacttgaggagaaacccggcggtgacaagctttcgacggtggggtgggcctctcaaaagaaaaaggaaagccgccccggattagtcacagtgacctcatcccagagtacgccagccaaggctccaagggccaagtgtaaccccagcaactcctcaccatcctctgcagcctgcgcgccctcttgtgccggcgaccttcccttgcctagcaatacaccaacattcagtattaaaacgtcaccagccaaggcacgatccccaatcaaccggcgcggctccgtatcatcagtgtctcctaaacccccctcctcctttaaaatgtccatcaggaactgggtgactcgtaccccctcttcctcccctcccattacgcctcccgcaagcgagaccaaaatcatgtcccctcggaaagctcttatacccgtgtctcagaagtcctctcaggcggaggcctgctctgagagccgtaacagagtaaagagacgcctagatagttcttgtctcgaaagcgtgaagcagaaatgcgtgaaaagctgtaattgtgtgacagagctcgacggccaagtcgagaatctccacttagatttgtgctgtctggctgggaaccaggaagacctgagcaaggattcccttggtcctaccaagagttccaagatcgagggcgcaggaacttccatcagcgaaccaccatctcctatctctccatatgcatccgagtcttgtgggactcttcccctgccactgagaccgtgcggcgaaggatcggagatggtcgggaaggaaaactcctcccccgagaataagaactggctgctcgccatggccgccaaaaggaaagccgaaaatccaagccccagatcaccctcatcacagactcccaactcaaggcgccagtctggaaaaaagctgccgtctcctgtgacgattacaccgtcctcgatgagaaaaatctgtacgtattttcatagaaagtctcaagaagacttctgcggcccagaacattcgacagaactttag

SEQ ID NO: 185186 - DNA, 1494 bp, Artificial Sequence
  Description of Artificial Sequence: Synthetic coding sequence
atgaagatcagcatcctgctgatgttcctgtggggcctgagctgcgctctgcccgttacccggtaccaaaataatgagagtgaagacagtgaggagtggaaagggcacctggctcaggcccctaccccgcccctggcaaatgaagacccctcagacagcactcagtccgaggaggggttaggctcagacgatcaccagtatatatacagactggctggtggcttctctcgaagcaccggcaaggggggagacgacaaagacgacgatgaggatgattctggggatgacacgtttggcgatgatgatagtggaccagggcccaaagataggcaggaaggggggaatagccggctcggctccgatgaggactctgatgacacaatacaagcttccgaggagtcagcgccccagggccaggattcagcgcaggatacaacttctgaatcccgcgagctcgataacgaggaccgagttgactctaagccagagggcggggattctacacaggaaagcgagagcgaagagcactgggttggaggcgggagcgatggcgaaagctctcatggagatggctcggaattggatgatgagggaatgcagagtgacgatccggaatcaatcagatcggagcgaggcaactcacggatgaacagcgccggcatgaagtcaaaagaaagcggggagaactccgagcaggccaatactcaggactctggcgggtctcagctgctggaacatccatctcgcaagattttccgaaagtcacgcatcagtgaggaggacgatcgttcggaacttgatgacaataacacaatggaggaagtcaagagcgacagtaccgagaactccaacagccgtgatactggactgtctcaaccaagaagagatagtaagggggattcgcaggaagactcaaaggagaatctttctcaggaggaaagccagaacgttgatggccctagctccgagtcctcgcaggaggcgaacctgagttctcaggaaaacagctccgaatctcaggaggaagtagtcagcgagagccggggtgataatccagaccccacgacaagctatgtcgaggaccaggaggattccgattcgtccgaagaggactctagccacacacttagtcattcaaagtccgaaagtcgcgaagagcaagcggatagcgagagtagtgagtctctaaacttctccgaggaaagccctgagtctcccgaggatgagaacagttcctctcaagagggattgcaaagtcacagttcttctgctgaaagtcaaagtgaggaatcccattccgaggaagacgacagtgactcccaggattcgtcgagaagtaaagaagatagcaactcaacggagtctaagtcctcaagcgaagaggacggacaacttaaaaacatagaaatcgaatctagaaagctaaccgtggatgcctatcataacaaaccgataggtgaccaggacgataatgactgccaggacgggtattag

SEQ ID NO: 185187 - DNA, 1542 bp, Artificial Sequence
  Description of Artificial Sequence: Synthetic coding sequence
atgaagatcagcatcctgctgatgttcctgtggggcctgagctgcgcactaccagttacaagatatcagaataatgagagtgaagatagcgaagagtggaagggtcatttagcccaggcaccaacacccccgcttgaaagcagtgagtccagcgaagggagcaaagtgtcttctgaggagcaggcaaacgaggaccccagtgatagcacgcagtctgaagaaggcctgggttcagacgaccaccagtacatctatcgactggctggcggattctcccgatccacgggtaaaggtggtgatgataaggatgacgacgaagatgactccggcgacgacacatttggcgatgatgatagcggacctggaccaaaggaccgccaggaaggagggaattcccgccttggctccgacgaagatagcgacgacaccatacaggcctctgaggaaagcgccccccagggacaggactccgcacaagacaccacctctgaatcgagagagctggataatgaggatcgggtggatagtaaaccagaaggaggcgattcaacgcaagagagcgagtctgaagagcactgggttggcggcggctccgacggggagagctcgcatggggacgggtcagagctggacgacgagggcatgcagtccgatgatcccgagtccattcggagtgaacgaggaaactcgcgcatgaacagtgctggaatgaaatccaaggagtccggagaaaacagtgaacaggccaacacgcaggatagtggtgggtcccaacttctcgagcatccttcccggaagatttttaggaaatcccgtatttccgaagaggacgatcgctctgaactggacgacaataatacaatggaggaggtcaagtctgattccacggagaacagcaattctagagacactggactttctcagccgagacgggacagtaagggggacagccaggaggattctaaagagaacctctctcaagaagaaagccagaacgtggatgggcccagcagtgagtcttcccaggaggccaacctgtctagccaggagaattcatccgaaagccaggaggaagttgttagtgagtctcggggagacaatcccgatcccacaaccagttatgttgaagatcaagaggattccgactcctccgaagaggattcaagccacaccctgagtcacagcaaatccgagtcccgagaggagcaggcagatagcgagagtagcgagtctttaaatttctcagaagagtcccctgaatctccagaagacgagaactcatccagccaagaaggtctgcagtcccacagctcctccgcagagtcccaatccgaggagagccacagtgaggaggatgattccgactcccaggattccagcagaagtaaggaggatagtaacagcactgaatccaaaagcagtagcgaggaggatggccagttaaaaaacattgagatcgagtcacgcaagctgaccgtcgacgcctatcataacaaacctataggtgaccaggacgacaatgattgtcaggacggctattag

SEQ ID NO: 185188 - DNA, 3906 bp, Artificial Sequence
  Description of Artificial Sequence: Synthetic coding sequence
atgaagatcatcacctacttctgcatctgggccgtggcctgggccattcctgtacctcagtcgaagcccttggaaagacacgtcgaaaaatccatgaatctgcacctgctggcccgatccaatgtcagcgtgcaggacgagttgaatgcttctggaaccataaaagagagtggcgtgctggtgcacgaaggggaccgcggccgccaggagaacacacaggatggtcacaagggtgaggggaacggctcaaaatgggccgaagtgggaggcaaaagcttttctacctacagcacactggcaaacgaagaaggtaatatagaaggctggaatggggatacaggtaaggcagagacctacggtcatgatgggatccacggcaaggaggagaatattactgcgaatgggatacagggacaggtaagtatcatcgataacgccggcgctacaaacagatctaataccaatgggaacaccgacaagaatacacaaaacggggacgtgggagatgccggccacaatgaagacgtggcagtggtgcaagaggacggaccccaggtagcagggagcaataacagcacagacaatgaagatgaaataatcgagaacagctgcagaaatgagggcaataccagcgagattacccctcagataaacagcaaacggaatggtacaaaggaggccgaagtcacccccgggacgggagaagatgctggtcttgacaattccgatggtagtccttccggcaacggggcagacgaggatgaggacgagggttctggcgatgacgaagatgaagaggctgggaacggaaaggatagcagcaacaactcaaaaggtcaagagggccaggaccatggtaaggaagacgaccacgattcctctatcggccagaacagcgatagcaaagagtattacgaccccgaaggtaaggaagaccctcacaacgaagtggatggcgacaagacatcaaagagcgaagagaactccgcaggcatccccgaggacaatggtagtcaacgcatcgaagacactcagaaactgaaccaccgcgaatcaaagagggtcgaaaatcggatcacaaaggaatcagagacccatgcagtcggaaaatcacaggataaaggcatcgaaattaaagggcccagctccggaaatagaaatattaccaaagaggtgggaaaaggcaatgaaggaaaggaggataaaggccaacatggtatgattctgggcaagggaaacgttaagactcagggggaagtcgtcaatattgaggggcccgggcagaaatctgaacccggaaacaaagttggtcattcgaatactgggagcgacagcaactctgatgggtatgactcatatgattttgatgataagagcatgcaaggggatgacccaaattctagcgatgagtccaacggcaatgatgacgctaatagtgagtcagacaataactccagtagcagaggcgacgcctcctacaatagcgacgagagcaaagataacggcaatggatcggattcaaaaggagccgaagacgatgacagtgactctacctctgatacgaacaacagtgactctaatggcaatggaaacaacggtaatgacgataatgataagagcgattctggaaagggaaaatcagattctagcgattccgattcctctgatagctcaaattcttcagactcctcggattcttccgacagtgactcaagtgatagtaacagcagctcggactcagacagttcggattcagacagcagcgattctagtgacagtgattctagtgactcctccaatagctcggactcctccgattcaagtgatagctctgattcatccgacagctcggacagttccgacagtaagtctgatagttccaagagtgagtcagactccagcgattccgacagcaaaagcgattcgtctgattctaatagctcggactcctcagataacagtgattcgtccgattcctcaaactcttccaattcctccgactcttcagactcaagtgacagtagcgactctagctcttcaagcgatagctctaacagttctgacagttccgactcctccgattcttctaattcctccgaatccagtgactcctctgatagttccgactcagactcctctgacagtagtgatagttcaaacagcaactcctctgatagcgattccagtaattcctcggattcatcagatagcagcaatagctcggacagcagcgatagctcagattcctccaactcttcggactccagtgattcatccgattcctccaatagctccgattcatcagattcaagcgatagcagcgatagttccgatagcagcaacagctccgattctaacgactcatcaaactcttcagacagcagcgatagtagtaactctagcgattcctcgaactcatctgattccagcgacagcagtgactctagcgacagtgacagcagcaattcgagcgatagtagcaatagttcagattcttctgattcttccaattcttcagactcatccgattcctcagattcatctgacggtagtgacagcgattccagtaaccgctctgactcatcaaacagcagcgactcctccgactcatcagatagtagtaatagctctgattctagtgactcaagtgacagtaatgagtcaagcaactcatccgacagcagcgattcgagcaactcttctgatagcgattctagcgatagctccaactcaagcgattccagcgactcatccaatagtagtgattcctcagagtcctccaactcgtctgacaactcgaactcctccgattcgagtaactcctccgacagctcagatagttcagatagctctaatagttctgacagttccaattccagcgatagtagtaatagttctgatagttcagactccaatagctccgacagctccgatagcagcaactcctccgacagtagcgactcctcagattcttcggactctagcgattccagcgacagttccaactctagtgacagcagtgactccagtgactccagtgattcctccaattccagtgactcatcgaactcctccgactctagtaattcctctgacagctccgactctagcgatagctcggatagttccgactcttcggactctagcgattcttccgattcgagtaatagcagtgacagttctgattcgtccgatagttcggattcctctgactcaagcgattcatcagactcatctgattcatctgagtccagcgacagctctgattcaagcaatagttcagacagttccgatagctctgacagttcagactcatccgactcttccgactcctccgatagcagtgattcatctgatagctccaacagctctgattccagcgattctagtgatagctctgactcctctgatagtagcaattcctcggactccagcgactcctctgaatcctctgatagcagtgactctagtgactcgagcgattccagtgacagctctgattcctcagatagctcggacagctctgattcatcaaacagcagtgacagctctgattcatcagacagttcagattcttcagatagctcagactcaagcgatagctccgacagctctgacagctccgactcaagcgattccagcgacagttccgattccagtgacagctctgattcttccgatagctcggattctaacgagagctctgattcaagcgactcctcggatagctctgacagctcgaattcctctgactctagtgacagtagcgattcttccgactcaacgtccgactcaaatgacgagagcgactcacagagcaagtctgggaatggcaacaacaatggatccgactctgattcggacagcgagggaagcgactctaatcactcaacgagcgacgactag

SEQ ID NO: 185189 - DNA, 3906 bp, Artificial Sequence
  Description of Artificial Sequence: Synthetic coding sequence
atgaagatcatcacctacttctgcatctgggccgtggcctgggccattcccgtgccccaatcaaagcccttggaaaggcatgtagaaaagagcatgaatctacacctgttagcccgctccaatgttagtgtccaggatgagcttaacgccagcggaactatcaaagagtctggggtgttagttcacgagggagatagggggaggcaggagaatacccaggatggacataagggtgaaggcaacggatcaaaatgggctgaggtcggcggaaagtcattttctacctattctacactggcaaacgaggagggcaatatcgaagggtggaatggggataccggcaaggctgagacctatggtcatgatggtatacatggcaaagaggagaatattacagctaatggaattcaaggccaggttagcataatcgataatgcgggggctacaaaccgatctaacaccaatggcaacactgacaagaatacacagaacggcgacgtcggtgacgctggccataacgaggacgtcgcagtggtgcaggaggatggcccccaggtggctggatcaaacaactctactgataatgaggacgagatcattgaaaattcttgcagaaatgaggggaacactagtgagataaccccccagattaactcaaagcggaatggcacgaaggaagccgaagtcacaccggggaccggtgaagatgctggcctcgacaactccgacgggagtccatcagggaacggagcagacgaggatgaggatgaaggctccggcgacgacgaagatgaggaagctggaaatggcaaggattccagcaataattccaagggacaagaaggccaggaccacggcaaggaggatgaccacgacagttccattggtcagaacagcgatagcaaagaatattatgacccggaaggcaaggaggatccgcacaacgaggttgatggagataagaccagtaagtcagaagaaaacagtgccgggattcctgaggacaacggctcccagcgtatagaggacacacaaaaattgaaccatcgcgagagtaaacgggtcgaaaatcggattaccaaagagtcagagacacatgccgtgggcaaatctcaagacaagggaatcgagataaaaggtccatcatctggtaatcgcaatattactaaagaggtgggaaagggaaacgaaggtaaggaggacaaaggacagcacggaatgatcctgggcaaggggaatgtaaaaacgcagggtgaagtcgtcaatatagaaggtccaggacagaagtcggagccgggcaacaaggttggccactctaatacaggatcagactccaacagtgacggttacgattcttatgatttcgatgataaaagtatgcagggtgacgaccccaacagcagcgacgaaagtaacggtaacgacgatgcgaactcagagtccgacaacaattcatcgagcaggggtgacgcaagctacaactcagacgagagcaaggataatggtaatggctccgatagcaaaggggccgaggatgatgacagtgatagcaccagcgacacgaacaacagcgactctaacggcaacggcaacaatggcaatgacgataacgacaagagcgatagcggaaaagggaaatcggattcctcggactccgattcatccgacagcagcaattcctccgatagctctgacagctctgattctgattcctctgatagtaattcctcctctgacagtgatagttctgactctgattctagcgattcctcggactcagactcctccgattccagcaattcaagcgattcaagtgacagtagcgatagctcagattcgtcggactcttctgacagcagtgattcaaaaagcgactccagcaagagcgaatctgacagctcagatagtgatagtaagagcgacagctctgattccaattcctccgactctagcgacaacagcgattctagcgactcaagtaacagctcgaactcatctgactccagtgactctagcgattcttctgacagttcatcttcgagcgactctagcaatagcagcgacagcagcgacagtagcgactctagcaactcttccgaaagcagtgatagctcagattcctccgattccgacagcagtgatagcagcgattcgagtaattctaattcatcagactcagacagttccaacagttcagacagtagcgatagcagtaattcctccgactcttccgattcatctgacagctccaacagctcagatagctccgactcttccgactccagtaattccagtgactcaagtgattcaagcgacagttctgactcctcggattcaagcaattcaagtgacagcaacgatagctctaattcaagtgattctagcgattccagtaacagcagcgattccagtaattcatcggattcatcggactcctcagattcttcagacagcgatagctccaacagctctgattctagcaactcatccgactcgagcgactctagcaattccagcgattccagcgacagctcggattctagcgatgggagcgatagcgactctagcaaccgaagtgatagcagcaattcctccgacagttcagacagctcagatagctccaattcgtcagacagctccgatagttccgacagcaatgagtcttccaatagtagcgacagcagcgattccagtaattcctccgactccgattcttctgactccagtaatagcagtgacagctctgactcttctaactcatctgacagctccgagagcagcaactccagcgacaattccaacagctcggactcttctaatagctctgactcttctgatagctcagattcttcaaactccagcgactctagtaacagcagcgacagttcaaattccagtgattcaagtgatagcaatagcagcgacagctccgattccagtaactcgtctgattctagtgacagctctgactcctcagactcttctgactctagtgatagctccaattccagcgactcttccgattcctccgattctagtgattctagtaacagcagtgacagttctaacagtagtgatagctcaaattcaagtgactcctccgactcctcggattcctccgacagttcggatagcagcgattcctctgatagcagtgacagctccaactcatcagactctagtgactcatccgactccagcgatagctctgattcttccgactcatccgattctagcgatagctcagaatccagtgacagtagtgactcatccaactcatccgattcaagcgattccagtgattccagcgattcttcagatagcagtgactcctccgattctagcgacagctccgattccagcaattctagtgattcatcggatagcagcgactcttcagatagctctgacagctccaacagctcagactcatcagactcgtcagagagtagcgactcatctgattctagtgattcctctgattcaagtgatagtagtgactccagcgactcaagcgactcttctgactccagcaactctagcgactcatctgacagctccgatagcagcgactcctctgacagcagcgatagctctgacagtagcgactcaagcgattcgtctgactcatcagacagttctgatagctcagactcctcagactcctctgatagctccgattcttcggacagcaacgaaagctcagactccagtgattcatctgactcatccgacagctcaaactcatctgactcatctgactcctccgatagttccgactctacaagtgattcaaatgatgagtcagactcacagtcaaaaagcggaaatggaaataacaacggcagcgatagtgacagcgactccgagggtagtgacagcaatcattctactagtgatgattag

SEQ ID NO: 185190 - DNA, 783 bp, Artificial Sequence
  Description of Artificial Sequence: Synthetic coding sequence
atggccaccccccccaagcggagctgccccagcttcagcgccagcagcgagggtacaagaatcaagaagatctcaatcgagggaaatattgccgccggcaagagtacatttgtcaatatactcaaacagctgtgcgaagactgggaagttgtgcccgaacctgtggccaggtggtgcaacgtgcagagtacccaggacgagtttgaagaactcacgatgtcccagaaaaacggcggcaatgttctgcagatgatgtacgagaagccagagcggtggagtttcacttttcaaacatacgcctgtctctcccggattcgcgcccagctcgctagccttaatggaaagctgaaagatgccgagaaacctgtcctgtttttcgagcgtagtgtgtactccgaccgatacatattcgccagtaatctgtatgagtctgagtgcatgaacgaaacagagtggaccatttaccaggattggcacgattggatgaacaaccagttcgggcagtcgttggaattggatggcatcatctatctgcaagccactccagaaacatgtcttcaccggatttacttgagaggaagaaacgaggagcagggcatcccactcgagtacctcgagaagctccactataagcacgagtcttggttgctgcatcggacactgaagacgaactttgactacctccaggaagtacccattttgaccttagacgtcaacgaggacttcaaggataagtacgagagtctggtggagaaggtcaaggagtttctgtccactttgtag

SEQ ID NO: 185191 - DNA, 48 bp, Artificial Sequence
  Description of Artificial Sequence: Synthetic coding sequence
atggccaccccccccaagcggagctgccccagcttcagcgccagctag

SEQ ID NO: 185192 - DNA, 834 bp, Artificial Sequence
  Description of Artificial Sequence: Synthetic coding sequence
atggccgccggccggctgttcctgagccggctgcgggcccccttcagctccatggctaagagcccacttgagggcgtttccagttctcggggccttcacgcgggaaggggacctagacgcctgtcgatcgaaggcaatattgccgtaggcaaatcaaccttcgtaaaattattgactaagacataccctgagtggcatgtggctacagaaccagtggcgacgtggcaaaatattcaggcagcaggtactcagaaagcatgtacggcccagagtttgggcaacctgctggacatgatgtatagggaacctgcacgatggagctacacattccagaccttttctttcttaagtaggctcaaggtccaattagagccctttcccgagaagctgctgcaggcgagaaagcctgttcagatctttgagagatctgtgtacagcgataggtacatctttgccaaaaacctgttcgaaaacggaagtctctccgacattgagtggcacatctatcaggactggcattcattcctgctttgggaatttgcctcacgtatcactctgcatggctttatttacctgcaggccagtccccaggtgtgtctgaagcggttataccagcgggcacgggaagaggagaaagggattgaacttgcctacctggaacagctgcacgggcagcacgaggcatggctgatacacaagacaaccaagctgcactttgaggccttaatgaacattccagtactggtgctggacgtgaacgatgatttctctgaggaggtcaccaagcaagaggatctgatgagagaggtcaacacattcgtgaagaatctttag

SEQ ID NO: 185193 - DNA, 720 bp, Artificial Sequence
  Description of Artificial Sequence: Synthetic coding sequence
atggccgccggccggctgttcctgagccggctgcgggcccccttctcctccatggccaaaagccctcttgaaggagtgtcctctagccgggggcttcatgcggggcgcggtccacggcggctgagcatcgaagggaacatcgcctgtacagcacagagcctgggaaatctgctggatatgatgtatcgcgaaccagcccgctggtcctacaccttccagaccttttccttcctgtcccgccttaaagtgcagctcgagcctttccccgagaagttgcttcaagcaaggaagcctgtccagatctttgagcgatcggtgtactccgataggtacattttcgcaaaaaacctctttgaaaatggatctctgtccgacatcgaatggcacatctatcaggattggcactctttcctgctctgggagtttgcgagcagaattaccctgcatggcttcatctatctccaggctagcccccaggtgtgcctgaagcggctgtaccagcgtgctcgggaggaggaaaagggaatcgagctggcatacttggaacagctgcacggacagcacgaagcctggctgattcacaagactaccaagctacactttgaagccctgatgaacatcccggtgctggtgctggatgttaatgatgatttttcagaggaggtgaccaagcaagaggatctgatgcgggaggtgaacacattcgtgaaaaatctgtag

SEQ ID NO: 185194 - DNA, 570 bp, Artificial Sequence
  Description of Artificial Sequence: Synthetic coding sequence
atggccgccggccggctgttcctgagccggctgcgggcccccttctctagcatggctaagtccccattggagggcgtttcttccagtcgtgggttgcatgccggccgaggacctcgtcggctatcaatcgagggcaatatcgcggtgggcaaatccactttcgtaaagctgctgaccaagacctatccagagtggcatgtcgccaccgagccagtggccacttggcagaacattcaggcggcaggcacccaaaaggcgtgcactgctcagtcattgggtaacctgctagacatgatgtatcgtgaaccggctaggtggagctacacattccagactttctcttttctctcgcgcctgaaagtgcagttagagcctttccccgaaaagctcctgcaggcgcgcaaacctgtacagatcttcgaacggagcgtgtacagtgaccggttacacttcgaagccttgatgaacatccccgtattggtgttagacgtgaacgacgacttttccgaagaagttacaaaacaagaggatctcatgcgcgaagttaatacctttgtcaaaaacctgtag

SEQ ID NO: 185195 - DNA, 768 bp, Artificial Sequence
  Description of Artificial Sequence: Synthetic coding sequence
atggccgccggccggctgttcctgagccggctgcgggcccccttctccagcatggccaagtctcccctggagggcgtatcttcatccaggggactgcacgcaggacgaggccctaggcggctttctatcgaagggaatattggcaacatcctgaagcaaattcgaatgagggccccaattcaagagacagcctgtacagcccagtccctgggcaatctgctcgacatgatgtatagagagccagcacgctggtcatatacattccaaacatttagctttttatctaggctgaaggtacagctggagccttttcccgagaaactgcttcaggcgaggaaaccagtgcagattttcgagcggtccgtctacagtgacaggtatatcttcgccaaaaatctttttgaaaacggttccctgagtgatatagagtggcacatctaccaggactggcactctttcctgctgtgggagttcgcgtccagaatcacactacacggcttcatttatctgcaagcttctccacaggtctgcctgaaacggttgtaccaaagagctcgcgaggaggagaagggcattgagttagcctacctcgagcagttgcatgggcagcacgaggcctggctaatacacaaaaccaccaagctccattttgaggccctcatgaacatccccgtgttggtactggacgtcaatgatgactttagtgaggaggtgactaagcaggaagacctgatgcgcgaggtgaacaccttcgtcaaaaatctgtag

SEQ ID NO: 185196 - DNA, 1416 bp, Artificial Sequence
  Description of Artificial Sequence: Synthetic coding sequence
atggccaagaaggtggccgtgatcggcgccggcgtgagcggcctgatttccctgaagtgttgcgtggatgagggacttgagccaacttgcttcgagaggacagaggacatcggaggagtgtggagatttaaagaaaatgttgaggatggccgcgctagcatatatcaaagtgtggtgactaacacctccaaagagatgtcctgcttcagtgactttccaatgcctgaggacttccccaattttctccacaactcaaagttgctggagtacttccgaatctttgcaaagaaatttgacctccttaagtatatccaatttcagactaccgtgctaagtgtgagaaagtgtcccgatttctcttccagcggtcaatggaaggtcgtgacccagagcaacggaaaagagcagagcgcagtctttgacgccgttatggtttgcagcggacatcatattctgccacacatccctttgaaatcttttcctggcatggaacggttcaagggtcagtactttcattccagacagtacaagcaccccgatgggtttgagggcaaacggattctcgtgattgggatgggaaacagcggctccgatattgccgtggagttgtctaaaaacgcggcgcaggtgttcattagcacgcggcatggaacttgggttatgagtagaattagcgaggatggatatccctgggacagcgtttttcataccaggttccgcagcatgctcagaaatgtgttgcccaggaccgccgttaaatggatgatcgaacagcagatgaatagatggttcaatcacgagaactatggcctagaacctcagaacaagtacataatgaaggagcctgtactaaacgacgatgttccttcgcgccttctatgtggggccatcaaggtcaagtcaacagtgaaggaactcactgagacctctgctattttcgaagatggtacagtcgaagaaaacatcgatgtgattatttttgccaccggctactccttcagcttccctttcctggaggactccctggtgaaggtggagaataacatggtttcattgtacaagtacatctttcccgcacacctagacaaatccaccctggcttgtattggcttaatccagcccctcggctccatctttcctacagccgaactgcaggccaggtgggtcacacgcgtcttcaaaggcctctgcagtctcccttctgagcgtaccatgatgatggatattatcaagagaaacgagaaacggattgacctgttcggggagagtcagagccaaaccctccagaccaattatgtcgactacctggacgagcttgctctggaaattggtgcaaagccagacttctgtagcttgctgtttaaagatcctaaactcgccgtccgcctgtactttggaccctgtaactcttattag

SEQ ID NO: 185197 - DNA, 969 bp, Artificial Sequence
  Description of Artificial Sequence: Synthetic coding sequence
atggagggcagcctggagcgggaggcccccgccggcgccctggccgctgtgctgaaacattcctccacactgccccccgagtctacgcaagtgaggggctacgacttcaaccgaggagtgaactacagagcccttctggaggctttcggaacaacggggttccaagctactaatttcgggcgggccgtacagcaggtaaacgctatgatcgaaaagaaattggagccactgtcacaggacgaggaccagcacgccgatctgacccaatccaggagacctttaactagttgtaccatcttcctggggtatacctccaatctaatctcatctggcattcgtgagaccattaggtaccttgttcagcacaatatggtcgatgtgctggtgaccaccgccggcggagtggaggaggatctgattaaatgccttgccccaacctacctgggagaattttccctgaggggaaaggagctgcgggaaaacggcattaatagaattggcaatttgctggtgcccaacgagaattattgcaaattcgaagattggctgatgcctatcctggaccagatggtgatggagcagaataccgaaggggtcaaatggaccccatctaagatgatcgccaggttgggcaaggaaattaacaaccccgaaagcgtgtattattgggcccaaaaaaatcacatccctgtgtttagccctgcacttaccgatggtagcttgggcgacatgatcttctttcattcttacaagaacccggggctggtactcgacatcgtcgaggcacaggagtttgatggctccgattcaggcgcaaggcccgatgaagcggtttcttggggcaagatccgcgtcgacgcccaaccggtcaaagtgtatgctgatgcctcactggtgtttcccttgttggtggccgagacatttgcgcagaagatggacgcatttatgcacgagaaaaacgaggactag

SEQ ID NO: 185198 - DNA, 984 bp, Artificial Sequence
  Description of Artificial Sequence: Synthetic coding sequence
atgcccatcatccccgccttctgggaggccgaggccggcggcagcagggaggaagagttcgaaactagtctggctaacatgattgaaaagaagttagagcctctcagccaggacgaagatcagcacgccgatctcacccaatctcgccggcccctcacttcttgtaccatcttcctgggctacaccagtaatttaatttccagcggcattcgagagacgatccggtacctcgtgcagcacaatatggtggatgtgctggtaactacggcagggggagtggaagaggacttgatcaaatgtctggcccccacctacctgggcgagttctccctgcgtggcaaggagcttcgtgagaatggcatcaaccgcattggcaatctgctggttccaaatgagaattattgcaaatttgaagattggttgatgcctatcctggatcaaatggttatggagcaaaataccgaaggtgtgaagtggacgccctccaaaatgatcgctcgcttgggtaaggagattaataatccagagagcgtgtactattgggcacagaaaaatcacattcctgtgtttagtccggccctgacagacgggtcccttggggatatgatattctttcattcatacaagaatccaggcctggtgctggatatagttgaagatctcaggttgatcaacacccaggccatcttcgccaagtgtacaggcatgatcatcttgggcggcggggtagtgaagcaccacattgcgaatgcaaacttgatgcgaaatggcgccgattacgccgtctatatcaacacagcccaggagtttgacgggtcggattctggcgctcggcccgacgaagccgtgtcctgggggaagatccgggtggacgcccagcctgtaaaagtgtacgccgacgctagtctcgttttccctctcctcgtcgccgagacattcgctcagaagatggatgcgtttatgcacgaaaagaacgaggattag

SEQ ID NO: 185199 - DNA, 462 bp, Artificial Sequence
  Description of Artificial Sequence: Synthetic coding sequence
atgccccagctgtgcacccgggccagcagcagcgagatccccggccggctgctcaccactctccaaagtgcacaaggacagaagtttctccatttcgcaaagtccgacagcttcctggacgacatctttgccgcatggatggcccagagactgaagacccatctgctgactgaaacctggcaaaggaaacgacaagaactgccatcaaactgcagtcttccataccacgtatataatatcaaggcgattaagctcagtagacactcctattttagttcttatcaggatcacgcgaagtggtgcatctcccaaaaaggtaccaagaaccggtggacttgcataggtgacctaaaccggtctcctcaccaggcgtttagatctggtggattcatctgtacccagaactggcagatctaccaggccttccagggtctggttctgtattacgagtcctgtaagtag

SEQ ID NO: 185200 - DNA, 1086 bp, Artificial Sequence
  Description of Artificial Sequence: Synthetic coding sequence
atgaagcagaagatgatggcccggctgctgcggaccagcttcgccctgctctttctcggcctcttcggcgttctcggagccgctaccatctcctgccgcaatgaggagggaaaagccgttgactggtttacattttacaaactcccaaaacgccagaataaggaatctggtgagactggtttggagtatctctatctcgattcaaccacccggtcctggcgaaaaagtgagcaactgatgaatgacaccaagagcgtgctggggcgcacactgcagcaactctacgaggcttatgcaagcaagtccaataacactgcctacctcatctataacgacggagtgccgaaacctgttaactacagtcgaaagtacgggcatacaaaaggcctcttgctgtggaatcgcgtgcagggtttctggcttattcattcaattccccaattcccgcccatcccagaagaaggttatgactaccccccaaccgggaggcggaacggccagtccggaatttgtataaccttcaagtataatcagtacgaagccatcgactcccaactcctcgtgtgtaacccaaacgtgtattcatgttctattccagctactttccaccaagaactcatccacatgccacagctgtgtacccgcgcatcttccagcgaaatcccagggagattactaaccaccctccaatctgctcaggggcagaagttcctccacttcgctaaaagtgattcctttctggacgatattttcgctgcctggatggcgcagcggctgaagacgcatctattaactgagacctggcaacggaagcggcaggagctcccatccaattgttctttaccataccacgtctataatatcaaagctattaaattatccagacacagctactttagtagctatcaagaccacgctaaatggtgcatctcccagaaggggacgaagaaccgttggacctgtataggagaccttaatcggagcccccaccaggctttcaggtcgggaggcttcatctgcactcagaattggcaaatttatcaagcatttcaaggcctggtcctctattacgaatcttgcaaatag

SEQ ID NO: 185201 - DNA, 1317 bp, Artificial Sequence
  Description of Artificial Sequence: Synthetic coding sequence
atggccctgcggggcgtgagcgtgcggctgctgagccggggccccggtttacacgtccttcgaacatgggtcagctctgccgcccagactgagaagggcggtcggacccaaagccagctcgctaaaagttccaggccagagttcgactggcaagatcctcttgtccttgaagagcagctaactaccgacgaaatcttgatccgagacactttcaggacttactgccaagagcgcctcatgccaaggatcttgctggctaatcggaatgaagtgttccaccgagagattatttccgagatgggcgaacttggcgtgttaggaccaacaattaagggttacggatgtgccggcgtcagttccgtcgcctacggactactggctcgtgaactagagagagtagattctgggtataggtccgctatgtcagtgcagtccagcttggttatgcaccccatatatgcatacggcagtgaggaacagcgccaaaaatatctgccccagcttgcaaagggcgaactcctaggatgtttcggcctgactgagccaaattccggttctgaccccagttctatggagactcgcgctcactataacagctccaataaatcttacaccttgaatggtacaaagacgtggataacaaatagcccaatggcagacctgtttgttgtatgggcgcggtgcgaagatggatgcattagaggcttcttactggaaaagggtatgagaggattgagcgccccacgaattcaggggaagttttctctcagggctagcgccaccgggatgattatcatggacggagtggaagtgcccgaggagaacgtgctccccggcgccagctccctgggcggaccttttggatgtctgaacaatgctagatacggaatcgcttggggggttttgggtgcctctgagttctgcctacatacggctaggcaatacgcccttgatcgaatgcaattcggagtgcccctggcacgcaaccagctgatccagaagaaactggctgacatgttgaccgagattacacttgggttgcacgcctgcctacaactcgggcggttgaaggaccaggacaaggctgcccctgagatggtcagcctactgaagcgtaacaactgcggcaaggccctggatattgctagacaagcaagagatatgctcggaggaaacggaatcagcgacgagtaccacgtaataagacatgccatgaatctcgaggccgtgaatacgtacgagggaactcatgatattcatgccctcatactcgggagagccattacaggaatccaggcctttacagcatctaagtag

SEQ ID NO: 185202 - DNA, 918 bp, Artificial Sequence
  Description of Artificial Sequence: Synthetic coding sequence
atgatccccctgctgctggccgccctgctgtgcgtgcccgccggcgcattaacttgctacggagattcagggcagcccgtcgattggtttgtggtgtacaaactgcctgcattgcggggatctggagaggcagcccaacgcggactgcaatacaaatatttggatgagagctcggggggctggcgggacggacgcgcactgatcaactccccagagggggccgtgggacgcagcttgcagccgctataccgcagtaacacctctcagttggccttcttgctctacaacgatcagcctccacaaccctccaaagcgcaggactcttctatgcgcggacataccaagggcaagcagctcacgtatacatacccttgggtgtacaattaccagctggaggggatcttcgcccaggaattccccgacctcgaaaacgtggtcaagggtcaccacgtgagccaggaaccctggaactccagtataaccctcactagccaggcaggggccgtgttccagagttttgctaagttcagcaaattcggtgacgatctttatagtggctggcttgccgcagccctgggcactaaccttcaagtgcaattttggcacaaaacagtaggcatcctgccaagtaactgttctgacatttggcaagttttgaatgtaaatcagatagctttccccggccctgccggacctagctttaatagtacagaggaccacagcaaatggtgtgtaagtccaaaaggtccttggacttgtgtcggtgacatgaaccgtaatcaaggtgaagagcaacggggaggcgggacgctttgcgcccagctgcccgctttgtggaaagccttccagcccctcgtgaagaattatcagccctgcaatggcatggccagaaaacccagcagagcctataagatctag

SEQ ID NO: 185203 - DNA, 909 bp, Artificial Sequence
  Description of Artificial Sequence: Synthetic coding sequence
atgcactaccccaccgccctgctgttcctgatcctggccaacggcgcccaggcattcaggatctgcgcctttaacgcccagaggctgacactcgctaaggtggcaagggagcaggtcatggacactctcgtcagaatcctggcgcgttgcgacatcatggtcctccaggaggtagtggactccagtgggagcgcgattcccctgctgctgcgagaactcaatcggttcgatggaagtggaccatattcgaccctgtccagcccgcagctggggcgaagtacttacatggaaacatacgtctatttctatcgctcacacaaaacccaagtactcagttcctatgtgtacaatgacgaagacgacgtgttcgccagagaaccatttgtggcacaattctctctgccctctaatgtgctgccaagtttagtgctggttcctctgcatacaacccccaaggccgttgaaaaggagctgaatgcactatacgacgtctttttggaggtctctcagcactggcagtccaaggacgtcatactcctcggcgatttcaacgctgactgtgcttcacttacaaaaaaacggctagataaactggagcttagaactgaaccaggcttccactgggtgatcgccgacggtgaggacacaacagtgagagcatccacccactgtacatatgatcgcgttgtattgcacggtgaaaggtgtagaagcctcttacacaccgccgccgccttcgattttccaacctcctttcaattgacagaggaggaggctctgaatatatccgatcattatcccgtcgaagtggagctgaaattgtcccaagcccacagcgttcagcccctgagcctgacagtgctcctgctcctctccctccttagtccccagttgtgtcccgccgcctag

SEQ ID NO: 185204 - DNA, 909 bp, Artificial Sequence
  Description of Artificial Sequence: Synthetic coding sequence
atgcactaccccaccgccctgctgttcctgatcctggccaacggcgctcaggcttttaggatttgcgccttcaacgctcagagattaacacttgcaaaggtggcccgggagcaggttatggacaccctggtgcggattctggcccgatgtgatattatggtgcttcaggaggtggtggattcctcagggtccgctatcccattgctattaagagagctaaatcgatttgacgggagcgggccttacagcaccctgagcagcccacagttggggaggtcaacctacatggagacatacgtatacttctaccgcagccataaaacacaggtgctctcctcctatgtttataatgatgaggatgatgtgtttgctagagagcctttcgttgcacagttctcgctgccatccaatgtgttaccgtctctcgtcttggtgccactgcacaccacccctaaggctgtggagaaagagctgaatgcactgtacgacgtcttcttggaggtgtcccagcattggcagtcaaaggacgtgattctgctgggggacttcaatgccgactgcgcaagcctgacgaaaaaacgactagataagttggaacttagaactgagcctggatttcattgggtcatagcggatggggaagacactactgtgcgggcttcgacccattgcacgtacgaccgggtcgtacttcatggagagcgatgtagatctcttctgcatactgcggcggcatttgatttcccaacatccttccaactcactgaggaagaggctctaaatatttctgaccactatcccgtggaagtagaactgaaactttcacaggcacactccgtccaacctctctctttgacagtgctcttgctcctgtccctgctctccccacaattatgcccagccgcttag

SEQ ID NO: 185205 - DNA, 909 bp, Artificial Sequence
  Description of Artificial Sequence: Synthetic coding sequence
atgcactaccccaccgccctgctgttcctgatcctggccaacggcgcccaggcttttaggatttgcgcatttaatgcgcagcgcttgactcttgcaaaagtggccagggagcaagtcatggacacattggtgagaattctagctagatgtgacattatggtactacaggaagttgtggactcatcggggagcgccattcccctcttactgagggagttaaacaggttcgacggatcgggtccatactccactctcagcagtccacagctgggccgaagtacctacatggaaacctacgtgtacttctatagaagccacaagacacaggttctcagttcttacgtatacaacgatgaggatgatgtgtttgcccgcgaaccctttgtggcacagttcagtctgccgagcaatgtgctccccagcttggttctggtaccactgcacaccaccccaaaggcagtggagaaggagctcaatgccttatacgatgtctttctggaagtatctcaacactggcaatccaaagacgtgattctgctgggagattttaatgctgactgtgcttccttaacgaagaagcggttagataaactggagctgcgaaccgaacccggattccactgggttatcgcggacggtgaggatacgacagtgcgggcaagtacgcactgcacatacgacagagtagtgctgcatggtgaacggtgccgatctcttcttcacactgcggccgcattcgatttccctacctcttttcagttgaccgaagaagaggccctcaacatttctgatcattaccccgtggaagtggagctaaagctttcacaagcacactctgtgcagcctctatcccttactgtgctgctcctattgtcattgctttccccccagctctgcccagccgcctag

SEQ ID NO: 185206 - DNA, 909 bp, Artificial Sequence
  Description of Artificial Sequence: Synthetic coding sequence
atgcactaccccaccgccctgctgttcctgatcctggccaacggcgcacaggcattcagaatatgtgcgttcaacgctcaacgcctgaccctggccaaagtggcccgcgaacaagttatggataccctggtgagaatcctggcgcgatgtgatattatggtccttcaggaggtggtggattcctccgggagcgctataccactgcttctgcgggagctcaaccgcttcgacggtagtggcccatactccactttgtcttcacctcagctaggtagaagcacctacatggagacctatgtttacttctacaggtcgcataaaacgcaggtcctgtcctcttatgtttataatgacgaggacgacgtgttcgctcgcgagccttttgtggctcagttctctctgccctctaatgtgttgccctcattggtgctggtcccgcttcataccactcccaaagccgtggagaaagaactgaacgcactgtacgatgtattcctcgaagtgtcccagcattggcaatctaaggacgtcatcctcctgggggactttaatgctgattgcgcatctctcactaaaaagagattagacaaactggagttgcgcaccgaacccggctttcactgggtaatagccgacggcgaagacaccaccgtgcgggcctctactcactgcacttatgacagagtcgtgctgcatggagagcggtgccgaagcctactgcatacagcagccgcatttgacttcccaacgtcttttcaactgaccgaagaggaagctctcaatatttccgatcactatcctgttgaggtggaactcaagctatcccaggcgcacagcgtacagcccctgtcactcacagtgctgttgctactgagcttactctccccccagttgtgccccgcggcatag

SEQ ID NO: 185207 - DNA, 909 bp, Artificial Sequence
  Description of Artificial Sequence: Synthetic coding sequence
atgcactaccccaccgccctgctgttcctgatcctggccaacggcgcccaagcctttaggatctgcgcctttaacgcccagcggctgaccctcgccaaagtcgccagagagcaggtgatggatactttggtgcgcatcttggccaggtgcgacatcatggttttacaggaagtggtggattctagtggctcagccatccccttgctcctgagagagctaaaccgttttgatggaagcggcccctattccacactgtcttcacctcagctgggtcgaagcacttatatggaaacctacgtgtatttctataggtctcacaagacccaggttctttcttcgtacgtgtataacgacgaagacgacgtgttcgcccgcgagccctttgttgcacagttttctctgcccagtaacgtcctcccaagccttgtgcttgtcccccttcacacaactcccaaggcggttgagaaggagctaaacgctctctacgacgtgttccttgaggtatctcagcattggcagagtaaggacgtgatcctccttggcgactttaacgccgattgcgcctctctgaccaagaagcgtctggacaaacttgagttgagaacagagcccggcttccactgggtgattgctgatggcgaggacacaactgtcagagccagcacacactgtacctacgatcgtgtagttctgcatggggaaagatgccgttcccttctccacaccgcagcagcctttgatttcccaaccagctttcagctcaccgaagaggaagcccttaacatatctgatcattatcctgttgaggtcgagctgaagctatcacaggcacactctgtacagcctctgagtctgaccgttctgttactcctgagtctgctgagtccacagctttgtccagctgcatag

SEQ ID NO: 185208 - DNA, 909 bp, Artificial Sequence
  Description of Artificial Sequence: Synthetic coding sequence
atgcactaccccaccgccctgctgttcctgatcctggccaacggcgcacaggctttccggatttgcgcattcaacgcacagagacttaccttggcaaaagtagcccgggagcaggtgatggacaccctcgtgcgtatcctggcgcggtgcgatatcatggtcctgcaggaggtcgtggactcaagtggatcggcgattccactcctgctgcgcgaactaaatcgctttgacggttctggtccgtactctaccctcagctcgcctcaacttggccggagcacctacatggaaacatacgtctatttttaccgatcccataaaacccaggtgctgtcttcctatgtctacaacgacgaagatgatgtctttgccagggaaccattcgtcgcccaattcagcctcccttcaaacgtgttgccatctctggtacttgtccccctccacactaccccaaaggccgtagaaaaggaattaaacgccttgtatgatgtctttctggaggtatcacagcactggcagtctaaggacgtgattctgttgggcgatttcaatgccgactgtgctagtctcacgaagaaaaggctggacaaattggagctgagaactgagccaggattccactgggtaattgcagacggggaggacactacggtgcgagcgtcgacacactgcacctacgacagggtcgtgttgcacggtgaacgatgcagaagccttctccatacagccgccgccttcgacttcccaacttctttccaactaacggaagaggaggccttaaatattagcgatcactatccagtggaagtcgagttgaagctgagtcaggcccatagtgttcagccactttctctgaccgtactgctcttgttgtctctgttatccccgcagctgtgcccggccgcctag

SEQ ID NO: 185209 - DNA, 315 bp, Artificial Sequence
  Description of Artificial Sequence: Synthetic coding sequence
atgcactaccccaccgccctgctgttcctgatcctggccaacggcgcccaggcattccgcatctgtgcgtttaatgcccaacggctgacccttgccaaggtcgctagagaacaagtcatggacacactcgtgcggatcctcgcgcgctgtgatataatggttctgcaggaggtagtggattcttccggctcggctattcctttgctgctgagggaactgaaccggtttgacggttccggcccatactctaccctgagttcccctcaacttggcaggagcacttatatggaaacttatgtgtacttctacaggtag

SEQ ID NO: 185210 - DNA, 81 bp, Artificial Sequence
  Description of Artificial Sequence: Synthetic coding sequence
atgcactaccccaccgccctgctgttcctgatcctggccaacggcgcacaggccttccgaatttgtgcgtttaacgcatag

SEQ ID NO: 185211 - DNA, 627 bp, Artificial Sequence
  Description of Artificial Sequence: Synthetic coding sequence
atgcactaccccaccgccctgctgttcctgatcctggccaacggcgctcaggcatttcgtatctgtgcattcaatgcccagcgcttgacgttggccaaagtggcccgcgagcaggtgatggacacactcgtacgtatccttgctcggtgtgacattatggtgctacaagaagtggtggatagttctggaagtgctatcccactcctgctgcgggaactgaatcgattcgacgggtcaggaccttattcgaccctgtcatctccgcagctagggaggagtacatatatggagacctatgtttatttttacagatcacacaagactcaagtcctctcaagctatgtgtacaacgatgaggacgacgtgtttgcccgggagccattcgtggcccagttttccctcccgtcaaacgttctccctagcttagtcctggttccactccacacgactcccaaagctgtagaaaaggagcttaatgccctctatgacgtctttctggaggtctctcaacattggcagtcgaaggacgtcatactcctcggggatttcaacgctgactgtgcttccctgaccaagaagcgcctggataagcttgaactaaggactgagcccggatttcactggtag

SEQ ID NO: 185212 - DNA, 918 bp, Artificial Sequence
  Description of Artificial Sequence: Synthetic coding sequence
atgagccgggagctggcccccctgctgctgctgctgctgagcatccattccgcccttgctatgagaatttgcagtttcaacgtcagatccttcggggagtccaaacaggaagacaaaaatgccatggacgtgatcgtcaaggtaattaaacggtgcgatattatcctggtcatggagatcaaggactcaaacaatcgaatctgccctatcctgatggaaaagctaaatcgcaatagcagacgtggtataacttataattacgtcatctctagcaggctgggtcgcaatacttacaaggaacagtatgcatttctttataaggagaagctggtttctgttaagagaagctatcactatcacgattaccaggacggagacgccgacgtgttcagtcgagagccctttgtggtgtggttccagagtcctcacaccgccgtgaaagactttgtgattatccccctgcacacaacacccgagacatctgtgaaagaaatagacgaactggtggaggtatacactgacgtcaaacacaggtggaaggctgagaacttcattttcatgggcgacttcaacgccggctgctcctacgtgcccaagaaggcctggaagaatatcaggctgagaaccgatcctcgtttcgtctggctgatcggcgatcaggaagatactaccgttaaaaaaagtactaactgtgcttatgatcgaatcgtcctgcggggccaagaaatcgtgagtagcgttgtgcccaagtccaactcggtttttgacttccaaaaagcctacaagctcacagaggaggaagcattggacgtatccgaccactttccagtcgagtttaagctgcagagctctcgcgcgttcaccaacagcaagaagtccgtgaccctaagaaagaaaaccaagtctaagagatcctag

SEQ ID NO: 185213 - DNA, 918 bp, Artificial Sequence
  Description of Artificial Sequence: Synthetic coding sequence
atgagccgggagctggcccccctgctgctgctgctgctgagcatccactccgccctggctatgcggatatgctctttcaacgtgagatccttcggggaatccaagcaggaggacaaaaatgctatggatgtaatcgtgaaggtgatcaagcggtgcgatatcattctcgtgatggagattaaggactctaacaatcggatctgccccatccttatggagaaactcaacaggaacagcaggaggggcatcacctacaactacgtaatcagttcccgattaggaaggaacacatacaaggaacagtacgccttcctctacaaggagaagctggtttcggtcaagcgctcttatcattaccacgactaccaggatggcgatgccgacgtgttttctcgagagccctttgtggtgtggttccagtccccacataccgccgtgaaagattttgtgatcattccgctccacacgacacctgagaccagtgttaaggagatcgatgagctggtcgaagtttataccgatgtgaagcacaggtggaaagctgaaaacttcatcttcatgggtgattttaatgccggctgtagctatgtgccgaaaaaagcctggaagaacatccggctgaggacagacccgaggttcgtgtggctgattggggatcaggaagataccaccgtcaagaaatctacgaactgtgcctacgaccggattgtgctgaggggccaggaaatagtgagtagcgtcgtgccaaagtccaactctgtgttcgactttcaaaaggcctacaaattaaccgaagaagaggctctggacgtttccgaccattttccagtggagtttaagctgcagtcatctagggcctttactaatagcaaaaaatcagtaaccctaaggaaaaagaccaagtccaagcgaagctag

SEQ ID NO: 185214 - DNA, 867 bp, Artificial Sequence
  Description of Artificial Sequence: Synthetic coding sequence
atgagccgggagctggcccccctgctgctgctgctgctgagcatccacagcgctttagccatgcgcatctgctcatttaatgtaagatcattcggcgagagcaaacaggaggataaaaacgcaatggacgtgatagtgaaggtgatcaaacgctgtgacatcattctggtcatggaaataaaagatagcaacaatcgcatatgccctatactcatggagaagctgaacaggaatagccggcgcggaatcacttacaactacgtgatcagctctcgactgggccggaatacatacaaagagcagtatgcatttctctacaaagagaaattggtgtcggtgaagaggtcttaccattaccatgattaccaggatggtgacgcagacgttttcagtcgagagccctttgtggtatggtttcagtctcctcataccgccgtgaaagattttgtgatcatacccctgcacaccaccccagaaacctcggttaaggagattgatgaactggtagaagtttacaccgacgtgaagcatcggtggaaagccgagaatttcatctttatgggcgatttcaatgcggggtgcagttacgtgcctaaaaaggcctggaagaatattcgactgcggacagatccacgattcgtgtggcttatcggagatcaggaagatacaactgtgaagaagagcacaaactgtgcctacgatcggatcgtactgagaggccaggagattgtgtctagcgtggtccccaagtctaatagcgtgtttgattttcaaaaggcttacaagctcaccgaggaagaggtccggcttccgagttgcctgtccatgccgctgtcttggaaggacgagttggcttgggctacttag

SEQ ID NO: 185215 - DNA, 303 bp, Artificial Sequence
  Description of Artificial Sequence: Synthetic coding sequence
atgagccgggagctggcccccctgctgctgctgctgctgagcatccactctgcacttgctatgcgtatctgttcctttaacgtgcgttcattcggagaatcgaagcaagaagataaaaatgctatggatgtgatagtgaaagtgatcaagaggtgtgacattattttggtgatggagataaaggacagtaacaatagaatctgccctattttaatggaaaaactcaatcggaattcccgcagagggattacatataattacgtcataagtagccgcctcgggcgcaatacgtataaagagtag

SEQ ID NO: 185216 - DNA, 828 bp, Artificial Sequence
  Description of Artificial Sequence: Synthetic coding sequence
atgagccgggagctggcccccctgctgctgctgctgctgagcatccacagtgcacttgcaatgagaatttgcagcttcaatgtgcgttcttttggcgaatctaaacaggaagacaaaaatgccatggacgtaattgtaaaggtgattaagcggtgtgatattatattagtgatggaaattaaagactctaacaaccgtatctgtcctatcctgatggagaagctcaatcgggagaagttagtctcggtcaaacgctcataccactatcacgactatcaggacggagacgccgatgtcttctcaagagagccatttgttgtctggttccagagtccccacacagccgtgaaggattttgttattattccactccatactacgccagaaacatcagtgaaggaaattgacgagctagtagaagtttacaccgatgtgaaacatcggtggaaggcagaaaattttatcttcatgggggactttaatgccgggtgctcatacgtgcctaagaaggcttggaaaaacatccgtctacgcactgaccctagatttgtttggttgataggcgatcaggaggataccacggtcaaaaagagcaccaactgcgcctacgaccgaatcgtgctgagagggcaggagatcgtatcttcagtggtgcctaagtccaactctgtgttcgatttccagaaagcttataagctgaccgaggaagaagcgctcgatgtttccgaccacttcccagtcgagtttaaattacagagctcccgggcgttcaccaactcaaaaaagtcggttactctgcgtaagaagacaaagtcgaagcggtcgtag

SEQ ID NO: 185217 - DNA, 753 bp, Artificial Sequence
  Description of Artificial Sequence: Synthetic coding sequence
atgacccccctgtgcccccggcccgccctgtgctaccacttcctgacatcactcttacgaagcgcaatgcagaatgccaggacagccgaaggccggagccgggggaccctgcgcgcaaggccggccccgcgtcctgccgctcagcacggtattccccgcccgctgagctcagcaggaaggctctcccagggatgccgtggcgccagtaccgtaggagctgctggatggaaaggggagcttccaaaagccggcggcagccccgctccgggaccggagacacctgcaatttccccctccaaacgagctagaccagccgaggtcggaggaatgcaactcaggtttgctcgactatccgaacatgccaccgcccctacgcggggctcagcacgcgccgctggatacgacctctattccgcgtacgattacacaatcccgcccatggaaaaggcagtggtaaaaacagacatacagatcgccttgccttcagggtgctacggcagagtggccccccgctccggactggccgccaagcactttatcgatgtgggcgccggggtgatcgatgaagattaccgcggcaacgtgggcgtagtcttgttcaatttcgggaaagagaagtttgaggtgaaaaagggcgatcgaattgctcagctgatttgcgaacgaatcttctaccccgaaattgaagaggttcaagccctcgatgacacagaaagaggatctggaggatttggttcaaccggaaaaaactag

SEQ ID NO: 185218 - DNA, 759 bp, Artificial Sequence
  Description of Artificial Sequence: Synthetic coding sequence
atgacccccctgtgcccccggcccgccctgtgctaccacttcctgacctccctgctccggtcagccatgcagaacgcgcgtggcgcccgccagcgggcagaggcggccgtactctccggcccgggtcccccattaggaagggctgcccaacatggaatccctcggcccctttcttcagccggaaggttgtcgcaagggtgccgaggggcttcaacggtgggcgctgccggttggaagggtgaactgcctaaagcaggagggtcccctgcccctggacctgaaactcccgcgatctcaccatctaagcgcgcgagacccgccgaggtaggcggaatgcagctacgattcgctaggctgagtgaacacgctaccgcgcctacaagaggatcagcccgagccgcagggtacgacttatactcagcttatgactatactatacctcctatggaaaaggccgtggtcaaaaccgatattcagatcgccctaccgagcggctgctacggccgagtggccccccgctctggactggccgccaagcactttattgatgtgggtgccggagttattgatgaggattatcggggaaatgtcggagtagttctgtttaacttcggtaaggagaagtttgaggtaaagaaaggcgaccgcatagctcagttgatctgcgagcgcatcttttaccctgagatagaagaggtccaagcgctcgatgatacggagcgcggctccggaggattcgggagcaccggtaagaactag

SEQ ID NO: 185219 - DNA, 495 bp, Artificial Sequence
  Description of Artificial Sequence: Synthetic coding sequence
atgccctgcagcgaggagacccccgccatcagccccagcaagcgggcaagaccggcagaagtgggcggaatgcagcttcgctttgctcggttgagcgagcatgccactgccccgacgaggggtagtgccagggcggcgggctacgatttatacagtgcttacgattacaccatcccaccaatggaaaaggccgttgtgaagactgacattcagatcgcgctgccttccggatgctacgggagagttgctcctagatccgggctggcagccaagcattttatcgacgttggagccggagtaatagacgaggattaccgcgggaacgttggtgtagtcctcttcaatttcggtaaagagaagtttgaggtcaagaaaggtgacaggatcgcacagttaatctgcgaaaggatcttctatccggaaatcgaggaagtgcaagcacttgacgacactgagaggggttccggtggcttcggatctaccggaaagaactag

SEQ ID NO: 185220 - DNA, 426 bp, Artificial Sequence
  Description of Artificial Sequence: Synthetic coding sequence
atgcagctgcggttcgcccggctgagcgagcacgccaccgcccccacccggggatccgcacgggctgctggatatgatttatacagtgcatacgactatacgatccctccgatggaaaaagccgttgtgaaaacagacatccagatcgccttgccttccgggtgctatggccgggtcgccccaagatcaggactggccgccaagcactttatagacgtaggagcaggagtgatcgacgaggattacagagggaacgtgggagtagtattgttcaattttgggaaagaaaagttcgaggtgaagaaaggagaccgcattgcacagcttatttgcgaacggatcttctacccagaaatagaggaggtgcaagctcttgatgacaccgaacgcggatctggtggttttggttcaaccggcaagaattag

SEQ ID NO: 185221 - DNA, 1056 bp, Artificial Sequence
  Description of Artificial Sequence: Synthetic coding sequence
atgcccctgcggaagcaccggcagcacttcaagaagtacggcaactgttttactgcgggcgaagctgtggactggctgtacgatctgctgcgaaacaactctaactttggtccagaggtcaccaggcagcagaccatccagctcctgagaaaattcctcaagaaccacgtgattgaggatatcaaaggtagatggggctccgagaacgtcgacgacaacaaccagctatttcggttccctgcgacttcaccactgaagaccctgccaaggagaacccccaaacgccatggacttcacttatcacaagagaatggggagaaaattaaacacgaaatcatcaacgaggaccaggagaacgctatcgacaaccgggagctgtcacaggaagacgtagaggaggtgtggcgatatgtaatccttatctacctacaaactatcctgggagtgccctcacttgaggaggtcataaaccctaagcaggtgatcccacagtacattatgtacaatatggctaacacatccaagcggggcgtagtcattctccaaaataagagtgacgacctgccccattgggtgctttcagcaatgaagtgcctcgctaactggcccaggagtaacgatatgaacaatcctacgtacgtaggcttcgagcgggatgtttttcgaactatcgcagattacttcctcgacctgcccgaacctctcctgacatttgagtactacgaactatttgtcaatatcctcggtaattttaaagatttccggtcatcaatccctgtggtttgtggttacatcactgtgtcggacagaagttcaggaatccataaaatccaggacgacccacaatcatcaaaattcttgcacctcaataacctgaattcctttaagtctactgagtgcttgttgctcagtcttctgcacagggagaaaaataaagaagaatctgactctaccgaacgcctccagataagtaatcctgggtttcaagagagatgtgcaaaaaaaatgcaactggtcaatctgcgcaacaggcgcgcctgttgcaacttgatctag

SEQ ID NO: 185222 - DNA, 1584 bp, Artificial Sequence
  Description of Artificial Sequence: Synthetic coding sequence
atggagagccagggcgtgccccccggcccctaccgggccaccaagctctggaatgaagttacaaccagcttccgcgctggtatgcccttgcggaagcataggcagcacttcaaaaaatacggtaattgttttactgcgggtgaagccgtggactggctctacgatctgctgcggaacaattcaaattttggccctgaagtgacccgtcagcagactattcaactgctcagaaagtttttgaaaaaccatgtgatcgaagatatcaaggggcgctggggaagcgagaacgttgacgacaataaccaactcttccgattccctgcgacatcaccgctgaaaaccctccctcgcagatatccagaattacgaaagaataatattgagaacttcagcaaggacaaggactcaattttcaagctccgcaatctttctagaaggacacctaagcgtcacggccttcatctttcccaggagaatggggaaaaaatcaaacatgaaatcattaatgaggatcaggaaaatgccatcgacaacagagagctgtcgcaggaggacgttgaggaggtctggcgctacgtcattctcatttacttgcaaacgattttgggcgtcccatcccttgaggaagttattaatccgaaacaggtgatcccacagtatatcatgtataacatggcaaacacgagcaaacgcggggtggttatattgcagaacaagtctgacgaccttccccactgggtactcagtgccatgaagtgtctcgccaactggcccaggagtaatgacatgaataaccccacttatgtcgggtttgaacgcgatgtgtttagaactatcgcggactattttctggacctgcctgaacctctgttaacatttgagtattatgagttgttcgtcaatatcctcggtctactgcaacctcatctcgagcgcgtggcgattgacgcgctgcagctttgctgtcttctgcttcctccaccaaataggagaaaattgcagctgctcatgcgtatgatttcaagaatgagccagaatgtggatatgcccaaactccatgacgccatggggacaagaagcctaatgatccacactttttctaggtgcgtcctctgttgtgcagaggaggtggacctggatgaacttctagcgggccggttggtgagcttcctcatggaccatcatcaggaaatcctgcaagtcccatcatacctacaaactgccgtagagaaacacctggactatctaaagaaaggccacattgagaatcccggtgatggactgtttgcgcctttgccaacctattcatattgtaagcaaattagcgcacaagagtttgacgagcagaaagttagcaccagccaggcggcaattgccgagttgttagagaacattattaaaaaccggagcctgcctttgaaagaaaaacgcaaaaaattaaaacagtttcaaaaggagtaccccctcatctatcaaaaacggttcccaactaccgagtctgaagctgcgctctttggggataagcctactatcaagcagccaatgctgatcctgagaaaacccaagttcagaagcctgcgctag

SEQ ID NO: 185223 - DNA, 2436 bp, Artificial Sequence
  Description of Artificial Sequence: Synthetic coding sequence
atggagagccagggcgtgccccccggcccctaccgggccaccaagctgtggaacgaagtgacgacctcctttcgggccggtatgccgttgaggaaacaccggcagcacttcaaaaagtacggaaactgctttacagccggcgaggccgttgactggttgtacgatttactccgcaacaatagtaatttcggtcctgaagtgactaggcaacaaacaatccagctgctacgaaagtttctgaaaaaccatgtcattgaggacatcaagggtaggtgggggagcgagaatgtcgatgacaataaccagctatttcgcttcccagcgacatcccctctgaagaccctgcccagacgttaccccgaacttcgaaagaacaatatagaaaacttctctaaggataaggactccatctttaagctcagaaatctcagtcgcaggacccctaagagacacgggttgcacttaagccaggaaaacggggaaaaaataaagcatgaaattattaacgaggatcaggagaacgccatcgacaacagagagctgagccaagaggatgttgaggaggtgtggcgatatgttattctgatctacttacagacaatactgggagtaccaagtctggaggaggtgatcaatcccaagcaggtgattccccagtatattatgtacaatatggctaatacttccaaaaggggagtggttattttgcagaataagtcagatgatctccctcattgggtgctcagcgccatgaaatgcctggccaactggccacggtctaatgacatgaataaccctacatatgttggatttgaacgggatgttttcagaacaatagcggactacttcctggacctgccagaaccactgttaaccttcgagtattacgagctgttcgtaaatattctcgtggtgtgtggctatattaccgtgtctgataggtcttctggaatccataagatccaggacgacccccaatcttctaaattcctccatctgaataaccttaactcgttcaagtctactgagtgtctgctactgtctttgttgcatcgcgaaaaaaataaagaagagtcagattcgacggaacgtctccagatctcaaatccagggtttcaagagcgttgtgcgaaaaaaatgcagttggtgaaccttaggaacagaagggtgtccgccaacgacattatggggggatcttgtcataatctcataggcttatcaaacatgcacgatctttcaagtaacagtaaacccagatgttgcagcctcgaggggattgttgatgttccgggaaatagcagcaaggaggcttcatctgtgtttcatcagtcatttcctaatattgaaggacagaacaataagctatttttagagtctaagcctaagcaagagttcctgctgaatctgcattctgaagaaaacatccaaaaacccttcagcgcgggcttcaaacggacatccactctgaccgtgcaggaccaggaggagttatgcaatgggaagtgtaaatcgaagcaattatgccgatctcaatctctcctgcttaggtcctcaacacgccgtaatagctacatcaacacacctgtggccgagatcattatgaagcccaacgtgggacagggctcaacaagcgtccagaccgcaatggaaagtgaactgggcgaaagttctgcaacaattaacaaacgtctctgcaagtccaccatcgagctatccgagaactccttgttaccggccagctcaatgctaacaggaactcagagtcttttgcagccacacctggagcgggtggctatagatgctctccagctatgctgcttgctgctgcctccgcctaaccgcagaaagttgcagctgctgatgaggatgattagccgcatgagccagaatgtggatatgccgaagctccacgatgcaatgggcactcggtccctgatgattcatactttttcacgctgtgttctgtgctgcgccgaagaagttgatctggacgagctgctcgccggccgactcgtgagcttcctcatggatcatcatcaggagatacttcaggtgccgagttacctgcaaactgctgtggagaagcacctggattatctgaaaaagggtcatatagagaaccctggggacggcctattcgcccccctgccaacatattcctactgtaagcagatcagcgctcaagaattcgacgaacagaaagtttcgacttcacaggccgccatcgccgagctgctggaaaatatcataaagaaccgcagtctgccactgaaagagaagcgcaagaaactgaagcaatttcagaaggagtatcctctcatctaccagaaacggttccccaccacagaaagtgaggctgctctgttcggggacaagccaaccatcaagcaacccatgttaattttgaggaagccgaaattccgtagcctgagatag

SEQ ID NO: 185224 - DNA, 1590 bp, Artificial Sequence
  Description of Artificial Sequence: Synthetic coding sequence
atggagcaccggatcgtgggccccggcccctaccgggccacccggctgtggaacgaaacagtcgaactgtttagagcaaagatgcctcttagaaagcatcggtgtcgatttaagagttacgagcattgtttcacagcagcagaagccgtggactggctgcatgagctgctgcgttgtagtcagaactttggacctgaagtcacccgtaagcagactgtccaactgttgaagaaattcttaaagaaccatgtgatcgaggatattaaaggcaaatggggggaagaggactttgaggacaaccgccacttatacagattccccccctcatcaccactgaagccataccctaaaaaaccgcctaatcagaaagacgtgattaaattccccgaatggaacgacctcccccccggaacctcccaggagaatattcctgtcaggccggtcgtgatgaatagtgagatgtggtataaacggcactccatcgcaattggagaggttccagcctgtaggctagtgcacaggagacagctgaccgaggcaaacgttgaggagatctggaagtccatgactctatcctacctgcagaagattctaggcctggattccttggaagaagtgcttgacgtgaaactagtaaatagcaaattcataattcataatgtctacagcgtgtccaaacagggcgttgtcattttagatgataagtctaaagaattgcctcactgggtcctttccgccatgaagtgcttagcaaactggcctaattgttccgatttgaaacagcctatgtatctagggtttgagaaagatgtgtttaagactatcgctgactattacggacacctcaaggagcccctgctaacctttcacctgttcgacgcttttgtctctgtgctaggattgcttcaaaaagagaaggtggccgttgaagcctttcaaatttgttgcctcctacttccccccgagaaccgtcggaaactccagttgctgatgcgcatgatggcgcggatctgtttaaataaggaaatgcctccgctatgcgacggattcgggacgcgaactctaatggtgcagacttttagtagatgtatcctgtgtagcaaagacgaagtggatctggacgaattgctcgcagctcgacttgtgacattcctgatggataactatcaagagatacttaaagtgcccttggcgctacagaccagcatcgaggagcgcgttgctcacttacgtcgtgtgcaaatcaaatatccaggcgcagatatggatataaccctatcagcacccagcttctgcagacagattagcccagaggaatttgaataccagaggagttacggatcccaggagccccttgccgccttattggaagaggtgatcacagatgctaaactgtccaataaggaaaagaagaagaagctgaaacaattccagaagtcgtatcccgaagtgtatcaagaacgattccctacccccgaatcagcagcgttgctgtttcccgaaaaaccaaagcctaaaccccagttactgatgtgggcacttaaaaaacctttccagccctttcagcgcacccggtcctttcggatgtag

SEQ ID NO: 185225 - DNA, 1404 bp, Artificial Sequence
  Description of Artificial Sequence: Synthetic coding sequence
atggagcaccggatcgtgggccccggcccctaccgggccacccggctgtggaacgagacagtggagcttttcagggcaaaaatgcctctcagaaagcaccggtgcagatttaaaagctacgagcactgtttcactgcagcggaagcggtagattggctccatgagttgcttcgatgtagccagaatttcgggcctgaagtgaccagaaagcagaccgtgcagctgctaaaaaaatttttgaaaaatcatgtgatcgaggacatcaaaggcaagtggggcgaggaggattttgaagacaatcggcatctataccgtttccctccatcaagccctttgaagccatacccaaagaaaccaccaaaccagaaagacgtcattaaattccccgagtggaatgacttgccacctggcacatcccaggagaacatccccgtccgcccggtagtgatgaactctgaaatgtggtataaaaggcattcgattgcaatcggggaagtacccgcctgtcggcttgtccacaggaggcagttgactgaggcaaacgtggaagaaatttggaagagtatgactctgagctacctgcagaaaattctgggcctggattcccttgaagaagtcctggatgtgaagctcgtcaacagtaagtttataattcacaacgtgtactcggtctcgaagcaaggcgtggtgatcctcgacgataagagcaaggagctcccccactgggtgttaagcgcaatgaagtgtctagccaactggccgaattgcagtgacctgaaacagcctatgtatctgggcttcgaaaaggatgtgttcaagactatagccgattactacggacatctcaaggaacctctgctgactttccatctgttcgatgcctttgtttccgttctgggtctactccagaaggagaaagttgctgtggaggcgtttcagatctgctgtcttctgttgccccccgagaaccgtagaaaactgcagttgctgatgcgcatgatggcacgcatttgcctgaataaggagatgccacctctatgtgatggtttcggcacaaggacactgatggtgcagactttttcccgctgtatcctgtgctctaaagatgaagtggaccttgatgagttactggcagccaggctggtgacatttctcatggataactaccaagaaatccttaaggtgccactggctcttcaaacttccatagaagagcgggttgcacacctccggcgcgtccagttccagaagtcatatccagaagtctaccaggagcgcttcccaaccccagagtccgcagccctgctcttcccagaaaaaccaaaaccaaagcctcagttgctgatgtgggccctgaaaaagcctttccagccgttccagagaaccaggagcttccgcatgtag

SEQ ID NO: 185226 - DNA, 1323 bp, Artificial Sequence
  Description of Artificial Sequence: Synthetic coding sequence
atgcccctgcggaagcaccggtgccggttcaagagctacgagcactgcttcaccgccgcggaagctgtggattggctccatgagctgctccgctgttctcagaactttggacctgaggtaactagaaagcagactgtgcagttgctgaaaaagtttcttaagaatcatgttatcgaggacatcaaaggcaagtggggggaggaagactttgaggacaatcgccacctgtaccggttcccacccagcagcccactgaagccttatccaaagaaacctccaaaccaaaaggatgtaattaagtttccagaatggaatgatctgccaccgggtactagtcaggaaaacattcctgtgcggccggtggtgatgaactcagagatgtggtataagagacactcaatcgccatcggagaggtgccagcctgtaggctcgtccacagacgccagttgacagaggctaatgtggaagaaatatggaaatcaatgaccctgtcttacctccaaaaaattctcggcctggactcgttggaggaggtccttgacgttaagctggtcaactctaagtttattatacacaatgtttactccgtcagcaaacagggcgttgtcattctggatgacaaatccaaggaactgccacattgggtgctaagcgccatgaagtgcctggcaaattggcctaactgctccgacctgaagcagccaatgtatttagggtttgagaaggacgtctttaagactattgcagactattatggacatcttaaggagcccctgctgacgttccatctctttgacgctttcgtaagtgttctgggccttttgcagaaggagaaggtcgctgtggaagcttttcagatctgttgcctgttactgcctccggagaataggagaaagttgcagctgcttatgaggatgatggcccggatctgcctgaacaaagaaatgcccccgctgtgcgacggattcggcactcgcaccctcatggttcagacgttctcgagatgtatcctgtgctcaaaggatgaggtggacctcgatgagctccttgctgctcgtctggtgactttcttgatggacaactatcaggagatactcaaagtgcctctcgccctccaaacctcaatagaagaacgagtcgcgcacttgcgcagagtccagtttcagaagtcgtacccggaagtgtatcaagagagattccccaccccagagagtgccgctctcctgttcccagagaaaccaaaaccaaagccccagctgctgatgtgggcactcaaaaagccctttcaaccctttcagcgtacccgttcatttaggatgtag

SEQ ID NO: 185227 - DNA, 4746 bp, Artificial Sequence
  Description of Artificial Sequence: Synthetic coding sequence
atgcggaccaccaaggtgtacaagctggtgatccacaagaagggcttcgggggcagcgacgatgagctagtggtaaatcccaaggtgttccctcacatcaagcttggcgacattgtggaaattgcgcatcccaacgatgaatattctcctctgctcctgcaggtgaagtcactgaaggaagacctgcagaaggaaaccatatctgtggatcagaccgttacccaggtgttcagactccgaccttatcaggacgtgtacgtgaacgtagtagatccaaaggacgtcacactggacctagtcgagctgacgttcaaggaccagtacatcgggcggggggacatgtggcgcttaaagaaatccctcgtatccacttgcgcctacattacacagaaagtggagttcgccggcatccgggcacaggccggtgaactgtgggtgaagaacgagaaagtgatgtgcggctacatcagtgaggataccagagtggtcttcaggagtacctcggccatggtgtatatattcattcaaatgtcatgcgaaatgtgggattttgacatctacggagatctctatttcgaaaaagccgttaatggttttctcgccgatcttttcacaaaatggaaagaaaagaactgtagtcacgaagtaactgtggtgctgttctccaggactttttatgacgcgaaatccgtcgacgagttccctgaaatcaatagggccagcatcagacaggaccataagggcagattttatgaagatttttacaaggtcgtcgttcagaatgagcggcgcgaagaatggacctcccttcttgtgacaatcaagaaactatttatacagtaccccgtgcttgtccgattagaacaggccgagggctttccccagggggacaacagcacatccgcacagggcaactatcttgaagctatcaacctcagcttcaatgtgtttgacaaacactatattaacagaaacttcgacaggacaggacagatgtccgtggttattacccctggcgtgggagtttttgaagtcgaccggctacttatgatcctgactaagcagagaatgatcgacaacgggatcggggtggatcttgtatgcatgggtgagcagcccctccacgcagtgccactgttcaaattgcacaatcggtcagccccaagggacagccgactcggagacgattataacatccctcactggattaaccattcattctacacctcaaaatctcagcttttctgcaattcattcaccccaagaatcaaactggccggaaaaaagcctgcgtctgagaaggccaagaatggtcgcgataccagcctgggatctccaaaggaatctgagaacgccctcccaattcaagtcgactatgatgcctatgacgcccaggtcttccggcttccaggcccatccagagctcagtgtttaacaacatgccgatctgtgcgagaacgcgagtcccacagcaggaagtctgcctcctcttgcgacgttagttctagccccagccttccctctcgcacactcccaactgaggaggtgcgctcacaagcatccgacgatagcagtttgggcaagtctgccaacatactgatgatcccacaccctcacctacaccagtatgaggtgtccagctcattgggttacacctctacccgggacgtgctggaaaatatgatggagcccccccagagggacagttccgcgccaggccgcttccacgtaggcagcgctgagagtatgctgcacgttcgccccggaggttatactcctcaacgggccttaattaatcccttcgctccatcaagaatgcctatgaagttaacctccaataggcggaggtggatgcacacatttcctgtaggcccttccggcgaagccatccagattcatcaccagacgcgccaaaatatggccgagctgcagggatccggacagcgggaccctacacatagctctgcagagctcctcgaacttgcctatcatgaagccgctggccggcactccaattctcgccagccaggggacgggatgagctttctaaatttttcgggaactgaggagctgtccgtaggactgctcagtaactccggcgcagggatgaatccccgcactcagaataaagactcgctggaggacagcgtatccactagccctgatccaatactcacgctgtctgcccctccggtggtaccaggtttttgttgcaccgtgggcgtcgactggaaaagtcttacgactccagcatgtctcccattaactacagactatttccccgaccgtcagggccttcaaaacgattataccgagggctgctatgatttactcccggaagccgatattgatcgccgtgacgaggacggcgtccagatgaccgctcaacaggtctttgaggagtttatctgccagagactcatgcagggctatcagatcatagtgcaacccaaaacccagaaacccaacccagccgtccccccacccttaagctcatctccattatatagtcggggcctagtatctcggaacagaccggaagaagaggaccagtactggctctcaatgggtcgcaccttccacaaagttacgcttaaggataagatgatcaccgtgactcgatacctgcctaagtatccctacgagtctgcacagatccattatacctactctctgtgtcctagtcattccgactccgagtttgtgtcctgttgggtagagttctctcacgagcgcctggaggagtacaagtggaactatctggatcagtacatctgttccgctgggagtgaggatttcagtctgatcgagagtctcaagttctggaggactcgttttttactcctacccgcctgtgtcaccgcaactaaaagaattaccgagggcgaagctcattgtgatatttacggggacagacccagagccgacgaagatgagtggcagttattggatggatttgtgcggtttgtggaaggtcttaaccgaatcaggcggaggcatcgttctgatcgtatgatgcgtaagggcactgctatgaaaggcctccaaatgaccggccctatctctacccactccctcgaaagcacagcgccacccgtgggcaagaaaggaaccagcgcactctccgctctcctggaaatggaggcatcccaaaagtgtctgggggaacagcaagccgctgtgcacggcggtaaatccagcgcccagtcagccgagtcatcgtcagtggccatgacgccgacatacatggacagtccccggaaggtctctgtggaccagaccgcaactcccatgctggatggaacatccctgggaatctgcacgggacaatcaatggaccgtgggaacagccagacctttggaaatagccaaaacataggggaacagggctactctagtactaactcgagcgacagcagttcccagcaacttgtcgcctcctcactgacctcttcctcaacgctaaccgagattctcgaagcgatgaagcacccaagcaccggagtccaattgctgtccgaacagaaaggcttgagcccctattgcttcattagtgcagaggtggttcactggctcgtaaatcatgtggaagggatacaaactcaagccatggctatagatattatgcagaagatgttagaggagcagcttatcacccacgctagtggcgaggcttggcgcaccttcatctacgggttttacttttacaaaatcgtgaccgataaggagcccgacagggttgccatgcaacaaccagccaccacttggcacacagcgggggtcgatgacttcgctagcttccaacgaaaatggtttgaggtcgcgttcgtggcagaggagctcgtgcatagcgagatacccgcgttcttgctcccttggttgccctcgaggcccgcctcctatgcttccagacattccagcttcagtcgatctttcggaggcaggtctcaggccgccgccctgttagcagccacagtgcctgagcagagaaccgttacgctggacgtcgatgtgaataaccggactgacagactggagtggtgttcctgttactatcatggaaacttctcgttaaatgccgcctttgaaatcaaactgcattggatggccgttacagccgccgttctgttcgagatggtccaagggtggcataggaaggccactagctgtggatttctcctagtcccagtgctggaaggccctttcgcactgccgtcatatctgtatggtgacccactgcgcgcccaactttttatccccctgaacattagctgcctgctgaaggaaggttccgagcaccttttcgatagctttgaacccgagacctattgggaccgaatgcatcttttccaggaagctattgctcacagattcgggtttgtacaagacaaatactcagcatccgctttcaacttccctgcagagaacaaaccacagtatatacacgtcacgggaactgtcttcttgcagctaccatactccaaacgcaagttttcaggccagcagagacggaggcggaactcgacgagttcaacaaatcagaacatgttttgtgaagagagggtggggtacaactgggcttacaataccatgcttactaagacatggagaagcagtgccaccggggacgagaagttcgccgatagactgctgaaagatttcacagatttttgcattaatcgagataataggcttgtgactttctggacatcatgcttggagaaaatgcatgcttctgcgccctag

SEQ ID NO: 185228 - DNA, 3690 bp, Artificial Sequence
  Description of Artificial Sequence: Synthetic coding sequence
atgcggaccaccaaggtgtacaagctggtgatccacaagaagggcttcggcggctccgatgacgagctcgtggtgaacccaaaggttttccctcacattaagctgggagacattgtggagattgcacatccgaatgatgagtacagccctctcctcctccaggtcaagtctctcaaggaggacctccagaaggaaactatctctgtcgaccaaacagtaacgcaggtgttcagactaaggccataccaggatgtctacgtgaacgtggtcgaccccaaggatgtaaccctcgatctagtggagctcacattcaaggatcagtacataggccgaggagatatgtggcggcttaagaagtccctggtgtcaacctgtgcatacataacccagaaggttgagtttgcaggtatacgagctcaggctggcgaactttgggtgaagaatgagaaggtgatgtgtggttacataagcgaagacactagagtggttttcaggtcaactagtgccatggtctatatcttcatccagatgagctgcgagatgtgggacttcgatatatacggcgatctttatttcgagaaagcggtcaatgggttcctggctgacctgttcaccaaatggaaggagaaaaactgttcccatgaagtaacagtggtgttgttctccagaaccttctatgacgcaaaatccgtggacgaatttcccgagattaaccgggcttcaataaggcaagaccacaagggaagattctacgaagacttttacaaggttgtcgttcaaaacgagaggcgggaagaatggacgtccctgctggtcacgatcaagaagctgttcatccagtaccctgtgctagtgaggttggaacaggccgaaggtttccctcagggggacaactcaacctcggcccagggcaactatctcgaggctattaatttaagtttcaacgtctttgacaaacactatatcaaccggaatttcgaccgtacaggtcaaatgtccgtggttatcacaccaggagtaggtgtcttcgaagtggacagactgctcatgatcctgactaaacagcgaatgatcgataacggaataggcgtagacttggtttgcatgggagagcagcctcttcacgcagtgccactttttaagctccataaccgctcagcccctagagattcccgtctcggtgacgattataatattccccactggataaaccacagcttctatacctctaaatcacagctgttctgcaacagcttcacccccagaatcaaactcgctgggaaaaaacctgcgtccgagaaagctaagaacggcagagacacctctctggggtctccaaaggagtctgaaaatgctctgcctattcaggtggactacgatgcatatgacgcccaagtcttcagactgcccggcccaagccgtgcccagtgtctcaccacatgtcgaagcgtccgggaacgggagtcccatagtaggaagagcgcatcatcctgtgatgtgagctcctcaccttctctgcccagcagaaccctgcccaccgaggaagtgcgatctcaggcgtcagacgattcttctctcggtaaatcagccaatatccttatgatccctcatcctcacctacaccaatatgaagtgagtagctccttgggctatacgtccacacgagacgttctggaaaatatgatggagccgccccagagagatagcagtgctcctggacgctttcatgtggggagcgccgagtcgatgctgcacgtgcggcccggcggatatacgcctcagcgcgccctcatcaatccttttgcgcccagcaggatgccaatgaagctcacgtctaatcgtaggcgttggatgcacaccttccccgtaggaatgaatcccaggacacagaacaaagacagcctggaagacagcgttagcacaagccccgacccaatcctaacattaagcgccccacctgtcgtccccggattctgttgcaccgtgggtgtcgactggaagtccctaacaacgcctgcttgcctgcccctgaccactgattacttccccgatcgacaggggttacagaacgattacacagaaggttgttacgatctgctgcctgaagccgacatcgaccgccgtgatgaggatggagtccagatgacggctcagcaggtcttcgaagaatttatctgccaacggctgatgcagggatatcaaatcatcgttcagccaaagacacagaagcctaaccccgcggttccccctccgctttcttcctcaccactctattctcggggcctagtgtctagaaaccgcccagaggaagaagaccagtattggctctccatgggccgcacttttcacaaggtaacccttaaggataagatgatcaccgttactagatacctccccaaatatccttacgagtctgcgcagatccattacacatactctctgtgtcctagccactctgacagcgagttcgttagctgctgggttgagttttcccacgagcggctagaggaatacaaatggaattatctggatcagtatatctgttcagccggatccgaagacttctccctaatagaaagtctcaagttttggagaacaagattcttgctgctacccgcatgtgtaacggctacaaagagaatcaccgagggtgaagcgcactgtgatatctatggcgaccgcccgcgggcagatgaggatgagtggcagttactggatggattcgtgcgtttcgttgaaggactgaataggatcagacggcgacacagatcggaccggatgatgcggaaggggactgccatgaagggtctccagatgacgggacctattagtacccacagcttggaatctacagcaccacccgtcggcaagaagggaacttctgctctgtctgccctgttggaaatggaagcgtcacaaaagtgcctgggcgagcaacaggcagccgttcacggggggaaatcatcagcccaatctgccgagagttcgtctgttgcgatgactccgacttatatggatagcccacggaaggatggcgccttctttatggagttcgtcaggtctccacggacggcatcctccgccttctatccgcaggtcagtgtggaccagaccgctactcccatgttagatggaacttccctgggtatttgtacaggccagtccatggacagaggaaattctcagacgtttggtaactcacaaaacattggggagcagggctactccagcacaaattcttccgactcttccagccaacagctggtggcttcatccctaaccagcagcagcacattaaccgagatacttgaagccatgaaacatccctctactggggtgcagttgctgagcgagcaaaaggggctcagtccttattgctttatcagcgcggaggttgtgcactggctggtgaatcatgtggaggggatccaaacccaggccatggcaattgatataatgcagtggccttgttcaagtcctcccccgcccggaacgcaacaagagtggaccacttcccctgcgagctcggctagcggcttgcggtggcccctgtggcagaaaagcagctgtacacttcgtttcctgcccttttcatgcccagggtgcctggccgggcagccacctatgcaggtgggtaccgcccccctcgctgaagtgctggaggatggagctagacggcagcacttttag

SEQ ID NO: 185229 - DNA, 4512 bp, Artificial Sequence
  Description of Artificial Sequence: Synthetic coding sequence
atgcggaccaccaaggtgtacaagctggtgatccacaagaagggctttggaggaagcgacgacgagctcgtggtgaacccaaaagtgttcccccatatcaagctgggagacattgtggaaatcgctcacccaaatgacgaatacagccccctgttactgcaagttaaatctttgaaagaggatctgcaaaaggaaaccatctccgtggaccagaccgttactcaggtattcaggttgagaccgtaccaggacgtgtatgtgaacgtggtcgatcccaaagatgtgacactggatctggtggaactcacctttaaagatcagtacatcggtagaggagatatgtggcgtttgaagaaatccctcgtcagcacctgtgcctatatcactcagaaggtcgagttcgccggcatccgagcccaagccggtgagctgtgggtaaagaatgagaaagtcatgtgcggttacatcagcgaagacaccagagtggtctttaggtctacatcagcgatggtatatatctttatccagatgagttgtgagatgtgggattttgacatctacggcgatctgtactttgagaaagccgtcaacgggttcttggcagatcttttcaccaagtggaaagaaaagaactgttcacatgaggtaaccgtcgtgctcttctccaggacattttacgacgcaaaatcagtcgacgagttcccagagatcaaccgtgcctccatacggcaggaccacaaaggcagattctatgaggatttttataaggttgtggtccagaatgaacggcgcgaggaatggacaagcctgctggtgactataaaaaagctgtttatccagtacccagtgctagtgcggctggagcaggctgaagggttccctcagggagataatagcactagcgctcaaggaaattatctagaggcaatcaacttaagtttcaacgtttttgataagcactatataaatagaaatttcgataggacaggccaaatgagcgttgtgatcacgcccggagtaggggtatttgaagtggacagactactgatgatcctgaccaaacagaggatgatcgataatgggattggcgtggacttagtgtgcatgggcgaacagcctctgcacgcagtgcccctattcaaattgcataaccggtccgcccctagagactcccgtttaggagatgactataacatcccccactggattaaccacagcttctatacgagtaagagtcagctgttctgtaattcctttacccccaggattaagctcgcagggaaaaaacccgctagcgagaaggctaagaatggcagggatacctcactcggttctcctaaggaaagcgagaacgccctcccaattcaagtagactacgatgcctatgatgctcaagtgttccgcttaccaggcccttctagagcccagtgcctcaccacctgtaggtccgttcgggagcgggagtctcattcacggaaaagcgcatccagctgtgacgtgtcaagtagcccctcactgccatcacgaaccctgcccaccgaagaggtgaggagccaggcgagcgacgactcttctctcggaaagtctgccaatatcttgatgatcccccaccctcacctgcaccagtatgaggtgagttcatctctcggctacacaagtacaagggacgtgcttgagaacatgatggagcccccccagcgagactcatctgctccaggcaggttccacgtaggcagcgccgagtccatgttacacgtccgacctggcgggtacactcctcagcgggccctgattaatccctttgccccatcccggatgcctatgaagctgacttctaacagacgcaggtggatgcatacgttcccggtggaaacttcctgtttctacctcagcattggaatgaatcccagaacacaaaacaaggacagcctggaggatagcgtcagcacttcgcccgaccccatgcctggattttgttgtaccgtgggagtcgattggaagtccctaacgaccccggcttgcttgccacttactaccgactactttcctgaccgccaggggttacagaacgactacactgaaggctgttacgatctgttgccggaggccgatatagaccgccgggacgaggacggcgtccagatgaccgcccagcaggttttcgaagagttcatctgccagcgcctcatgcagggttatcaaatcattgtccagccgaaaacgcaaaagcctaacccagctgtaccaccccctctctcaagctctcccctctacagccgaggcctcgttagccgcaacaggcccgaagaggaagaccagtactggctgagcatgggacggaccttccataaagtaacattgaaagacaagatgattacggtgacccgctaccttccgaagtatccttatgagtcggcccaaatccactatacatatagtctttgcccaagccactccgattctgaatttgtctcttgctgggtggaattcagtcatgagaggctcgaagaatataagtggaattacctcgatcagtacatttgcagcgcgggttccgaagatttttccctgatcgagtccctgaaattctggcggacgcggttccttctgctgcctgcatgcgtgaccgccaccaagaggatcactgagggggaggcccactgcgacatttatggcgacagaccaagagcagatgaagacgaatggcaactgttagacgggtttgtcagattcgttgaaggactgaatcgaattcgcaggaggcatcgcagtgacagaatgatgaggaaggggactgcgatgaagggcctgcagatgaccgggcctataagcacccatagcctcgagtctactgcccctccggttgggaaaaagggaacctctgccctgtccgctctactggagatggaggcctctcagaagtgcctgggagagcagcaagctgcggttcacggaggaaagtcctccgctcagtctgccgagtcctcatcagtggcaatgacccctacttatatggacagtccacgaaaggtatcagttgatcaaactgccaccccaatgttagacggaacctccctgggcatttgtacaggccagtcaatggatcgcgggaactcccagacctttggtaattctcagaatattggagagcagggttattcctcaactaacagctctgacagctcctcccagcagttggtcgcgtcaagcctgacaagcagcagcaccctaactgaaattctggaagccatgaagcacccatcaacaggcgttcagctgctgtcagaacagaaggggctttccccgtactgtttcatttctgctgaagttgttcattggctggtcaaccatgtcgagggaatacagacacaggccatggccatcgacattatgcaaaagatgttagaagagcagctcattacacacgctagcggggaggcttggaggacctttatttatggcttctacttttacaagatcgtcaccgacaaagagcccgaccgcgtcgcaatgcagcagcctgccacaacctggcacacagcaggtgttgatgactttgcttcgttccagaggaagtggtttgaggttgctttcgtggcagaggagctcgtccacagcgaaattcccgctttcctgcttccatggctcccgtcgcggcctgcatcatacgctagcaggcattcctcattctcacgttcattcggtggacgctcccaagccgctgctctcctggcggctaccgtgccggaacagcgaaccgtcactctagacgtggacgtaaataaccggacagatcgccttgagtggtgttcttgctattaccacggaaacttctcacttaacgctgcctttgagattaaactgcactggatggctgtgacagccgcagtgctgtttgagatggtgcaggggtggcaccgtaaggccacaagctgcggcttcctgctcgtccccgtgcttgaagggcctttcgctctgccttcttacctctacggcgaccccctacgagcccagttgttcatccctctgaacataagctgccttctgaaggagggctccgagcatttgttcgattccttcgaacccgaaacctattgggaccgcatgcatttatttcaggaggccatcgctcaccgcttcggattcgttcaggacaaatactccgcttcagctttcaactttccggccgaaaacaaaccccagtatattcatgtaactggcacggtgtttcttcaactaccatactcaaagaggaaatttagcggccaacaaagaagacggagaaattcgacatccagcacaaaccaaaatatgttttgtgaagaacgcgtgggatataattgggcttataacaccatgctgaccaagacctggagatcatccgcaaccggcgacgagaaattcgccgacagactgcttaaagatttcacagatttctgcatcaacagggataaccgactggtcaccttctggacctcctgcttagagaaaatgcatgccagtgcaccatag

SEQ ID NO: 185230 - DNA, 1680 bp, Artificial Sequence
  Description of Artificial Sequence: Synthetic coding sequence
atgcggaccaccaaggtgtacaagctggtgatccacaagaagggctttgggggctctgacgacgaactcgttgtgaaccccaaagtgtttccacatatcaaactgggggatatagtggagatagcccaccctaatgatgagtactcccctctcctgcttcaggtgaaatctctgaaagaggatcttcaaaaggaaacaatatcagtcgaccaaaccgtcacgcaagttttccgtcttcggccctaccaggacgtgtacgtcaacgtggttgaccctaaggacgtgactctggatttggtggagttaaccttcaaggaccagtacattggccgtggagacatgtggcgccttaagaagtccctggtatcaacatgtgcctacataactcagaaggttgagtttgccggaatcagggcccaagccggcgaactgtgggtcaagaacgagaaggttatgtgcggttatatctctgaagatactagagtcgtgttcagatccaccagcgccatggtctatatttttattcaaatgtcttgcgaaatgtgggatttcgacatttacggcgacttatattttgagaaggccgttaacggttttctggcggacctgttcaccaaatggaaagagaaaaattgtagccatgaagtgacagtagttctgttctctcgtaccttctacgatgccaagagcgtcgacgaatttcccgaaatcaaccgcgcctccatacgacaagatcataaaggccgattctacgaggacttctacaaggtggtggtacaaaatgaaagacgagaagaatggaccagtctactagtgacgatcaaaaagcttttcatccagtatccggtgctagtacggctggagcaggcagaggggtttccccaaggagacaattcaacatcagcccagggcaattatctggaggctatcaacctgagcttcaatgtcttcgacaaacactacataaacagaaactttgacaggacaggtcagatgtcggtggtgatcactccaggggtcggggttttcgaagtggaccggttactgatgatccttaccaaacagaggatgattgacaacggaatcggggttgacctggtgtgcatgggcgagcagccactgcacgccgtgccgctgtttaaactccacaatcgctcagcaccaagagactcacgactgggagatgactacaacattccacattggataaatcattccttctacacctccaagtctcagctgttttgcaactcctttacccctaggatcaagctcgccggtaaaaaacccgcctctgagaaggctaagaatggacgcgacactagtctgggtagccctaaggaatccgagaacgcacttcccatccaggttgattatgatgcctacgatgcccaagtgttcaggttgcccggcccgtcaagggcacagtgtctgactacatgccgctccgtgagagagagagagagccattctaggaaatctgcctcctcttgtgacgtgagttcctccccctctttaccaagccgcactttacccactgaagaagtgagaagtcaggcatcagacgactcctcccttgggaagagcgccaacatcttaatgattccccacccccatcttcatcaatatgaggtatcttcttcacttggatacacctccacgagggagcacctgggctag

SEQ ID NO: 185231 - DNA, 4659 bp, Artificial Sequence
  Description of Artificial Sequence: Synthetic coding sequence
atgcggaccaccaaggtgtacaagctggtgatccacaagaagggcttcgggggatctgacgacgaactggtcgtgaacccaaaggtcttcccccacataaagctgggggatatcgttgaaattgctcaccccaacgacgaatattctcccctacttcttcaggtgaaatctctcaaagaggatctgcagaaagaaaccattagcgtagatcagaccgtgacacaggtattccgcctgcgcccctaccaagacgtgtatgtgaatgtcgtcgatccaaaagatgtgacgctcgacctcgtggaactgacttttaaggaccaatatattggccgtggcgatatgtggcggttgaaaaagtctttggtttccacatgcgcctacattacacagaaggtggagttcgccgggatacgggcccaggccggcgagctatgggtgaaaaacgagaaggtcatgtgcggctacataagtgaggacacccgggttgtctttaggagcaccagcgcgatggtctatatcttcatccagatgagctgtgagatgtgggattttgatatttacggcgacttatatttcgagaaagccgtgaacgggttcctggccgatctctttactaagtggaaggaaaaaaactgctctcacgaggtgaccgtggtgctcttctcaaggaccttttacgacgccaagtcggtggacgagttcccagaaattaaccgggccagcatccgacaggatcacaagggtcggttttatgaggatttctataaagtagtggtgcagaacgaacggagagaagaatggacatctcttctggtgactataaagaagctgtttatacagtatccagtgttggtgcgccttgaacaggctgagggatttccacaaggggacaattctaccagcgcccagggaaattacttagaggcaataaacttgtcattcaatgtcttcgacaagcactatattaacagaaatttcgatcggaccggtcagatgagtgtcgtcatcacaccgggcgtaggtgtctttgaagtggatcgactgctcatgatactaaccaagcagcgcatgattgataatggaataggcgtggatttggtttgtatgggggagcagcctctccatgctgtgcctctttttaagcttcacaaccggagtgctccacgggactcaagattaggggatgactataatatcccccactggattaaccatagtttctatacaagtaaaagccagctcttttgtaattccttcaccccaagaataaagttggcgggcaagaagccagcgagcgagaaagccaagaatgggcgggacacatctctcggcagtcccaaggagagcgaaaacgcactgcctatacaggtggactacgacgcatacgacgcccaagtcttccgactcccaggaccatcaagggcacagtgtctgacaacatgccgtagtgtgcgagagcgagagagccattcccgcaagagtgcctcgagctgcgatgtgtcctcttctccaagcttaccttctagaacactgcccacggaagaagtacggtcccaggcatctgacgatagttctcttgggaaatcagccaatatcctgatgatcccgcatcctcacctgcaccagtacgaagttagttcgtctttggggtatactagcacaagagacgttctcgagaacatgatggagcctccccagagggatagttccgcaccagggaggttccacgttgggtctgccgaatctatgctccatgtgcgtcccggcgggtacacaccccagagagccttgatcaatccttttgctccctctagaatgcctatgaaactgacgtctaaccgccgtagatggatgcacacattccccgtgggacccagcggagaggcaatccaaattcatcaccagactcgacagaacatggccgagcttcaggggagtgggcaaagagatcctacccacagcagcgctgagctgctggagctcgcttaccatgaagccgccggaaggcacagcaattcaagacagcccggggatggtatgtcctttctgaatttcagtggaaccgaagaactctcagtgggcctgctgtctaatagcggagccggcatgaaccctaggacccaaaacaaggactccctggaagatagtgtgagcacttcaccagaccccattcttactctgagcgccccgccagtcgtcccggggttctgttgcactgttggagttgattggaagtcccttacaactcccgcgtgtttaccactgactaccgattactttcccgataggcaaggactgcaaaacgattacactgaaggatgttacgatctccttcctgaagccgacattgacaggcgggacgaagatggcgtgcagatgacagcccaacaggtgtttgaggagtttatctgccagcgcttgatgcagggttaccagattattgtccagcccaagacacagaaacctaacccggcagtccctccccccttgtcgtcatctcctctgtacagccgaggtctggtttcgcgcaaccggccagaggaagaggaccagtattggttatctatgggacggacatttcacaaggtgaccttgaaagataagatgattactgtcacaagatatttgcctaagtacccctatgaatctgcccagatccattatacctactcactgtgcccttctcattcagacagtgagttcgttagctgctgggtcgagttctcccatgaacggctggaggaatataagtggaattacctagaccagtacatttgtagtgctggctccgaggactttagcctgattgaatcactgaagttctggcgaacacggtttctactcctcccggcctgtgtgacggcaacaaagaggatcacagaaggagaggcccattgcgacatctacggagatagacctcgggctgacgaagatgagtggcagctgctggacggcttcgtgcggtttgtggaaggtctgaaccggatccggcgtcgccacaggagtgaccgtatgatgcggaagggtacggccatgaaagggctacaaatgacgggccccatctcaacgcatagcctggaatccacagcccctcctgtcgggaaaaaggggactagcgcactctccgctctcctggagatggaggcctcacaaaagtgtctgggcgaacagcaggcagctgtccacggtggaaagagctcagctcagagtgccgagtctagctccgtcgcaatgacccccacttatatggattcccccagaaaagacggggccttcttcatggagtttgtgcggagtccccggacagcttcttccgctttctaccctcaggtttccgttgatcaaactgctactcccatgctcgacggtactagtcttggaatctgcacaggacagagcatggatcgcggtaactctcaaacctttggtaattcacaaaacatcggcgaacagggctactccagtaccaactcttcagactccagctctcagcaattggtggcctcaagcctcaccagcagctccacgctcaccgagatcttagaggccatgaaacacccaagcactggcgtccagttgctgtcagagcagaaaggtctgagcccatactgtttcataagtgccgaggtggttcactggctggtcaatcacgtcgaagggatccagactcaggcgatggccatcgatataatgcagaaaatgctggaggagcagctcatcacccatgcaagcggggaagcctggcggacctttatatatggcttctacttttacaaaatcgtgactgataaggaacccgaccgggtggctatgcaacagcctgcaaccacatggcacactgctggcgtggacgacttcgcctctttccagcgcaagtggttcgaggtggctttcgtggccgaggaacttgtgcactccgaaatcccagcgtttctccttccatggttaccaagcaggcccgcctcatacgccagcaggcactcaagtttttcacgaagctttggtggaagatcgcaggctgcagccttgctggccgccacagtaccagaacagcgaacagtcacccttgacgtagacgtaaataaccggaccgacagattagagtggtgctcatgttactaccacggcaacttctctcttaacgccgccttcgaaatcaagctgcactggatggctgtcactgccgctgtactgtttgaaatggtgcagggctggcaccgaaaagctacctcgtgcggctttctcctcgtacccgtgttggaagggccctttgcccttccttcctatctgtatggcgacccattgagagcccagctcttcattcctctcaacattagctgcttgctcaaggaagggtcagaacacctgtttgattctctgggactttataagattaatatactgcctttgctcctgacgagtctcttacgcactagtctatcaataagtacactgcaggaacaatgtttttgcagttgccccactcctagcgccagctcccaaggaagttctggaggcggcgggactcctcctgcacctccgactcggacctgctccgctcgctccggctcagccactacaggccccacaaccccttgtagcccaaaacacggcgcacctgctccacaggggatgaagagcctattgataggctgttag

SEQ ID NO: 185232 - DNA, 4719 bp, Artificial Sequence
  Description of Artificial Sequence: Synthetic coding sequence
atgcggaccaccaaggtgtacaagctggtgatccacaagaagggctttggagggtctgatgatgaactcgtcgtcaatccaaaggtttttccccacatcaagttgggcgacattgtcgaaattgcccaccctaacgatgagtactcacccttactgcttcaagttaaaagccttaaggaggatttacaaaaagaaacaatttctgtggaccagaccgtgacgcaggtgtttaggctgcggccctaccaagacgtgtacgtcaatgttgtcgaccccaaggacgtaaccctcgatctggtagaactgacatttaaagatcagtatatagggcgcggcgacatgtggaggctgaagaaaagcctcgtgtccacctgcgcttatatcacccagaaagtggagttcgccggcattcgcgcccaggccggggaactgtgggtgaaaaatgaaaaggtcatgtgtggatatatttctgaagacacgagagtagtattccggtccacctccgcaatggtttacatcttcatccagatgtcgtgtgagatgtgggattttgacatctatggggatttgtatttcgagaaagcggtcaatgggttcctcgctgatttgttcaccaagtggaaagagaagaactgtagccatgaagttaccgtggtgctcttttctcgaactttctacgatgctaagagcgtcgacgagttccccgagatcaatcgggcgtctatacgccaagaccacaaggggcgattctatgaagacttctataaagtcgtggtccagaacgagagaagggaagagtggacttctctcctcgttacaattaaaaaactcttcattcagtatccagtcctcgtacggcttgagcaagccgaaggatttccccagggtgataattccacctctgcccaggggaattacctcgaagccatcaatttatccttcaatgtgttcgataaacactacatcaacagaaatttcgatagaacagggcaaatgtctgtggtgatcacccccggtgttggggtttttgaagtggaccgcttattaatgatcctgacaaaacaaagaatgatcgacaacgggatcggcgtggacctcgtgtgtatgggtgagcaaccacttcacgctgtgcccttgtttaaacttcacaatcgtagcgccccccgagactctcggctcggggatgattacaatataccccattggattaatcacagcttctacacttctaaaagtcaactgttttgcaatagttttacccctcgcatcaaactggccggtaagaagccggccagcgagaaggcaaaaaacggacgtgatacaagcctgggatctcccaaggagtctgagaacgccctgccgatccaagtggactatgacgcttatgatgcgcaagtatttcgcctccccggcccctccagggcccagtgtcttacaacctgccgaagtgttagagagagggaatcccatagtcggaagagcgcgtctagctgtgacgtcagttcatctccatcattgccttcacgcacactgcccaccgaggaggtacgctctcaggccagtgacgacagctctctcggcaagagcgccaacattctaatgattccacacccacacttacaccaatacgaagtttcctcttccctcggatatacgtccactcgcgacgtgcttgaaaatatgatggagcctccccaaagggattccagtgcacctggaaggtttcatgtggggtctgctgagagcatgctgcatgtgcggcctggcggatacacaccccagagagcactgattaacccatttgctccctccaggatgcccatgaaactgaccagcaacagacgccggtggatgcacaccttccctgtgggaccttcgggagaggcgatacagatccatcatcagaccagacagaacatggcggaattacaaggtagtggacaacgagatcccacccactcaagtgccgaactgcttgagttggcttatcatgaggccgccggccggcatagcaattctcggcagccaggtgatggcatgtccttcctgaacttttctgggacggaagagctgtctgtgggccttttatcgaatagcggcgccgggatgaatcctagaacacagaataaggattcgttagaagactcagtgtctaccagcccagatcccatgcctggcttttgctgcactgtcggcgtagactggaagagcctgacaactcctgcatgtctcccactcacaactgactattttcctgatagacagggactgcagaatgactacacggaaggatgctatgatctgctccccgaagccgacattgacagacgggatgaggatggcgtccaaatgactgcccagcaagtattcgaggaatttatttgtcagagattaatgcaaggataccaaattatcgttcagcctaagacccagaagcctaacccagctgtaccgccgcccctaagctcatcccctttgtatagcaggggtctggtatcccgcaaccgccccgaagaagaggaccagtactggctcagcatgggccggacctttcacaaagtgactctcaaggataaaatgatcactgtaacccgttacctccctaagtacccctatgagtcagcccaaattcactacacgtactctctgtgcccctctcattcggattcagagttcgtttcctgttgggtggaattcagccacgagcgtctggaggagtacaaatggaactatctcgatcagtacatctgcagcgctgggagcgaggatttctccctgatcgagagtcttaaattctggcgtaccaggttcttgctgctgccagcttgtgtgactgctacgaagcgcatcacagaaggggaggcccactgtgatatctacggcgaccggcctcgggcagacgaagacgaatggcagctactcgacggcttcgtaaggtttgtggagggtttaaataggattcgccgcaggcaccgcagtgatcggatgatgagaaagggtactgcaatgaagggccttcagatgactggacccatcagcacacatagcctcgagagcaccgcaccacctgttggtaaaaagggcacctctgctttatcagccctgctggagatggaagcttcccagaagtgcctgggggagcagcaggccgctgtgcatggaggaaaatccagtgcccagtctgccgagtcatcaagtgtggctatgacccccacatacatggactcccccagaaaagtcagcgtggaccaaactgccacccctatgctggacgggactagtctcggcatatgtactgggcagagtatggaccgagggaatagtcaaacattcgggaactcccaaaatataggagaacagggttatagtagcacaaacagctctgactcaagcagccagcagctcgtagccagctcgcttacaagctcttctacgctgactgaaatcctggaggccatgaaacatcccagtactggtgtccagcttttgtccgagcaaaaaggactctcaccttactgttttatctccgccgaagtcgtccattggttggtgaaccatgtagaagggattcagacccaggcaatggctatcgacatcatgcagaagatgctggaggagcaattaattacccatgcttccggcgaggcatggaggactttcatttacggcttctacttttacaaaattgtgacagataaggaaccagaccgtgtcgcaatgcagcaacctgcaactacatggcatacagctggcgtagatgacttcgccagcttccaacggaaatggtttgaagttgccttcgttgccgaggaactggtgcacagtgagatccctgcgttcttattaccgtggctgccatctagacccgcctcctatgcttccaggcattcaagttttagccggagcttcggagggcgcagccaggccgccgcacttctggcagctactgtaccagagcaacggaccgtcacacttgacgttgatgtcaataatcgcacagacagactcgaatggtgttcatgctactaccacggaaacttcagcttgaacgcagcttttgaaatcaaactccactggatggcggtcacagcagcagttttattcgagatggtgcagggctggcataggaaggctaccagttgtggctttcttctcgtccccgtgctggaaggcccattcgccctacccagttatctgtacggggaccccctaagggcccaactgtttataccactgaacatcagttgtctgctgaaggaaggatccgaacacttgtttgactcattcgagcctgaaacttattgggatagaatgcatctgtttcaggaggccattgctcatcgatttggattcgtccaggataaatacagcgcatcggcttttaactttcccgctgaaaataaaccccagtatatccacgtgacaggcaccgttttcttacaactgccctacagcaagcgcaaattttcaggtcaacagagacgacgtaggaactccacgtctagcacaaaccaaaacatgttttgcgaggaacgagtcgggtataattgggcttataatactatgctgacgaagacatggcgctctagcgcaaccggagatgaaaagttcgccgatcggctgttaaaggactttacagacttttgcatcaatcgcgataacagactggttacattctggacaagctgcctcgaaaagatgcacgcgagcgcaccgtag

SEQ ID NO: 185233 - DNA, 4719 bp, Artificial Sequence
  Description of Artificial Sequence: Synthetic coding sequence
atgcggaccaccaaggtgtacaagctggtgatccacaagaagggcttcggtgggagtgacgacgaactagtggtgaatccaaaagtctttccgcatatcaagctgggcgatatcgtcgaaattgcccaccccaacgacgaatactctccgttgctcctacaggtcaagtccttaaaggaagacctgcagaaagagacaatctcagtggatcagactgttacccaagtatttagactacgcccttaccaggacgtttatgtgaatgttgtcgacccgaaagacgtgactttggacttggtggagctcactttcaaggaccagtacatcggaagaggtgacatgtggcgcctgaagaagagcctcgtgagtacatgcgcttacataactcaaaaggtcgagtttgctggaatccgggctcaagccggggaattatgggttaaaaacgaaaaagtgatgtgtggatatatctctgaggatacgagagtggtgtttcgctccacctccgccatggtgtacattttcatccagatgagctgcgagatgtgggatttcgacatctacggggatttgtactttgagaaagccgtcaacggatttttggccgatctgttcactaaatggaaagagaagaattgtagtcatgaagtgacggtcgtgctgtttagccgtacattttacgatgctaaatctgtggacgagtttcctgagattaatcgagcttccataaggcaagaccacaaaggtaggttttatgaagatttctataaggtcgtggtacagaatgaacgaagagaagagtggacgagcctgctggttaccataaagaagctgtttatacaatatcctgtgctggtgcgcctggaacaggccgaaggattcccacagggagataatagcacatctgcccagggaaactatctcgaggcaatcaacctgagtttcaacgtgtttgataaacattacataaacaggaactttgatagaactggccaaatgtccgtagtcatcactccaggggtgggggtatttgaagtcgaccggttgcttatgattctgactaaacaaaggatgatcgataacgggattggggtcgacctggtgtgtatgggggaacagcccctacatgctgtgccactctttaaacttcacaacaggtccgcccctcgagacagtagactaggagacgattataacatcccacactggatcaatcattctttctatacctctaaatcacagcttttctgcaatagcttcactccacggatcaagctggctggaaagaagcctgcgagtgaaaaagctaagaacggccgagatactagccttggaagcccgaaagagagtgagaatgcgttgcccattcaggtcgattacgacgcgtatgacgcccaggtttttcggctgcccggcccatctagggctcagtgtctgaccacttgtaggtcagtacgagagcgagagtcccactcccggaagtctgcaagctcatgtgacgtgagttcctctccaagcctgccatctcggactctgccaacggaagaggtgcgaagccaggcgtcagacgattccagccttgggaaatccgccaacattctgatgatcccacatccccatctacatcagtacgaggtgagctcatcgctgggatacacaagcacgagagacgttttggagaatatgatggagcctccacagcgtgacagcagcgctcctgggaggtttcacgtcggatcggcggagagcatgctgcacgttaggcctggaggctacactccacagcgggccctcatcaatcccttcgccccatcgagaatgcctatgaaacttacgtcaaacagacgacgatggatgcacacctttccagtgggcccttcaggcgaggcaatccagatccatcaccagacccgacaaaatatggcagaactccagggctccgggcaacgagacccaactcactcaagtgcagagcttttagagctggcttaccacgaggccgcagggagacactccaattcgcgacagccaggcgacgggatgtcttttttaaatttctcaggaaccgaggaactttctgtcggcctgctgtccaactccggcgctggcatgaatccgcgtacccagaataaggactcactggaggattcggttagtaccagccccgatcctatgcccgggttttgctgcaccgtcggggtcgattggaagagtttgaccactcccgcctgcctcccactgaccaccgactacttccctgacagacaagggctacagaacgattacacggaaggttgctatgatttgttacccgaagctgatatcgatcgaagggacgaagatggtgttcagatgaccgcacagcaggtctttgaggaattcatctgccagagactcatgcaaggataccagattattgttcagcccaaaacacagaagcctaacccagcagtgccacctcccctgtcttctagcccgctgtactcacgaggccttgtttcccgaaaccgtccagaagaggaggatcagtattggctctccatgggacgcacatttcataaggtgactttgaaggacaaaatgatcacagtgactagatatctacctaaatatccctacgaatccgcccagattcactatacctatagtctgtgcccctcccacagcgattcagagttcgtctcatgttgggtcgaattttcccatgagagacttgaggagtataaatggaactacttagaccagtatatctgttccgcagggagcgaggatttctcactgattgagtcgctaaaattttggcgaacgcgcttcctgctcttgcctgcctgtgtgactgccaccaagagaatcactgaaggcgaagcacactgtgacatttatggggataggccccgggccgacgaggatgagtggcaacttcttgacggtttcgtgcgattcgtagaaggcctgaaccgtattcgtagaagacaccgctccgatagaatgatgagaaagggcactgcaatgaaaggtctccagatgacaggcccaatttcgactcatagccttgagtctactgcacctcctgtgggcaaaaaagggacgtcagctctttctgcactactggagatggaagcctcccagaagtgcctgggagagcagcaggctgccgtgcacggggggaagagctctgcacaatcagcggagtccagctccgtggctatgacccccacatacatggatagccctcggaaagtgtcagttgaccagaccgctacccctatgctggatggaacctcccttggcatctgcactggccagtctatggatagagggaactcgcagacgtttggaaattcacaaaatatcggcgagcagggatacagttccacaaattcaagtgattcctcctcacagcagctggtggcctcctcgttgacgtcgagctcgaccctgaccgaaattctcgaagcaatgaagcacccaagcacaggtgtccaactgctgagtgagcagaaaggcttgagcccctattgtttcatcagcgctgaggtcgttcattggctggtgaatcacgtcgagggaattcagacccaagccatggcaattgacatcatgcagaagatgttggaagagcagctcattacacatgcgagcggggaggcttggcgcacttttatttatggcttttacttctacaaaatcgtcactgacaaggaacctgacagagtagcaatgcaacaaccagcaacaacctggcatactgcaggcgtggatgatttcgccagcttccagcgaaaatggtttgaagttgctttcgtggcagaggagttggtgcacagcgagatcccagcgttcctacttccttggctcccctccagaccggcgtcttacgcatcccggcactctagtttttcccggagcttcggcggcagaagtcaggcagcggcgttgctcgctgctacggtgcctgagcagagaacagtcactctggatgtcgacgtgaataacaggaccgacaggcttgagtggtgcagctgttattatcacggcaatttctcgttaaatgccgcctttgagatcaaactgcattggatggccgtaaccgctgctgtgcttttcgaaatggtgcaaggctggcacaggaaagccaccagctgcggcttcctattagtgccagtgcttgagggaccgttcgcgctaccatcctacctttacggcgaccctctgcgcgcgcagttgttcatccccctcaacatttcttgccttctaaaagaggggtctgagcacctgttcgactcctttgagcccgagacatattgggaccggatgcatcttttccaggaagcaatcgcccaccggttcggattcgtccaggacaagtatagtgcaagtgcttttaacttccccgctgagaataaaccccagtacatccacgtgacaggaaccgtcttcctgcaactgccttatagtaagcgcaaatttagcggacagcaaagacggcgccgaaacagtaccagttctacgaatcagaacatgttttgtgaagaacgggtggggtacaattgggcctacaataccatgctgacaaagacctggagatcgtctgccacaggtgacgaaaagttcgccgatcgcctgctaaaggacttcaccgatttctgcattaacagggataatcgacttgtcaccttttggacctcctgcctggagaaaatgcacgcgtcggccccctag

SEQ ID NO: 185234 - DNA, 138 bp, Artificial Sequence
  Description of Artificial Sequence: Synthetic coding sequence
atgcggaccaccaaggtgtacaagctggtgatccacaagaagggctttggtggatccgacgacgagctcgtggttaatcctaaggtgttcccacatatcaaactcggcgacatagtggagatagcccaccctaactag

SEQ ID NO: 185235 - DNA, 4512 bp, Artificial Sequence
  Description of Artificial Sequence: Synthetic coding sequence
atgcggaccaccaaggtgtacaagctggtgatccacaagaagggcttcggaggctcagacgacgagctagtggttaaccctaaggtgtttcctcatattaaactcggagacattgtcgagatagcacacccaaatgacgagtatagtcccctgctcctgcaagtgaaaagcctgaaggaagacctgcagaaggagaccatttctgtcgatcagaccgtgacgcaggtgttccgcctgcggccctaccaggacgtctacgtcaatgtcgtcgatcctaaggacgtaacactcgacttggtggagctgaccttcaaggatcagtatatcggtcgtggcgatatgtggcgcctgaaaaagagcctcgtttcaacgtgcgcctatattacacagaaagtcgaatttgcaggcattagagcgcaggctggcgaattgtgggtcaagaacgaaaaagtgatgtgtggctatatttcggaagatacccgcgttgtgtttagaagcacctcagcgatggtttacattttcatacagatgagctgtgagatgtgggatttcgacatttacggagacctgtactttgaaaaagctgtgaatggattcctggcagatttattcacaaagtggaaggagaagaactgtagtcacgaggtgactgtagtgctgttcagtaggactttttacgacgcaaagtccgtcgatgagtttccagaaattaacagagctagtattcggcaggatcataaagggagattttatgaggatttctataaggtggtggtgcagaacgagagacgggaggagtggacaagcctcctggtgaccattaagaagctcttcatccagtatcccgtcctcgtccgtttggaacaggccgagggatttccacagggcgacaattctaccagcgcgcagggcaattacctggaagcaattaacctcagcttcaacgtgttcgataagcactacatcaacagaaattttgatagaaccggccagatgagtgtggtaattacacccggggtaggggtgttcgaagtagaccgcctgctgatgatcttgaccaagcagcgtatgattgacaacggaatcggcgtggacctggtgtgcatgggagagcagcctctccacgcagtccctctattcaaactgcataacagatcagctccacgtgattctagactgggagacgactataatatccctcactggatcaaccactcattctatacatctaaaagtcagttattttgcaactctttcaccccgcgcatcaaactcgctggaaaaaagccggcgagcgagaaagccaaaaacggacgtgatacaagtctcggttctccaaaggaatccgagaacgcattgccaattcaggttgattacgatgcctatgatgcgcaggtgttcaggctacctgggccgtcaagggctcagtgccttacaacatgcagaagcgtcagggagcgagagtctcattctcggaaaagcgcatctagctgcgatgtatctagcagcccttcactacctagccggaccttgcccaccgaggaggtgcgcagccaagccagtgacgacagtagcctgggtaagagcgctaacatcctgatgatcccgcacccccacttacaccagtacgaagtgtctagctccctcgggtatacttccacacgagacgtgctggagaacatgatggagccaccgcagagagattccagcgccccaggcagattccatgtggggagcgctgagtcaatgctccacgtaaggcccggaggatatacgccacaaagggccctcattaacccattcgctccatctagaatgcccatgaagctgacatcaaatcgtcggagatggatgcacacattcccagtgggtatgaaccccaggactcagaataaggactccctggaagatagcgtgtcaaccagccccgatccaatactcactctctcagcaccccctgtggtccctgggttttgttgcacagtcggggttgactggaagtctctcacgacccccgcctgtctcccactgactaccgactatttccctgaccgacaggggctgcagaatgattacaccgagggctgttacgacctgttacccgaggcggatatcgacaggcgtgatgaagatggcgttcagatgactgcacagcaggtgtttgaagagtttatttgtcaaagactcatgcagggatatcagataattgtacagcctaagacccagaagcctaatccagcagtccctccacccctgagctccagcccactctactctcgcggtctggtgtcccgtaacaggccagaggaagaagatcagtactggttgagtatgggccgaacgttccacaaggtgactctgaaggataaaatgatcacagtgactcgttacctccccaagtatccttatgagtctgcacagatccactacacctatagcctctgtccatcacatagtgattccgaattcgtgagctgttgggttgagttcagccacgagcggttggaggaatacaaatggaattatctcgaccagtacatctgctcagctggtagcgaagattttagcctgattgagtccctcaagttctggcggacccgctttctcttgctgccagcatgtgtcaccgccaccaagcggattacagagggcgaagcccactgcgatatctacggggacagaccccgcgccgacgaggatgagtggcagctgcttgatggcttcgtgcggttcgtggagggcctcaaccgcatccgcagaaggcatagaagtgacagaatgatgagaaaggggacagccatgaaggggttgcagatgacaggccctatttctacacattccctggagtctaccgccccgcccgtgggtaagaagggcaccagtgcgctttctgccctcctggaaatggaagcaagccaaaaatgcctgggagagcagcaggccgccgtgcatggcggcaagagtagtgcacagtcagctgagagcagctccgtagctatgacacccacctatatggactccccacggaaagtatccgtagaccagaccgccacaccaatgttggacggtaccagccttggtatctgcactggacaaagcatggatcgcgggaactctcaaacgttcggcaatagccaaaacatcggtgagcagggttatagctccacaaattcttccgactcctcaagtcagcagctggtggcaagctccttgacttctagctccactctgacagaaatcctcgaggcaatgaaacaccctagtacgggcgtacagctcctctcggagcaaaagggactttccccttactgtttcatttcggccgaagtcgtacattggttggttaatcacgtggagggtatccagacgcaagcaatggcaatagacataatgcagaagatgttagaagaacagctgattacacatgcctccggagaagcttggcggacctttatttatggcttctatttttacaaaatcgtcacggacaaggagcccgacagggtggctatgcagcagccagccacaacatggcataccgccggagtcgatgactttgccagttttcagagaaaatggtttgaagttgccttcgtggccgaggaactggttcactccgagatccccgcctttctcctaccttggctcccttcaaggccagccagttatgccagtagacacagttcgttttctaggagctttggcggccgttcgcaagccgctgccctgcttgccgcaaccgttccagaacaaaggacagttaccctcgatgtggatgtgaataacagaaccgatagactcgaatggtgttcatgttattatcatgggaacttctcactgaacgcggccttcgagatcaaactccactggatggctgtaacagctgcagtgctattcgagatggttcagggctggcatagaaaagcgacctcatgcggtttcctgctggttcctgtcctcgaaggcccttttgcactcccaagctatctctatggagatccactgcgggcccagctgtttatccccctcaatatcagctgtctgctcaaagagggatccgaacatctctttgatagttttgagccggagacttactgggatcggatgcatctgtttcaggaggctatcgcgcacagatttggctttgtccaggacaaatactctgcctcggcctttaactttccggctgaaaacaaacctcagtatatccacgtaacaggcactgtgttcttacagctgccttactcgaaacgcaagttctctggccaacagcggcgtaggagaaatagtactagctctactaatcagaacatgttctgcgaggaaagagtcggatacaattgggcttataataccatgcttaccaagacttggcgttcctcagccactggagatgaaaaattcgctgatagattactcaaagatttcactgacttctgtatcaaccgcgacaacagactagtgacgttttggacctcatgcctggaaaagatgcatgcctccgcaccttag

SEQ ID NO: 185236 - DNA, 1995 bp, Artificial Sequence
  Description of Artificial Sequence: Synthetic coding sequence
atgcggaccaccaaggtgtacaagctggtgatccacaagaagggctttggagggagcgatgatgagttggtggttaatcccaaagtgttccctcacatcaaactgggcgacattgtggaaatcgcccatcctaacgatgagtactccccattgctcctccaagtgaaaagcctgaaagaggacctgcagaaggagacgattagcgtcgatcagaccgtcacacaggtgttccgactaaggccatatcaggatgtatatgtaaatgtagtcgaccccaaggtttcaacttgcgcgtacatcacccagaaagtagagttcgctgggattcgcgctcaggctggggaactgtgggtgaagaacgagaaggtcatgtgtggatatatcagcgaggatacccgggtggtgtttcgctccacctccgcaatggtgtacatcttcatccagatgagttgtgaaatgtgggatttcgatatctacggggacctatacttcgaaaaggccgtgaatgggttcttggcagacctgttcacgaagtggaaggagaagaattgctcacacgaggtgactgtagtcctcttcagtaggaccttttacgacgctaaaagtgtggatgagttcccagagattaaccgcgcctctatccgacaggaccacaagggccgcttttacgaagatttttataaggtagttgtccagaatgagaggcgggaggaatggacatccctgttggtcacaatcaagaaactatttattcagtatcccgtcttagtgcgactggaacaggcggaaggattccctcagggagacaatagcactagcgctcagggaaactacctggaggcaataaacctttccttcaacgtgttcgacaagcattacatcaaccggaattttgaccgcacggggcagatgagtgtggtgattactcccggcgtgggggtgttcgaggtggacagacttctcatgatcttaactaagcagaggatgattgacaacgggatcggcgttgatctggtgtgtatgggcgaacagccattgcacgccgtaccactgttcaaattgcacaaccgatcagcgcccagagactcccggcttggggacgattacaacatcccacactggatcaatcacagtttctacacctctaaatcccaactgttttgtaatagcttcactccacgcataaaattggcagggaaaaagcccgcctcggagaaggctaagaacggtagggacacgtcactgggtagccccaaggaatccgagaacgccttgcctatacaggtcgattacgacgcatatgacgcccaggtgtttagattacccggaccatctcgggcccagtgccttacaacgtgcaggagcgtgcgggaaagagagtctcactccaggaaatctgcatcctcctgcgatgttagcagcagcccatctttgccttcacgcactttgcctactgaagaagtgcgatcacaggcctcggacgattcctctctgggaaagtctgcaaatattttaatgatcccccaccctcacttacatcagtatgaagtgtcgtctagcctcggatatacaagtaccagagatgtactggagaacatgatggaacctcctcagcgggactcctccgcacccggccgattccacgtggggtctgcagaaagtatgcttcatgtaaggcctggcggctataccccccagcgcgccctgatcaaccctttcgccccctcacgcatgcccatgaaacttacgagcaatagacgacgatggatgcacacttttccagtcggcatgaatcctagaacacaaaataaagactccctggaggacagtgttagcacttcacctgatccctctaaacgaggtcaactcaccggggagcgagggcgacaaggcgtgtggggcgggcaatcaatgcggaaacaagaggaagctttgtgggaagtgagtggacccgaggttcacattccacttggctatggcaaagctatgtggtag

SEQ ID NO: 185237 - DNA, 1263 bp, Artificial Sequence
  Description of Artificial Sequence: Synthetic coding sequence
atgaagcaccccagcaccggcgtgcagctgctgagcgagcagaaggggctctcaccatattgcttcatttccgcagaggtcgttcactggctcgtgaaccacgttgaaggaattcaaacgcaagccatggctattgatattatgcaaaagatgctggaggaacagcttattacacacgcctccggcgaggcttggcgaacgtttatctacggattttatttttacaagatcgtgaccgacaaagagcctgatcgtgttgctatgcagcagccagcaaccacatggcacacagcgggagtagacgacttcgcatcttttcagcggaagtggttcgaggtagcatttgtcgccgaggagcttgtgcatagtgagataccagcgttccttcttccttggctgccaagccggccagcgtcctatgcctccagacattcctctttcagccgttcattcggcggtagaagtcaagcagctgcgctgctggctgctaccgttccagagcaacgtaccgtcacattggacgtggatgtgaacaacagaacagatcggcttgaatggtgtagctgctactatcacggaaatttttccctcaacgcagcgtttgaaataaaactccactggatggctgtgacagcagcagtgttgttcgagatggtgcagggttggcaccgcaaagcgacctcttgcgggtttctcttggtgcccgttcttgagggtcctttcgcattgcctagttacttgtatggtgatccactcagggcgcagctgttcatcccactgaatatctcgtgccttctgaaggagggaagtgagcatctgtttgattcctttgagcctgaaacatattgggaccgcatgcatctgtttcaggaggccatcgcacacagatttgggttcgtgcaggacaagtacagcgcttccgcctttaattttccggcagaaaacaaaccccagtatatccatgttacaggcaccgtctttctccaactgccatattccaaacgcaagttttcaggtcagcagaggcgaaggaggaactctacctcgtctactaatcaaaatatgttctgcgaggagagggtgggttacaattgggcgtataacactatgctgaccaagacttggcgcagcagcgcaactggtgacgaaaaatttgccgatcggctgctgaaagatttcaccgatttctgcatcaaccgtgacaacaggctggtcactttttggacaagctgccttgagaagatgcacgcatccgcgccgtag

SEQ ID NO: 185238 - DNA, 4785 bp, Artificial Sequence
  Description of Artificial Sequence: Synthetic coding sequence
atgcggaccaccaaggtgtacaagctggtgatccacaagaagggcttcggcggctctgatgacgagctggttgtaaaccccaaagtcttcccgcatattaagcttggcgacattgtcgagattgcccaccctaatgatgagtattcccccctgctgctccaggtaaaaagcttgaaggaggacctacaaaaagagacgattagtgtggaccagacagtgacccaagtcttcagactgcggccctaccaggacgtatacgtgaacgtggtcgatccaaaggatgtcacactcgacttggttgaattaacattcaaggaccagtacatcgggcggggcgacatgtggaggctgaagaaaagtttggtgtccacctgtgcctacattacacagaaggtcgagtttgccgggatcagggcccaggccggagagctttgggtaaagaatgaaaaagtgatgtgcggctatatcagcgaggatactagagttgtgttccggtccacaagtgccatggtctacatttttatccagatgagctgcgagatgtgggattttgacatttacggggacctttactttgagaaggccgtgaatggatttctagcagatctatttactaaatggaaagaaaaaaactgctcacacgaagttaccgtggtcctcttctcccggacattttacgacgccaagtccgtcgacgaattcccggagattaacagagcgtctattcgccaggaccataagggccgattctatgaagatttttataaggtcgtagtccaaaatgagcgacgtgaggagtggacatctttgctagttacaatcaagaaattgttcatccaataccccgtgctcgttcgccttgaacaagccgagggattcccacaaggggataattctacatctgctcagggtaattacctcgaggctattaacttgagctttaacgtctttgataagcactacataaaccgtaatttcgatcgcactggacagatgtcagttgtcatcaccccaggcgtaggtgtgtttgaggtggacagacttttgatgattctaacgaaacaaaggatgatcgacaatggcattggagttgacctggtatgcatgggagagcaacccctacacgcagtaccactcttcaaactccataatcggtccgcccctcgtgatagcagactcggagatgactacaatattccccactggatcaaccactccttctataccagcaaatcccagctgttttgcaactccttcactccacgcattaagctcgcgggaaagaagcctgctagcgagaaggctaaaaacggccgggatacatcactgggatccccgaaggagagcgaaaatgcactgccaatccaggttgactatgatgcctatgacgcccaagtgtttcggctacctgggccctctagagcacagtgtctgactacctgcagatctgtgcgggagagagagtcgcactcccgtaagagcgctagcagttgtgacgtgtcctcgagccccagcctgccttccagaacgctgccaacagaggaggtgcggtcacaggcttcagacgactcctcattaggcaagagtgccaatattctcatgatcccgcatccgcatcttcatcaatatgaggtgtctagttcacttggatatacatctacacgggatgtgctggagaatatgatggagccacctcagagagattcatctgcgcctggaaggttccacgtcgggtctgctgaatccatgctgcatgtgcgcccaggaggctatacaccccagcgcgctctgatcaatcctttcgctccttccagaatgcccatgaagcttacatccaaccgccgcagatggatgcacacctttccagtcggaccgtcaggggaggctatccaaatccaccaccagacacggcagaatatggctgaactgcagggatccggtcagagggacccaacccactcatccgcagagctgcttgaactggcatatcacgaggctgcgggacgccattctaatagccgacaacccggagacgggatgtcctttctcaattttagcgggacagaggagttgagcgtaggtctgctttccaatagcggcgccggcatgaaccctagaacgcagaacaaggacagtctggaagattctgtctcgaccagccctgaccccatgcccggattttgctgcacagtgggggttgactggaaatcccttaccacaccagcctgtctgccactgactaccgactacttcccagatcggcaaggtctgcaaaatgattatactgagggctgctacgatcttctacctgaggcagatatcgataggagagacgaagacggagtgcaaatgacggctcaacaggtatttgaagaattcatctgccaacggcttatgcagggttatcagatcattgtccagcccaagacccaaaagcctaaccctgcagtgccccctcccttgagctccagtcctttatattcccgcggcctggtatccagaaatcgacctgaggaggaagaccagtactggctttccatggggaggactttccacaaggtgacattgaaggataagatgattacggttacccgctacttgccaaaatacccctatgagtctgcgcaaattcactatacttacagcctgtgtcctagccacagtgactctgaattcgtgtcatgctgggtggaattctcccacgagcggttggaggaatacaaatggaattatctcgaccagtatatttgttctgctggaagcgaggattttagcttgatcgaaagcctgaagttttggcgaactaggtttctcctactcccagcctgcgttaccgccaccaagcggatcacagagggcgaagcccactgcgatatctatggggatcggccccgcgccgacgaagacgaatggcaactactggacggattcgtgcggttcgtcgaaggcttgaaccgcatccggcgccggcacaggtcggatcgtatgatgcggaaggggactgccatgaagggcctccagatgactggcccaatcagtactcacagcctggagagcaccgcaccacctgtgggaaagaaaggcacttctgcactatcagctctacttgaaatggaggcgagtcaaaaatgcctcggcgagcagcaagccgctgtgcacggcggcaaatcctcagctcagtcagcggagtcttcaagcgtcgctatgaccccgacctacatggactctcctcggaaggatggagccttctttatggagttcgtcagatcaccaagaactgcctctagcgctttctaccctcaggtgtcagtagaccagactgccacaccgatgctcgatggcacctctctcgggatctgcacaggacaatccatggatagaggcaacagccaaacattcggaaatagccagaatatcggtgagcaaggttattcatccaccaacagctccgactcctccagtcagcagttggtggcatcctcactgacctcgagctctactctgacagagatactggaggcaatgaagcacccttcaactggcgtccaattgctttctgagcagaaaggtctgagtccttattgcttcatttccgccgaagttgttcactggctagtgaaccacgtggagggtatacagacccaggctatggccatcgacatcatgcagaaaatgctggaggaacagctgattacacatgcctctggcgaagcctggcgaaccttcatctatgggttttacttctataaaattgtgacggataaagagcccgaccgggtggccatgcagcagcctgcaaccacctggcataccgctggcgttgacgatttcgcaagttttcagaggaaatggttcgaagtagccttcgtcgcggaggagctggtgcactctgagattccagcctttttgctcccctggttaccgagtagacccgccagctacgcctctcgccactcaagcttctcgcgctcattcggaggacgtagccaggccgcggccctgttggcggccacggtgcctgagcagaggacggtgacactcgacgttgacgtgaacaacaggacggaccgtttagagtggtgctcctgttattatcacggaaacttttcactgaatgcagccttcgagattaagctgcactggatggcagtgacagccgccgtgctgttcgaaatggtacaaggctggcacagaaaagccaccagctgcggatttctcttggtcccagtgctcgaggggcctttcgcgttgccaagttacctgtacggtgaccccctgcgggctcaacttttcattccgctgaacatatcttgtttactcaaggaaggatccgagcatctctttgattccttcgagcccgaaacttactgggacagaatgcacctgtttcaggaggccatcgcacaccgttttgggtttgtccaggacaagtatagtgcaagcgcctttaacttccccgcagagaataagccgcagtatatccacgtgactggaacggtgttcctgcagttgccttattctaaacgtaagttttccggccagcagcgccgtcggcgtaacagcacgtcctcaaccaatcagaatatgttctgcgaagaaagagtgggttataactgggcctacaataccatgctgaccaaaacatggcggtctagtgccactggtgacgagaagtttgccgataggcttttgaaggacttcacagatttttgcattaaccgggacaacagacttgtcaccttctggacaagctgcctggagaaaatgcacgcatccgccccttag

SEQ ID NO: 185239 - DNA, 1536 bp, Artificial Sequence
  Description of Artificial Sequence: Synthetic coding sequence
atggccaccgtgcaggagaaggccgccgccctgaacctgagcgccctgcatagccccgcccaccgcccaccaggctttagtgtggcccaaaaaccttttggcgctacatacgtgtggtcgagcatcataaacacgctgcaaacccaggtagaagtaaagaagagaaggcatcggctgaagaggcacaacgattgcttcgtcggttccgaagctgtggatgtgatcttttcccatctgatacagaacaagtactttggcgacgtagacatcccacgtgccaaggtcgttcgggtgtgccaggctctgatggactacaaggtattcgaagccgtgccaacaaaggtctttggtaaagataaaaagcctaccttcgaagatagtagttgctccttgtacaggttcaccaccatccctaatcaggactcgcagctggggaaggagaataagctatatagccctgcgcgctatgcggacgcactctttaagtcatctgacatcaggtcagccagtcttgaggatctttgggagaatctgagcctaaagcctgcaaattcccctcacgtgaacatttcagcaaccctaagcccccaggtcattaacgaggtgtggcaggaggaaactattggacggctgctacaattagtagacctgcctttattggattctcttctcaagcaacaggaggccgtccccaagatccctcagcccaagcggcaatcgacgatggtcaactccagcaattacctagaccgtggaatcctgaaggcgtattccgactcccaagaggatgaatggctttctgcagccatcgactgcctcgagtacttgcccgatcagatggtcgtggaaatttccagatcctttcctgagcagcccgaccggactgatctggtaaaagagctattgttcgatgccataggccggtactacagctccagggaacctctgctgaaccatctgtcagacgtgcataacggaatagctgaactcctggtcaatgggaagacagaaattgccctagaggccacacaactgctcctgaaattgctggatttccagaaccgggaggaattccgacggctgctgtatttcatggctgtggcagctaaccctagcgaatttaagctgcagaaagaatccgataacagaatggttgtgaagcgaatttttagtaaagccatagtggataacaaaaacctctccaaggggaagactgacttgttggttctattcttgatggatcaccaaaaggatgtattcaaaattcccggaaccctgcacaaaatcgtaagcgttaaactaatggcaattcagaacggccgggatcccaacagagatgccggatacatctactgccaacggattgatcaacgggactattccaacaatactgagaaaactactaaagatgagcttctcaacttgttgaaaaccctcgacgaggacagcaagctgtccgcaaaagagaagaagaaactcctagggcaattttacaaatgccatccagacatctttattgagcattttggagattag

SEQ ID NO: 185240 - DNA, 1509 bp, Artificial Sequence
  Description of Artificial Sequence: Synthetic coding sequence
atgcggggcctgtgcgagttctactggcaggagttcggcatcaagggcttctctgtggcccagaagccattcggggccacatatgtctggagctcgatcattaacacactgcaaacccaggtggaggtaaagaagcgccgccatcgtctcaaacgccacaatgattgtttcgttggtagtgaagccgtggacgtgattttttcccacctcatccagaacaagtactttggcgatgtcgatataccccgggccaaagtcgttcgggtctgtcaggccttgatggactacaaagtcttcgaggcggtgccgacgaaggtcttcggtaaggataaaaaacctactttcgaggatagcagctgcagcctgtacagatttaccactatccctaatcaggacagtcaattgggcaaagaaaacaagctgtattctcctgctagatatgcagacgccctgtttaagtcctcggacatcagaagcgcctccctggaagacctgtgggagaacttgagtctgaagccagccaatagcccccatgttaatataagcgcaaccctgtccccacaggttatcaacgaagtgtggcaagaggagactatagggcgattgctgcaactggtagacctcccactgctcgacagcctgctcaaacagcaggaggcggtacccaaaattcctcagcccaaaaggcagagcactatggtgaacagttctaattaccttgacagaggcattctgaaggcatactctgattcccaagaggacgaatggctttctgccgcaatagattgcttggaataccttccagatcagatggtagtggagattagcaggagctttcccgagcaacccgacagaaccgacttggtgaaggagcttctctttgatgcaataggtagatactactccagccgcgaacccctgttgaatcacctatccgacgttcacaacgggatcgccgagctgttagtgaatgggaagacggaaatcgcgttagaggccactcaattactcctgaaactactagatttccaaaatcgcgaggagtttcggaggctactgtacttcatggccgtggcagccaacccttcagagttcaaactgcagaaggagagtgacaacaggatggtggtcaagcgaatttttagcaaggccatcgtagataacaagaacctgtccaagggaaaaacagatctgcttgtactatttcttatggatcaccagaaagacgtttttaagataccggggacactacacaaaattgtatctgtgaagctaatggcgatccagaacgggcgggacccgaatagggacgctggatatatttactgccagagaatcgaccagcgggattacagcaacaatacggaaaaaaccaccaaagacgaacttctgaacctgctgaaaaccctcgatgaagattccaaactgtccgccaaggagaaaaagaagctcctgggccagttctacaagtgtcatcctgacatcttcatcgaacatttcggagactag

SEQ ID NO: 185241 - DNA, 1230 bp, Artificial Sequence
  Description of Artificial Sequence: Synthetic coding sequence
atggaggagggcggcagcaccggcagcgccggcagcgacagcagcacatctggttctgggggagcgcagcagcgggaactcgaaaggatggctgaagtgctggttacaggcgaacagttgaggctgagactccatgaagagaaggttataaaggatcggagacatcatctgaagacttatccgaattgctttgttgctaaggaacttatcgattggctgatcgagcataaagaggcctccgaccgggagaccgcgattaaacttatgcagaagcttgctgaccggggcattatacaccacgtgtgtgatgagcataaagagtttaaagacgtgaagctattttataggtttagaaaagatgatggtacattcccattggataacgaagtgaaggcatttatgcggggacagcgattatatgagaaacttatgtcccctgaaaataccctcctgcagcccagagaggaggaaggcgttaaatatgagcgcaccttcatggccagcgagttcctggattggctcgtgcaggagggcgaggccaccaccagaaaggaggcagagcagctttgccacaggctcatggaacacggcatcatccagcacgtgtccaacaagcatccgttcgttgacagtaatctcctttaccagtttcgcatgaattttagacgtaggcgccggctgatggagttgctcaacgagaagagccctagcagtcaggaaacccacgactctcccttttgcctgcgcaagcagtctcacgacaaccggaagtccactagttttatgtcggtttcccctagcaaggagattaagatcgtgtctgcggtgcgcagatcttcaatgtcatcttgcggcagtagtggatacttctcttcctccccaacgctatcaagctctccccccgttctgtgtaaccccaaatcagtgttaaagagacccgttacatccgaagagttgttgactcctggggctccttacgcacgcaagacattcacaatcgtgggggacgcagtcgggtgggggttcgtcgtgaggggaagtaaaccatgccacatccaagctgtggacccatctggaccggctgccgccgcaggcatgaaagtatgccagttcgtggtgagcgttaacgggcttaacgtgctgcatgtcgactacaggacagtgtcaaatctgattctgaccggtccacggaccatagtgatggaagtgatggaggaactggaatgctag

SEQ ID NO: 185242 - DNA, 2877 bp, Artificial Sequence
  Description of Artificial Sequence: Synthetic coding sequence
atgcggacccacacccggggcgcccccagcgtgttcttcatctaccttttatgtttcgtatccgcgtacatcacagatgaaaaccccgaagtaatgatcccttttaccaatgccaattacgactcccatccaatgttgtattttagccgggccgaggtagcggaattgcagctcagagccgctagcagtcatgagcacatcgcggccaggctcacagaagctgttcatacaatgttgtcaagtccactggagtacctcccgccctgggaccccaaagattatagcgcaaggtggaacgagattttcgggaacaacctgggggctctggctatgttctgtgtattgtacccggagaacattgaggcccgtgatatggccaaagactacatggagagaatggccgcccagccatcctggttggttaaggatgcgccttgggacgaggtgccacttgctcattccttggttggcttcgcaaccgcatatgatttcctgtataactacttgtcaaagacacaacaggagaaatttctcgaagtgatcgctaatgcgtccggctacatgtatgaaacttcataccggagaggctggggctttcaatatctccacaatcaccagcccacgaattgtatggctctgctgacagggagcctggtcctgatgaaccagggctacctgcaggaagcttacctttggacgaagcaggtgctgactatcatggaaaaatctttggttctgttacgggaggtcaccgacggaagtttatatgagggggtcgcctacggcagctacactacaagatctctttttcaatacatgttcctggtccagcgccactttaacatcaatcactttgggcacccttggctgaaacagcacttcgcgtttatgtatagaacgattctgccgggttttcagagaactgtcgcaatcgcagatagcaactacaactggttctatggtcctgaaagtcagctggtatttcttgacaagttcgtgatgcgtaatggcagtggtaattggttggctgaccagataagaaggaacagggtggtggaaggaccagggactcctagtaagggacagcgctggtgtactctccacaccgagttcctgtggtatgatgggtctctgaaatccgtcccccctcctgactttggcacacccactcttcactacttcgaagactggggggtagtaacgtacggaagtgctctcccggcggagatcaatcggtctttcttgtccttcaaatccggtaaactcggaggaagagcgatctacgacattgtccatcggaataagtacaaggactggatcaagggttggagaaacttcaatgccggccacgagcacccggatcagaactcttttactttcgccccaaacggagtacctttcattactgaggctttatatgggccgaagtatacctttttcaacaacgttcttatgtttagcccagcggtgtcaaagtcttgcttcagcccatgggtgggccaggtaacggaagactgcagctccaagtggtccaaatacaagcacgatttggcggcttcttgccagggacgcgttgttgcagccgaggaaaaaaacggggtggtgtttatccgtggggaaggcgtaggcgcctataacccacagcttaacttgaagaatgtgcagaggaatctgatactgcttcacccccagcttttactcctcgtggatcagattcacctgggagaagagtcgccgttagagactgccgcctccttcttccacaacgtggacgtaccattcgaggaaacggtggttgacggcgtgcatggagcatttattcgccagagggacggcctctacaagatgtattggatggacgataccggatatagtgagaaagccaccttcgcatcagtaacctacccgcgcgggtacccctataacgggacaaactacgtgaacgttaccatgcatctgcgctctcctattaccagggcggcttatctgttcatcggccctagtattgacgtccagagcttcaccgtccacggagatagccaacagctggatgtgtttattgcgacgtctaagcatgcctacgccacatatctttggaccggagaagccaccggccaatcagcatttgcccaggtgatcgccgatagacataagatcctgttcgatagaaactccgctatcaagtctagcattgttccagaagtcaaggactatgcagctatcgtggagcagaatctgcagcactttaagccagtgttccagctcttagaaaagcagattctttcccgtgtgagaaacactgcttcgttccgaaagaccgcagaacggctgcttaggttctccgataaacggcagactgaggaagcaatcgacagaatttttgctatctcgcaacaacagcagcagcagtccaaatctaagaagaaccggagggccggcaaacggtacaaattcgttgatgccgtccccgacatcttcgcacaaattgaagtaaacgaaaagaagattcgccagaaggcacagattctggcccagaaggaactgcccatcgacgaggatgaagaaatgaaggaccttctggacttcgcagacgtaacgtacgagaagcacaagaacggtgggctgatcaagggccgtttcggacaggccaggatggtcactacgactcactctcgtgccccatcactatccgccagttataccaggctgttcttgattctcaacattgccatcttcttcgtaatgcttgccatgcaactcacttattttcagcgagctcaaagcctgcacggccaaagatgtctgtatgccgtcctgctcattgactcgtgtattctgctctggctgtactcttcctgttcccaatcacagtgttag

SEQ ID NO: 185243 - DNA, 2877 bp, Artificial Sequence
  Description of Artificial Sequence: Synthetic coding sequence
atgcggacccacacccggggcgcccccagcgtgttcttcatctacctcctgtgttttgtctctgcctatataacagacgaaaatcccgaggttatgattcccttcactaacgcaaactacgatagtcaccccatgctttattttagcagggcggaggtagccgaactgcagttacgtgcagcctcaagtcacgaacacattgctgcacgcctcaccgaagccgtccatacgatgttatccagtcccttggagtatctgcccccgtgggatcctaaggattatagcgcaagatggaacgaaatatttgggaacaacttgggagccttggcaatgttctgcgtgctctatccggagaatattgaggcacgcgatatggctaaagactacatggaaagaatggccgcccagccttcatggctggtgaaggatgccccatgggatgaggttcccctggctcatagcttggttggtttcgccacagcttatgattttctttacaactacttaagcaaaactcagcaggagaaattcctggaggtaatagctaacgcttccggctacatgtacgagacctcctatcgccgcgggtgggggtttcaatatcttcataaccaccagcccacaaactgcatggccctcctcacaggctcactcgtgctgatgaaccaggggtacctgcaagaagcatatctttggacgaagcaggtccttactattatggagaaaagtcttgttctccttcgagaggttacagacgggagcttgtacgaaggcgtcgcctacggttcttacacaacaaggtctctgtttcagtacatgttccttgtgcagagacattttaacatcaaccactttggccacccctggctgaagcagcatttcgccttcatgtacaggaccatccttcccggctttcagaggactgtggctatcgcagatagcaattataattggttttacggccctgagtcccagctcgtgtttttggataaatttgtgatgaggaatggtagcggcaattggctggcggaccagatacgacggaatagagtggtggagggtcccggcaccccgtctaagggtcaacgatggtgcactctgcacactgaattcctgtggtacgacgggtcgctgaagagtgttccgcccccagacttcggcaccccgactctgcactactttgaggactggggggtcgtcacctacgggtcagcattacccgcagagatcaaccgcagctttttatcctttaagtcaggcaaacttggtgggcgggccatttatgacattgtgcatagaaacaagtacaaagattggatcaaggggtggaggaactttaatgccggccatgagcacccagatcaaaatagctttacatttgcccctaatggggttccgtttattacagaggctttgtatggccccaagtatacattcttcaacaatgttctgatgttctcgcctgctgtgagcaagtcctgctttagtccatgggtcggacaggtaacagaagactgctcttccaaatggagcaagtataaacacgatctggcagcctcctgccagggtagggtagtcgctgctgaagagaaaaacggcgtggtgttcataagaggtgaaggggttggggcatataacccccagctgaatctgaaaaatgtacagaggaacttaatcctgctacaccctcagctcctcctgttggttgatcagatccacctgggagaggagtcccctctggaaacagccgctagtttttttcataacgtggatgtgcctttcgaggaaacagtggtggatggcgttcacggcgcttttatacgtcaacgggatgggttatacaagatgtactggatggacgacaccgggtatagtgaaaaggccacattcgccagcgtgacataccctagaggatatccgtacaatggcaccaactatgtcaacgtgacaatgcacctgcggagtcccattacgcgtgctgcctacctttttattggacctagtattgatgttcagagcttcacggttcacggtgactctcagcagctggatgtcttcatcgctaccagcaaacacgcttacgcaacatacctctggacgggagaagcgactggccagagcgcttttgcgcaggtgatcgcggacagacacaagatcctttttgaccgcaattccgctatcaaatcctccattgtcccagaagtgaaggactatgccgcaattgtggaacagaatctccagcattttaagccagtcttccaactgttggaaaaacaaattctgagtagggttcggaacactgcatccttcaggaaaaccgcagagaggctgctgaggttctccgataaacgccagaccgaagaagcaattgatcggatattcgccatatcacagcagcagcagcagcaatccaagagcaagaaaaacaggagagccggaaagcgctacaaatttgtggatgctgtccccgatatcttcgcccaaatcgaagtcaacgaaaagaaaatccggcagaaagcccaaatattagcccagaaggagttacccatcgacgaagacgaagagatgaaagacttgttggacttcgctgatgtgacttatgaaaagcataaaaatggtgggttgataaaagggaggtttgggcaggctcgtatggtaaccaccacccattctagagcaccctctcttagtgcttcgtatacacgtctatttctgattcttaatatcgcaatattctttgtgatgcttgctatgcagctcacttacttccagcgcgcacagagcttacacggacagcggtgcctatatgcagtcctcttaattgattcttgcattctgctctggctctactcctcctgcagccagtcccagtgctag

SEQ ID NO: 185244 - DNA, 501 bp, Artificial Sequence
  Description of Artificial Sequence: Synthetic coding sequence
atgcggacccacacccggggcgcccccagcgtgttcttcatctaccttctttgctttgtctcagcatacattactgacgaaaatccggaggtgatgataccttttactaacgcaaattacgactcccatcccatgttatacttttcacgcgccgaagtggccgaactacagctcagagccgcatcctcacacgagcatattgcggcacgccttactgaagctgtgcataccatgctgtcatcaccccttgagtacctcccaccttgggaccccaaagactatagcgcaagatggaacgaaattttcggtaacaatttgggcgctctggcaatgttctgcgtcctctaccccgaaaatatcgaagccagagacatggccaaggactacatggaacgcatggctgctcagccttcttggctggtgaaagacgccccttgggacgaggttccactggctcattccctcgtaggttttgccacagcctatgattttctgtattag

SEQ ID NO: 185245 - DNA, 2877 bp, Artificial Sequence
  Description of Artificial Sequence: Synthetic coding sequence
atgcggacccacacccggggcgcccccagcgtgttcttcatctacctcttgtgtttcgtgtccgcatatatcacggacgagaaccctgaggtgatgattccttttactaacgctaactacgattcccacccaatgttgtactttagcagggccgaagttgctgagttgcagcttagagccgcttcttcacatgaacacattgccgcaaggcttactgaagcggtccacactatgctgtccagcccactggaatatcttcctccctgggatccaaaggattattctgctagatggaacgaaatcttcggcaataatctgggcgccctagccatgttttgcgtgctataccccgaaaacatagaagcgcgagatatggccaaggattatatggagagaatggccgcccagccaagctggttggtgaaggacgccccctgggatgaggtgccactcgcccactcgctggtgggcttcgccacagcgtacgattttctgtacaactaccttagcaagacacaacaggagaagttcctggaagtgatcgccaacgcaagtggctacatgtacgagacctcttaccgaagagggtggggcttccagtacttacataatcaccaaccgactaactgcatggccttgctgacaggctcactcgtgttaatgaaccaagggtacttgcaggaggcttacctgtggacaaagcaggtgctgaccattatggagaaatcccttgtgctgctcagggaggtcactgacggtagtctttatgaaggcgtggcctatggatcctacaccacccgctcactgtttcagtacatgttcttggtccagcggcatttcaacattaatcatttcggacacccatggctgaagcagcatttcgctttcatgtatcgcacaatcctacccggatttcagaggacggtggccatcgcagatagcaactataactggttttatggccctgaatcccaactggttttcctggataaatttgtcatgaggaacggcagtggaaactggcttgccgaccagatcaggcgcaatagggtggtcgaaggacctggaaccccctctaagggccagagatggtgcacactgcacacagaattcctgtggtatgatgggtcactgaagtccgttcctcctcccgactttgggacccctaccctgcactactttgaggattggggggttgtgacctacggatcggctctacctgccgaaattaataggagcttcctcagcttcaagtccggcaagctgggggggcgggcaatttatgacatcgtgcaccggaataagtataaagattggattaaaggctggaggaactttaacgctggccacgagcacccggatcaaaactctttcacctttgctccaaacggagttccatttatcacagaagctctgtatggacctaagtacacttttttcaataacgtgctgatgttctccccagcagtctccaaaagttgcttctctccttgggtgggccaggtgactgaagattgttcatcaaaatggtctaagtacaaacatgatctggccgcgagctgccagggaagggtggttgctgcagaggagaaaaacggtgttgtattcattcggggggagggcgtgggcgcttataatcctcaattgaatctgaaaaatgtccaaagaaacctgattctcctccacccacagctgctgctgctcgtcgatcagattcacttgggcgaagagtcccctcttgaaactgccgcatcctttttccataacgtcgacgtgcccttcgaggagaccgtagtagatggtgtgcatggagcatttattcgccagcgagatgggctgtacaaaatgtattggatggacgacacgggttattcagagaaggccacatttgcaagcgtgacctaccccagagggtatccatacaacggcactaactacgttaacgtgacaatgcacctcagaagtccaatcaccagagctgcctacctcttcattgggccgtcaattgatgtacagtcattcaccgtgcacggagacagtcagcaactggatgtgtttatagccacgagcaaacatgcctatgccacatacctttggacgggggaggctaccggacagtcagcctttgcacaggtgatagcagatcgacacaaaattttgtttgaccgtaactctgctattaaatcctctattgtccccgaagtaaaagattatgctgctatagtggaacagaacttacaacacttcaagcctgtcttccagctgctggagaaacagattctatctagggtgcgaaacacggcctccttccggaaaacagcagagaggctcttacgattctcagataaaaggcagacggaggaggccatcgatagaatattcgccatctcacagcagcagcagcagcaatccaaatccaaaaaaaatagacgcgctgggaaacggtataagtttgtcgacgcggtccctgacatctttgcacaaattgaggttaacgagaagaaaatccggcaaaaggcacagatcctcgcgcagaaagaactgcctatcgacgaagacgaagagatgaaagacctgcttgatttcgccgatgtcacctatgagaagcacaagaatggtggactgattaaagggcgctttggacaggcccgcatggtgacaaccacacacagccgtgcgccgtcactcagcgcctcttatactaggctgtttcttatcctgaatatcgcaattttttttgtgatgcttgcaatgcagcttacctactttcagagggctcagagtctgcatggacaacgctgcttgtatgcggttttgcttatcgactcatgtatactgctttggctttatagctcatgtagtcagtcccagtgttag

SEQ ID NO: 185246 - DNA, 2934 bp, Artificial Sequence
  Description of Artificial Sequence: Synthetic coding sequence
atgggcagcttcgaggacggcctggccgccctggagatctggcggagcgacgctactatgaggacacacactcggggcgcgcctagtgtcttctttatttacctcttgtgctttgtgtctgcttacattactgacgagaaccccgaggttatgatccccttcaccaatgctaattacgacagccaccctatgctctatttctcccgtgctgaagtggccgagttacagctccgagctgcctcatcacacgagcatatcgccgccaggctgaccgaagctgttcatacgatgctatccagtccactggagtatttgccaccatgggatcctaaggattattctgcccggtggaatgaaatctttggcaacaacctgggcgcgctggccatgttctgtgttctgtacccagagaacattgaggctagggatatggccaaagattacatggagagaatggctgctcagccaagttggctggttaaggatgccccttgggacgaggttccactggcccatagtctggttggctttgccaccgcctatgattttctgtataactacttgagtaagacacagcaggagaaattcctggaggtgatcgccaatgcatcgggatacatgtacgagactagttatagacgagggtggggctttcaatacctacacaatcaccagcccactaactgcatggccttattgactggtagtttagtattaatgaatcagggataccttcaggaagcttatttgtggaccaagcaggttctcacaatcatggagaagagcctggttctattgcgggaggttactgacggctcactctatgaaggtgtggcatacggaagctatactactagatctctgttccagtatatgtttctggtgcagcggcacttcaatatcaatcattttggccatccctggctgaagcagcacttcgcattcatgtatcggacaatccttccgggattccagcgaactgtggcaatcgctgactcgaattacaactggttttacggccctgagtcccagttagtctttctggacaagtttgtgatgaggaacgggagtggaaattggttagccgatcagattaggcgcaaccgcgtggtggagggacccggaacacccagcaagggccagcgttggtgcactctgcacaccgaatttctttggtacgatggatcattgaaaagcgttccgcctccggatttcggcactcccaccctgcattatttcgaagactggggagtggtgacctacggcagcgcgttgccagccgaaatcaaccgctctttcctgagttttaagagcggcaaactgggcggtcgggcgatctacgacatagtacacagaaacaagtacaaagactggatcaagggatggaggaacttcaacgctggtcacgagcatcctgatcaaaatagtttcactttcgcaccaaatggagtgcccttcattactgaggcactctatgggcctaaatacaccttttttaacaacgttctgatgttttcacctgcagttagtaaatcatgctttagcccctgggtcggccaagttaccgaggactgtagcagcaagtggtccaagtataaacatgaccttgccgctagttgtcagggcagagttgtggcagcggaagagaagaacggcgtggtatttatccggggggaaggtgtgggtgcgtataatccgcagttgaacctgaagaacgttcagcgaaacttaattctcttgcacccacagcttctcctactcgtggatcagatccatctgggagaggaatccccattggaaacagcagcctctttttttcacaacgtggacgtcccttttgaggaaaccgtggtggacggcgtgcatggcgcttttattagacagcgtgatggactgtataagatgtattggatggatgacaccggttactcagaaaaggctactttcgcctccgtgacctaccctcggggctatccctacaatgggacgaactatgtcaacgtaacaatgcatttgaggtcccccattactcgggcagcgtatctgtttataggtccttccatagatgtgcagtcgtttacggtacacggtgatagccaacaattggatgtgtttatagctacttccaagcacgcatacgctacttacctttggaccggagaggcgacaggtcaaagcgcgtttgctcaggttatcgcagaccgtcacaaaatcctgtttgaccgtaactcagccattaaatcttccatcgtccccgaagtgaaagattacgcggcaattgtcgagcaaaacttgcagcactttaagcctgtattccaacttctcgagaagcagattttgtctcgggttcggaacacagcctcctttcgcaaaactgctgagagacttctgcgcttttctgataaacgccagactgaggaagccattgaccgcatcttcgccatcagccagcagcaacaacagcagtccaaaagtaagaaaaaccggcgagctggaaagcggtacaaattcgtagatgccgtgcccgacatctttgcccagatcgaagtgaacgaaaagaaaatacggcagaaagcccaaatcctagcccagaaagagctccctattgatgaagacgaagagatgaaggacttgcttgatttcgccgacgtgacttacgagaagcataagaatggagggctgataaagggtcgattcggacaagctcggatggtgacaaccacccattcacgggccccatcactctccgcatcctatacacggctgtttctgatcctcaatatcgccatttttttcgtgatgttggccatgcagctcacgtacttccagagggcacagtccttgcacggccagaggtgtctatatgcagtgttgctcatagactcatgtattctcctctggctgtattcttcgtgctcccagtcccagtgctag

SEQ ID NO: 185247 - DNA, 570 bp, Artificial Sequence
  Description of Artificial Sequence: Synthetic coding sequence
atggccgccctgaagggccggcaggtgtactgggccaccgccggcaagatatccggctggacttggccacacgccccgcgccgcccccatgtcctccttcttaacggcataggcgtaggcggtgcgctcggctccatcgacgagctactgtgccaggcgttatcaaatggcctgaacgtgccagagggcagtttaacctctacatgtgcgcagcagcccgatggtcttattcacaccgccaaatgggggcatgtgcatagtctttcaagtcactcccctggcgccccaaatgcttgcggcgtgctgccagggactacggtcgacgacggagtgcaccaggacctgcagcgcgtgctggcatgcgagcaggtctacgacttggaagggatgttggatgacgcccattcacatgagctcctcgcggttgttgcagccgtacatcaccacggtgtgtctaaagcgctgcacaatgggacattgagctttgtggaagcctttggggggatccccccttgcactgtccggatcttccggaggtggttcgggtgtcttggcgatctggaaatttag

SEQ ID NO: 185248 - DNA, 3669 bp, Artificial Sequence
  Description of Artificial Sequence: Synthetic coding sequence
atgcccaagggcggcgcccccccctggatcatggccctgatgttcaccggccacctgctgtttctagcgctactgatgtttgccttctccacatttgaagagtcagtcagtaattactccgagtgggccgtgttcacagatgacatcgatcaattcaagacgcagaaggttcaagacttccgcccaaatcagaaactcaaaaaatctatgctccatccctctttgtatttcgacgctggagagattcaggccatgcgacagaaatctcgagccagccatctgcatctgttccgagcaattcggtccgccgtcaccgttatgctgtctaacccgacgtattacctcccccccccgaagcacgcagacttcgccgccaaatggaatgaaatctacggcaacaaccttccaccgctcgcactttattgcctgttgtgccccgaggacaaagttgcgttcgagttcgtgctagagtacatggaccgaatggttggatataaggattggcttgtggagaacgccccaggagacgaggttcccattggccatagccttacaggcttcgcgaccgcttttgacttcctgtataacctcttggataaccaccggcggcagaagtatcttgaaaagatttgggtaatcacagaggaaatgtacgaatattctaaggttcgcagttggggtaagcagctgctgcacaaccatcaagccaccaacatgatcgctcttttaacgggtgcattggtgaccggagtcgataaggggtccaaggcaaatatttggaagcaggcagtggtcgacgtaatggaaaaaacaatgtttctcctgaatcacatcgtcgacggatcccttgacgagggggtagcctatggcagttacacggccaagagcgtaacccagtatgtgtttctggctcaaaggcactttaacatcaataatcttgacaataattggctaaaaatgcatttttggttttattacgccacattactccctgggtttcagcgaaccgtgggcattgctgatagcaattacaattggttctatggtcccgagagccagttggtgttcttggataagtttattctgaagaatggggcagggaactggttggcacagcagattaggaagcacagacccaaagacgggccgatggtgccctccacagctcagcggtggtcaacacttcataccgagtacatatggtacgacccgcagcttaccccccagccacccgcagattacggaaccgccaagatccacacgtttccaaactggggtgtcgtgacttatggagccggactccctaatacacagacgaatacctttgtgtcctttaagagcggaaagctgggaggcagagcagtgtacgacatcgtgcactttcagccgtactcgtggatcgatgggtggcggagctttaaccctggccacgagcatccggaccagaactcctttacgttcgcgcctaatggccaggtgtttgtctcggaggccctctatgggcccaaactctcgcacctgaataacgtcctcgtgtttgcgccctcaccctcctcgcaatgcaacaagccctgggaagggcagctgggcgaatgcgcccagtggctgaagtggacgggggaagaggttggagatgcagctggggaaatcatcacggcatcccagcatggggagatggtattcgtcagcggtgaagccgtttctgcttacagtagcgctatgaggctgaaaagtgtctatcgggccctgctcctcctcaacagccagaccctgcttgtagttgatcacattgaacggcaggaagacagcccaatcaacagtgtgtccgcctttttccataacctcgatatcgactttaagtacatcccctataagtttatgaaccgctacaatggagcgatgatggacgtttgggatgctcactacaagatgttctggtttgatcatcatggaaattcccccatggcatcaatccaagaggccgagcaagcagcagaattcaaaaagcggtggacgcaatttgttaatgtgacttttcagatggaacccacgatcacacggatcgcctacgtgttctatgggccgtatatcaatgtctctagctgtcgatttattgattcttccaacccgggtttacaaattagcctcaacgtcaataacaccgagcacgttgtgtcaatcgtgacagattatcataacctgaagacccgctttaattatctgggcttcggagggtttgccagcgtggccgaccagggacagattacaagattcggccttgggacacaggccattgtgaaacctgtgcgacacgatagaatcatcttcccattcggcttcaaattcaatattgcagtggggctcattctgtgcatctccttggtcatcctgacgttccagtggagattctacctctcctttcggaagcttatgcgatggatcctgatcctggtgattgctctctggttcattgagctactggatgtgtggtccacctgctctcagccaatttgcgcgaaatggaccaggaccgaagccgagggctcgaagaaatccctctctagcgaaggccatcacatggacctccccgatgtggtcataacttccctaccaggttctggcgctgaaatactgaagcagctctttttcaactcaagcgacttcttgtatatcagagtgcctacagcttatattgacattcccgagaccgaactggagatcgacagcttcgttgacgcctgtgaatggaaagttagcgacatacgctctgggcactttagactgcttaggggctggctgcagtctctggtgcaggatactaagttgcacctgcagaacatccatctgcatgagccaaaccggggcaagctcgcccagtatttcgccatgaacaaggataagaagcgcaaatttaaacgtcgggagtccctccctgaacagaggtctcagatgaaaggcgcatttgacagagacgccgagtacatccgcgcattaagacgacatctggtttactacccctccgctaggccagtgctgtccctctcctccggctcatggacgctgaaacttcatttttttcaggaagtcctgggcgcaagcatgcgggcgctttacatcgtccgggacccgagggcctggatctattctatgctgtacaactccaaaccctctctgtacagcctgaaaaacgttccggagcatctagcaaaattattcaaaattgaggggggtaaagggaaatgcaatctcaattcaggctacgcattcgagtatgagcccctgcgcaaggaattatccaagagcaaaagcaacgctgtgagtctcttgagccacctctggctggctaacacagcagcagccctgcgcatcaatacagatctactgcccactagctatcagctggttaagttcgaagatatcgtacatttcccacagaaaaccacggagcgcatattcgctttcctcggcataccgctgtcaccagcctctctcaaccagatattatttgcaacaagtactaatctcttttacctgccttatgagggcgaaatctctcccaccaataccaacgtttggaaacagaacctgccacgcgatgaaataaagctgatagaaaacatttgttggacattaatggaccgcttgggatacccaaaatttatggactag

SEQ ID NO: 185249 - DNA, 3639 bp, Artificial Sequence
  Description of Artificial Sequence: Synthetic coding sequence
atggccctgatgttcaccggccacctgctgttcctggccctgctgatgtttgccttctccacattcgaagagtccgtcagtaactacagtgagtgggcggtgttcactgatgatattgaccagttcaagacccagaaagtgcaggactttcgacctaaccaaaaactgaaaaagtcgatgcttcacccatctctgtactttgacgctggggaaatccaggctatgagacagaaatccagagcctcacatttgcacttgtttcgggcaatccggagcgccgtgacagttatgctctccaatcctacctattaccttccaccccctaaacacgccgattttgcagcgaaatggaacgagatctatggcaataatttgccgccgttggcactgtattgcctcctctgtccagaggacaaagtagcttttgaattcgtgctggagtacatggaccgtatggtgggatacaaggactggctggtggaaaacgcacccggagacgaagttcctatcggtcactccctaactgggtttgcaaccgcctttgatttcctgtacaatttactggataaccatcggagacagaaatacctggagaaaatctgggtgatcactgaggagatgtacgaatattcaaaggtgcgcagctggggcaagcaattgttgcacaatcatcaagccactaacatgattgccctgctcaccggcgccctggtaaccggcgtggacaaaggctccaaggcaaacatatggaaacaagcagttgtggacgtcatggagaaaaccatgtttctgctgaaccacatagtagacggctccctggatgaaggggtggcttacggctcttataccgccaagagcgtgacacaatacgtattcctggctcagcgacacttcaacatcaacaacttggataataattggctgaaaatgcatttctggttctattatgccactctgttgcctgggttccagagaacagtagggatcgcagattccaattacaattggttctatggccctgagtcccagctggtctttttagataaattcattcttaagaacggggccgggaactggttagcacagcagatccgaaagcatcggcctaaggacgggccaatggtgccttcaacggcccagagatggagcacattacacaccgagtacatctggtacgatccacagctaactccccagccacccgctgactacggcaccgctaaaatccatacatttccaaactggggtgtggttacatacggcgccgggcttcctaacacacagaccaacactttcgtgtccttcaagtcgggcaaactaggcgggagggcggtgtacgacatcgtacattttcagccctatagctggattgatggttggcgctcatttaaccccggccacgaacatcctgaccaaaatagctttacatttgcgccaaatgggcaggtgtttgtgagcgaggctttatacggcccaaagcttagccatttgaataacgtcctggtgttcgcacccagcccatcttctcagtgcaacaagccatgggaagggcagctcggggaatgtgcccagtggctgaagtggaccggggaagaggtgggcgacgcagccggagagatcatcaccgctagccaacatggtgaaatggtattcgtgagcggggaggcagtcagtgcttacagtagtgctatgaggttgaaaagtgtttatagggcactgctgttgttgaactcacaaactctgctggtggtcgatcacattgaacgacaggaggactctcctataaatagcgtaagcgctttttttcataacctcgacattgatttcaagtacattccctacaagttcatgaaccgatataatggtgccatgatggacgtgtgggatgctcactacaaaatgttttggtttgatcatcatgggaattccccgatggcaagcattcaggaggccgaacaggccgccgagtttaaaaagagatggacccagttcgtaaatgttacatttcagatggagcccacaattacccgtatcgcctatgtgttttatgggccctatataaacgtaagctcatgtcgcttcatcgactcctccaatccaggcctacaaatatccctgaatgtgaataatactgagcacgtggtgtcaatcgtcaccgattaccacaacctgaagacccgatttaattatctcggatttggagggttcgcttcagtagctgaccagggtcagattaccagatttggcttaggaactcaggcaatcgtgaagccggttcgccacgatcgcatcattttcccctttgggtttaagttcaacattgccgtcggactgattttatgcatttctctggtgatcctgacctttcaatggcggttttacctctcattcagaaaactgatgaggtggatcttgatcctggtgattgctctgtggttcatcgaactactggatgtctggtctacctgttctcagccgatatgcgcgaagtggacgcggacagaagcagaggggtccaagaagagcttatcgagtgaaggtcaccacatggacctgcctgatgtcgtaatcacctctcttccagggtcaggcgcggaaatactgaagcagctgttcttcaattccagtgatttcctgtatatccgggtccctactgcctacatcgacattccagagaccgaattggagatcgactccttcgttgatgcctgcgaatggaaggtctcagacattcgctccggccacttccggttactcaggggatggctccagtcactcgtgcaggatacaaagcttcatcttcagaatatccaccttcatgaaccgaacagaggaaagctggcacagtatttcgcaatgaacaaggataaaaagaggaagtttaaaagaagggaaagccttccggagcagagaagccaaatgaagggagcgttcgatagagatgccgagtatatcagagccctgcggcgccatcttgtatattaccccagtgcccggcccgtcctctccctgagcagcggaagctggacactgaagctgcacttcttccaggaagtgcttggggcttctatgagagctttgtacatagtgagggaccccagggcttggatttattccatgctatacaattcaaaaccatccctctatagccttaaaaacgtgcctgaacacttggccaagctctttaagatcgaaggaggcaagggtaaatgcaacttgaatagcgggtacgccttcgaatacgaacctctcagaaaggagttaagtaagagtaaatccaacgccgtgagcctgctgtcacatttgtggttagccaataccgccgccgctctgaggattaacaccgatttgttacccaccagctaccagctggtgaagttcgaagatattgtacacttcccgcagaaaaccacggagcgcatctttgcctttcttgggatccccttgagcccagcatccctcaaccagatcctattcgctacctctaccaacctgttttatctaccctacgagggcgagatcagccctacaaacactaatgtatggaagcagaatctgcctagagacgagatcaagctgatcgagaacatttgttggactttgatggaccggctcgggtatccaaagttcatggattag

SEQ ID NO: 185250 - DNA, 606 bp, Artificial Sequence
  Description of Artificial Sequence: Synthetic coding sequence
atggacctgagcctgctgtgggtgctgctgcccctggtgaccatggcatggggccaatacggggactatggctacccttatcagcagtaccacgactacagtgacgatggttgggtgaatctgaaccgacagggattttcttatcagtgccctcagggacaagtgattgtcgcagtccggtccatcttctccaagaaggaaggaagtgaccgacagtggaattatgcctgcatgcccacccctcagtctctgggcgaacctacggagtgttggtgggaagagattaacagagcaggtatggagtggtatcaaacctgttctaacaacggtctggtggcaggctttcagagccggtactttgagagcgtcctggacagagagtggcagttttactgctgtcggtactccaagcggtgcccatatagttgctggctcacaaccgagtaccctggacattacggtgaggagatggacatgatttcttacaactatgactattacatccgaggagcaacaaccacattctccgctgtggagagggatcggcagtggaaatttatcatgtgtcgaatgaccgagtacgactgcgaatttgccaacgtttag

SEQ ID NO: 185251 - DNA, 333 bp, Artificial Sequence
  Description of Artificial Sequence: Synthetic coding sequence
atgcggttcatgaccctgctgttcctgaccgccctggccggcgcccttgtgtgtgcctatgaccccgaggccgcatccgctccgggatccggcaacccttgtcatgaggccagcgctgcccaaaaggagaacgctggagaggaccctgggctggccagacaggcacccaaaccgcgcaaacagcgctcttccctgctcgaaaagggccttgatggtgccaagaaggcagtgggcggattagggaagctcggaaaagacgccgtggaggaccttgaaagcgtgggaaaaggagcagttcacgacgtgaaggatgtgctagactcagtgctttag

SEQ ID NO: 185252 - DNA, 1191 bp, Artificial Sequence
  Description of Artificial Sequence: Synthetic coding sequence
atggccctgctgaccaacctgctgcccctgtgctgcctggccctgctggctctgcctgctcagagttgtggccctggacggggaccggtcggtcggcgccggtacgctagaaaacagttggtgcctctcctatacaagcagtttgtgcctggcgtgccagaaaggacactgggcgcctcaggtccagccgaggggcgcgtggcacgcggaagtgagcgttttcgcgatcttgtgccgaattataacccagatataatattcaaggacgaggaaaattccggtgctgacagactcatgacagaaagatgtaaggagcgggtcaacgccttggcgatcgcagtcatgaatatgtggccaggtgtgcgcctgcgtgttaccgaaggatgggacgaggatggccaccacgcccaggactctttgcattacgaaggccgtgcattagatatcactacgagtgatcgggacagaaataagtacggactgctggcgaggttggccgtcgaggccggattcgactgggtgtactacgaatcgcgcaatcacgtgcatgtgtccgtcaaggccgacaacagtctcgctgtgagggctgggggttgttttcctgggaacgcgactgtcaggctgtggagcggagagcggaaagggctcagagagctgcacaggggcgactgggtgctggctgctgacgcaagtggtagagtggtgcccacccctgtgttactgtttctggatcgagatctgcaaaggcgggcttcatttgtcgccgtcgaaacagaatggcccccaaggaagctgctgctgaccccttggcatctggtttttgccgccagaggtccagcccctgccccgggggacttcgctccagttttcgcacgacggcttcgcgcgggagattcagtgcttgctccaggaggagatgcactgcgccccgctagggtggctcgggtagcccgagaagaagccgttggtgtcttcgcccctctgaccgcacacgggactctgctcgtgaatgacgtccttgcttcctgctacgctgtccttgagagtcatcagtgggctcatcgagccttcgcccctcttcggcttctgcatgcacttggtgccctgctgcctgggggggctgtacagccgaccggtatgcactggtactcccgcctgctgtataggttagcagaggaactgctgggatag

SEQ ID NO: 185253 - DNA, 1413 bp, Artificial Sequence
  Description of Artificial Sequence: Synthetic coding sequence
atgagccaggcctacagcagcagccagcgggtgagcagctaccggcgtacgttcggcggtgcacctggcttccccctgggaagtcccctctcttcacccgtcttcccccgcgcaggctttgggagtaagggaagtagtagcagcgtaacatcccgtgtttatcaagtttcccggacctccgggggtgcagggggcctcgggtcacttcgggctagccgactggggacgacacgcaccccctcatcttacggggctggcgagctgctggattttagccttgcagacgcggtcaaccaggagttcctgactactagaactaacgagaaagtggagctgcaggagctaaacgatcgcttcgcgaactacattgaaaaagtgagatttttggaacagcagaatgcagctcttgctgccgaggtgaatcgacttaaaggacgggagcccactcgcgtcgctgaactgtatgaggaagagctcagagaactccgtcggcaggtagaggtgttaacaaatcagagagccagagtggacgttgagagagacaatttactcgacgacctccagaggctgaaagccaagctgcaggaggagatccagttgaaagaagaggcggagaacaacctcgctgctttccgggcagatgtggatgccgctacgttagcaagaattgacttagagcgtcgaatcgaatccctcaacgaagagatagccttcctcaagaaggtgcatgaagaagagatcagagaactgcaggcccagctacaagagcaacaggtccaggtagaaatggacatgtccaagccagaccttacagctgcattacgcgatattcgtgcccagtatgagacaattgccgccaagaatatttctgaggctgaggagtggtacaagagcaaggtgagtgacctaacacaggctgccaacaaaaacaacgacgctctgcgccaggcaaagcaagagatgatggaatatcgacaccagatccagagttacacatgtgagatcgatgcgcttaaaggaacaaatgattctctaatgaggcaaatgcgcgaattggaagatcgttttgcctccgaggcttctggctaccaggataatatagctcgactcgaggaagaaatccgacacctgaaagacgagatggcaagacacctgcgagagtatcaggatctgttgaatgtgaaaatggccctggatgttgagatcgctacttatcggaagctgttggagggtgaggagtctcggatcaacttacccatacagacctacagcgccttgaactttcgtgagacttcgccggagcagagaggatctgaggtacacaccaagaagaccgtgatgattaaaactatcgaaactcgagatggggaggtggtgtccgaggccactcagcaacaacatgaagtcctgtag

SEQ ID NO: 185254 - DNA, 2523 bp, Artificial Sequence
  Description of Artificial Sequence: Synthetic coding sequence
atggccctggccagcgccgcccccggcagcatcttctgcaagcagctcttgttctccctattggtcctgaccttactctgtgacgcttgtcagaaggtctatttacgggtaccttcgcacttacaggccgaaacattagtgggaaaagtcaatctggaagagtgtctgaagagtgcttccctaattcgttccagtgatcccgcattccgaatcctggaggacggctcaatctacactacacacgacctgatcctgagctctgagcgaaagtccttttccatcttcttatccgatggccaacgcagggagcagcaagaaatcaaggtggtactttccgctcgggagaacaagagcccaaagaagcggcacactaaggatacagcactgaaaaggagcaaacgccgctgggcccccatacccgccagtctgatggagaattctcttggacctttccctcagcacgttcagcaaattcaaagtgatgccgcacagaactatactatcttttactcaataagtggcccaggtgtggacaaggagcctttcaatctcttctatatcgagaaagataccggcgacatcttctgcacccggtctatagatcgggagaagtacgaacaatttgccctgtatggatacgccacaacagccgacggttatgcccccgagtatcctctgcccctgattatcaagattgaggatgacaatgacaatgcaccatactttgagcatcgggtgaccatctttactgtgcctgaaaattgtcgctcaggcacgtctgtgggaaaagtaaccgctaccgaccttgatgaaccagatacccttcacactcggcttaaatacaaaattctgcagcagattccagaccatcccaagcacttctccattcacccagataccggcgtgatcacaacaacaactccatttctcgatcgagagaagtgtgacacgtatcagctgatcatggaagtgcgggacatgggcggtcaacctttcgggttgttcaataccggaacaatcacgatcagccttgaagacgagaacgacaatccccccagttttacagagacatcgtacgttaccgaggttgaggagaaccgcatcgatgtggaaatccttcgcatgaaagtgcaggaccaggaccttcctaataccccccactccaaagcagtgtataaaatccttcaggggaacgaaaatggaaacttcatcatctccaccgatccaaacaccaatgagggggttctctgtgtggtcaagccgctgaactacgaggtgaaccgacaagttattctgcaagttggcgtgattaacgaggcccaattttccaaagctgcgtcgtcacagactcctacaatgtgcaccacaaccgtcactgttaagattatcgactcagatgaaggacctgaatgtcacccacctgtcaaggtcatccaatcacaggatggcttcccagcagggcaggagttactcggatataaggctctcgaccctgagataagtagcggagagggtctcaggtaccagaaactaggcgacgaggacaattggttcgagattaatcagcataccggagatctgcgaaccctgaaggtgttggatagagagtcaaaattcgtgaagaataaccaatataatatctctgtggtcgccgtagatgccgttggcaggagctgtacgggcacgctggttgtgcatttagatgactacaatgaccacgcaccccaaattgataaggaagtgaccatctgccagaacaacgaggattttgccgtgctgaaacccgtagacccggacggaccagagaatggcccaccattccagttttttctggacaactctgctagcaagaactggaatattgaggagaaggacggtaagaccgccatcttgcgacagcgccagaatctggactataattactacagtgtgccaatacaaatcaaagaccggcatggtcttgtggcgacccacatgctcaccgtgcgggtgtgcgactgcagcaccccaagtgagtgcaggatgaaggacaagtctacgagagacgtgagacccaacgtgattttggggcgctgggctattctcgccatggttttaggctccgtgctgttgctgtgtatactttttacatgcttttgcgtaacagctaaaagaaccgttaaaaaatgcttccctgaggacatcgcacagcagaatttgattgtctcgaacacggaaggacccggggaagaggtgactgaggcaaacattcgcctgcccatgcagacctcaaatatatgcgacacgtcgatgtcagtcgggacagtgggcggtcagggaattaagactcaacagtcgtttgaaatggtgaaaggaggttatacgctggactcaaataagggtggcggacatcagaccctggaatctgtgaagggagtcggacagggtgataccgggcggtacgcatatacggattggcagagctttactcagcctaggttgggggaagagtccattagaggccacacactgatcaagaattag

SEQ ID NO: 185255 - DNA, 2685 bp, Artificial Sequence
  Description of Artificial Sequence: Synthetic coding sequence
atggccctggccagcgccgcccccggcagcatcttctgcaagcagctcctgttcagcctccttgtgctgaccctcttgtgtgacgcttgccagaaagtgtacctgcgcgtcccaagtcacctgcaggccgaaactctggttggcaaagtcaaccttgaggaatgcctcaagtccgctagcctcatcaggtcaagtgacccagcctttcgtattctggaggatggctccatatacactacgcacgacctgatactgagctcagaaagaaagagtttttcaatcttcctatcagatggccagcggcgtgaacagcaagagatcaaagtggtactctctgccagggagaacaaaagcccaaaaaaacgacatacaaaggacactgcacttaagcgaagcaagaggagatgggctcctataccagctagtctcatggagaacagtctcggcccttttcctcagcatgtgcagcagatacagtctgatgccgcccagaattataccattttctacagtattagtgggcctggtgtcgataaagaacctttcaacttattctacatcgagaaggatacaggagacattttctgcacacgctccatcgatagggaaaaatatgaacagtttgccctttatggttatgctaccacggctgacggctatgcccctgagtatcccttgccactgatcatcaaaatcgaagacgataatgataacgcaccctattttgaacaccgcgtgacgatttttacggttcccgagaactgtaggagcgggacatcagttggtaaggtgaccgctacagatctggacgaacctgatacccttcatacaaggcttaagtacaagattttacagcagattcctgaccaccccaagcactttagtattcatcctgacaccggggtcattactactactacgccttttctcgatcgagagaagtgcgatacctaccaactcatcatggaggtccgcgacatggggggccagccttttgggctgttcaacacgggaaccattactataagtctagaagatgagaatgataacccaccctcgttcacagaaacttcttacgtcaccgaagtggaagagaatcggatcgacgtggagatactgaggatgaaagtgcaggatcaagatttaccaaacacacctcattctaaagctgtttacaagattcttcaggggaacgagaacggaaacttcattatctcgacagatcccaatactaatgaaggagttctctgtgtcgtcaagcccctaaattacgaagtgaatagacaggtcattctccaggtgggggtgatcaacgaagctcagttcagtaaggccgcctcctcccagaccccaaccatgtgcaccacaacagttaccgtcaagattatcgacagcgatgagggccctgaatgtcaccctcctgttaaagtcatccagtcacaggacggatttccagcagggcaggaactgctcggctataaagcgctggatcctgagatttccagcggggagggccttcggtaccagaagctgggggatgaagataattggtttgaaattaaccagcatacaggcgatctccggaccctgaaagttctcgatagagaatccaagtttgtgaagaataatcagtataacattagtgtcgtggccgttgatgcggtaggccggtcctgcaccggaacactggtcgtccacttggatgattacaatgatcacgccccccaaatcgacaaggaagtgactatttgtcagaacaatgaggacttcgctgtgctgaagccggtggatccagacggcccagaaaatggacccccgttccagttttttctggataatagtgcttctaagaactggaacatcgaagagaaagacggtaagaccgcaattctcagacaaagacagaatttagactacaactactacagcgttcctatccagattaaagaccggcatggtctagtggctacacatatgctgaccgttcgtgtgtgtgactgttctacgccttccgaatgcagaatgaaagataaatccacacgggatgtgaggccaaacgtgattctaggtcggtgggcgatccttgctatggtactgggaagtgttctgctactgtgtatactgttcacgtgtttctgtgtcaccgcgaagcggactgttaaaaaatgcttcccagaggacatcgcccagcagaatcttatcgtgtccaacacagaaggcccaggcgaagaggtcacagaagcaaatatccgtctgccaatgcagacttctaacatttgcgatacctctatgtcggtaggtactgtgggcggtcagggtattaaaacacaacaatcgttcgagatggtgaagggaggttacactctggattccaacaagggagggggtcaccagaccctcgaatcagtgaagggcgttggacaaggcgataccggaagatacgcatatacagattggcagagtttcacacagccaaggctgggtgagaaagtgtacctctgcggccaagacgaggaacacaagcactgtgaggattatgtctgttcttacaactacgaaggaaaggggtcattagccggatccgtgggatgttgtagcgaccgccaagaagaggaaggactggaattcctggaccacctagagcccaaatttcgaacacttgctaagacatgcattaagaagtag

SEQ ID NO: 185256 - DNA, 2691 bp, Artificial Sequence
  Description of Artificial Sequence: Synthetic coding sequence
atggccgccgccggcccccggcggagcgtgcggggcgccgtgtgcctccatctgctacttacactggtcatcttctcccgagctggagaggcttgtaaaaaggtgatccttaatgtgccatcaaagctggaggcggataagattatcgggcgcgtgaatctggaggaatgttttcgctccgcagatttgattaggagttctgacccagatttccgggtgctaaatgatggatcagtgtacactgcgcgggccgttgcgttgtcagacaaaaaacggagcttcaccatttggttgtccgataagcggaagcagacccagaaggaggtgaccgttttgctggagcaccagaaaaaggtatccaagactagacatacccgcgaaactgtgcttaggcgggccaaaaggaggtgggcaccaatcccctgcagcatgcaggaaaattctctgggaccatttcccttgttccttcagcaagtagaaagcgacgctgcccagaattatactgtgttctattctatcagcggccggggcgtggacaaagaaccgctcaacctcttttatatcgagcgtgatactgggaacctcttctgcaccagacccgtggaccgggaagagtacgatgtgttcgatctgatcgcctacgccagcaccgcagacggctactctgcagatttgccactcccattacctatacgtgtcgaagacgaaaacgataaccaccctgtgttcacagaggccatctacaattttgaagtgctggaatcaagtcgccccggaacaactgtcggggtcgtctgcgctaccgatagggacgagccggacacgatgcatacacggctcaagtacagtattctgcagcagacccccaggagccctggcctatttagtgtgcatccaagcacaggggtgataaccactgtatcccactacctggatagagaggttgtggataagtactcactgatcatgaaagtccaggatatggacgggcagttcttcggacttatcgggactagtacttgtatcatcacggtcactgactctaatgacaatgctccaacattccgccagaacgcctatgaggcatttgtggaggaaaatgcgtttaacgtcgagatcctcagaattcccatcgaagataaggacctaatcaacactgccaattggcgtgtgaatttcacgatcctaaaaggcaatgagaatggacactttaagataagcacagataaagaaaccaacgaaggagtcctgtcagtggtgaagccgttgaattacgaggaaaaccggcaggtgaacctcgagattggcgtgaacaacgaggccccatttgcacgggacataccccgggttaccgccttgaacagagccctggtgactgttcatgtcagagacctggacgaagggcctgaatgtacacccgctgcgcagtacgtgcgaataaaggagaacctcgccgtaggttctaagattaatgggtataaggcatacgacccagagaaccggaacggcaatggcttgagatataagaaactgcatgatcccaaaggctggatcacaattgatgaaattagtggcagtatcattacgagcaagatcctggacagggaggtcgagacacctaagaacgagctctataacatcaccgtgctcgctatcgacaaagacgaccgcagctgtacaggcactttggctgtgaacatcgaagatgtgaacgataatccaccagagattctacaggaatacgtcgtcatttgtaaacccaagatgggatataccgacattttagcagtggatccggacgagcctgtgcatggggccccgttttatttttccctgccaaacacgtctcccgagattagtaggctgtggtcactcactaaggtcaatgacaccgccgcccgcctctcctatcagaagaacgccggatttcaagaatataccattccaatcactgtgaaggaccgagctggacaagcagcgacgaaattgttgcgcgttaatctgtgcgaatgtacccatcccacccaatgccgtgctacaagccggtccactggggttattctgggcaaatgggcgattctggcaattctgctggggatcgctcttctcttcagcgtgctccttactctggtgtgtggggtgtttggtgcgactaagggaaaacggttcccagaagatctggctcagcagaatctgataatctcaaacaccgaggcccctggcgacgatcgcgtgtgcagcgccaatggctttatgactcagactacaaacaactcttcccaagggttttgtggcaccatgggctccggcatgaagaacggcggacaggaaaccattgagatgatgaagggtggcaaccagacgctcgaatcatgcagaggagccggccatcaccatactcttgattcttgcaggggaggccacacggaggtggacaattgccgatatacctattccgagtggcattccttcacacagccccgcctgggggaaaagctgcaccgctgtaaccagaacgaagacagaatgccctcacaagattatgttctcacatataattacgaaggacgagggtcgcccgccggcagcgtcgggtgttgctctgaaaagcaagaggaggacggattggacttccttaataacttagagcctaaatttataactttggctgaggcgtgcacaaaacggtag

SEQ ID NO: 185257 - DNA, 2520 bp, Artificial Sequence
  Description of Artificial Sequence: Synthetic coding sequence
atggccgccgccggcccccggcggagcgtgcggggcgccgtgtgcctgcatttgttgctcacgctggttattttctctcgggccggcgaggcctgtaagaaagttattctgaatgtcccatcaaaactggaggcggacaagattattggacgggtcaatcttgaagagtgcttcagatccgctgacctgattagaagctcagacccagactttcgcgtgctgaatgatggctcagtgtataccgctagagccgtggccctgagtgacaaaaagcgatcctttacgatctggttgagtgataaaaggaaacagacccagaaggaagtgacagtactcctggagcaccaaaagaaagtttccaagactcgacatacacgcgagacagtgttgagaagagctaagcggagatgggcccccataccctgctctatgcaggagaactccctcggcccgttcccgctgttcctccagcaggttgagtctgatgctgcacagaactataccgttttctactccatctccgggcgaggtgttgacaaggagcccctgaatttattctatattgagagagatacaggtaatctattctgtactagacccgtggatcgggaagagtacgatgttttcgacctgattgcttacgcttccaccgctgacgggtattccgctgacctgccactccctctgcctattcgggtggaggatgagaatgacaatcatcccgtatttactgaggcaatttataacttcgaggtgctggagtcttcccggcccggcaccaccgtgggcgttgtgtgcgctacagacagggatgaacccgatacgatgcatactaggctcaagtattccattctgcagcagaccccccggtctccaggactattctcagtgcacccaagtaccggcgtgatcaccactgtgagccattatttggatcgcgaagtggtggataagtactcgttgataatgaaagtacaggacatggacggtcaattcttcgggctgatcggcacatctacgtgtataataaccgtaaccgatagcaatgacaacgccccaacttttcgccagaacgcctacgaagctttcgtggaagaaaacgcttttaatgtcgaaattctacggatacctatcgaagataaggatttgataaatacagccaattggagggtgaatttcactattcttaaagggaatgagaacggacactttaagatcagcacagacaaagagaccaacgaaggcgtactgtccgtcgttaagccactgaactatgaagagaataggcaggtgaaccttgaaatcggggtgaacaacgaggctccttttgctcgtgatattcctcgagtgacagccctgaatcgcgcactggtcacagtccatgtgcgcgaccttgatgagggaccagagtgcacccccgcagcccagtacgtgcgtataaaggaaaacctggccgttggctcgaagatcaatggttataaggcttatgaccccgaaaatagaaatggaaacggactgagatataaaaaactgcacgacccgaagggatggattactatagacgagatctcaggctcgatcatcacttcaaagattctggaccgagaggttgagactcctaaaaacgagctgtacaacattacagtgcttgctatcgacaaggatgatcgaagttgtacaggaactctcgccgtaaacatcgaggatgtgaacgataacccccctgaaatcctccaggaatacgttgtaatctgtaagcctaaaatgggttacactgatatattagccgtcgaccccgatgagcctgtgcatggcgcccccttctatttctcactacctaatacaagccccgagatctcaagactgtggtccttgacaaaggttaatgacacagctgctcggttgtcctatcaaaagaatgcaggcttccaggaatacactatcccaatcactgtgaaagatagggccggccaggccgccacgaagctattgagggtaaatctttgcgaatgtacgcatccaacgcaatgtcgcgccacgagtaggtctactggtgtgattctagggaagtgggccattctcgccattctgctgggcatcgccctgctgttcagcgtcttacttaccctggtgtgtggcgtattcggagccacaaagggtaaaagattccctgaagatttggcccagcagaatttgattatttccaatactgaagcgcccggagacgatcgtgtgtgttccgccaacggcttcatgactcagaccactaacaattcgtcacagggattttgtggaactatgggaagcggcatgaagaacgggggacaggagacaattgaaatgatgaaggggggaaatcagaccctagaaagctgtcgtggcgctggacaccatcacacactggatagctgccgggggggacatacagaagtcgacaactgtcggtacacatatagcgagtggcatagttttactcagccaagactgggcgaggaaagcatacggggtcatactggctag

SEQ ID NO: 185258 - DNA, 3150 bp, Artificial Sequence
  Description of Artificial Sequence: Synthetic coding sequence
atggactggagcttcttccgggtggtggccatgctgttcatcttcctggtggtggttgaggtaaattctgagttccgcatccaggttcgagactacaacactaaaaacggcacaatcaaatggcatagcattcgtcggcagaaacgtgagtggatcaagttcgctgctgcctgtagggaaggcgaggataattctaagaggaacccaatcgccaaaatccactcagactgtgccgctaaccagcaagtcacctaccgcatttctggcgtgggaatcgatcagcccccatacggcatatttgtgattaaccagaagacaggggaaatcaacattacaagtatcgtggaccgggaggtgacaccctttttcattatatactgccgcgcattaaactctatggggcaggacctggagcggccgcttgagctgcgcgtccgcgttttagacattaacgataacccaccagtgtttagtatggccacatttgccggtcagatcgaagaaaacagcaacgctaacaccctggttatgatcctgaacgcaacagatgctgacgaacccaataatctcaactccaagatagctttcaagattatccgtcaggaaccttctgattccccaatgttcatcattaacagaaacactggggaaattcgcacaatgaacaatttccttgacagagagcaatatggccagtacgcccttgccgtgcgaggctctgacagagatggcggtgctgacggcatgagcgctgaatgcgaatgcaacatcaaaatattggatgtgaatgacaatattccctacatggaacaatcctcctacacaatcgagattcaggagaacacgctcaattctaacttactagagattagagtcatcgatctggatgaagagttttccgccaattggatggcagttattttcttcatttccggcaatgaagggaactggtttgaaatcgagatgaacgaaaggacaaacgtgggaatccttaaagttgtcaaaccattggactatgaagcaatgcagagccttcagctgtcaatcggagtccgcaataaagccgaattccaccattctatcatgtctcagtacaaactgaaggccagtgcgatcagcgttactgtactcaacgttatcgaaggccctgtgttccgcccaggatcaaagacttatgtggtgactggaaacatgggtagcaacgacaaagttggcgacttcgtagctactgatctggatacaggtaggccttccacgacagtacgctatgtgatggggaataatcccgccgaccttcttgcagtcgactcccggaccgggaagctaacgctgaaaaataaagtgacaaaggaacagtacaacatgctgggaggaaagtaccaggggacaatccttagtattgatgacaacctgcagaggacctgcactggcacaattaatatcaatattcagagcttcggcaacgatgataggacaaatactgagccgaacacgaaaatcaccaccaacaccggtcgccaggagagtacgagtagtacaaactacgatacgtcaacaacttcaaccgacagctctcaagtctattcctccgagccgggtaacggggccaaagaccttctgagcgacaacgtgcattttgggcctgcaggaattggactcttgatcatgggctttctagtgctcggcctcgtcccctttttgatgatttgttgcgactgcggaggcgcaccaaggtctgccgccggattcgaacccgtgcccgagtgctccgacggtgctattcattcctgggcagtcgagggtcctcaacctgaacccagagacatcacaacggtaatcccccaaatcccacccgacaacgctaacatcatcgaatgcattgacaatagtggggtgtacactaatgagtacggggggagagaaatgcaggatttggggggcggggagcgcatgacagggtttgagcttacagagggcgtgaaaacctccggtatgcccgagatatgccaggagtattcggggacactacgcaggaacagcatgagggagtgtcgcgaaggaggactcaatatgaactttatggagtcctatttctgccagaaggcttacgcttacgcagatgaggacgaaggaagaccttctaatgactgtcttctgatctacgacatcgaaggcgtgggcagtccagccgggagtgtcggatgttgctcattcatcggtgaggatcttgacgattcctttctcgacacactcggccctaaatttaagaagctcgctgatatcagcttgggcaaggagagctatcccgatctggatcccagctggcctcctcagagcaccgagcccgtgtgtctacctcaggagacggagcctgtggttagcggacaccctcctatctcccctcatttcggtaccaccactgtgatctccgagagtacatatccctccggccccggcgtgctgcatcccaaacctatcttggacccgttgggatatggtaatgtaaccgtgacagaatcatataccacctctgatactctaaaaccctctgtacatgtgcacgataacagacctgccagcaatgttgttgtcaccgagcgggtcgtcggaccaatcagtggagctgacctgcatgggatgcttgaaatgccagatctacgcgacggctctaacgtgattgtcacggagagagtgattgccccgtcttcctccctgccaacttcccttacaatccaccaccctcgcgaatcatcaaacgtggttgtaaccgaaagagttattcagcccactagcggtatgatcggttctttgtcaatgcaccccgagctggccaatgcccataacgtcatagtcaccgaaagggtcgtaagcggcgcaggcgttacaggaatttcaggaacaacagggatttctgggggcattggttcttccggattggtgggcacttcaatgggcgccggctccggcgctcttagtggcgcgggcatctccggcggaggcatcggcctgtcctcactcgggggtactgccagtataggtcatatgaggtcgtcctctgaccatcactttaaccagacaatcggctcggcatcgccaagtactgctaggtccaggattaccaagtactcgacggtgcagtatagtaagtag

SEQ ID NO: 185259 - DNA, 3357 bp, Artificial Sequence
  Description of Artificial Sequence: Synthetic coding sequence
atggcccggagccccggccgggcctacgccctgctgctgctgctgatatgctttaatgtggggagcggcttgcatctgcaggttctttcgaccaggaatgagaacaagctgttgcctaagcacccccatctcgtgcggcagaaacgcgcctggatcacagctcccgtggccttgagggagggagaagatctgtcaaagaaaaatcctatcgctaaaatacactcagatctggctgaggaacgcggactgaaaatcacctacaagtataccggcaaaggtatcacagagccccccttcggcattttcgtgtttaataaggatactggggaattgaatgtcacctccatcctggaccgcgaggagacaccatttttcctgctgaccggctatgcgctggacgctcgaggcaacaacgtggagaaacctcttgaactgcgtataaaggtattagatataaatgataacgagccagtgtttacacaggatgtatttgtggggtcagtagaggagctctcagccgctcacactcttgtgatgaagataaatgccactgatgcagacgagcccaacacactgaactcaaaaatttcctataggatcgtaagccttgaacccgcttacccacctgtcttttacctgaacaaggatactggcgagatctacaccaccagtgttacactcgacagggaagagcacagctcatataccctcacggtcgaagcccgagacggaaacggtgaggtgacagacaaacccgtaaagcaggcacaggttcagattcgaatcctcgacgtaaacgataacatccccgtggtggagaacaaggtgctcgagggaatggtcgaagagaatcaggtgaatgtcgaggtgacacgtatcaaagtgtttgacgccgatgaaatcggtagtgataactggcttgctaatttcacattcgcttctggtaacgagggggggtacttccatattgaaacagacgcccaaactaacgagggtatcgtgaccttaatcaaagaagtggactatgaggaaatgaaaaacctggattttagtgtcattgtggctaacaaggcagcgttccacaagtctattcgttcaaagtacaagccaacacccatccccattaaggtgaaggttaagaacgttaaggaaggcatacactttaaatctagcgtgattagcatctacgtgagtgagtccatggacaggtcgagcaagggacagattatcggcaactttcaggctttcgatgaggacacagggctgccagctcacgcccgctatgtgaaattagaggacagagataactggatctcagtagactccgtgacaagcgaaataaaactggcaaagttacccgacttcgaatctcgctacgtacagaatggcacttataccgtgaaaattgtggccattagtgaggactacccgcggaaaactatcacaggcacagtgcttatcaacgtagaggatattaacgacaactgtcctacattgatcgaaccagttcagaccatctgtcatgatgccgaatacgtgaacgtcactgctgaggacctcgatgggcaccctaattccgggccattcagcttttctgtaatagataaaccccctggaatggctgagaagtggaaaattgctaggcaagagtcgacgagcgttctgttacaacagagtgagaagaagctgggtcgttctgagatccagtttttgatatcggataatcagggtttttcttgtccagagaaacaggttttgaccttaacagtgtgcgaatgtttgcacgggtcaggctgcagagaagcacagcacgattcctacgtggggctgggccctgctgctatagccctgatgatattagcctttctgctcctgctgctggtgcctctgctgttgcttatgtgtcactgcggtaagggcgccaaggggttcacacccattcccggtacaatcgagatgctccatccatggaacaatgagggagcacccccagaagataaggttgtcccttcatttcttcctgtagatcagggaggttctctagtgggcaggaacggtgtaggaggtatggcaaaagaggctactatgaagggctcatctagcgcatctatagtgaagggccaacacgagatgagtgagatggatggacgctgggaagagcacaggtcgctgttgagcgggcgggcaacccagtttactggcgcgaccggcgccattatgactaccgagacaaccaaaacagcgagggcgacgggagcttctcgcgatatggccggcgcccaggctgccgccgtcgctctgaatgaagagtttctgcgaaactattttactgataaggctgcaagctatactgaggaagatgaaaatcatacggctaaggattgccttctggtatactctcaggaagaaacggaaagtctcaatgccagcatcggttgctgctcattcattgagggtgaacttgacgaccggttcctagatgacctggggttgaagttcaagaccctggcagaggtatgtctcggccagaaaattgatataaataaagaaatcgagcagcgacagaagcccgcaacagaaacaagcatgaacacggcttctcatagtctttgtgaacaaaccatggtaaactcagagaacacgtattcctcaggttcgtctttccccgttccgaaatcactgcaggaagccaatgccgagaaagtcacccaggaaatcgtgaccgagcgctccgtgagctcacgccaggctcagaaagtggccacccccctgcccgatcctatggcctccagaaacgtgatcgccaccgaaacatcgtacgtgaccgggtcaaccatgccacctaccaccgtgattctgggaccaagtcagcctcagtccctgatcgttaccgagcgggtgtacgcaccggcaagcacccttgttgatcaaccctacgcaaatgaggggaccgttgtggtcaccgagcgcgtaattcagccccacggcggaggctcaaacccactggagggcacgcagcacctccaggacgtgccttatgtgatggtgcgagagcgcgagtcatttctggccccaagtagcggcgtgcagccaactcttgcgatgcccaacatcgcagttggtcagaacgtgacagtgaccgagcgagtgctggctcccgctagcacccttcagagctcgtatcagattcccactgaaaatagcatgacagctcggaataccacagtcagtggggcgggtgtgcccggaccgcttcctgactttggcctcgaagaatccgggcattcgaattcaaccatcaccactagctccacgcgggtgaccaaacattctacagtccaacactcctacagttag

SEQ ID NO: 185260 - DNA, 3123 bp, Artificial Sequence
  Description of Artificial Sequence: Synthetic coding sequence
atggactggctgttcttccggaacatctgcctgctgatcatcctgatggtggttatggaggtgaattccgaatttatagtggaggttaaggagttcgatatagagaacgggactactaagtggcagacagtacggcgccagaagagagaatggattaagtttgctgcggcctgtagggaaggagaagacaattctaagcggaatccgatcgcgaagattaggtctgactgtgagtctaatcagaagataacctaccgtatcagcggggtcggcatcgacaggccaccttacggtgtgttcaccattaatccaaggaccggggagatcaatattacatctgtggtcgatagggagattacacctctgttcctcatttactgcagagctttgaactctcgcggtgaggacctggagcgacccctggaactacgcgtaaaggtcatggatattaatgacaatgccccagtgtttagccagtcggtgtacaccgcaagcatcgaggagaattctgacgctaataccctggtcgtcaaactttgcgctaccgatgctgacgaagaaaaccacctaaactccaaaattgcttacaagattgtctctcaagagccaagtggagccccaatgtttatactcaaccgctacacaggcgaagtttgcaccatgagttcatttttggaccgggaacagcacagcatgtataatttagtggtgcgagggtcagatcgcgacggcgctgctgacggacttagctccgagtgcgactgtcgtatcaaggtgctcgatgtgaacgacaattttccaaccctcgagaagacatcgtacagtgcctctatcgaagagaattgcttgagctccgaactgattcgcttgcaggccatcgatttggatgaagagggcacggacaattggctcgcgcagtacctgattctgtcaggaaacgatggtaactggttcgacatccaaacagatcctcagacaaacgaagggatactgaaagttgtcaaaatgctggactacgaacaggcccctaatatacagcttagtattggagtgaaaaaccaggccgactttcactactccgtggcgtcccagttccagatgcatcccactcccgtgaggattcaggtggttgatgtgagggaaggccctgccttccacccatccacaatggcgtttagcgtccgggaggggattaagggttccagcttgctgaactacgtcttaggcacatacaccgcgatcgaccttgatactgggaacccagctaccgatgttagatatataattggccatgacgctggcagctggctcaaaattgactctcgtacgggtgagatacagttctcacgcgagttcgacaagaaatctaaatacatcataaacggaatatataccgcagaaatcttggcgattgatgacgggtccgggaagacggctacagggactatctgcatagaagttcctgacattaacgattattgtcctaacattttccctgagcgccgaaccatatgtattgactctccttccgtgctaatctctgtgaacgagcacagctatggctccccattcaccttttgtgtggtggacgaacctcccggtatagctgacatgtgggatgttcgtagcacaaatgcgacgtccgctatactgaccgcaaagcaagtattgagccccggcttttatgagattcccatcctggtgaaagactcctacaatcgtgcctgcgaactggcacagatggtgcagctgtacgcctgtgactgcgatgataatcacatgtgccttgattccggtgccgcagggatatatacagaggatatcaccggagatacctacggacctgtcaccgaagaccaggccggagtgagcaatgttggtttaggccctgccggaatcggcatgatggtgttggggatcctgttacttatcctcgcccccctactcttgctgctatgttgttgtaagcagagacagcctgagggtctgggcacccgatttgcacctgtcccggagggaggcgagggggtgatgcagtcctggcggatcgaaggcgctcaccctgaagacagggacgtgagcaacatttgcgcgccaatgaccgctagtaacactcaggaccgcatggattcctctgagatctacaccaatacctatgctgctggaggtacggtagagggaggagtcagcggcgtggagctgaacactggtatgggtacagctgttggcctgatggctgccggcgctgccggcgcctccggcgctgcccgtaaacgatccagcacaatgggaacacttcgagactacgctgatgcagacatcaacatggcctttctagattcttatttcagcgagaaggcttatgcctatgcagatgaggacgagggccgccccgctaacgattgtctgcttatctatgatcatgagggcgtgggcagcccagtgggtagcatcggatgttgttcctggatagtcgatgacctagacgaatcttgcatggagaccctggatcccaagttcaggacactcgccgaaatctgcttgaacaccgaaatcgaacccttcccttcacaccaggcctgtattccaatctcaactgatttgccactcctggggccaaactattttgtgaacgagtcaagcggtctaactccatcggaagttgaattccaggaggagatggcagcttctgaacctgttgtacacggggatataatcgtcacagagacctacggaaatgcagacccctgtgtccagccaactactatcattttcgatcctcagctcgcccccaacgtggtcgtgactgaagcagttatggctcccgtttatgatattcagggtaacatctgtgtgccagcagaactggccgactataataacgtgatttacgcagagcgcgtgttggctagtccaggggtgccggatatgagtaattcctccacaacagaaggatgcatgggacctgtcatgtcaggaaatatcctcgtgggcccagagattcaggttatgcagatgatgagtcccgatctgccgatcgggcagactgtcggctccacatcgcctatgacctctaggcatcgcgtcacccgctacagtaatatccattacacacaacagtag

SEQ ID NO: 185261 - DNA, 3180 bp, Artificial Sequence
  Description of Artificial Sequence: Synthetic coding sequence
atggactggctgttcttccggaacatctgcctgctgatcatcctgatggtggtgatggaagtgaactcagagtttattgtggaggtaaaggagtttgatatcgaaaatggaaccacaaagtggcagactgtaaggagacagaagcgagagtggataaagttcgccgcagcctgtcgagagggagaggacaattccaaacggaaccccatagctaagatacgcagcgattgcgaatccaatcagaaaattacctatcgcatctccggggtcgggattgataggcccccctatggtgtgtttacaatcaatccaaggacaggggagattaacatcacctccgtggtcgaccgggagatcacccccctgtttctcatttattgcagagcactaaactctaggggtgaagatttggaaaggccacttgagctccgcgtcaaggtcatggatattaatgacaatgccccggtattttcacaatcggtctacactgcgtcaatcgaggagaatagcgatgccaacacactggtggttaaactttgcgccacagacgccgacgaagagaaccacctgaactccaaaatcgcttataagattgtatctcaggaacccagcggtgccccaatgttcatcctgaataggtacaccggcgaggtgtgtactatgtcctcattcctcgaccgagaacagcactctatgtacaatctggttgtacgcggctctgaccgagacggtgccgccgacggcctctcctcagagtgcgattgtcgtattaaggtcctcgatgtgaatgacaactttcctactttagagaaaaccagctacagtgcgagcattgaagaaaactgcctgtccagtgagctgataagattgcaggcaatcgacttagacgaggagggcacagacaattggcttgcacaatatctaattctcagcgggaatgatggtaactggttcgacatacaaactgatccacaaacgaacgagggcattctaaaggttgttaaaatgctggactatgaacaagcccccaacatccagctgtccataggcgttaaaaatcaagccgacttccactactctgtggcttcccaattccagatgcaccctacacccgtgcggattcaggtggtggatgtccgcgagggaccagcattccaccccagcaccatggcgttcagcgtccgcgaaggaatcaaggggagctctcttcttaattatgtgctgggcacttacaccgcaatcgaccttgatactggcaaccccgctactgatgtccgctacattattggacacgatgcaggtagttggctgaagattgactctagaaccggtgaaatccagttctcacgcgaatttgacaaaaaaagtaagtacatcataaatggcatctatacagcagagatactagccatcgacgatggatccggcaaaactgccaccggcacaatctgtatagaagtccctgatattaacgactattgtcctaacatattccctgaacgtcgcactatttgcattgacagtccatcggtgttgatctctgtcaacgagcatagctacggatctcctttcactttctgtgtcgtggatgaacccccaggcatcgctgatatgtgggatgtccgatctacaaacgccacctccgcaatactgaccgcaaagcaggtcctaagtcctgggttctacgagataccaatcctcgtaaaggactcatacaaccgcgcctgcgagctcgcacaaatggtgcagctttacgcctgtgactgtgacgataatcacatgtgtctcgacagcggtgcagccggtatctacaccgaagatataacgggcgatacttacggacctgtgacagaagatcaggcaggagttagcaacgtggggctagggcctgctggaattggaatgatggtcctcggaatccttctattaatcctggctccgctcttgctgctcctgtgctgttgtaaacaacgacagcccgagggcctcggaacccgctttgcccctgtgccagaaggaggggagggagtaatgcagagttggcgcattgagggcgcccatcccgaggatcgcctcttttctgcttatgccctccccggaggcggcggaacagccgatggtggtggttctgttctgggcaggtgcgccctccaggccactcctgctctgcttaaccagcacccgcccttctctgaaatatacacaaatacttacgcagccggtgggactgtggagggaggagtgagtggggtggaactgaacacagggatgggaaccgccgtcgggctcatggccgctggtgcggccggcgcttccggggcggctcgaaagaggagcagcacaatggggacacttagggattatgctgatgccgatatcaatatggcgttccttgattcttacttctcagaaaaggcttatgcctacgccgatgaggatgagggacgacctgccaatgattgcttactaatttacgaccatgagggggtgggttcgcctgtgggctctataggttgctgctcctggattgtagatgatctcgacgaatcgtgcatggagacactagaccccaagttccggactttggcggaaatatgccttaacaccgagatcgagcctttcccctcacaccaggcttgcatacccatctctacagacctacctctgttgggacctaattactttgtcaatgaatccagcgggttaacaccttcagaggtagaattccaggaagagatggccgccagcgagccagtagttcatggagacattattgttacggaaacctatggtaatgcagacccttgcgtgcagcctactaccatcatcttcgacccccagctcgccccgaacgtcgtcgtcacggaagccgtcatggcccctgtctatgacatccaaggtaatatttgcgtccccgcggagctggctgactacaataatgtgatatacgcagaacgggtgctggcttcaccgggggtccccgacatgtctaattccagcaccactgaagggtgtatgggacctgtgatgtctggcaatatcttggtcgggccggagatccaagttatgcaaatgatgtccccagacctccccatcggtcagaccgttggttctacctcccccatgacctcccgacatagggtcaccaggtatagcaatattcattatacccagcagtag

SEQ ID NO: 185262 - DNA, 498 bp, Artificial Sequence
  Description of Artificial Sequence: Synthetic coding sequence
atggccagcggcgtgcaggtggccgacgaggtgtgccggatcttctacgatatgaaggtgaggaagtgttctacccctgaagaaataaagaagcggaagaaagctgttattttttgtctgagcgccgacaagaaatgcattatcgtcgaagagggaaaggagattcttgtgggtgatgtgggagtgacgattaccgacccttttaagcattttgtgggaatgctccccgagaaagactgccggtatgccctgtatgatgcctcattcgagaccaaagaatctcggaaggaggagcttatgttttttttgtgggcccccgagctcgccccactgaaatcgaagatgatatacgcctcttccaaggacgctatcaagaagaagttccagggcataaagcacgagtgccaagcaaacgggccagaagacctaaatagagcatgtatcgccgagaagctgggtggatcgcttatcgtcgccttcgaaggttgtccagtgtag

SEQ ID NO: 185263 - DNA, 447 bp, Artificial Sequence
  Description of Artificial Sequence: Synthetic coding sequence
atgaaggtgcggaagtgcagcacccccgaggagatcaagaagcggaagaaggcagtgatcttctgcctgagcgccgataaaaaatgtatcattgtggaggagggaaaggagatcctcgtcggagatgttggggtgactatcactgacccatttaagcactttgtgggcatgctaccagagaaggactgcaggtacgctctatatgatgcaagcttcgagacaaaggaatccaggaaggaggaacttatgttcttcttgtgggctccagagctcgcgccacttaaatccaagatgatttacgccagcagtaaagatgcaattaaaaagaagtttcagggcattaagcacgagtgtcaagcaaatgggcctgaggatctgaaccgcgcttgcattgccgaaaagctgggtgggtctctaatcgtagcgtttgaaggttgtcctgtttag

SEQ ID NO: 185264 - DNA, 897 bp, Artificial Sequence
  Description of Artificial Sequence: Synthetic coding sequence
atgagcgacgccaacctggacagcagcaagaagaacttcctggagggtgaggtggacgatgaggagtctgttatcctgaccttagtccctgtgaaggatgacgctaacatggaacagatggagccatccgtcagctctaccagcgacgtgaaactagagaagccaaaaaaatataaccctggacatctactgcagaccaacgagcagttcaccgcacctcaaaaggctagatgcaagattccggcattgccactccccaccatcttaccacctataaataaggtttgtagagacactctccgggattggtgccaacagcttggactgtctactaacggcaagaagattgaggtgtacctgagactgcatagacacgcttacccagaacagcgtcaggacatgcctgaaatgagtcaggaaaccaggttacagcgctgctccagaaagcggaaggccgtgacgaagcgcgctaggctgcagaggtcatatgagatgaacgaaagggccgaggagacaaataccgtcgaggtcatcacctctgcacctggggcaatgctcgcttcttgggcccgcatcgcagcaagggcagtgcaacccaaggccctgaactcttgcagcatcccagtctcggtcgaagcttttctgatgcaggcctcaggggtgagatggtgcgtagtccatggacgcttgttgagcgccgatacgaagggttgggtgcggctgcagttccatgccggccaggcttgggtgccaacgacccatcggagaatgatcagtttgtttcttttgccagcctgtatctttccctctccggggattgaggacaatatgctgtgtccggattgcgctaagcgaaataagaaaatgatgaagagactgatgaccgtagagaagtag

SEQ ID NO: 185265 - DNA, 480 bp, Artificial Sequence
  Description of Artificial Sequence: Synthetic coding sequence
atggaccccagccagttcaaccccacctacatccccggcagcccccaaatgctaacagaagaaaactctcgcgatgactctggggctagccagatcagcagcgagactctcataaagaatctgagtaacctgaccatcaacgcctcatcagagtccgttagccctctgagtgaggccctgctgcgcagagaaagtgtgggggcagctgtgctgagggagatcgaagacgaatggctctattcgcgcagaggagtccgcaccctgctgtcggtgcaacgagaaaaaatggccaggctgcgatacatgctgctgggcggagtccgtacacatgagaggcgccctactaataaggaacccaagggtgttaaaaaagaatccagacccttcaaatgcccttgctccttttgtgtcagtaatggctgggatccctccgagaacgctaggatcggcaaccaggacaccaaacccctgcagccttag

SEQ ID NO: 185266 - DNA, 915 bp, Artificial Sequence
  Description of Artificial Sequence: Synthetic coding sequence
atgctgcggggcagcgccagcagcaccagcatggagaaggccaagggtaaagaatggacatccacggaaaagtcgagagaagaggaccaacaggcctctaaccagccgaatagcatcgcgctcccggggacttccgccaagcggacgaaggagaaaatgtcaataaaagggagcaaggtcctatgccccaaaaagaaggctgaacacacagataacccccgaccccagaagaagatcccaattccccctctcccgtccaaactcccccctgttaacctaatccaccgggatatcctacgcgcatggtgccaacaactgaagctgtctagtaagggtcagaaactggatgcttacaaaagattgtgtgcattcgcttaccctaaccagaaggacttcccaagcactgctaaggaggcaaaaattcgtaaatctttacagaaaaaacttaaggtggaaaaaggcgaaacatcgttgcagtcctctgagacccatccccccgaagtggctctccctccagttggcgaaccacccgctctggagaattccacagccttgctggagggggtgaatacagtggtggtgaccacatcagccccggaggcactactagcatcatgggcacggatctcagctagggcccggactcctgaggcagtagagagccctcaagaggcatctggggttcgttggtgtgtcgtgcatggcaaatctctgccggcagacaccgatggttgggtccacctgcagtttcacgcaggtcaggcctgggtgcccgagaaacaggaggggcgtgtgagcgctctttttttactccccgccagtaattttcccccacctcacttagaggataatatgctgtgcccaaagtgtgttcaccgcaataaagtgctgattaagtccctacaatgggagtag

SEQ ID NO: 185267 - DNA, 351 bp, Artificial Sequence
  Description of Artificial Sequence: Synthetic coding sequence
atgggcaccctgcccgcccggcggcacatccccccctgggtgaaggttccagaagacctgaaagatccagaagtattccaggtgcaaacgcgcttgctgaaggctatttttggcccagatggcagcaggataccttacatcgagcaggtctctaaggccatgctggagttaaaggccctcgagtctagtgatcttaccgaagtcgttgtttatggttcatatttatacaagctgcgcacaaagtggatgttacagagtatggccgaatggcataggcagaggcaggagcgaggcatgctgaagctggccgaggcgatgaatgccctcgagctcggtccttggatgaagtag

SEQ ID NO: 185268 - DNA, 1104 bp, Artificial Sequence
  Description of Artificial Sequence: Synthetic coding sequence
atgagcagcaccctggccaagatcgccgagatcgaggccgagatggcacggacccaaaagaacaaggccacggcccaccaccttggcttgcttaaagccagacttgcaaagctgcgcagggagctcatcacgcctaaaggaggcggaggaggcggtccgggagagggtttcgacgtggcgaagactggagatgcacgtattgggttcgtagggtttccctctgttggaaagagtactctgcttagtaatcttgccggcgtatattccgaagtggctgcgtatgaatttactacactcactacagtccctggagtgatcagatacaaaggggccaaaatacagcttcttgatctccccggcattatagagggagctaaagatgggaagggaagaggcaggcaggtgatagcagtcgcaagaacgtgtaacctcatcctgatagtcttggatgtgctcaaacccctgggccataaaaaaattattgagaatgaactcgaagggtttggaatccgcctcaattctaagcccccaaacatcgggttcaaaaagaaggacaaaggcggcatcaatctgactgccacctgcccccagtccgagttggacgcagaaaccgtaaagtccattcttgccgagtacaaaatccacaatgcagatgtgacattaaggagcgatgcaacagctgacgatctcattgatgttgttgagggaaatcgggtatacatcccatgcatatacgtgctcaacaaaattgaccagatttcaatcgaggagctggacattatatacaaggtgcctcactgcgtgcctatctccgcccaccataggtggaattttgacgacctgttagaaaaaatttgggactatctgaagctcgtgcgcatttatactaaaccaaaaggacaactgccagactacaccagtcctgtagtgctaccgtatagtagaacaaccgttgaagatttctgcatgaaaattcataagaacctgatcaaagaattcaagtacgctctggtttggggcctgtcagtgaaacacaatccacagaaggtgggtaaggatcatactttggaagacgaagatgtgatccagatcgtgaagaaatag

SEQ ID NO: 185269 - DNA, 396 bp, Artificial Sequence
  Description of Artificial Sequence: Synthetic coding sequence
atggccgccgccgtggccatggagaccgacgacgccggcaaccggctaaggttccagctggaactagagttcgtacagtgcctcgccaaccccaattacctgaatttcttggctcagagggggtactttaaggataaggcattcgtcaactacctaaagtatcttctgtattggaaggatcctgaatatgcaaagtatttaaagtatccccaatgtttgcacatgctggaactgctgcagtacgaacacttcaggaaagagttagttaatgcccagtgtgccaaattcatcgacgaacagcagatcttacactggcagcactacagccgaaagaggatgagactccagcaagctctagccgagcaacaacaacagaataacacctccggtaaatag

SEQ ID NO: 185270 - DNA, 1032 bp, Artificial Sequence
  Description of Artificial Sequence: Synthetic coding sequence
atgggcatcctggagaagatcagcgagatcgagaaggagatcgcccggacccaaaaaaataaagccacagagtaccatttggggttgctcaaggcaaaacttgccaagtaccgcgcacagctgcttgagccaagtaaaagcgccagttctaaaggagaggggttcgatgtcatgaagtcgggagacgcacgggtggctttaattggcttcccatctgtggggaagagtacatttctttctctcatgaccagtacagccagtgaagccgcctcctatgaatttacaactctcacgtgtatccctggggtaattgagtacaagggcgctaatatccaattgcttgacctgcccgggattattgagggcgcagcgcagggtaaggggcgcggaaggcaggtaattgccgtcgcccgaaccgctgatgtcataatcatgatgcttgatgccacgaaaggcgaggtgcagcgcagtctgctcgagaaagaactcgagtctgtggggatcagactcaataaacacaaaccaaatatctattttaaacccaagaaaggaggaggaatttccttcaacagtaccgtgactctcacacagtgtagcgaaaaactagttcaactgatcctccacgagtacaaaatcttcaatgccgaggttctgtttcgggaggactgctctcctgacgagtttatcgacgtcatcgtggggaatcgcgtgtatatgccctgcctctatgtatacaacaagatagatcagattagtatggaggaagttgaccgccttgcgaggaagcctaactctgttgtgatctcttgtggcatgaaattgaacttagattatctacttgaaatgctttgggagtacctcgccctgacctgtatttacacaaagaagcgcggccaaaggcccgactttactgatgcaattatcttacggaaaggagctagtgttgaacatgtctgccataggattcacaggtcccttgcttcccagttcaaagcccctgcacccagcacagtacgctccggctgggcttag

SEQ ID NO: 185271 - DNA, 2037 bp, Artificial Sequence
  Description of Artificial Sequence: Synthetic coding sequence
atggagctgcggagctaccagtgggaggtgatcatgcccgccctggagggtaagaatataatcatctggctgccaaccggagcggggaagacacgagcagctgcatacgtagccaagaggcacctggagacagtagatggcgctaaagtggtggtgctggtcaatagggtgcacttggtcacacaacatggcgaggagttccggcggatgttggatgggcgatggaccgtcaccacattgtctggggatatgggaccaagagcaggttttggccacctggccagatgtcacgacctactcatttgtacagcagagcttctgcagatggctcttacctcgccagaagaggaggaacacgtcgagcttacagtcttcagtcttatcgtggtagacgagtgtcaccatacccataaagatacagtctacaacgtcatcatgtcacaatacctcgaactgaagcttcagcgcgcgcagccactaccacaggtgctagggttgacagcctccccgggaacaggaggggccagcaagctggacggggcaatcaaccacgttctccagctgtgcgctaacctcgatacatggtgtattatgagcccacagaattgttgccctcagcttcaggaacattcccagcagccttgcaagcagtacaatctgtgtcacaggagatctcaggacccttttggagatctgctcaagaagcttatggaccaaatccatgaccacctcgaaatgcccgagctgtctcgcaagttcggcacacagatgtacgagcaacaggtcgtgaaattgtcggaggctgcagcacttgcaggcctgcaggaacaaagggtgtacgcactccacctccgtaggtacaacgacgctcttctcatacacgacacagtcagagccgtggacgcactagcggctttacaggacttttatcacagggagcatgtaacgaaaacacagatactttgtgccgagaggcgcctccttgcactcttcgacgatcggaagaatgaactggcccatctagcgactcatggccccgaaaaccctaaattggaaatgttagaaaagatcctgcagaggcagtttagcagtagcaattcaccgcggggcatcatattcaccaggacccgtcagagcgcccacagcctgctgctttggttgcagcagcaacagggccttcaaacagtggatattcgagcccaattgctcattggagcaggaaactcctcacagtcaacacacatgacgcagcgggaccaacaggaggtgattcagaagtttcaggacggcaccctcaacctccttgtggcaaccagcgttgcggaggagggtctagatattccccattgcaacgtcgtcgtgaggtacggattgctgacaaacgagattagtatggtgcaagcacgcgggagggcaagagccgaccagtccgtgtatgccttcgtcgccaccgagggttctcgagaattgaaaagagaattgattaacgaggcactggagacattgatggagcaggcagtggctgccgttcagaagatggaccaggccgagtaccaggccaaaatccgcgacctacagcaggccgcattaacaaaacgagcagcacaagctgcccaacgggagaatcaaagacagcagttcccagtcgagcacgtccagctcctttgtatcaattgcatggttgcggtgggacatggatccgaccttagaaaggttgagggtacgcatcacgtgaacgttaatccaaacttcagtaactattacaacgtgagccgtgaccccgtggttatcaataaagtgtttaaggattggaaaccggggggcgtgatctcttgtaggaactgcggggaagtctgggggctgcagatgatatacaagagtgtaaagctgccagtcttgaaggtgagatccatgttacttgagacgccccagggcagaatccaagctaagaagtggagccgggtcccattctctgtccctgacttcgacttcctacagcactgcgctgaaaacctgagtgacctaagcttggattag

SEQ ID NO: 185272 - DNA, 909 bp, Artificial Sequence
  Description of Artificial Sequence: Synthetic coding sequence
atggagctgcggagctaccagtgggaggtgatcatgcccgccctggaagggaaaaatatcattatttggctgccgaccggagccggtaagacacgggcggccgcttacgtcgcaaagcgacatctggaaactgtcgacggcgctaaggtcgtcgtgctggttaaccgcgtgcatctggtcacccaacacggggaggagttcagacggatgcttgacggacgttggaccgtgaccaccctgagcggcgacatgggtcccagggccgggttcggtcacctcgcgagatgccatgatctgctaatctgcactgcagagctgcttcaaatggcactgacttcgcccgaagaggaagagcacgtggaactgactgtgttttctttgatcgtggttgacgaatgccatcacacacataaggataccgtatacaacgtcatcatgtcgcagtatttggaactgaagctccaacgagctcagcctctaccgcaggtcctggggctaacagcaagccccggaaccggcggtgccagtaaactggatggcgccatcaaccacgtactacaactttgtgccaacctggatacatggtgtatcatgtcgcctcagaattgttgtccacagcttcaagagcacagccagcagccttgtaagcagtacaatctttgtcaccgtagatcgcaggaccctttcggagaccttctgaaaaagctgatggaccaaatccacgatcatttagagatgccagaactgagccggaaattcgggacacagatgtacgaacagcaggttgtgaagctgtctgaggcagcggccctggccggactgcaggaacagagagtgtatgcactgcatctaaggcggtataatgatgctttgttaattcatgatacggtccgggcagtggacgcctag

SEQ ID NO: 185273 - DNA, 1464 bp, Artificial Sequence
  Description of Artificial Sequence: Synthetic coding sequence
atggagctgcggagctaccagtgggaggtgatcatgcccgccctggagggaaaaaacatcattatttggctgcccaccggggcaggaaaaacccgggccgccgcttatgttgccaaaagacacctggagacagtggatggagccaaggtggtagtgcttgtgaaccgagtccacctggtgacgcagcacggcgaggagttccgccggatgttggacgggcgttggaccgtgactactctgtccggggacatgggcccccgcgcaggttttggacacctagcgcgttgccatcatacacacaaagataccgtgtataacgtgattatgtctcagtacttggagttgaagctgcagagagcacaaccgctacctcaggttctgggcctcaccgcttccccagggacaggcggagccagtaagctggacggggcaattaaccacgtccttcagttgtgtgccaatctcgatacatggtgcatcatgtccccccaaaattgctgcccccagctgcaggagcactctcagcagccgtgcaagcaatacaacctgtgccacaggcggtcccaggacccctttggtgatctcctcaaaaagctgatggatcagatccacgatcacctagaaatgccggagctgagtcggaagttcggcacgcaaatgtatgagcaacaagtcgtaaaactgtccgaggcggcagccctggcagggttacaggaacagcgtgtttacgcactacacctgaggaggtacaatgatgccctactgatacacgatacagttagggcagtggatgcccttgcagctctgcaggacttctaccacagggaacacgttaccaaaactcagatcctctgcgcggaacgccggctgttggcactgtttgacgataggaagaacgaactggctcatctcgcaacacatggaccggaaaatccgaagttagagatgttggaaaaaatcctccagcgccagttttcttcgtctaattctcctagagggataattttcacccgcacgcgtcagagcgctcattccctgctcttatggttacagcagcagcaaggactccagaccgtggacattcgtgctcagctgctcatcggagccgggaacagtagccagagcacccacatgactcagcgtgatcagcaagaggtcatccagaagttccaggatgggacactgaacctgctagtcgctacatctgttgccgaagaaggccttgacattccccactgcaatgttgtggtgaggtacgggctgctgaccaacgaaatcagtatggtgcaagcgaggggacgcgccagggctgatcagagtgtctacgccttcgtggcaaccgaaggttcacgggaactcaagcgtgaactcatcaatgaagccctggaaacgctaatggagcaggcagtggcagcggttcaaaagatggatcaggcagagtaccaggctaaggaattactttag

SEQ ID NO: 185274 - DNA, 471 bp, Artificial Sequence
  Description of Artificial Sequence: Synthetic coding sequence
atggagctgcggagctaccagtgggaggtgatcatgcccgccctggaaggtaagaatattattatctggctacctactggagccggaaagacccgcgccgccgcctatgtggccaagagacacctggagaccgtggacggggctaaggtggtcgtgctggttaaccgtgtgcacctagtaacccagcatggagaggaattccgacgaatgctggacggccgttggacagtcactacactttctggcgatatgggcccccgcgccggattcggtcatctggcaagatgccatgatctgcttatttgtacagccgaacttctgcagatggctttgacctctccagaagaagaagaacacgttgagctcactgtattctccctgatcgtcgtagacgagtgccatcatactcataaagatactgtttacaacgtgattatgtcacagtacctggagctgaaactccagagatag

SEQ ID NO: 185275 - DNA, 2208 bp, Artificial Sequence
  Description of Artificial Sequence: Synthetic coding sequence
atggccaaggagcggggcctgatcagccccagcgacttcgcccagctgcagaaatatatggaatacagtacaaagaaggtctcggatgtgcttaagctgttcgaagatggcgagatggccaagtacgtgcagggagacgctatcggatacgaaggctttcagcagttccttaagatttatttggaggtcgataacgtccccagacatcttagcctcgccctgttccagagttttgaaactggacattgtctgaatgaaacgaacgtaacgaaggacgtggtgtgcctcaatgacgtgtcctgctatttcagcttactcgagggcgggagacccgaagataagctggaattcactttcaagctctatgataccgacaggaacgggattttggattccagcgaagtggataaaatcatcctgcagatgatgcgcgtggctgagtacctggactgggacgtgtccgaactgcgtcccatcctccaggagatgatgaaggagattgattatgatggatcgggctctgtgtctcaagctgagtgggtgcgcgcaggtgctaccaccgtccctctcttagtcctgctgggcctggagatgactttaaaggacgatgggcagcacatgtggcgccctaaaagatttcccaggccagtctattgcaatctctgcgagtcttcaatagggctcgggaaacaaggcctgtcttgcaacctttgtaaatatacagtgcacgaccagtgtgcaatgaaagccctcccatgcgaagtttcaacctacgctaagtctcggaaagacataggcgtgcaatcccatgtctgggtgcgcggaggatgtgagtctggaaggtgtgatcgctgtcaaaaaaagattcgcatttatcactcactcacgggcctacattgcgtttggtgccacctggagattcacgatgactgcctgcaggcggtagggcatgagtgtgactgtggcttattgcgcgatcatatccttcctccctcgagcatctatcccagcgtgctggccagtggacccgacagaaaaaactcaaagacgtcacagaaaacaatggatgacctcaatctgagtacctccgaagctctaagaatcgatcccgtcccaaacacccacccactcttggtattcgtgaatccaaagagcggaggcaagcaggggcagcgggtgctgtggaagttccagtatattctcaatccgaggcaagttttcaatcttctgaaggatggtcctgagatcggtctccgcctgtttaaggatgtgcccgactcgcgaatcctggtctgcggaggagatggcacagttggatggatcctggaaacaatcgacaaggccaatctgccggtcctgccgccagtagcagtgctgccgctgggaacaggaaatgatttggcaaggtgtttacgctggggcggcggttatgagggacagaacttagctaaaattctaaaggatctggagatgagcaaagtggtgcatatggacaggtggtcggtagaggttatcccacaacagacagaggagaagtcagatcccgtgccgtttcagatcatcaacaattatttctctattggggtcgacgccagtatagcccatcggttccatatcatgagggagaagtatccggaaaagtttaactctaggatgaaaaataagctttggtattttgagttcgccacatctgagtcaatcttctccacctgtaaaaaactcgaagagagcctgacagttgagatctgtgggaagccgctagacctgtcaaacctgagcttggaaggaatagctgtgcttaacatccccagcatgcacggcgggagcaatttatggggcgatacccggcggccacacggcgatatctacggtatcaatcaagccttgggcgccacagcaaaggtgatcacagacccggacatccttaaaacttgcgttcctgacttgagcgataagcgcttggaggtggtagggcttgagggggccattgaaatggggcagatttacacgaaacttaaaaatgcgggaaggcggctagccaagtgcagcgaaatcaccttccacactaccaaaactcttcccatgcagatcgacggagaaccttggatgcagactccctgcaccatcaaaataactcataagaaccagatgccaatgttaatgggtcccccacctcgttcgactaatttcttcggcttcctaagctag

SEQ ID NO: 185276 - DNA, 2208 bp, Artificial Sequence
  Description of Artificial Sequence: Synthetic coding sequence
atggccaaggagcggggcctgatcagccccagcgacttcgcccagctgcagaaatatatggagtatagcaccaagaaagtgtctgatgtgctgaaactatttgaagacggcgaaatggccaagtacgttcaaggcgacgcaattgggtacgaaggcttccagcagttcttgaagatatacttggaagtcgataatgtacccagacaccttagtctggctctgtttcagtcatttgagacgggacattgtctgaatgaaacgaacgtcactaaagacgtagtttgcctgaacgatgtctcttgctacttctcactcctcgaggggggacggccagaagacaagctagagttcaccttcaagttatacgatactgacaggaatggcatattagactcatctgaagtggataagatcatcctccaaatgatgcgagtggccgaatacttggattgggatgtatccgaactgcgacccattctacaggagatgatgaaggagattgactatgacgggagtggcagtgtctcccaggccgaatgggtgagggctggcgctacgacggttccactgctggtgctcctcgggctggagatgacactcaaagacgacgggcagcacatgtggcgacctaaacgttttccaaggcccgtgtattgtaacttatgcgaaagctctatcggactcggcaaacagggcttgagctgcaacttgtgtaagtacaccgtacacgaccagtgcgccatgaaagccctgccttgcgaggtttccacgtacgccaaatcaagaaaagatattggcgtccagtcccatgtttgggtacgtggggggtgcgagagcggccgctgtgatcggtgtcagaaaaagattaggatatatcattcgctaaccggtctgcactgtgtatggtgtcacctcgagatccatgatgactgtcttcaggctgtcgggcatgagtgtgattgtggcctgctccgggatcatatccttcctccttcttccatctaccccagcgtgttagctagtggaccggacagaaagaacagtaagacttcccagaagaccatggacgatcttaacttgagcacatccgaggccttgcggatcgaccccgtgcccaacacacacccattgcttgtctttgtcaacccaaagtccggcggaaaacaaggacagcgcgtactctggaagttccagtacatccttaaccctagacaggtgtttaatctattgaaggatggccctgaaattgggctgcgcctcttcaaggatgtccccgactccagaatcctcgtttgcgggggagacggtacagtggggtggatcctggaaactattgataaagctaatctcccggtgctgcctcctgtcgctgtcctaccactaggaacaggcaacgacctggctcgttgccttaggtggggggggggctacgaagggcaaaatctagcgaaaatcctcaaggacctcgagatgtccaaagtggtgcacatggataggtggagcgtggaggtgattcctcaacaaaccgaggaaaaatccgacccagtcccttttcaaataattaataattatttcagtattggcgtcgatgccagtatcgctcatagattccacattatgagggaaaaatatcccgaaaaatttaatagccggatgaagaataagctctggtacttcgagtttgccacaagcgagtctattttctcaacatgcaagaaactcgaagagagcctgacagttgagatatgtggcaagccgctggacctcagcaacttaagcctggaagggatcgccgtgctcaacattccctcaatgcacgggggcagtaatctatggggcgacacacgccggccacacggagatatttatggtattaaccaggcactcggtgctactgctaaagtgattaccgacccggacattcttaaaacctgtgtgcctgacctctctgataagaggctggaggtagtgggcttggagggtgccatcgaaatggggcaaatctacacaaagctcaagaacgcgggaagaagacttgctaaatgttccgagattacatttcatacgaccaagaccctgcccatgcaaatcgatggtgagccttggatgcagaccccatgcactatcaaaataactcacaagaaccagatgccaatgctcatgggccctcctccccgctctacaaacttcttcggatttctgagttag

SEQ ID NO: 185277 - DNA, 744 bp, Artificial Sequence
  Description of Artificial Sequence: Synthetic coding sequence
atggccaaggagcggggcctgatcagccccagcgacttcgcccagttgcagaaatacatggagtactccacaaaaaaagtctccgatgtgctgaagcttttcgaagatggcgagatggccaagtacgtgcagggggacgcaatcgggtacgagggctttcagcagttcctgaagatctacctggaagtagataatgtgcccaggcacctgagtctggcactattccagtccttcgaaacaggtcactgcctgaacgagacaaacgtgacaaaggatgtcgtctgcttaaacgacgtctcttgttacttctcccttttagagggcgggcgcccagaggataagctggaatttacttttaaactttatgatacagatcggaatggtatcctggattcttccgaagtggataagattatcctccagatgatgcgggtcgctgagtacctggactgggacgtttcggagcttcgacccatattgcaggagatgatgaaggagatcgactatgacggcagcggcagtgtatcccaagctgaatgggtgagagcgggagccacaaccgtgccccttctggtactgctagggctggagatgactcttaaagacgacgggcagcatatgtggcgtccaaagagattcccccgtccagtttactgtaacctgtgtgagtcatccataggcctcgggaaacagggactgtcttgcaatcggccgatcacttgtgtgggcgccaggcgtctctag

SEQ ID NO: 185278 - DNA, 351 bp, Artificial Sequence
  Description of Artificial Sequence: Synthetic coding sequence
atggccaaggagcggggcctgatcagccccagcgacttcgcccagctgcaaaaatatatggaatactccactaagaaggtcagcgatgtgctcaagctatttgaagatggggagatggctaaatacgtccagggggatgccatcggatacgaggggttccagcagtttttgaaaatttacctggaggtggacaatgtaccccggcacctctcactggctttgttccagtccttcgagactggacattgcctgaacgagaccaatgtcactaaggacgttgtgtgcctgaatgacgtgtcctgttacttcagtctgcttgaaggaggtaggcccgaagataaactggagtag

SEQ ID NO: 185279 - DNA, 177 bp, Artificial Sequence
  Description of Artificial Sequence: Synthetic coding sequence
atggccaaggagcggggcctgatcagccccagcgacttcgcccagctgcaaaaatatatggagtattctactaagaaggtgtctgacgtactaaagctcttcgaagacggagagatggctaaatacgtacaaggggacgctattgggtatgaaggctttcaacagtttctaaagtag

SEQ ID NO: 185280 - DNA, 66 bp, Artificial Sequence
  Description of Artificial Sequence: Synthetic coding sequence
atggccaaggagcggggcctgatcagccccagcgacttcgcccagctgcagaagtacatggagtag

SEQ ID NO: 185281 - DNA, 444 bp, Artificial Sequence
  Description of Artificial Sequence: Synthetic coding sequence
atggccaaggagcggggcctgatcagccccagcgacttcgcccagttgcagaagtacatggagtactccacaaagaaagtgtcagacgtgctgaagctcttcgaggacggtgaaatggcaaagtacgtccagggggatgcaatcggatacgaaggatttcagcagttcttgaagatctatctggaggtcgacaatgtacctaggcacctgtccctggccctctttcagtccttcgaaacaggccactgtcttaatgaaacaaacgtgacaaaggatgtcgtatgtctgaacgacgtgtcgtgttatttcagcttactagaaggtggaaggcccgaggataagctagagttcacctttaaactgtacgacacggaccgcaacggcattttggactcttctgaggtggacaaaatcatactacagatgatgagggtggccgagtag

SEQ ID NO: 185282 - DNA, 2208 bp, Artificial Sequence
  Description of Artificial Sequence: Synthetic coding sequence
atggccaaggagcggggcctgatcagccccagcgacttcgcccagctccagaaatacatggaatatagcacgaaaaaggtgtcggacgttctgaaattattcgaagacggggagatggccaagtatgttcagggggacgctatcggctatgaaggcttccagcagtttctgaagatttatctggaagtggacaacgttcctagacacctttccctggccctgttccagtcatttgagacagggcactgtcttaatgaaacaaatgtgacgaaggacgtggtttgcctgaatgacgtctcctgttacttcagtctgctagagggtggtaggccagaggacaaactggaatttacctttaagctctacgacacagaccgaaatggcatcctggactcaagcgaagtagacaagatcatcctccagatgatgagagtggctgagtacctggattgggatgtgagtgagctcagacctattctacaggagatgatgaaagaaatcgattacgacggctctggttccgtgagtcaggcagagtgggtaagggccggcgctactactgttccgttgctggtgctcctgggcctggagatgacactgaaagatgacggccaacacatgtggaggcctaaaagattccctaggcctgtttactgtaacttgtgtgagagtagcatcgggcttggcaagcagggtctatcctgcaacctgtgcaaatatacagttcacgatcagtgcgccatgaaagccctcccatgcgaggtgtcaacatatgccaagtcccgcaaagacatcggcgtccagtcgcacgtgtgggtgcgagggggttgtgaaagcgggcgctgtgatcgctgtcagaagaaaatccgaatctatcactcactgaccggcttgcactgcgtttggtgtcatctggaaatacacgacgattgtcttcaggccgtgggccacgagtgtgactgtggcttgttgcgcgaccacatcctgcctccttcctccatctatccaagcgtgctggcctcagggccagatagaaaaaattctaaaacatcacagaaaaccatggatgacttaaatctgagcacaagtgaagcccttcggattgatccagtaccaaatacgcacccactgctggtattcgtgaatcccaagtccggggggaaacaaggtcagcgggtgttgtggaaattccagtacatccttaatccccggcaggtgttcaatctcctaaaggacggaccagaaatcggtttgcgcctcttcaaggacgtcccggactcccgcatcctggtctgcgggggggacggaacagtggggtggatactcgaaacgatcgataaggctaacctgccggtgctccctccagtggccgtgctcccacttggcacaggcaacgatctggcccgctgcctgcggtggggcggtgggtacgagggccagaacttggccaaaatcttaaaagatctggagatgtccaaagtcgtgcacatggatcggtggagcgtggaggtaatcccacagcaaaccgaggaaaaaagcgaccccgtcccattccagatcataaataactattttagcatcggcgtcgacgctagtatcgcccatcggttccatatcatgagagagaagtaccccgaaaaatttaatagccggatgaagaacaagctgtggtactttgagttcgctacctctgaatccattttcagcacctgcaagaagctcgaagagagcctgacagtggagatctgcggaaaaccactggatctgtctaacctgtccctggagggcatcgccgtcctaaatattccaagcatgcatggagggagcaatttatggggagatactcgtagacctcacggtgatatttatgggattaaccaggccttgggtgctacagctaaggtcattacagaccccgacattctgaaaacatgcgtaccagacctttccgacaagcggctggaggttgtggggctggagggggcaatagaaatgggccagatctacacaaaattgaagaatgccggtagaagactggccaaatgctcagagatcaccttccacacaacaaagacactcccgatgcaaatagacggcgaaccttggatgcagactccctgcactatcaaaatcactcacaaaaatcaaatgccaatgctgatggggcctccacctcggtctactaatttctttggctttctaagttag

SEQ ID NO: 185283 - DNA, 402 bp, Artificial Sequence
  Description of Artificial Sequence: Synthetic coding sequence
atggccaaggagcggggcctgatcagccccagcgacttcgcccagcttcagaagtacatggagtatagcactaaaaaggtatccgacgtgctcaagctcttcgaggatggggaaatggccaaatacgtccagggggatgctatagggtacgagggatttcaacagttcctgaaaatctacttggaggtcgacaatgtccctagacacttgtcactcgctctgttccaatcgtttgaaacgggacattgtctaaatgagaccaacgtcacaaaagacgtggtatgtcttaacgacgtgagttgttacttctcactgctcgaagggggccgccccgaggataaactggagtttactttcaaactgtacgacaccgatagaaatgggatacttgatagtagctag

SEQ ID NO: 185284 - DNA, 324 bp, Artificial Sequence
  Description of Artificial Sequence: Synthetic coding sequence
atggccaaggagcggggcctgatcagccccagcgacttcgcccagctgcaaaagtatatggaatacagcaccaaaaaggtgagcgacgtgctgaagctgtttgaagacggcgagatggcaaagtacgtccagggtgatgctattggctacgaaggttttcagcagttcctcaagatttacctggaggtggacaacgtaccacggcacctatccttggccttattccagagtttcgagaccggacactgccttaatgagacaaatgtcaccaaagacgtagtatgcttaaacgacgtttcatgctattttagcctcctggaatag

SEQ ID NO: 185285 - DNA, 135 bp, Artificial Sequence
  Description of Artificial Sequence: Synthetic coding sequence
atggccaaggagcggggcctgatcagccccagcgacttcgcccagctgcaaaaatacatggagtatagcactaaaaaggtttcagacgtattgaaattattcgaagacggagaaatggctaagtacgtgcagtag

SEQ ID NO: 185286 - DNA, 135 bp, Artificial Sequence
  Description of Artificial Sequence: Synthetic coding sequence
atggccaaggagcggggcctgatcagccccagcgacttcgcccagcttcagaaatacatggagtactcgacaaaaaaagtttccgacgtgttgaagttattcgaagacggtgagatggcaaaatacgttcagtag

SEQ ID NO: 185287 - DNA, 402 bp, Artificial Sequence
  Description of Artificial Sequence: Synthetic coding sequence
atggccaaggagcggggcctgatcagccccagcgacttcgcccagcttcagaagtacatggagtactccactaagaaggtctctgacgtgctcaagctcttcgaggacggcgaaatggcaaaatacgtgcagggcgacgcaatcggctatgaaggcttccagcaatttctcaaaatctacctggaagtagacaatgtgccccgccacctgagccttgccctgtttcagtccttcgaaactgggcactgcctgaacgaaacgaacgtcacgaaggacgtggtctgtctgaatgatgtgagttgctacttctctctactagaaggaggacgtcccgaggataaattagaattcacctttaagctgtatgatactgatcgtaatggtatcttagactcatcttag

SEQ ID NO: 185288 - DNA, 135 bp, Artificial Sequence
  Description of Artificial Sequence: Synthetic coding sequence
atggccaaggagcggggcctgatcagccccagcgacttcgcccagctgcagaagtatatggaatatagtaccaagaaagtaagtgatgtgttgaaactgttcgaagacggcgagatggccaagtatgtgcagtag

SEQ ID NO: 185289 - DNA, 2415 bp, Artificial Sequence
  Description of Artificial Sequence: Synthetic coding sequence
atgaccaaccaggagaagtgggcccacctgagccccagcgagttcagccagctgcagaaatacgcagaatactccacaaaaaagctgaaggatgtattggaagagtttcacgggaacggtgtcctggctaaatataatccagaggggaaattggtagtgttggggaataccattgacttcgaaggcttcaaactgtttatgaaaaccttcttagaagctgagctgcccgacgacttcactgcccacctgttcatgagcttcagcaataaatttccgcacagctcgcccatggtgaaatccaagcccgccctgcttagcggcggactccgcatgaataaaggggccatcacacctccacggacaaccagccccgctaatacctgttccccagaagtgatacacctgaaagatatagtctgctatctaagcctgctggagagaggtcggcccgaagacaagcttgagtttatgttcaggctctacgacaccgatggaaacgggtttctggactccagcgagctggaaaatattatatcacagatgatgcatgtggccgaatacctggagtgggacgtgaccgagctgaaccctatactccatgaaatgatggaagaaattgactatgatcatgatggaacggtctcactggaggaatggatccaaggcggaatgacaaccattccactgctggtgctattggggttagagaacaacgtcaaggacgatggtcagcatgtgtggaggctgaaacactttaataagcctgcctactgtaacctgtgtttgaatatgttgatcggagtcggcaagcaaggattgtgctgttcattctgcaagtacaccgtgcacgagaggtgcgtcgcccgggccccaccgtcgtgtataaagacatatgttaaatccaaacggaataccgacgtaatgcaccattattgggtggagggcaactgtcctacaaagtgtgataagtgtcacaagacagtgaagtgctatcaaggcctgaccggactccattgtgtttggtgccaaataacactccataataagtgcgctagtcatctcaagccagagtgtgattgtggtcctctaaaggaccatatcctgcctcccaccaccatctgtcccgtagttcttcagaccctgccgacttctggagtgtccgtcccagaagaacggcaatccaccgtaaaaaaggagaagtctggcagtcaacagcccaacaaggtgattgataagaacaaaatgcaacgcgccaattctgttaccgtcgatgggcagggactccaggttaccccagtgcccggaacccaccccctcctcgtttttgtgaatcccaaaagtgggggcaaacaaggtgagcggatttacaggaagttccagtacctgcttaacccgcggcaggtgtacagcctgtcggggaatggaccaatgccaggtttgaattttttccgggacgtccccgattttcgagtgctggcgtgtggtggcgatggcactgtggggtgggtgcttgattgtatcgagaaagctaatgtgggtaaacatccccccgtggcaattctcccactagggactggcaacgatctggctaggtgtctgcgctggggcggcgggtatgaaggagagaaccttatgaagattctaaaagatatagaaaatagtacagaaattatgctggataggtggaaattcgaagtgatccccaacgataaagatgagaaaggtgaccccgtgccctattcaattatcaataattacttctctattggcgtggatgcaagcatcgcccatcgttttcatatcatgagggaaaagcatccagagaaatttaatagtcgcatgaagaataagttttggtatttcgagtttggaaccagcgaaaccttctcagccacttgtaagaagcttcacgaaagtgtggaaatcgaatgtgacggcgtccagatcgacctcatcaatatttccctcgaagggattgccatcctcaacatcccctccatgcacggtggatccaatctgtggggtgagtcaaaaaaacggcgcagtcaccgaagaatcgagaaaaagggtagcgacaagcgcaccactgtcacagacgcgaaggagctgaagtttgcttcccaggatctgagcgaccagctactcgaagtagtgggcctagagggagcaatggaaatggggcaaatatataccggacttaaatctgctggacgccggctggctcagtgcagctgcgtggttatacggacctccaagagcctcccaatgcagatagacggtgaaccctggatgcaaacaccctgcacaatcaagatcactcacaaaaaccaggcgcccatgctgatgggtccacctcccaagactggcctcttttgttccctcgttaagcgcacacgaaatcggtcaaaagagtag

SEQ ID NO: 185290 - DNA, 2415 bp, Artificial Sequence
  Description of Artificial Sequence: Synthetic coding sequence
atgaccaaccaggagaagtgggcccacctgagccccagcgagttctcccagctgcagaagtatgctgagtactccaccaaaaagctgaaagatgtgttagaggaattccacgggaatggtgtgctggcaaaatacaatcccgaagggaaacaggacatcctaaatcagacaattgacttcgagggattcaaactgtttatgaagacattcctggaagcagagctcccagacgactttacggcgcatttatttatgtccttctctaataaattcccccacagcagcccaatggtcaagtcaaagccagcgctcctttcaggcgggctgagaatgaataaaggcgcgatcacccctcctaggacaacctctcccgctaacacttgttcaccagaggtcatccacctgaaagacattgtatgctacctgtccttgctggaacgcggacgaccagaagataaactcgaatttatgttccggctgtatgacactgacggtaatggcttcctggacagttcggagcttgagaatataataagccagatgatgcacgtggcagagtacctcgagtgggatgtaacagaactgaaccccatccttcacgaaatgatggaggagatcgattacgatcatgacggaaccgtatcccttgaggaatggattcagggtggcatgacaacaatccccctactggtgctgttgggactggagaataatgttaaggacgacggtcagcacgtttggagactcaagcactttaacaagcctgcgtactgcaatctgtgtttgaacatgcttatcggcgttggcaagcagggtctctgttgttccttttgcaaatacacagtgcacgaaagatgtgtggctagggcgccgccctcttgcatcaagacctatgtcaagtcaaaaaggaatacggatgtcatgcaccactactgggtggaggggaattgtcccacaaagtgcgacaagtgccacaaaacagtcaagtgctatcagggtctcactggactacattgcgtgtggtgtcagataaccctgcataacaagtgcgctagtcatttgaaacccgagtgcgattgtggacctctcaaagatcacatactcccacccaccaccatttgcccggtcgtgcttcagaccttaccgacttctggggtgtccgtgcccgaggagagacagagcaccgttaaaaaggagaaatccggatcacagcagcccaataaagtgattgataagaataagatgcagcgtgctaatagcgtgacagtcgacgggcaggggcttcaagtcactccagtccctgggacgcaccccctgcttgtgttcgtgaaccctaaatccggtggaaaacagggggagagaatataccgcaagtttcaatacctgctgaatccaagacaagtgtactccctgtccggcaacggccccatgcctgggctaaatttctttagggacgtgccggactttagggtgctggcatgcggcggggacgggaccgtgggctgggtattagattgcatcgaaaaagctaatgtgggaaaacatcctccagtggctatcttaccacttgggactggaaacgatctagcccgctgcctccggtggggcggggggtatgagggagagaacctgatgaaaatcctgaaggatatcgaaaattctaccgagattatgctggacaggtggaaattcgaagtcattcccaatgataaggacgagaagggcgatcccgttccatactcaattataaacaattacttctctataggagtggacgcctcaatagcccaccgcttccacattatgagagagaagcaccccgagaagtttaatagccggatgaagaacaagttttggtattttgagtttgggacatcagaaaccttttcagccacatgtaagaaactccatgaatctgtggagatagaatgtgatggggtgcagattgacctaatcaacatatctctggagggtatagcgatcctgaatatcccctctatgcacggagggtccaacctctggggggagtcaaagaaacgccggtcccatcgaaggattgagaagaaaggcagcgataagaggaccacagtaacagacgctaaggaactgaagtttgcttctcaagacctttcagaccaactgctagaggtcgtgggcctggaaggggccatggagatgggccagatctatacaggtctgaaaagtgcaggtcggcgcctggcccagtgctcttgcgtggttatccgcacctcaaaatcgcttcctatgcagattgacggggagccatggatgcagaccccatgtaccatcaaaattactcacaagaaccaggcacccatgctaatgggaccccctcccaagactggccttttctgctctctcgtgaaacgaacacgcaataggagtaaagagtag

SEQ ID NO: 185291 - DNA, 2412 bp, Artificial Sequence
  Description of Artificial Sequence: Synthetic coding sequence
atgaccaaccaggagaagtgggcccacctgagccccagcgagttctcacagctccaaaaatatgccgaatactcaacgaagaaactaaaagacgtcctggaagagttccatggcaacggagtgcttgctaagtacaatcccgaagggaagcaggatatcttgaaccagaccatagacttcgagggtttcaaactgttcatgaaaacctttcttgaagctgaactaccagacgactttactgcacatctatttatgtctttcagcaacaagttcccacatagttctccaatggtcaaatcaaagccagccttgctgtccggtggcttgaggatgaacaaaggcgccattactccacctcgcactacaagccctgcgaatacatgcagtccggaggtgatccacctcaaggacatcgtgtgttatttatcgctcttagagcgggggcggccagaggataagctggagttcatgtttcggctgtatgacacggatggcaacggctttctagattcatcggaattggagaatattatctcccagatgatgcatgtggcagaatatctggagtgggacgttaccgaactgaaccccattcttcacgagatgatggaggagattgattacgaccatgacggaaccgtttccctggaggagtggattcagggtggaatgaccaccatccctcttctcgtgctactcggcttggagaacaatgtcaaagatgatgggcagcacgtgtggcgactcaaacactttaacaagcccgcatattgtaacctctgcctaaatatgctaattggcgtgggcaaacagggcctgtgctgttccttttgcaagtacactgtgcatgaaaggtgcgtggcacgggcccctccttcatgcatcaagacttacgtcaagtctaagcgcaacacggacgtcatgcaccactattgggtggagggtaattgccctaccaagtgcgataagtgccataaaactgtcaagtgctaccagggactgaccgggctccactgtgtgtggtgtcagatcactctccataacaaatgcgcatcgcaccttaaaccagagtgtgactgcggcccacttaaggaccacatactcccacctactaccatatgtcctgtggtactgactctccccacgagtggtgtatcagtgccagaggaacggcagtctactgtgaagaaagaaaaatccggctcccagcagcctaacaaggtgattgacaagaacaaaatgcaacgtgccaatagtgtcacagttgacgggcagggcctccaagttacacctgttccaggaactcaccctttgttggtttttgttaatccaaagtccggtggcaagcagggtgaaagaatatacagaaaattccagtatctgcttaatcctcgccaggtctactcactttccggcaacggaccgatgcccgggctaaacttctttagagatgtccctgactttagggtccttgcatgtgggggcgatggaaccgtgggatgggtgttggattgcatcgagaaggccaacgtgggcaaacacccacccgtcgctatcctcccgctcgggaccgggaatgacctggcaaggtgtctccggtggggaggaggctatgaaggtgagaacctgatgaagatcctcaaagatatcgaaaactcgactgaaatcatgctggatcgctggaagttcgaggtgatccccaatgataaggacgaaaaaggggatcccgtcccctactccatcatcaataattacttttcaatcggcgtggatgctagcattgcccaccggtttcacataatgcgagagaagcaccctgagaagttcaactccagaatgaaaaataaattttggtacttcgaatttggcacatctgaaacgttcagtgccacctgcaagaagctgcacgagtcagtggaaatcgagtgtgatggcgtgcagatcgatcttatcaatatcagtctcgagggaatcgcaattctgaacatcccgagcatgcacggtggaagcaatctgtggggggagtcgaaaaagcggcggagtcacagaagaattgagaaaaaaggtagtgataagcggaccactgtgactgacgctaaggagctcaaattcgcatcgcaggacctgtccgaccagctacttgaagttgtgggtttggagggagccatggagatgggccaaatctacaccgggcttaagtccgccggcaggagacttgctcagtgttcctgcgtcgtcatccgtacgagtaagtcactgcctatgcagatcgacggagagccatggatgcaaacgccatgcacgatcaaaattacacataagaatcaggcaccaatgctcatgggtcccccacctaagaccggccttttctgttccctagttaagcgcacacggaaccggtctaaggagtag

SEQ ID NO: 185292 - DNA, 2415 bp, Artificial Sequence
  Description of Artificial Sequence: Synthetic coding sequence
atgaccaaccaggagaagtgggcccacctgagccccagcgagttctcgcaactgcaaaagtatgcagaatattccaccaagaagctgaaggacgtgctcgaggagttccacggcaacggagtgctcgctaagtacaatcctgagggaaaacaggatatattaaaccagaccatcgactttgaaggattcaagctgtttatgaagacctttttagaggcagagcttccagatgacttcaccgctcatttattcatgtccttctcaaacaaattcccccacagttcccccatggtgaaaagtaaaccagccctgctgtccggcgggcttaggatgaacaagggcgctatcaccccacccaggaccacttctcccgctaatacctgctccccagaggtcattcatttaaaggacattgtgtgctaccttagcctcctggagcgaggcagacctgaggataagttggagtttatgttcaggctttacgatacagacggaaatgggttcctggactcttcggagttggagaatatcatttcccaaatgatgcacgtcgcggagtatctggaatgggatgtgacagaacttaacccaatcttacacgaaatgatggaagagatcgactacgaccatgatggtactgtgtccctggaagagtggattcagggcgggatgaccaccatacctctactggtcctgctgggcctagaaaacaacgtgaaggatgatggccagcatgtgtggcgcttgaagcactttaataagcccgcatattgcaacctttgtttgaatatgttgattggggtcgggaaacaaggtctgtgttgcagtttttgcaagtacactgttcacgaaagatgcgtagcacgggccccccccagttgtatcaagacatacgttaagagcaaaaggaacactgacgtgatgcaccattattgggtcgaggggaactgcccaaccaagtgtgataaatgccacaaaactgtgaaatgctaccaggggctcacgggcctccactgcgtgtggtgtcaaattacgcttcacaacaagtgtgcctctcaccttaaacccgaatgtgactgcggcccattaaaggaccatattctccctcccacgactatctgtccagtagtgttgcaaacattgcctactagtggcgtttctgtgcccgaagaacgccagagcaccgtgaagaaggagaagagcgggtctcagcaacccaacaaggttattgacaagaataaaatgcaacgggccaactccgtaactgttgacgggcagggactgcaggttactccagtgcccggcacccatccccttcttgtattcgtgaaccccaagtccggcggcaaacagggcgagagaatctacagaaagtttcagtatctgctgaacccgaggcaagtatattcactgagcggtaatggccccatgccagggctgaattttttccgtgacgtgccagatttccgcgtgctggcatgcggcggtgacggcaccgtggggtgggtgctggattgtatcgaaaaagccaacgttggaaagcacccacctgtggcaattctccctctaggcaccggaaatgacctggcacggtgcctgcgatggggcggcgggtacgagggggagaacctcatgaagattttgaaggatatcgaaaactctacggagatcatgctcgaccggtggaagtttgaagtgattccgaacgacaaggatgaaaagggggaccctgtcccctactccattataaacaactacttctcaatcggggttgacgcctccatcgcacaccgttttcatatcatgagggagaagcatccagagaagtttaatagcagaatgaagaataagttttggtactttgagtttggaacatctgaaaccttcagcgctacttgcaagaaattacacgagagtgttgaaatcgagtgcgacggagtccagatagacctgattaatattagcctcgagggaattgccattctaaatatcccatccatgcatggaggcagtaatctctggggagagagtaagaagcggaggtctcaccgacggattgagaaaaaaggctcggacaagcggactacagttacagacgcgaaggaactaaagttcgcctcccaagacttatctgaccagcttctcgaagtggtgggccttgagggcgcaatggaaatgggtcagatatacacaggcctgaagtctgctggacggaggttagcccagtgctcttgcgttgtcatccggacctcgaagtctctacccatgcagattgacggtgagccatggatgcagaccccttgcaccattaaaattacccacaagaatcaggcacccatgttgatggggccgccccccaagaccggactcttttgttccttggtgaaaaggacaagaaatcgaagtaaggaatag

SEQ ID NO: 185293 - DNA, 2322 bp, Artificial Sequence
  Description of Artificial Sequence: Synthetic coding sequence
atgaccaaccaggagaagtgggcccacctgagccccagcgagttctcacaacttcagaaatacgctgagtacagtactaagaaactgaaggacgtgcttgaagaatttcatggcaacggggttcttgctaagtataaccccgaggggaagcaggacattttgaatcaaactatcgactttgagggcttcaaacttttcatgaaaacattcctggaagccgaattgccagatgatttcacagcacacttatttatgtcattttcaaataagtttcctcattcctcgcccatggtcaaatccaagcccgcgctgttaagtggtgggctgaggatgaacaaaggcgccatcaccccacctagaacaacttcccccgcaaatacctgttccccagaggtcatacatctgaaagatattgtctgttacctgagcctgctggagcggggcagacctgaagacaaactggagtttatgtttagactgtatgataccgacggtaatggctttttagattcatctgagctggaaaacataattagccagatgatgcatgtcgcggaatacctggagtgggacgtgaccgagcttaatcccattttacacgaaatgatggaggagatcgactatgatcacgatggcaccgtcagtctggaagagtggatacaaggaggtatgactaccattccactgctcgtgctgcttgggttagagaataacgtcaaggatgatgggcagcacgtctggcgactgaaacacttcaataaaccagcatactgcaacctctgtctcaacatgctgattggggtcggcaagcagggattatgctgttcgttctgcaaatacacagtgcacgaacgctgcgtggcacgcgctccaccaagttgtataaaaacatacgtgaaaagtaaaaggaataccgacgtgatgcaccattactgggtcgaaggtaattgccccactaagtgtgataaatgtcataaaacggtgaagtgctaccaaggcctgaccggactgcactgcgtgtggtgccagatcactctacacaataagtgtgcatctcatcttaaacctgaatgtgattgcggcccattgaaagatcatatcttgccacctacgaccatttgcccggtggtgttgcagaccctgccaacaagtggagtctcagtgccagaggagagacagtcgaccgtcaaaaaggaaaaaagcgggagtcagcagccaaataaagtgatagacaagaacaagatgcaaagagcaaactcggtgacagtggacggacaagggctgcaggtgacaccagttcctgggacccacccgcttctggtctttgtcaatcctaagtctgggggcaaacagggggagaggatctacaggaaattccagtatctgctaaacccccgtcaggtttacagtctctcaggaaatggtccaatgcctggcctgaacttctttcgcgatgtgccagactttagagtgcttgcatgcggaggagacgggaccgtgggatgggtgctggactgtatcgaaaaagccaatgtgggcaagcacccacctgtggccatcttaccactgggaacggggaatgatctcgcacgatgcctaaggtggggtggggggtacgaaggtgaaaacctgatgaagattctgaaagacattgagaatagtaccgagatcatgctggatcgatggaagttcgaggtgattcctaacgacaaggatgagaaaggagaccctgtaccatactcaattatcaataactacttcagtataggcgttgacgctagcatcgctcaccgatttcacatcatgcgggaaaaacatccggagaaatttaattctcgcatgaagaacaaattctggtattttgaattcggcacttcagagacctttagcgctacttgcaagaaacttcacgagtctgttgagatcgagtgcgatggggtacagatcgatctcatcaatatcagcttagagggaatcgctatcctaaacatcccctccatgcacgggggctcaaatctctggggagagagcaagaagagacgtagccatcggagaatcgagaaaaaaggcagcgataaacgtaccacagtcacggatgctaaggagctcaagttcgcatcccaggatttatccgaccagttgctggaggtggtgggattggagggagccatggagatgggccagatatacactgggctcaagtccgctggccgcagactggcccagtgcagttgcgtggtcatcaggacttctaagtctctccccatgcagatcgacggcgagccatggatgcagactccttgtactgtgagtacagaatag

SEQ ID NO: 185294 - DNA, 2391 bp, Artificial Sequence
  Description of Artificial Sequence: Synthetic coding sequence
atgaccaaccaggagaagtgggcccacctgagccccagcgagttcagccaactgcaaaagtatgccgaatatagtaccaagaagctgaaagatgtcctcgaggagttccacggcaatggcgtccttgccaagtataatcccgaaggaacaattgattttgagggctttaagctgtttatgaaaacgttccttgaagcagagttgcctgacgacttcactgcccacttgtttatgtctttctctaacaagttccctcacagtagcccaatggtgaaatctaagccggcactgcttagtggtggccttaggatgaacaagggagctatcacacctccccgcacaacatctcccgccaacacctgcagccccgaggtgatccacctcaaggatatagtgtgctacctttctttgttggaaagaggcagacccgaagacaaactggagttcatgttcagactgtatgacactgacggaaacggcttcttggattcttcagagctggagaacatcatttcccagatgatgcacgtggctgagtacctggaatgggatgtgaccgagctgaatcctattctgcatgaaatgatggaggagattgattacgatcacgacggtacagtaagtctggaggagtggattcaaggtggaatgaccaccattcctctccttgtgttgcttggcctagagaataacgtgaaagacgacggacagcatgtctggcggcttaagcactttaataagcctgcgtactgtaacctctgcctgaacatgctgatcggcgtgggcaagcagggattatgttgcagcttctgtaagtataccgtgcacgagcgatgcgtggcccgggcaccgcctagctgcataaagacttatgtcaaatctaaacgcaataccgatgtgatgcaccattattgggttgaaggcaactgccccacgaagtgcgacaagtgtcacaagaccgtgaagtgttatcaggggttaaccggtttacattgtgtgtggtgccagattactctgcacaacaaatgcgccagccacctgaaacccgagtgcgactgcgggccccttaaggaccatatactcccacctacaacaatttgtcctgtagtgttaacattgcctactagcggtgtcagtgtccccgaggagcggcaaagtaccgtaaaaaaagagaagagtggatctcagcagccgaacaaggtcatcgacaagaacaagatgcagcgggccaatagcgtgaccgtggacggacagggactgcaggtgactccagtgcctgggacacacccactgctcgtgttcgtgaaccctaagtccggaggcaagcaaggcgagcgcatttaccggaagttccagtacctgctgaacccaaggcaggtgtattccttgagcgggaacgggcccatgcccggcctgaactttttccgggatgtgccagattttcgggtcctggcttgcgggggggacggaaccgtgggatgggtattggattgcattgagaaagcaaatgtggggaagcatccacccgtggctatcctccctcttggcacaggcaacgatttagccagatgtcttaggtggggtggcggttatgagggcgaaaatttaatgaagatactcaaagacattgaaaacagcacagaaatcatgctggacaggtggaagtttgaggtcattccaaacgacaaggatgagaaaggcgaccccgtcccgtattctattattaacaattacttctcaatcggtgtggatgcttctatcgcacatcggttccatatcatgagagagaagcaccctgaaaagttcaattccaggatgaagaataagttctggtattttgagttcggcacatcagaaacttttagcgccacgtgcaagaagttacatgaaagcgtcgagatcgagtgtgacggagtgcagatcgacctgatcaacatttctttagagggcattgccatactgaatatccccagtatgcacgggggaagtaacctgtggggagagtccaagaaacgtcggtcacatagacgcattgaaaaaaaaggtagcgacaagagaactaccgtgactgacgctaaggagcttaagttcgcatctcaagacctgtcagaccagctgctggaggtggtcgggttggagggggctatggaaatgggccagatatacacaggcctaaaaagtgccggccgaaggctcgcgcagtgctcttgcgtcgtcattcgaacctccaagagcctccctatgcagatcgacggtgagccatggatgcagacaccttgcacaattaagattactcacaagaaccaggctcccatgctgatgggaccgccacctaagaccggcctgttctgctccttggtaaagcgtactcgtaacagaagtaaagagtag

SEQ ID NO: 185295 - DNA, 228 bp, Artificial Sequence
  Description of Artificial Sequence: Synthetic coding sequence
atgaccaaccaggagaagtgggcccacctgagccccagcgagttctctcaattacagaagtacgctgagtattcaacaaagaagttaaaggacgtcctggaagaattccacggcaatggagtgctcgccaagtataaccccgagggtaaacaagatatcctgaatcagactatcgactttgagggcttcaaactgttcatgaagacctttcttgaggcagagctctag

SEQ ID NO: 185296 - DNA, 2358 bp, Artificial Sequence
  Description of Artificial Sequence: Synthetic coding sequence
atgaccaaccaggagaagtgggcccacctgagccccagcgagttcagccagctgcaaaagtacgctgagtatagtacaaagaaactcaaggatgtattagaggaattccacgggaatggtgtcctggcgaaatataatccggaggggacgattgatttcgagggcttcaagctgtttatgaaaacttttctggaagcagagctgcccgacgatttcaccgcccatttattcatgtccttcagcaacaagttcccccactcatctccaatggttaagtcaaaacccgccttgctgtccggagggctgagaatgaataagggagctatcacccctccacggaccacctcacccgccaacacatgctcccctgaggtcattcacctcaaagacatagtgtgttacctgtccttgctggaacgcggtcgccctgaggacaaattggagttcatgtttaggctctacgacaccgatggaaatggctttctggactcctccgaactggaaaatataatcagccagatgatgcacgtcgccgaatatttagagtgggacgtgactgagctcaatcccattcttcacgagatgatggaggaaatcgattatgaccatgatgggaccgtcagcttagaggaatggattcagggcggaatgacgactattccactcctggtgctcctcgggttggagaacaacgtaaaggatgacggacagcacgtctggaggctgaaacatttcaataagccagcatactgtaacctctgtcttaatatgttgatcggagtgggaaaacaagggttgtgttgcagcttttgtaagtacacagtgcatgagcggtgcgtggcaagagccccccccagttgtatcaaaacatacgtgaagtctaagcgtaacaccgacgttatgcatcactactgggtggaaggtaactgccccacaaaatgcgacaaatgtcacaagacagtgaagtgttatcagggactgaccggcctgcactgcgtgtggtgccagatcacattgcataacaagtgtgcttcccatctaaaaccagagtgtgactgtggcccacttaaggatcacattttgccaccaacgactatctgccccgtggttttagagagacagtccacagtgaagaaggaaaagtcgggcagccagcagccaaacaaagtaattgataaaaacaaaatgcaaagggccaactccgttaccgttgacggccagggtctgcaggtaactccagtcccagggacacatcctctgcttgtgttcgttaatcccaaatcgggtggaaaacagggggagcgtatataccgcaaatttcagtatctgctgaatccacggcaggtgtactcactctccggcaacggtccaatgccaggtcttaactttttcagggatgtgccagacttcagagtgctggcatgcggaggcgatgggacggtaggctgggtcctagactgcatcgagaaagccaatgtcggcaagcacccaccagtggcgatcctccctttgggtacagggaacgacttagctaggtgtctcagatggggcggaggatacgaaggggaaaacttgatgaaaatcctcaaggacatcgagaattcaactgaaatcatgcttgacaggtggaagttcgaggtgattccaaacgataaggatgaaaagggcgaccctgtgccatacagcatcatcaacaattatttcagcattggggttgacgccagcatagcccacagatttcatattatgagagagaagcaccctgagaagtttaacagccgcatgaagaacaagttttggtactttgagtttggtacaagcgaaaccttctcggccacttgcaagaaactgcacgagtcagtggaaatagagtgtgacggcgtccagatcgacttgattaatatcagcttggagggcatcgctatcctcaatatcccctctatgcatgggggcagtaacctttggggagaaagcaaaaagagaaggagccataggcgcattgaaaagaagggttctgacaagcgcaccaccgttaccgatgccaaggaactcaagttcgccagtcaagatcttagtgaccagctcttagaggtcgtcggcctggagggtgcaatggagatgggtcaaatctatactggcctgaaatccgcaggtcgacggctggcccagtgtagctgtgtggtaatccgtacctcaaaaagcctgcctatgcagattgacggagagccctggatgcagaccccctgcaccattaaaatcacacataagaatcaggcacctatgctaatgggaccgcccccaaagacgggtctattctgtagcttggtgaagcgaaccagaaaccgctccaaagaatag

SEQ ID NO: 185297 - DNA, 3645 bp, Artificial Sequence
  Description of Artificial Sequence: Synthetic coding sequence
atggccgccgccgccggcgcccccccccccggccccccccagcccccaccacctcctcctcccgaggaaagttccgactcagaaccggaggccgaaccaggtagccctcagaagcttattcggaaggtgtctacttcagggcagattcgccaaaagactattatcaaagaagggatgctgactaagcaaaataatagcttccagagatcaaagaggcggtattttaaactcagggggcgcactctgtactacgcaaaaaccgcgaaatccatcatcttcgacgaggtggatctcaccgacgcgtccgttgctgagagttcaactaaaaacgtgaacaactctttcacagtgatcacaccctgtagaaagttgattctctgtgcagacaatagaaaggagatggaagactggatcgcggccctaaaaactgttcagaacagggaacatttcgagcctacacagtactctatggaccatttttctggaatgcataactggtatgcatgttctcatgcaaggcccacctactgcaacgtgtgcagagaagctctgagtggagtgacaagccatggacttagttgtgaggtgtgtaagtttaaagctcacaagcgttgcgcggtgcgcgcaaccaacaattgcaagtggacaaccctggcctcaatcggcaaggatattattgaggatgccgacgggattgccatgcctcatcagtggctggagggtaatttgcctgtgagtgccaaatgtacagtctgcgacaagacatgcggttccgtactccggttgcaggactggaggtgcctgtggtgcaaggccatggtgcacacatcctgcaaagaatcactgctgaccaagtgcccccttggtttgtgtaaggtttccgtgatcccacctaccgcactcaattccattgacagcgatgggttctggaaggcgtcatgtcctccttcttgcacgtcaccactcctggtgtttgtgaatagcaagtcgggggataaccagggcgtcaagtttctgagaaggttcaagcagctgctgaatcccgcacaagtttttgacttgatgaacggggggccccatcttgggctcagactattccagaaattcgatacatttcggattttagtatgcggaggtgatggttctgtaggctgggtactatccgagatagattctctgaacctgcataagcagtgccaacttggagtcctccccctgggcactggcaacgatctcgccagagtcctggggtggggatcagcctgcgacgatgacacgcagttgccccagatactcgaaaaattggaacgggcatctactaaaatgctggatcggtggtccgtaatggcatatgaagcaaaactgccccggcaagcttcctcaagtacagtcacagaagacttttcagaagatagtgaggttcagcagatcctgttctacgaggatagcgtagccgctcatctgtccaaaatcctaacaagcgaccaacactccgtggtgatcagcagcgctaaggtgctgtgtgaaacagttaaagatttcgtggcccgggtgggtaaagcatatgagaaaactaccgaatccagtgaggaatccgaagttatggccaagaagtgtagtgtgctgaaggagaaattagacagcctactaaagaccctcgacgacgaatctcaagcaagttcttctctgccaaacccccctcccacaatcgctgaggaggccgaagatggggatggttctgggagcatttgtggatccacaggtgatagactcgtggcgtcagcctgccccgctagaccacagatcttccggccccgcgaacagctgatgctgcgagccaactctctcaagaaggccattaggcaaattatcgagcatacagagaaagctgttgatgagcagaacgcacagactcaggagcaagagggattcgtgctcgggctcagcgaatcagaggaaaaaatggatcacagagtatgtccccctttgagccattcagagtcgttcggcgttccaaaaggccggtcccagcgcaaagtctctaagagcccatgcgaaaagttgatcagtaaaggaagcctgtccctgggaagttctgcctccttgcctccgcagccaggaagcagagacggtctccccgcactgaacaccaagattctctatccaaatgtcagggcagggatgtccggcagtttgcccggaggatctgtcatctctcgactgctgataaacgctgatccatttaattcagagcccgagactctggaatattacaccgagaagtgtgtgatgaataattatttcggcattgggctcgatgccaagatttcccttgattttaacaacaaacgcgatgagcaccctgaaaagtgtcgaagtagaactaagaatatgatgtggtacggagttctcggtacaaaggaattactgcatagaacatacaaaaatctggagcagaaagtgctgctcgagtgcgacgggcggcccatccctctgccttctctacaaggcattgctgtactcaatattccttcctacgctggaggcacaaatttctggggcggcactaaggaggatgatacgttcgctgccccttctttcgatgacaagattttggaggtggttgccgttttcggctcaatgcagatggcagtctcaagagtgatccggctgcagcatcataggatcgcccaatgtcgcactgttaaaatctctattctgggtgacgaaggagtccccgttcaggtcgatggggaggcttgggtgcagcccccgggatacattcggatcgtacacaagaatagggcacagactctgacccgcgacagagcctttgagtctactctgaagagctgggaagataaacagaaatgcgagctgccacgcccaccttcctgctcacttcatccggagatgctgagcgaagaagaagctacccagatggaccagttcgggcaggctgctggcgtactcattcactccatccgtgagattgctcagagtcacagagatatggagcaagaactggcacacgctgtgaatgcatcctccaagtctatggaccgtgtgtacggcaaacctcggaccactgagggactgaattgctctttcgttctggaaatggtgaataactttcgagcactcagaagcgagactgagctgctgttaagtggcaaaatggcccttcagttagacccacctcagaaagagcagttaggctctgctctcgcggagatggatcgccagctgcggagactcgccgacaccccttggctttgccagtccgccgagccaggggatgaggagtccgttatgttggatcttgctaagcgaagtcggtcaggcaagttcaggttagtcacaaagttcaagaaggagaagaataataaaaataaagaggcgcacagcagtctcggcgcacctgtgcatctgtggggaactgaggaagtggccgcatggctcgagcacctgtctctatgcgaatacaaggatattttcacacggcatgatatccgcggaagtgaattgctgcacctggagcgtcgggatcttaaggatctgggagttaccaaggtcggccatatgaagagaatcctctgtgggataaaagaactgtcacgaagtgctcccgccgtcgaagcttag

SEQ ID NO: 185298 - DNA, 3513 bp, Artificial Sequence
  Description of Artificial Sequence: Synthetic coding sequence
atgaacatgttcctgtacttccagaccatcatcaaggagggcatgctgaccaagcagaataatagctttcagcggtccaaacggcgctacttcaagctccgaggtcgtaccctttactacgctaagaccgcaaaatcaatcatttttgacgaggtggatcttaccgatgcgtccgtggctgaatcttctaccaaaaacgtaaacaactccttcaccgttatcacaccctgcaggaagctcatactatgcgctgataatagaaaggaaatggaggactggattgcagctctgaagacagtgcaaaacagggaacacttcgaaccaacacagtattctatggatcacttcagcggcatgcacaactggtacgcatgttcccatgcgcggcccacttactgtaacgtgtgccgggaagctctgtcaggcgtgactagtcatggtttatcatgcgaagtttgtaagttcaaggcccataaaaggtgtgcagtgagggccaccaacaattgcaagtggacaaccctggcgtctattggtaaagacatcatagaggacgcagatggcatcgctatgcctcaccaatggctggagggaaatctccccgtatcagccaagtgtactgtctgcgacaagacttgtggttccgttttacggctccaggactggcggtgtctgtggtgcaaggccatggttcatactagttgtaaggagagcctgctgactaagtgccctctcggtctgtgtaaggtgagtgtaatccctccgacagcactgaattcgatcgacagcgatggtttttggaaggcatcttgcccaccgtcttgtacctccccacttctggtgtttgtaaattctaaatccggcgacaatcagggtgtgaagtttcttcgccgattcaaacagcttctgaaccccgcacaagtatttgacctgatgaatggaggcccgcacttggggttgcggctgtttcaaaaattcgacaccttccggattcttgtgtgtggaggagatggctcagttgggtgggtcctctctgagatagattcactaaatctgcataagcagtgccaactgggcgtgctacccctggggactggcaacgacttagcgagagttctgggctggggtagtgcttgcgatgatgacacccagctgccccagattctcgagaagctggaacgggcctctactaagatgctcgaccggtggtctgtcatggcgtatgaagcaaaactacctcggcaggcatcttcgtccactgtgactgaagatttctcagaagacagcgaggtacagcagatcttattctacgaagacagcgtggccgcgcatctttcaaaaattttgacctcagaccagcattccgtagtcatctccagcgctaaagtcctctgtgagaccgttaaggactttgtggccagggtgggtaaggcctacgagaaaacaacagagtctagtgaagagtcagaggtcatggcgaagaagtgctcggtcctcaaagagaagctggactctctcctgaaaacattagacgacgagtctcaggcctccagcagtttacccaacccaccccccacaatagctgaggaggccgaggatggcgacggcagtggcagcatctgcggttctaccggggacaggttggttgcatcggcgtgtccggcgcgaccgcagattttccggcccagagagcagctcatgctccgggccaactccctgaagaaagcaatccggcaaatcattgaacacacggagaaggctgtcgacgaacaaaacgcccagactcaggagcaagaagggttcgttctggggttgtccgagtcagaagaaaagatggaccaccgggtgtgcccccctttgtcccatagcgagtctttcggagttcctaaggggcgatctcagcgcaaggtgtccaagtctccttgcgaaaaactgatctctaaaggatcactgagcctgggatcttcagcctcactacctccacagccaggctcccgggacgggctccccgctctgaatacaaagatcctctatcccaacgtgcgcgctggaatgtccggcagtttacctggcgggtctgtgatctccagactcctcatcaacgcagatccttttaactctgaacccgagacactggagtactataccgaaaagtgcgttatgaacaactactttggaattgggttggacgccaaaattagccttgattttaataataagagggacgagcacccggagaaatgcagatccaggactaaaaacatgatgtggtatggagtgctcggaacaaaagagttactacatcgcacgtataaaaacttagagcagaaagtgttgctcgagtgcgatggccgccccatccccttgccctcccttcaaggcatcgcggttctcaacataccctcatatgctggcggcacaaatttttggggaggcacaaaagaagatgatacttttgcagcccccagttttgacgataaaatcttggaggtagtcgctgtgtttggtagcatgcaaatggcggtgtctcgggtgatccggttgcagcaccatagaattgcccagtgtagaacagtgaaaattagcattctgggtgatgagggggtcccagtgcaggtggacggggaggcatgggtgcagcctcccggatatataaggatcgtgcataagaatcgggcccaaaccttaactagagacagggcgttcgaaagcacactgaagtcttgggaagacaagcaaaaatgcgaactgcccagacccccttcttgcagcttgcatcccgagatgctgagtgaagaagaagcaacccaaatggaccagttcggacaggccgccggggttctgattcattccatcagggaaattgcacagtcccatcgagatatggagcaggagctagcccatgctgtcaacgcttcatccaaatccatggacagggtctacggcaagccgcgcacaacagagggcctcaactgtagctttgtgttagagatggtgaataactttagggcccttagaagtgaaacggaactcttactgtctggaaaaatggccctgcagcttgacccaccacagaaggagcagctagggtccgcccttgcagaaatggaccggcagttgcgtcggctggccgacaccccttggctgtgccaatccgccgagcctggggatgaggagagcgtgatgttggatctggctaagaggtctaggagcgggaaattcagactggtcaccaaatttaagaaagaaaaaaataataagaacaaggaggcacactctagcctgggggcccccgtgcacctctggggaaccgaggaggtcgccgcctggctggagcatctctccctctgtgaatataaggacatattcacacgccacgatattcggggctcggagctgctgcacttagaaaggcgcgacttaaaggatctgggtgttacaaaggtcggacacatgaagagaattctctgcgggatcaaggaacttagtaggagtgctcctgccgtggaagcatag

SEQ ID NO: 185299 - DNA, 1704 bp, Artificial Sequence
  Description of Artificial Sequence: Synthetic coding sequence
atggaggccgagcggcggcccgcccccggcagccccagcgagggcctttttgcagatggtcatctgatcctttggacactctgtagcgtcctattgcctgtgtttattacattctggtgttctcttcaaaggagtaggaggcagctgcataggcgcgacatcttccgaaagtccaagcatggctggagagacaccgacttgtttagccaacccacctactgctgcgtttgcgcacagcacatcctgcagggggccttctgcgattgctgcggtttgagagttgatgaggggtgtctcaggaaggctgataagaggttccagtgcaaagaaattatgctgaagaacgataccaaagtgctggacgccatgccccaccactggattcgcggaaacgtacctctgtgttcttattgcatggtgtgtaaacagcagtgcggatgccaacccaagctttgtgactatcgatgcatctggtgtcagaaaaccgtccacgacgagtgcatgaaaaatagtctcaagaacgagaaatgtgactttggtgagtttaaaaacctaattattccccctagttatttgacttcgattaaccagatgcgaaaggataagaagaccgactatgaggttcttgcctcgaagctggggaaacaatggaccccactaattatccttgctaatagtcggagcggaaccaacatgggagagggtttgctgggagagttcaggattctcctgaacccagtgcaggttttcgatgtaacaaaaacacctccaattaaggccctccaactttgcacactgcttccatactatagtgctagagtcctggtttgtgggggggacggcaccgtggggtgggtcctcgacgcggtagacgatatgaagatcaaggggcaggaaaaatacattccccaggttgctgtactgccactgggcaccggcaatgacctcagcaacaccctgggctgggggactgggtacgccggcgagattccagtcgcccaggtgttacgaaacgtgatggaggccgatggcatcaagctagaccgttggaaagtgcaggtaaccaacaaaggatattataacctgcgcaagcctaaggagtttacaatgaataattacttcagcgtgggcccagatgccctgatggcactgaacttccacgcccacagagaaaaagctcctagcctgttttccagtcgaatccttaataaagctgtttatctgttctatgggacgaaggactgtctcgtgcaggagtgcaaagatttaaacaaaaaggtggaactggaactggatggagaaagagtcgctcttccttccctcgaggggataattgtgctgaatataggatactggggaggtggctgccggctatgggaggggatgggtgatgaaacctatccgttagccagacacgacgacggcctgctggaagtagtaggagtgtacggaagttttcattgcgcccagatccaagtgaagctggcaaacccgttccggattggacaagctcatacagtgagactcattctgaaatgttccatgatgcctatgcaggtggacggggagccatgggcacagggtccttgcacagttaccataacccacaagacccacgctatgatgctctattttagcggcgaacagaccgacgacgatatttcttccacgagcgatcaggaagatatcaaagcaactgagtag

SEQ ID NO: 185300 - DNA, 2376 bp, Artificial Sequence
  Description of Artificial Sequence: Synthetic coding sequence
atgggcgaggagcggtgggtgagcctgacccccgaggagttcgaccagctgcagaagtatagcgagtattcatcgaagaaaataaaagacgcgttgaccgaattcaatgaaggtggcagcttgaagcaatacgaccctcacgagccaatctcttacgatgtgtttaagctgttcatgagggcctaccttgaggttgacctgccccagcctctgtctacacacctgtttcttgcgttctcacagaagccgagacatgagacgtctgaccaccctacagaaggagcatcgaactctgaggcgaattcggctgacaccaatattcagaatgcagataacgcgacgaaggcagacgaagcatgcgccccggataccgagtccaacatggctgagaaacaagcccccgcagaagatcaggtagccgccacccccttggaaccccccgtgccacgcagtagctccagcgagagccccgtggtgtacctgaaagatgtagtgtgctacctgtctctgctggagactgggcggccacaggacaaattggaatttatgttcagactatatgattcggacgaaaacggcctgctggatcaagcagagatggactgcatcgtgaaccaaatgctacatattgcgcaatacctagagtgggaccctaccgagcttcggcctatcctgaaggagatgctccaggggatggattacgaccgagatgggttcgtgtccctacaagaatgggtccacggaggaatgaccactattccccttctcgtcttgctcgggatggatgatagtgggtccaagggcgatggacgccacgcctggactatgaaacacttcaagaaacctacttattgcaatttctgccatatcatgcttatgggagtgcgaaaacagggcttgtgctgtacatattgcaaatatacagtccacgagcgctgcgtgtcccgcaatattcccgggtgcgtaaagacttactcaaaagcaaagcgtagtggggaggtgatgcagcatgcttgggttgaaggtaactctagcgtaaaatgcgaccgctgtcacaaatccatcaagtgctaccagtccgtgaccgcccgtcactgtgtgtggtgtaggatgacgttccacagaaaatgcgagctgagcacactgtgcgacggtggcgaattaagggaccatattttgctgcccactagtatttgtccaatcactagagaccggccaggtgaaaagtccgatggctgcgttagcgcaaaaggggagcttgtcatgcagtataagatcatccccactcccggcacgcacccactgctcgttttggtgaaccctaagtctggcggtcgccaaggtgaacggatactgcgcaaatttcactacttgctaaatcctaaacaggtgttcaatctcgataatggggggcctacccccgggctcaacttctttagggacacaccggattttagagtgctggcttgtggaggggatgggacagtcgggtggatcctggattgtatcgacaaagcaaacttcgccaagcacccccctgtcgctgtgctgcctctgggcaccggcaacgacctggctcgctgccttagatggggcggtggatacgagggcgggtcactgactaagattttgaaagatattgaacagagcccgcttgttatgttggaccgttggcacttggaggtgataccccgcgaggaggtggagaatggggatcaggttccatactccatcatgaacaattatttttcaatcggagttgatgcatctatagcacacagattccatgtcatgcgagaaaagcatcctgagaaattcaactcgagaatgaagaataagctctggtacttcgagttcggaacctcagaaaccttcgctgccacctgcaaaaagcttcacgatcatatagaactcgaatgtgacggtgttggggtggacctgtccaacatttttctggagggtattgccatcctcaacattcccagcatgtatgggggaaccaatctgtggggagaaaacaagaagaatcgagcggtgataagggagtcacgcaagggagtgaccgaccctaaagaactgaagttttgcgtgcaggacctgagcgaccagttattggaagtggtaggattggaaggagccatggagatggggcagatctatactggcttgaaatctgccgggaggagactggctcagtgtgccagtgtgactataagaacaaataagctgcttccaatgcaggtggatggtgagccatggatgcagccttgttgcactatcaaaataacacataagaaccaggctcctatgatgatggggccccctcaaaaatcttcattcttttctctgagaagaaagtctcgcagtaaagattag

SEQ ID NO: 185301 - DNA, 2301 bp, Artificial Sequence
  Description of Artificial Sequence: Synthetic coding sequence
atgggcgaggagcggtgggtgagcctgacccccgaggagttcgaccagctgcagaagtacagcgaatatagctcgaagaaaatcaaagatgcactgacagaattcaacgaaggagggagcctgaaacagtatgatccacatgaacccatcagttatgacgtgttcaagcttttcatgcgggcatatcttgaagttgatttgcctcaaccgctgtctactcatctgttcctggctttctcccagaagccccggcatgagacaagtgatcacccgaccgagggggcttctaattctgaagccaattccgccgataccaatatccagaatgctgacaacgcaacaaaagccgatgaggcttgcgcacccgatactgagtccaacatggcagagaagcaagctccagcggaggaccaggtagctgccacccctctcgaacctccagtgcctagatcaagcagcagcgaaagcccagtggtctatctgaaagacgtggtgtgctatctatccctccttgagacaggaaggccacaagacaagcttgagtttatgtttcggctctatgactcggacgaaaacggactgctagaccaggccgagatggattgtattgtgaatcaaatgcttcatatagcccagtacctggagtgggatccaaccgaactccgcccgatccttaaggagatgctgcaggggatggactatgatcgggacggattcgtctccctgcaggagtgggtccacgggggcatgacgactatcccactgctggttctactgggcatggatgatagtggctctaagggcgacggtcggcatgcctggaccatgaaacacttcaaaaaaccaacctactgtaacttttgtcacatcatgctgatgggagtaagaaagcagggcctgtgttgcacctattgcaagtacactgtgcacgagagatgcgtctcaagaaacattccagggtgcgttaaaacatactctaaagccaagagaagtggggaggtgatgcagcacgcctgggtggaggggaactccagcgtaaaatgtgatagatgccataagagtattaagtgttatcagtcagtgacagctagacattgtgtctggtgcaggatgacctttcatcgaaaatgtgaacttagtacgctctgcgatggaggggaacttcgcgaccacattctgttgccaacctccatatgtccaatcactcgcgatagaccgggggagaaatctgacggttgtgtaagtgccaaaggagaactggtcatgcagtataagatcatccccacaccaggcacgcatcctctactcgtgctggtcaatcctaagagcggagggcgtcagggcgaacggctcaacttcttccgggatacccccgacttccgcgtgctggcgtgtggaggagatggaacagttgggtggattctggattgcattgacaaggcaaacttcgcaaagcatcctcccgtagcagttttgccactcggaactgggaatgatcttgcccgatgtctgagatggggcggcggctatgagggaggttctctaacaaagattctcaaagatatcgagcaatcacccctcgtaatgttggatcgctggcatcttgaggtcattcctcgagaagaagtggaaaacggagatcaggtcccctacagcatcatgaataattatttttccattggtgtagatgcatcaattgcacaccgctttcacgtaatgcgggagaagcatccagaaaagtttaactccagaatgaagaataagctgtggtatttcgagttcggaaccagcgaaactttcgctgcgacatgcaagaaactgcacgaccacatcgagctggaatgcgacggcgtgggagtggacctcagtaatatttttcttgagggtatcgcaattctgaatatcccctcgatgtacggcgggaccaacctttggggcgagaataaaaagaatagggcagtgatccgggagtcccgcaagggagtgaccgatccgaaagaactgaagttctgcgtgcaagacctgagtgaccaattgttggaagtcgtgggcctggaaggagctatggaaatgggacaaatctacactggactgaagtcggccggacgaaggctcgcccaatgtgctagcgtaactatccgcaccaataagctcttacccatgcaggtggacggcgagccatggatgcaaccttgctgtacgatcaagatcacacataagaatcaggctccaatgatgatgggccctccccagaagtcgtcctttttttcgctgcgccggaaatcccggagcaaagattag

SEQ ID NO: 185302 - DNA, 2259 bp, Artificial Sequence
  Description of Artificial Sequence: Synthetic coding sequence
atgggcgaggagcggtgggtgagcctgacccccgaggagttcgaccaactgcagaaatacagcgagtattcctctaagaagattaaagatgccctcaccgagttcaatgagggaggaagcctgaagcagtacgacccccatgaacctatcagttacgatgtcttcaagctgtttatgcgggcttacctggaggtggacctaccccaacccctatccactcacttgtttctcgccttctcccagaagcctcgtcacgagacttcagaccaccccacagagggcgcatcaaattcggaggccaactccgcggatacaaacattcagaacgcagacaatgccactaaggccgacgaggcttgcgctccggacaccgagagcaatatggccgaaaagcaagcacctgctgaggaccaggtggccgcaacacctctggagcctcctgttcctcggtcttcaagcagcgagagtccagtggtgtatcttaaagacgtcgtctgctacctgagcctcctggagaccggcaggccacaggacaagttagaattcatgtttagactttatgacagcgacgaaaatgggctgctggaccaagccgagatggattgcatcgtgaaccaaatgctccacatagctcagtatcttgagtgggaccccactgagttaaggcctatattgaaagagatgttgcagggaatggattacgatcgtgatggttttgtgtctctacaagaatgggtccacggaggcatgacaactattcccctgctcgttctgttaggtatggacgattcaggcagtaaaggggacggccggcacgcatggacaatgaaacacttcaaaaagcccacttactgtaacttctgccatatcatgctgatgggtgtccggaagcagggactttgctgtacatactgtaaatacacggtgcacgagaggtgcgtaagcagaaatattccaggatgcgtcaaaacgtactcaaaagctaagcgtagcggtgaatttcatcggaagtgcgaactgtcgacattatgcgatggcggtgaactcagagatcacattcttttgcccactagcatatgccctatcacgcgggaccgtccaggcgagaagtctgatggctgtgtgagcgccaagggtgagctggtgatgcagtacaaaattattccaacgcctgggacccacccactgctggtacttgtgaacccgaaaagcggcggcaggcagggcgaacgcatcctgcgcaaatttcactacctgcttaaccctaagcaagtttttaacctcgataatgggggacctaccccgggtcttaacttttttagagacactccagattttcgagtgctggcatgtggtggggatggcaccgtgggctggattctggactgcattgataaggccaactttgcaaagcaccccccagtggccgtgctccccctgggcacaggcaacgatttggcccggtgcctaagatggggcggcggctacgagggcggctccctgacaaagattctgaaggatattgagcaatctccgttagtaatgttagacagatggcacctggaggtgattccacgcgaagaggtggagaatggcgatcaggtcccgtatagtattatgaacaactacttttccatcggcgtggacgcttctatcgctcatcgctttcatgtcatgcgcgagaaacacccggaaaagtttaattccagaatgaagaataagctctggtacttcgagtttggcacaagcgaaacattcgccgcaacatgtaagaagctgcatgatcacattgaactggagtgcgacggggttggcgtcgatctgtctaacatttttctagagggcatcgccatcctgaatattccaagcatgtatggaggcacgaacctctggggggagaacaagaagaaccgcgccgtcatccgcgagtcgaggaagggcgtgactgacccaaaggagctgaaattctgcgtacaggacctatctgaccaactcctggaagtggtgggcctagagggagctatggagatgggccaaatatatactggattgaagtcagcgggacgacgcctggcccaatgtgcctccgtaaccattcgcacaaataaactgctgccaatgcaggtggacggtgaaccctggatgcagccttgctgtaccattaagattacccacaagaatcaggcccctatgatgatgggtcccccacagaaatcatcctttttctccctgcgcagaaaatcccgaagcaaggactag

SEQ ID NO: 185303 - DNA, 1818 bp, Artificial Sequence
  Description of Artificial Sequence: Synthetic coding sequence
agcctgaagatgggcgaggagcggtgggtgagcctgacccccgaggagtttgaccagttgcagaagtactccgaatacagtagtaagaagataaaagacgccctgactgagttcaacgaggggggaagtctaaagcagtacgatccacacgagcctatctcctacgacgtctttaaactgttcatgagggcatacctggaggtagacctaccacagcccttgtccacgcatctcttcttggctttctcgcagaaacctaggcatgaaaccagcgaccaccccaccgagggagctagcaacagtgaggctaatagtgctgataccaacattcagaatgctgataacgccacaaaagccgacgaggcctgcgctcccgatactgagtccaatatggcagagaaacaggcccctgccgaagaccaggtcgccgcaacacctttggaaccccccgtgcctcggtcaagttcatctgagtcccccgttgtatatcttaaggacgtggtgtgctatctgtcactgctggagaccgggagacctcaggataagttggagtttatgttccggctgtacgattcagacgaaaatggcctgctggaccaagctgagatggactgcatcgtcaaccagatgctccatatcgcccagtaccttgagtgggaccccaccgaacttaggccgatcttaaaggagatgctgcagggcatggactacgatagagatgggtttgtaagcctgcaagagtgggtccacggcggaatgacaacaatcccgctgctcgtcctcttgggaatggacgatagtggttcaaaaggagatggccgccacgcatggacgatgaaacattttaaaaagccgacttactgcaacttttgtcacataatgttgatgggcgttcggaagcagggtctgtgctgtacctattgtaaatacactgtgcacgagaggtgcgttagcaggaacatccccggttgtgtaaagacatattctaaagctaagcggagcggggaatttcacagaaaatgtgagctatccacactctgcgatggcggggagctgcgcgatcatatcctgttgccaactagcatctgccccatcactcgggacagacctggagagaaaagtgacggctgcgtgtctgccaaaggggagctcgtgatgcagtacaaaatcatccctactccagggacacaccctctcctcgttctggtgaatccaaagagtggcgggaggcagggagagagaatcctgcgaaaatttcactatctgctgaacccaaaacaggtctttaatctcgacaacggggggcctaccccagggctgaacttcttccgggatacccctgattttagggtcctggcttgtggcggggatggaaccgtgggctggattttagactgcatagacaaagcgaacttcgccaagcacccaccagtggccgttctacctctggggactggcaacgatctggcgcgctgtctccgctggggcggcggttatgaaggtgggtctcttacaaaaattcttaaggacatcgaacagtctcctctggtgatgctggaccggtggcacctggaagttataccccgagaagaagtggagaacggagatcaagtgccttacagtattatgaacaactactttagcattggggtggacgcgtcaatcgcccaccggtttcatgtcatgagggagaaacacccagagaagttcaattcacgcatgaaaaataagttgtggtatttcgagttcggtacgtcggaaacctttgcggctacctgcaagaagctccatgatcatatcgagctggagtggtgttag

SEQ ID NO: 185304 - DNA, 2199 bp, Artificial Sequence
  Description of Artificial Sequence: Synthetic coding sequence
atgggcgaggagcggtgggtgagcctgacccccgaggagttcgaccagttgcagaaatacagcgaatactctagcaagaaaattaaagacgccttaaccgagttcaacgagggtggctcactgaagcagtatgacccacatgaaccaatatcctacgacgtgttcaaactgttcatgcgcgcttacctggaggtggatctgccccagcccttatctacccacttatttcttgcgttttctcaaaagcctaggcacgagacctccgatcatccgaccgagggagcgagtaactcagaggctaacagcgctgacaccaacatacagaatgcagacaatgccactaaggctgacgaggcgtgcgcgccagacacagagagcaacatggctgaaaagcaggctcccgccgaagaccaagtagccgccacgcctctggagccccccgtccctcgaagcagctcgtctgaatcccctgtcgtctatctgaaagacgtggtgtgttacctttcactgttagaaaccgggcgcccacaggataaacttgagttcatgtttcggctgtatgatagtgatgaaaatggcctgcttgaccaggccgagatggattgcattgtgaatcagatgcttcacattgctcaatatctggaatgggatcccactgagctgcgtcctatcctcaaggagatgcttcagggaatggattacgaccgggacggtttcgtttcactgcaggaatgggtgcacggtggtatgacaactatcccccttctggtgctgctgggtatggatgattctggatctaaaggggatgggcgacatgcttggaccatgaagcacttcaagaaacccacatactgcaacttttgtcacatcatgttgatgggagtccgaaagcaaggcctctgctgcacatattgcaaatacaccgtgcacgagagatgcgtgtcccgaaacatcccaggctgcgtgaagacttactctaaagccaaacggagtggcgagttccacagaaagtgcgaactgagcactttgtgtgatgggggcgaactgcgcgaccacatcttgcttccaaccagtatttgccccatcacccgctacaagattatcccgacgcctggcacccacccactgcttgtgctagtgaaccctaaatcaggcggccgccagggtgaacgaatccttcggaaattccattaccttctaaatcctaagcaggtttttaatttggataacggcggccctacccccggactgaatttcttcagggatacacctgatttccgggtcctggcctgcgggggagacgggaccgttggatggatcctcgactgcatcgacaaggcgaattttgccaagcatcctcccgtggccgtgctgcccctcggcacggggaacgacctcgccagatgcttgcggtggggcggcggctatgaaggcggttccctgacgaaaatattgaaagacatcgagcagagccctctggtgatgttagacaggtggcacttggaggttatacctagagaagaggtagaaaacggcgatcaggtgccatacagcataatgaacaattacttttccataggcgtggacgcatcaattgcacatcgattccatgtcatgcgggagaaacacccagagaaattcaactcaagaatgaaaaataaactttggtactttgaattcggtacttctgaaacgtttgccgcaacatgtaagaaattgcacgatcatattgaactggagtgcgacggagtcggcgtggacctttctaacatcttcctggaagggatcgcaatccttaacatcccatcaatgtacggagggaccaatctctggggagagaataagaaaaatagagccgtcatccgtgagtctcgcaagggagtgacggatcctaaagaactgaaattttgcgtgcaggacttatccgaccagctcctcgaggtcgtggggctggagggtgccatggagatgggccagatatacactggtcttaaatcagcgggccgccgcctggcccagtgtgccagcgttaccatcagaacaaacaagctgctgccaatgcaggtggacggagaaccatggatgcagccctgctgcaccattaagatcacccacaagaaccaggcacccatgatgatgggccccccccaaaagagcagcttcttctccctcagaagaaagtcgcggtcaaaggattag

SEQ ID NO: 185305 - DNA, 3198 bp, Artificial Sequence
  Description of Artificial Sequence: Synthetic coding sequence
atggacgccgccggccggggctgccacctgctgcccctgcccgccgcaaggggccctgcccgtgctcctgcagccgccgcagccgccgctgcatccccgccgggtccttgttcaggcgctgcgtgtgctccctccgccgctgccggcgcgggggccatgaatccctctagtagcgctggggaagagaagggcgccaccggcgggagcagcagctcagggagcggcgcaggtagttgctgcttaggcgcagagggcggggcggaccctcggggtgcaggcagtgctgccgcagcaggtgcggccgctctcgatgaaccagccgccgcaggtcagaaagaaaaggatgaagcccttgaggagaagttaagaaatctgacatttcggaagcaggttagctacaggaaagccatttcccgagctggcctgcaacatttggcccctgcccaccctctaagtctccctgtcgccaacggacctgcaaaggaacccagggccaccctggactggtcggagaatgccgtaaatggagagcacctgtggttggaaacaaacgtgagtggggacctttgttacctgggggaggagaattgtcaggtgcgattcgccaagagcgccctgcgccgtaagtgcgctgtttgcaagatagtagtgcatacagcctgcatagaacagcttgagaagattaatttccgatgcaagcctacttttagggagggaggaagccgcagtcccagggagaattttgtcaggcaccactgggtacatcgccgacggcaagaaggtaagtgcaaacagtgtgggaaaggattccaacagaaattctcctttcacagtaaggagatcgttgccatatcctgtagctggtgtaagcaggcatttcataacaaagtgacctgttttatgctgcatcatatagaggaaccctgctccctgggcgcccacgctgcggtaatcgtccctccaacttggataatcaaggtaaaaaaaccccagaactcactgaaggcctcaaaccggaaaaagaagaggacctctttcaaaaggaaagcgagtaagaggggcatggagcaggaaaacaaagggcgcccatttgtgatcaagcccatctcttctcccctgatgaaacctctactggtgtttgtaaacccaaagtctggaggcaaccaggggaccaaagtactccagatgttcatgtggtatctcaaccctaggcaagtgttcgatttgtctcaggaaggcccaaaggacgccctggagctctatcggaaggtgcccaatctgcgcatccttgcatgtgggggcgacgggactgttggctggatactgtctatcctagacgagctccagttatcaccccaacctccggtgggcgtgcttccacttggcacaggaaacgacctggctaggaccttgaactggggcggagggtatactgatgagcccgtttccaagattctctgtcaagtcgaggacggtactgtggtgcagctggaccgctggaatctgcacgtggaacggaaccccgacttgccccccgaagaactggaagatggtgtgtgtaagctgcccctgaatgtgttcaacaattacttcagcctgggcttcgatgcccacgtgaccttagagttccacgagtctcgcgaggcaaacccggagaagttcaatagtcgctttaggaacaaaatgttctacgccggggcagcgttcagcgattttctgcagcggtcctccagggacttgtctaagcatgtcaaagtggtatgcgatggaacggacctcactccgaaaattcaggaattgaaattccagtgcattgttttcctgaacatccccaggtactgcgcgggtaccatgccgtggggcaatccaggagatcatcacgacttcgaacctcagcggcatgacgatggatacattgaagtgatcgggtttacaatggccagccttgccgctctgcaggtagggggtcacggcgagcgcttacaccagtgcagggaagtaatgttgcttacctataaaagcatacccatgcaggtggacggtgagccttgccgattggcacccgcgatgatccggatttcacttcgaaatcaggctaacatggtgcagaaatccaaacgcaggacatccatgcctctgctcaacgacccccaatccgtgccagatcgactgcggatcagagtgaataagatctctctgcaagactacgagggcttccactatgacaaggagaaactgagggaagcctccattagcgattggctgaggaccattgccggagaactcgtccagtctttcggtgctattcctcttggaatactggtcgtgaggggggattgtgacctggaaacttgccgtatgtacatcgaccgccttcaagaggatctgcagtccgtttcatccggctcacagcgagtccattatcaggatcacgaaaccagctttcctcgcgcactgtctgcccagcgcctatctccaaggtggtgcttcttggacgacaggagtcaggaacacctgcatttcgtgatggaaatctcacaagacgaaattttcatcttagaccccgatatggtggtctcacaaccagctggaacgccacctggcatgccagatctggtcgtggaacaggcatcgggcatcagtgattggtggaaccccgcattgcgaaaacgtatgttgagcgattcaggattgggcatgatcgctccttattacgaagattccgacttaaaggatctttcacatagccgtgtcctccaaagtcccgtgagttcggaggatcacgcaatccttcaagccgtaattgccggggacttgatgaagttgatagagtcgtataaaaatggcggtagtttgctgatacaggggccggaccactgctcactcctccattacgcggctaagacaggcaacggtgaaatcgtgaagtacatcttagaccacggcccaagcgagctgctagacatggccgactcagaaacaggtgaaacagcactgcacaaagctgcttgtcagcgaaaccgggccgtgtgtcaactgctggtggacgcaggtgcgtcactgcgcaagacagattctaaggggaaaaccccgcaagaacgagctcagcaggccggcgatccggacttagccgcctacctggaaagccgacagaactataaggtgatcggacacgaagacctggaaaccgccgtgtag

SEQ ID NO: 185306 - DNA, 3207 bp, Artificial Sequence
  Description of Artificial Sequence: Synthetic coding sequence
atggacgccgccggccggggctgccacctgctgcccctgcccgccgcccgggggcctgcacgagcccccgccgccgccgccgccgctgccgcctcacctcctgggccatgttccggtgccgcttgcgcaccttccgctgccgccggggcaggggccatgaatccctccagcagcgcaggggaagagaagggcgctacgggcgggagttcatcctctggtagcggggcaggatcctgttgtcttggcgccgagggaggagccgacccccgcggggccggctctgcggccgctgccggcgctgcagccctggatgagcccgcggccgctggccaaaaggaaaaagacgaggcattggaagagaagctacggaatctgaccttccgtaaacaggtgagttaccgtaaggcgatttcaagagccggtctgcaacacctcgcacctgcccaccccctaagcttacctgtagctaacggaccagccaaggagcccagagcgaccctggattggtccgagaacgcagtgaatggcgagcacctgtggcttgaaaccaacgtttccggtgacctgtgctatttaggagaggagaactgtcaagtgaggtttgccaaatcagctctcaggcgaaagtgcgcagtgtgcaaaatcgtggtccatactgcctgcatagaacagctcgaaaagattaacttcagatgcaagcccacattcagggaaggagggtccagaagcccgagagagaacttcgtgagacaccattgggtccaccgaaggcggcaagagggtaagtgtaaacagtgtggcaagggctttcaacagaagttctcatttcacagcaaagagattgtggctatttcttgcagttggtgcaaacaggcctttcataacaaggtgacttgtttcatgctgcatcatatcgaggaaccatgttcgctaggcgcccacgccgctgtcattgtccctcctacatggattataaaagttaagaaacctcagaattctcttaaggcaagcaatcgcaagaagaagaggacgtctttcaaacgaaaagcttctaagcgcgggatggaacaggagaacaaaggtaggccgtttgtgattaaaccgatctcttcccctctcatgaaacccctcctagtctttgtgaatcccaaaagcgggggtaaccagggaaccaaggtgctgcagatgttcatgtggtacctgaacccaagacaggtctttgacctcagccaagagggccccaaagacgctctcgaactatataggaaagtacctaatctgagaatactggcttgtggcggcgatggcaccgttggctggatcctgtcgatcctggacgagctacagctctcaccacagccaccagtcggagtgctgcctctgggaacaggcaatgatctcgccaggactcttaattggggaggtggatataccgatgaaccagtgtcaaaaatattatgccaagtggaagatggcacggtcgtgcaattagatcgttggaatctgcatgtcgagcgtaatcctgacctcccacctgaggagttagaggatggcgtttgtaagctgcccctcaatgttttcaacaattatttctctcttggctttgatgcccacgttacactcgagttccatgagtcaagggaggcaaatcctgaaaaatttaacagtcgatttcgaaataagatgttctacgccggggccgctttcagcgattttctacagcggagtagtcgggacttatccaaacacgttaaggtggtgtgcgatggcacagatcttacacccaagattcaagaactgaaattccaatgcatagtttttctcaacattccccgatattgtgccggcacaatgccgtggggtaatcctggtgaccaccacgactttgagccgcagaggcacgacgatggctatattgaagttatcggattcactatggctagccttgcagccttgcaggtcggcggccacggggagcgattgcaccagtgtcgggaagttatgcttctgacctataaatcaatcccgatgcaggtggatggggagccttgcagattagctcccgcaatgattcgcattagtcttaggaatcaggccaatatggttcagaagtcaaagcggcggactagcatgccccttttgaacgacattcaccaggtccagaccgccgacctgagaagggtgagcgcaccccccggaagcttcactatccctcagagcgtgccagataggttgaggataagagttaataaaatttccttgcaggactatgaggggtttcactatgacaaggaaaaattgcgtgaggccagcataccactcggtattctggtggttcgtggcgactgcgatctggagacttgccgaatgtacattgaccgtctgcaggaagatttgcagtctgtgtcctcagggtctcagcgggttcattatcaagaccacgaaacgtcatttccacgggcgctgtctgctcaaaggttgagtccaagatggtgctttctcgatgaccggagccaggagcaccttcatttcgtaatggaaatcagccaagacgaaatcttcatactagatccggacatggtcgtgagtcagcccgccgggaccccgcccggcatgccagatctggttgtggaacaggctagcggcatatccgactggtggaaccctgctttgcgtaagcgcatgctctccgacagcggattgggaatgatcgcgccttactacgaagactccgatctcaaggacctgtctcattcacgtgtgctccaatccccagtatcaagcgaggaccacgcaatactacaggcagtcatcgcaggagatctcatgaaactcattgaatcttacaagaatggagggtctttgctgatacaggggcctgaccattgtagccttctgcactatgccgctaagacgggcaacggggaaatcgtcaagtacatcttggaccatgggcccagcgaactcctagatatggctgatagcgagactggagagaccgctctgcacaaagccgcctgtcaacgcaacagagcagtgtgccagctgctggtagatgcaggggcttcccttcgcaaaacagattctaaaggaaaaactccacaagagcgagcgcagcaggccggggatcctgacctcgctgcctatctggaatccagacagaattacaaagtcattggacatgaagatctcgagacagctgtgtag

SEQ ID NO: 185307 - DNA, 2949 bp, Artificial Sequence
  Description of Artificial Sequence: Synthetic coding sequence
atgaaccccagcagcagcgccggcgaggagaagggcgccaccggcggcagtagttcttctggcagcggggctggctcttgttgtctcggtgcagagggtggggcagacccaaggggcgcgggtagcgccgctgccgctggtgctgccgctctggacgaaccagctgctgccggacaaaaggaaaaggatgaagctcttgaagagaagctgcgcaatctgacatttaggaaacaggtgagttatcgtaaggccatcagccgagccgggctgcagcacctggcgccagcccaccctctgagcctgccagtagcaaatgggccggcaaaagagccacgcgccactctggactggtccgaaaatgctgtgaacggggagcacttgtggctggaaacgaatgttagtggggacctgtgctatcttggagaagaaaactgtcaggtgagatttgcaaaaagtgccctgaggcggaagtgcgccgtgtgtaagatcgtcgtgcacacagcttgtattgagcaactggagaagatcaactttcgctgtaaacccacgttcagggagggtggttcacgctctccgcgcgaaaactttgtgagacaccactgggtgcaccgccggcgacaagagggtaaatgtaagcagtgtggtaaggggttccagcagaaattttcatttcactctaaggagatcgtggcgatttcttgctcatggtgtaaacaggcgttccataacaaggtgacttgttttatgcttcatcatatcgaagagccgtgtagtctgggagcacatgctgcagtgattgttcctcccacttggattattaaggttaaaaagccccagaatagtctcaaggcctctaatcgtaaaaagaaacggaccagtttcaaaaggaaggccagcaagcgggggatggagcaggaaaacaagggccgcccatttgtcattaaacccatctcaagtccgctcatgaagccacttctggtcttcgtgaatcccaagagtggggggaaccaggggaccaaggtgctgcagatgttcatgtggtatctgaatccccggcaggtatttgacttgagccaggaagggcccaaggatgcactagagctgtaccgcaaggttccgaatctgcgcattttggcatgcggtggagacggcacagtaggttggatactatctatcctcgacgaactgcagttatcgccccagcccccagtgggggtattacccctcggcactggaaatgatttagcccggactcttaactggggaggcggctacaccgatgagcctgtgtctaagatcctgtgtcaggtagaagacgggacagtggtgcaactggaccggtggaatctgcatgtggaaaggaatccagacttgcctcccgaggagctggaggatggagtatgtaaactgcccctgaacgtctttaataattatttctctcttggattcgatgcccacgtgacgttggagttccatgagagcagagaggctaaccccgaaaaattcaattcgaggtttcgcaacaaaatgttttacgcaggagccgcattctctgacttccttcaaagatcgtccagggatttgagcaaacatgttaaggtcgtttgtgacggtacagatttgacaccgaagatccaggaactgaaattccaatgcatagttttcttgaacattccaaggtattgtgccggaaccatgccctggggcaaccccggggaccatcacgattttgaaccgcaacgacatgacgatggctacattgaagttatcggttttacaatggccagtttggcggcactgcaggtgggcggccacggtgaacgactgcatcaatgtcgtgaggtgatgctcttgacctataagtctattcccatgcaggtggacggggaaccttgcaggctggctccggccatgatcagaatttcacttaggaaccaggctaatatggtccagaagagcaagagaagaacttccatgccccttttgaacgacccacagagcgtgccggatcggctccggattcgcgtgaataagatctccctgcaagattatgaaggcttccactacgacaaagagaaactgagagaggcaagcataagtgactggttgaggactatcgccggggaactcgttcagagtttcggcgccatcccccttggtatccttgttgtgaggggtgattgcgacctggagacatgccgcatgtatattgacagactgcaggaagatctgcaatctgtctccagcggttcacagagagtgcactaccaggatcatgaaacatctttcccgcgcgccctgagcgcacaacggttgtcacctcgttggtgctttctggatgccactagcgccgatcggttttaccgaatcgacagaagccaggagcatctccacttcgtaatggagatctcacaagatgaaatctttatacttgacccagacatggtagtgtcacagccggccggcaccccccccgggatgccagatcttgtggtggaacaggcatctggtagcccagtgtcctccgaagaccacgccatcctgcaggccgtgatcgccggcgatctcatgaagttaatcgaatcatacaagaacgggggatcgttgctcatccagggcccagaccactgctctctgctgcactacgccgcgaagaccggtaacggggagatcgtgaaatacattcttgaccacgggccctctgagctcttggacatggcagattcagagaccggtgagacggcattacacaaggcggcctgtcagagaaatcgagccgtttgccagctcctagtggacgcaggtgcaagcctcaggaagaccgatagcaaaggcaaaacccctcaggagcgagcccagcaggccggagatccggatctggccgcctatctggaatcacggcagaactacaaggtgattgggcatgaggacttagagaccgctgtgtag

SEQ ID NO: 185308 - DNA, 2829 bp, Artificial Sequence
  Description of Artificial Sequence: Synthetic coding sequence
atggccgccgccgccgagcccggcgcccgggcctggctgggcggcgggtccccacgccccgggagtcccgcctgtagtccggtgctcgggagtgggggccgtgcccgtcccggtcctggcccgggacccggtcccgaaagagccggagtccgggctcccggtcccgccgccgcaccgggtcatagcttcagaaaagtgactctcacaaaacccactttctgccatctgtgtagcgattttatctggggactggccggctttctgtgcgatgtgtgcaactttatgagccatgaaaagtgtttgaagcatgtgcgaatcccctgcacctcagtggccccaagtcttgtgagggtccctgtggcacattgttttggaccccgcggactgcacaagcggaagttttgcgcagtgtgccggaaggtcctagaggctcccgctttacactgtgaggtgtgcgagcttcacctgcaccctgactgtgtcccttttgcctgctccgattgccgccaatgtcaccaggacggacaccaagatcacgacactcatcatcatcactggcgcgaaggcaacctgccctcaggagctcgatgcgaagtttgccgcaaaacctgtggttcatccgatgtcctggccggagtgcgttgcgagtggtgtggcgtacaggctcatagtttgtgctcagctgcactggcccctgagtgcgggtttggcaggctgcgcagcctagtcctcccccccgcatgcgtgaggctactccccggcggcttttccaaaacccaatcctttaggatcgtggaagccgctgagccaggcgagggtggtgatggcgcggacggcagcgctgccgtagggcctgggcgggagacacaggccactccagaatccggcaagcagacgctcaagatatttgacggcgatgacgccgtgcgccgcagccaattcagactggtgacagtgtctcggctcgcaggcgctgaggaagttttggaagcagcgctgcgagctcatcacatcccagaggaccccggtcatctggagctgtgcagactccccccctcttctcaggcctgcgacgcatgggccgggggaaaggcagggagtgccgtgataagcgaagaggggcggtctcctgggtccggcgaggccacacccgaggcttgggtgatcagagctctgccccgggcgcaggaggtcctgaagatttaccccgggtggctgaaagtgggtgtggcctacgtgtctgtccgcgtgacccctaagagtaccgcgcggagcgtggtgctagaggtgctaccactactgggtcgtcaggccgagtcacctgagagctttcagctcgtggaggtagcaatgggctgtcggcacgtgcagcgaaccatgctgatggatgagcaaccccttctagacagactgcaggacatccggcagatgagtgtccggcaagtttctcagacacgattttatgtggccgaaagccgtgatgtggctccccatgtctctctcttcgtcggcggtttgccccctgggctgtcaccagaggaatactcttcactcctgcacgaggcaggcgctacaaaggccaccgtggtgtccgttagccacatttattcttctcaaggcgccgtagtgctcgatgtagcctgtttcgcagaagctgagcgactgtacatgcttttgaaagacatggctgtgcgagggcgacttctgacagccctggtgctgccagacctgttacatgcaaaactccctccagactcatgcccactccttgtgttcgttaatcctaaatccggcggactgaaaggacgtgacctgctctgcagcttcaggaaattactcaacccccaccaggtgttcgacctcacaaacggcgggccactgcctggactgcatcttttcagccaggtcccctgctttagggttctggtttgcggtggcgatgggactgtagggtgggtcctcggggctctggaggagactagatacagactcgcctgtccagagccttccgttgcaatccttccactggggacaggtaatgacctgggtagggtgcttcgttggggcgcaggctattccggcgaagaccctttcagcgtgctgctgagcgtggatgaagcggatgcagtcttgatggataggtggacaatcctgctggatgcacacgaagctggttcggccgagaatgacacagcggacgcggaaccacctaagatcgtacagatgtcaaattattgcggaatcggcattgacgccgaactcagcctggatttccaccaggctcgtgaggaggaaccgggaaagtttacgagcagactgcataacaaaggggtgtatgtcagagtgggactgcaaaagatctcccatagtcgcagtctgcataaacagatcagactgcaggttgaacggcaggaagtggagcttccaagcattgagggcctcatcttcataaatattccaagctggggaagtggcgctgatttatgggggtcagactccgatactagattcgaaaaacctcggatggacgatgggctgctggaggttgttggtgtaacgggggtggtgcacatgggccaggtgcagggcggcttgaggagcgggatccgcatcgcacaggggagttattttcgcgtcaccctcctcaaggctacacccgtgcaggtggacggcgagccatgggtgcaggcccctgggcacatgataatcagtgctgccgggcccaaggtgcatatgctgaggaaggccaaacagaaacctagaagagcagggaccaccagagacgcacgcgctgatgctgcacccgccccagagtcggatcctcgctag

SEQ ID NO: 185309 - DNA, 1632 bp, Artificial Sequence
  Description of Artificial Sequence: Synthetic coding sequence
atgcccggcatggtgctgttcggccggcggtgggccatcgccagcgacgacctagtctttccaggattcttcgaactagtggtgcgggtgctatggtggatcggcatcctgactctgtacttgatgcaccgaggcaaactggattgtgccggcggagccttgctgtcatcgtatctcatagtccttatgatcctgctggccgtcgtgatttgcactgtgtctgccatcatgtgcgtcagtatgcggggaacaatatgtaacccgggcccccgtaagagtatgtccaagctgttgtatatccggctggctctcttctttcctgaaatggtgtgggccagcttgggtgccgcctgggtggccgacggagtgcagtgcgacaggactgtcgttaatggtatcatagccacagtcgtggttcgcacgcagatctggtgtccggcgacactgcggagagccagcccttgctttatcagcaacagaacaatcagcggcacaacgaagagcctcccacggtggtccgcaatgccacagggagcaccttcttgccgtagtcgcacaactgactatgacctggtagggggtgaccagctcaattgccattttggaagtatcttacatacaacgggcctgcagtaccgcgactttattcatgtgtcattccacgacaaagtttatgaactgccctttttggttgctttagatcaccgcaaggaaagcgtagtagtagccgtgcgtggcaccatgtccttgcaggacgtcctcacagatctgtccgcagaaagcgaggtgctagacgtagaatgcgaagtgcaggataggctggcccataaggggattagtcaggctgccagatatgtctatcaacggctgattaacgatggcattctcagtcaggcattctcgatcgcgcctgaatatagactggtgattgtcggccattctctgggcggcggagcagccgctctgctcgcaaccatgctgagagctgcctatccacaagttcggtgctacgcattctccccaccaaggggcttatggagcaaggcactgcaggagtattcacagagtttcatcgtaagcctggtgctgggtaaggacgtgattccaaggctcagtgtcacaaatttggaagacctcaagcgtagaatcctgagagtagtagcacattgtaacaaacccaaatataagatcttgttgcacggtctgtggtacgagctcttcggtggcaatcccaacaacctcccaaccgagcttgacgggggcgatcaggaggtgttgactcaacccctgctcggggagcaatccttactcacccgatggagtcccgcatactctttcagttccgactctccgctggacagctctcctaaatatcctcctctgtatcctcctgggagaattattcacctgcaggaagagggcgcttcaggccggtttggatgctgctctgcggctcattactctgccaagtggagtcacgaggctgagttcagcaaaatcctgataggtcccaagatgctaacagatcacatgcccgacattctgatgcgtgcactggacagcgtggtaagtgacagagcagcttgcgttagctgccccgcacagggagtgtcgagcgtggacgtcgcctag

SEQ ID NO: 185310 - DNA, 3129 bp, Artificial Sequence
  Description of Artificial Sequence: Synthetic coding sequence
atgcccggcatcgtggtgttccggcggcggtggagcgtgggcagcgatgatctggtgctgcctgctatctttttattcctgctgcatacaacctggtttgtaatactctctgtggtcttattcgggctcgtttataaccctcacgaggcatgctcccttaacctagtggaccatgggagggggtatcttggtatcctgttgtcttgcatgattgctgagatggctataatctggctgtcaatgcgcgggggcattctctacacagagccccgcgatagcatgcaatacgtgctctatgttcgcctggcaattctcgtgattgaattcatatacgctattgtgggtatcgtatggctcactcaatactacacttcctgcaatgatctcacagctaagaatgttactcttggaatggtagtatgtaactgggtggtgatcctcagcgtgtgtattacagtgctttgcgtctttgaccccacgggccgaaccttcgtgaagttacgcgctacaaagcggcgccagaggaaccttcgcacttataacctccgccaccgattggaggagggacaagctaccagttggtcccgcaggctcaaggtgttcttgtgttgcacgcggaccaaggactcacagtccgatgcctactccgagatcgcttatttatttgcggagttcttccgagatctggacatcgttccttctgacatcatcgccggcctggtgctgctgaggcaaagacagcgcgctaaacgcaatgccgtccttgacgaggcgaacaatgatattctggcattcctcagtggaatgcccgtgacgcgaaataccaagtatctggatctgaagaacagccaggagatgttacggtataaggaagtatgctattatatgctcttcgcacttgccgcttacggctggcctatgtacctgatgcggaagcccgcgtgtgggctctgccagctggcgcggtcttgctcgtgctgtctgtgccctgcccggcctaggttcgctccaggcgtcacgatcgaagaggacaattgctgtggctgtaatgccatagccatcagaaggcatttcttggatgagaatatgaccgcagtggacatagtttacaccagttgtcatgatgctgtatacgaaacaccgttttacgtcgccgtggatcacgacaagaagaaagtggttatatctattcgcggaaccctttctcctaaagacgcccttacagatctcacgggagatgctgagcggctgccagtggaagggcaccacgggacttggctcgggcataaaggcatggtgctgagcgccgagtacattaagaagaaattggagcaggagatggtgctgagtcaggctttcggccgagacttggggcgggggactaagcactatggtttgatagtcgttggacacagcctgggcgcggggacagcggccattctctcattcttattaagacctcagtatccaacactcaagtgttttgcttattcgccaccgggcgggcttctcagcgaggacgctatggaatactcaaaagagttcgtgacagcagttgtccttggcaaagacctggtgcctcggatcggactttcccagctggagggctttcgccggcagttgctggacgttctccagcgctcgacaaagcctaagtggagaattatcgtaggtgcaactaaatgtatcccaaagagtgaactgcccgaagaagttgaggtcaccaccctcgcctccaccagactctggacccatccgtccgatctaacaattgcccttagcgcctcaacacctttgtacccacccggacgtatcatccatgtggtccataatcaccccgccgagcagtgctgctgttgcgaacaggaggagccaacttattttgccatctggggcgacaacaaagcatttaacgaggtgattatctctccggcaatgctgcatgagcacctgccatacgtcgtcatggaaggactgaacaaagtgcttgagaactataacaaaggcaaaaccgcactgctgagcgctgccaaagtgatggtctcacccaccgaggtggaccttactccggagctaatttttcaacaacagcccctcccgactgggcctcctatgcctactgggctcgccctcgaactgcccaccgctgaccaccgtaacagcagcgtacgaagcaaatctcaatcggagatgagtttggagggcttttctgagggcaggctgctgagtcccgtggtcgctgcagcagcgcgacaagaccctgtcgagctcttactactgtctacgcaggaacgcctggcggccgaacttcaggcaagacgggctcctctggccaccatggaatctctatccgataccgagagtctttactccttcgactctagaaggtctagcgggttcaggagtattaggggcagcccaagcctgcacgcagtgctggaacgcgatgaaggacatctcttctatattgatcccgcgattcccgaggaaaatccatcgctgtcctctaggactgagctcctggcagccgactctctttccaaacatagccaggacacgcagccactagaagctgccctgggttcgggaggggtcaccccggagaggccaccatctgccgcagcgaacgacgaagaagaggaggtgggcggtggaggcggcggccccgctagccgcggagagctggctctgcataatggaaggctgggcgactctccatctccgcaggtactggagtttgccgagttcattgacagcctgttcaacctcgactccaaatcctcgtctttccaagacctgtactgcatggtggtcccagaatccccgacttccgattatgctgaaggtcctaaatcccccagtcagcaggagattcttctgagggcccagttcgaacccaacctggtcccaaaacctcctagactgttcgctggctcagccgacccttcaagcgggatcagtctgagtccgagcttccccctgtcaagcagcggcgagctcatggatctgacgccaacaggactgtcatctcaggagtgccttgctgcagataaaatccgcacaagtactcctaccggacacggtgccagccccgctaagcaggatgagttggttatctcagcccgttag

SEQ ID NO: 185311 - DNA, 2019 bp, Artificial Sequence
  Description of Artificial Sequence: Synthetic coding sequence
atgcccggcatggtgctgttcggccggcggtgggccatcgccagcgacgacctcgttttcccaggcttttttgaactggtggtgagggttctgtggtggattggcatcctcacactatacttgatgcaccgaggtaaactggactgcgccgggggcgccctgctcagctcctatttgattgtactgatgatcctgctcgctgtcgtgatttgcaccgtgtcggccataatgtgcgtgtcaatgagaggcactatctgcaatcccggcccccggaagagtatgagcaaactactgtacatccgcctggccctgttctttccagagatggtgtgggcaagcctgggcgccgcctgggtcgctgacggcgtgcagtgcgacagaactgtggtcaacggcatcattgccacagtggtcgtctcttggattatcatagccgccaccgtcgtcagcatcataatcgtgttcgatcctctgggcggcaagatggcaccttactccagcgctggtcccagccacctggactcacatgattcttcgcaattgctgaacgggctcaaaactgctgctacatccgtgtgggagactcgaataaaactgctctgttgctgcatagggaaagatgaccataccagagtcgccttcagctccactgccgaacttttttccacctactttagtgatacggacttagttccttcagatatcgctgctggactagcactcctgcaccagcagcaggataacatcagaaacaaccaggaacctgcacaggttgtttgccatgctcccggatcctcacaggaagctgatcttgatgcagagctggagaattgccaccactacatgcagtttgcagcggccgcttacggatggccattgtacatctatagaaatcccctgactggcctgtgtcggattggtggcgactgttgtaggtcaaggacaacagactacgatctggtcggtggcgatcaactgaattgccacttcggtagcatcctgcacaccactgggctacagtatagagacttcatacatgtaagtttccatgacaaagtgtatgagctgcccttccttgttgccctcgaccatcgaaaagagtccgtggtggtggccgtgaggggcaccatgagcctgcaggacgtcctgaccgatctctccgcggagtctgaagttctggacgtggaatgtgaggtgcaggatcgtctggcccacaagggaatttcgcaagccgcccgctacgtctatcagaggctgatcaacgacgggatcctgtcccaagccttctccatagctcccgaatatcgcctggtcatcgttgggcattccctcggaggaggcgcggccgctttacttgccactatgttgcgagctgcataccctcaggtgcgctgctatgccttttcccccccaagaggcctgtggagcaaagccctccaggaatattcacagtcattcattgttagcttggttctgggcaaagatgttataccacggctgagtgtcaccaatctggaggacctgaagagaaggattctcagggtcgtggctcattgcaacaagcctaaatacaaaatcctgctgcacggcctgtggtacgagctgttcggcggaaatccaaacaatctgccgacagaactggatggtggcgatcaggaagtgttgacccaaccactgctcggagaacaatcgttgctcacccgctggtcaccagcctacagtttctccagcgatagcccgctcgacagctcccccaagtatcctcctctgtatcctcctggtagaataattcacctgcaggaggagggggcatctggacgatttggttgctgtagcgcagcccattatagcgctaaatggagccatgaggctgagttctccaagattctgatcggaccaaagatgctgactgatcacatgcccgacatcctcatgcgcgccctggattctgtcgtctctgatcgtgctgcctgcgtttcctgtccagcccaaggcgtgtctagtgtggacgtggcatag

SEQ ID NO: 185312 - DNA, 663 bp, Artificial Sequence
  Description of Artificial Sequence: Synthetic coding sequence
atgtactgcgtgagccaccacgtgtgccagcacgagcggacccagatttggtgccctgcgaccttgcggcgagctagtccctgcttcatctccaatcgcactatctccggaaccaccaaatctttgccccggtggagcgctatgccccagggcgctccgagctgtaggtcccgaactaccgattatgacttggttggaggcgatcagctaaactgccactttgggtcaatccttcacactaccggcctgcagtatagagacttcatccatgtaagcttccacgataaagtgtatgagctgccgttccttgtggccctggatcaccgaaaagagtcagtggtagtcgccgtccgaggcactatgtcacttcaggacgtgctgactgatctcagcgccgagagcgaagtgctggatgtggagtgcgaagtacaggaccgcctggcccacaagggaatctctcaggctgcgcgctacgtttatcagcggctgattaacgacgggattctgtctcaagctttttcaattgctcccgagtacagattagtaatcgttggtcatagtctgggcgggggtgccgccgctctcctcgctactatgctgcgtgccgcctacccccaggtgaggtgttatgcattctcaccgcctcgtgggctctggagatag

SEQ ID NO: 185313 - DNA, 1140 bp, Artificial Sequence
  Description of Artificial Sequence: Synthetic coding sequence
atgtactgcgtgagccaccacgtgtgccagcacgagagctggatcataatagccgctactgtcgtgtcaatcattatcgtgttcgaccccctgggcggtaagatggcaccctattccagcgctggccccagccatctggatagccatgattctagccagctgctgaacggactgaagaccgccgccacaagtgtctgggagaccaggatcaagttactctgctgttgcattggcaaggacgatcacacgagggtcgcattttcttccaccgccgagctgttcagtacctacttttctgatactgatctggtaccatctgacatcgccgcaggcctggccctgctccaccagcagcaggacaatatccgtaataatcaagagcccgctcaagtggtgtgtcacgcccccggtagcagccaggaagctgacctggatgcagagcttgaaaactgtcaccattatatgcagttcgcagcggccgcttatgggtggccactttatatctacagaaaccccctcacgggactgtgtagaatcggcggcgattgttgcaggagcagaaccaccgattacgatctggttggcggagaccagctgaattgccactttggttccattctccacactacaggcctgcagtaccgcgacttcatacacgtaagctttcatgataaggtgtatgagctccctttcctggtggcactggatcacaggaaggaatctgtagtcgtcgcagtgcgtggaacgatgtcactgcaggatgtcctgactgacctgagcgccgagagcgaggtgttagacgtggagtgtgaggtgcaggataggctggcccacaagggcatctcccaagccgctcggtatgtctaccaaaggctcatcaatgatgggattcttagccaggccttctcaatcgcaccagagtaccgcctggtgatcgttggacacagtttgggcggcggcgccgccgcgcttctcgccaccatgctccgtgccgcatacccacagcagtcatcggcaggaattttttcggagctgcatagggtcaccagaccaggagaaggctgtgattcacaggcccagtgcgaccagctaggtagaagtgaagagaaaaacctggccagcgggagagcactgcaatag

SEQ ID NO: 185314 - DNA, 804 bp, Artificial Sequence
  Description of Artificial Sequence: Synthetic coding sequence
atgcccggcatggtgctgttcggccggcggtgggccatcgccagcgacgacctcgtgttccccggcttctttgaactggtcgtgagggtactgtggtggattgggatccttaccctgtacttaatgcatcggggaaaactcgactgcgcaggaggggccctcctgtcaagctacctaatcgttctaatgattcttctggccgtagtgatctgcaccgtgagtgctattatgtgcgtaagcatgcgtggaacaatctgcaatccgggccccagaaagtcgatgtccaagctgctatacatccgcttggctctcttcttcccggaaatggtatgggcctcattgggtgcagcctgggttgctgacggcgtccaatgtgataggacagttgtgaatggcattattgcaacagtcgtggtgtcatggattatcattgctgctacagtggtatctattataatcgtcttcgatcccctcggggggaagatggcaccatactcaagcgccgggcctagccacctcgattctcacgatagctcccagctgctcaacggactgaagacagctgccacatccgtttgggagacacggattaaacttctctgctgctgcatcgggaaagacgatcataccagggtagcattttcttcgacggccgagctgttttcaacttatttttctgataccgatttggtaccatctgatatcgctgctggccttgccctgctgcaccaacagcaagacaatacaagggccaccggcaactgtccccgtaacgacgggctgactctgctgtccctaaattag

SEQ ID NO: 185315 - DNA, 1467 bp, Artificial Sequence
  Description of Artificial Sequence: Synthetic coding sequence
atgggcgaccggggcagcagccggcggcggcggaccggcagccggccctcctctcatgggggtgggggccccgcggcggccgaagaagaagtgagggatgctgctgcagggcccgatgtcggagccgccggagatgctcccgctccagctcccaacaaggacggcgacgcaggcgtcggcagtgggcattgggagctccgttgccatcgattacaggattccctcttttccagcgattctggcttctcaaactatcgtggcatcctgaattggtgcgtcgttatgctcattttgtccaacgcccggctcttcctggagaacctgattaaatacgggatcctggtagaccccatccaagttgtgtctctctttttaaaggatccttactcctggccagcgccctgccttgttatagcggcaaacgtgttcgcggtagcggcctttcaagtggaaaagcgtctggccgtaggtgcgcttaccgaacaggcagggctgctgctgcacgtggcaaatctggccaccatactgtgcttccctgctgctgtcgtgttattagtcgaaagcataacccccgtggggtctctcttggcactaatggctcataccattctcttcctaaagctcttttcttaccgtgatgtgaactcctggtgtagacgcgctcgagccaaagctgcatcggccggaaagaaggctagctctgccgcggccccacacactgttagctaccccgacaacctgacataccgagatctgtactactttctgtttgcaccaacgctgtgctatgagctgaattttcctcggagcccccggatccgtaagcgatttctgctgcggcggattttagagatgttgttcttcacacagctgcaggtgggcttaatccagcaatggatggtgcctaccatccagaatagcatgaagcccttcaaggatatggactactcgagaattatagagcgactattgaaattagcggtcccgaatcatctgatttggctgatcttcttttactggctcttccactcttgccttaatgcggtcgccgaactaatgcagtttggcgacagagagttttatcgggattggtggaactcagaaagcgtgacctatttctggcagaactggaacatccctgtgcataaatggtgcataaggcacttctacaaaccaatgctccggcggggtagctcaaagtggatggctcggaccggagtgttcctggccagcgcgtttttccacgaatatttagtgagcgtgccccttaggatgtttagactgtgggccttcacaggtatgatggcgcagatccccctggcatggttcgtgggcaggtttttccagggcaactacggcaatgccgccgtgtggctaagccttatcatcggccaacccattgcagtgttgatgtacgtacatgactactatgtgcttaactatgaagcgccagccgctgaggcttag

SEQ ID NO: 185316 - DNA, 282 bp, Artificial Sequence
  Description of Artificial Sequence: Synthetic coding sequence
atgaagctgctgatggtgctgatgctggccgccctgagccagcactgctatgccgggtctgggtgcccacttctcgaaaatgttatctcaaagaccatcaaccctcaggtttcaaagactgaatacaaagagctgctacaagaatttatcgatgacaacgcaactacgaacgctatcgatgaactgaaggaatgcttcctgaatcaaaccgacgaaacacttagcaacgtcgaggtctttatgcagctgatctacgattcttctctgtgcgacctgttctag

SEQ ID NO: 185317 - DNA, 1038 bp, Artificial Sequence
  Description of Artificial Sequence: Synthetic coding sequence
atgaagaccctgatcgccgcctacagcggcgtgctgcggggcgagcgacaggccgaggccgatcgctctcaaaggtcccatggaggtcccgcactaagccgggagggatccggccgttggggcgtggcatgctccgctatccttatgtatatcttttgcactgattgctggctcattgccgtgctgtatttcacctggctcgtgttcgattggaatacgcccaaaaaaggtggaagaagatcccaatgggtgcgcaactgggccgtatggcgctactttagagactattttccgatacagctcgttaagactcataacctcctaacgacacggaattatatctttggttaccatccacacggaattatgggactgggtgcattttgcaatttcagcacagaagcaacagaagtgagtaagaaattccccggcattagaccctatctagctacgctcgctgggaactttaggatgccggtgttacgggagtatctgatgagcggcggcatttgtccagtgagccgcgacaccattgattatcttctttcgaagaacggatctggaaatgcaattattattgtagttggcggtgccgctgagagtctctcatcaatgccaggcaagaacgccgtgactctgcgaaatagaaaagggttcgtcaaactcgcgctgagacacggtgcagacttggtccccatctattcttttggcgaaaatgaggtgtacaaacaggtgatctttgaggagggttcctgggggaggtgggtgcaaaagaagttccagaaatacatcggtttcgcgccatgcatatttcacggaagaggattgttctcatctgacacgtggggtcttgtgccttattctaaacccattacaacagtagtaggtgaacccattaccatccctaagcttgagcaccctactcaacaggacattgacttgtatcacactatgtatatggaggcactggtcaaactatttgacaaacacaagacaaaattcggtctgcccgaaactgaggtacttgaagtaaactag

SEQ ID NO: 185318 - DNA, 3306 bp, Artificial Sequence
  Description of Artificial Sequence: Synthetic coding sequence
atggagcagcccggcgccgccgccagcggcgccggcggcggcagcgaagagccaggcggcggccgctccaataagcgctcagctggcaacagggcagccaacgaggaggagactaagaacaaaccaaagcttaacatacagattaagactttggccgatgacgttcgagaccggatcactagtttccgcaagtctacagtgaaaaaagaaaagccacttattcagcacccaattgacagtcaggtggctatgtctgaatttcctgccgcacagcctttgtatgatgaaaggtccctcaacctttccgaaaaagaggtactggacctgtttgagaagatgatggaggatatgaatctgaacgaggaaaagaaggcaccattgcgcaacaaggacttcaccacgaaacgcgaaatggtcgtccaatatatcagcgccactgcgaagagtggtggacttaagaacagcaaacacgagtgtaccctttcgtctcaggagtacgtgcatgaattgaggagcgggatcagtgatgaaaagcttctcaattgtttggagagtttgagagtgagtctgacctctaatcctgtcagttgggtcaacaattttggccacgaaggcttgggcttacttctggatgagctggagaaactgctggacaaaaagcagcaggagaatattgataagaaaaaccagtataaactaattcagtgtttaaaggccttcatgaacaacaagtttggactgcagcggatactgggtgatgaacgctcgctgctgcttctggctagagccatcgaccccaaacagcctaatatgatgaccgagattgtgaaaattctgtccgctatttgtattgtaggagaggagaacattctcgataagctgttgggtgctataacgacggctgcagagcgtaacaatcgggagaggtttagccccatcgtggagggcctggagaaccaggaggccctccaactccaagtcgcttgtatgcaattcattaatgctttggttacatctccatacgaattagactttcggatacatctgcgcaacgaattcctcaggtccggcctcaagacgatgttgcctgatctgaaggagaaggaaaatgatgaacttgacatacagttgaaggttttcgatgagaataaagaagacgacttgaccgagctatcgcacagattgaatgacataagagccgagatggacgacatgaatgaggtgtatcacctcctgtacaacatgctcaaagatacagctgcggagaattacttcctgtccatattgcaacactttctcctgatccgcaatgattattacatcagaccccagtattacaagatcatcgaagagtgcgtgagccaaatcgtgctgcattgctctgggatggatcctgactttaagtaccgtcagcggttagatattgaccttacccatttaattgactcctgtgtgaataaggccaaagttgaagagagcgagcaaaaggccgcagaattcagcaagaagttcgatgaggagttcactgcacgccaagaggcccaagccgagttgcaaaaacgcgacgagaagatcaaggaactcgaggccgaaattcagcagttgagaacccaagcgcaagtgcttagcagctcatcaggcattccgggacccccagccgctcccccactgccgggagtggggccgcctcctcctccccctgcgccacctctgcccggaggagcccctctgccaccgccccctccaccactgcccgggatgatggggataccgcctccccccccccctcccctgctgttcggaggtccgcctccaccaccacctctgggcggcgtgcccccaccgcccggaatctcactcaacctgccttacggcatgaaacagaaaaagatgtacaaacctgaagtaagcatgaagagaatcaattggtctaaaatcgaacccacggagttgagcgaaaactgcttttggctgcgcgtcaaagaagataaattcgaaaaccccgacctttttgccaaactggctcttaacttcgcaacccagatcaaagtacagaaaaacgccgaggcgcttgaagaaaaaaagacaggtcctactaagaagaaagtgaaagagctgcgcatcctggatcccaagacggctcaaaatctgtcaatcttcttgggctcctaccgcatgccatacgaagatatccggaacgtgattcttgaggtgaacgaagatatgctatccgaagcacttatacagaacctggtgaagcatcttcccgagcaaaaaatactgaacgaactggcagaactgaagaatgagtacgatgacctgtgtgaacccgagcaattcggagtcgtgatgagctcagtgaaaatgctgcagcctcgtcttagctccatattattcaagctgacgtttgaggaacacatcaacaacatcaagccatccattatcgctgtcacccttgcatgcgaggagctgaaaaaatccgagtcctttaaccgtctcttggagttagtgctactggtgggaaactatatgaatagtgggtcgcgtaatgcacagagcctggggtttaagatcaatttcctttgtaagattagggacactaaaagcgcagatcagaaaaccacacttttgcactttattgccgatatctgtgaagagaaatatagggacatcttaaagtttccagaggagctggaacacgttgagtcagcaagtaaggtgagcgctcagatactcaaaagcaacctggcatccatggagcagcaaatcgtgcacctagagcgcgacattaagaaattcccacaggcagagaatcaacacgataaatttgtggaaaaaatgactagcttcaccaaaacagctagggagcagtacgaaaagctgagcactatgcataataacatgatgaaactatacgaaaacctcggtgaatacttcattttcgattccaagacggtaagcattgaagagttctttggagatctgaacaattttcgcacattatttctggaggccgtgagggagaacaataaacgccgggagatggaggagaaaactcggcgggctaagttggcgaaagaaaaggccgaacaggaaaaactggagcggcaaaaaaagaagaaacagctcattgatatcaataaggaaggggatgagaccggggttatggacaatctgcttgaagccttacaatcaggagctgcatttcgggaccggagaaagaggatccctcgcaatcccgacaaccgccgggttccccttgaaaggagccgaagtcgccataatggagccatctcatcgaagtag

SEQ ID NO: 185319 - DNA, 3291 bp, Artificial Sequence
  Description of Artificial Sequence: Synthetic coding sequence
atggagcagcccggcgccgccgccagcggcgccggcggcggcagcgaagaacctgggggtggacggtcaaacaagagaagcgccggcaatcgcgcagcaaacgaggaggagactaaaaataagcccaagttgaacatacagattaagactctcgctgatgatgtccgcgacagaatcaccagtttcagaaaaagcaccgtcaagaaggagaagccattaatacagcatcctatcgattcccaggttgccatgtccgagtttcccgctgctcagcctctgtacgacgagcggtcactgaacctaagcgagaaagaggtgttggacctctttgagaaaatgatggaggacatgaacttgaatgaggaaaagaaagctccactaagaaacaaggactttacaaccaagcgcgagatggttgtacagtacattagtgcaacagccaaaagcggagggttgaaaaattctaagcacgaatgtactctgagttctcaggagtatgttcacgagctacgtagcggcatatcagatgagaagttgttaaattgtctcgaatccttgagggtgtcgctcaccagcaaccccgtcagttgggtgaacaactttggacatgaaggcctggggttgcttctggacgagctcgaaaagctgctggacaagaagcagcaggagaatattgataagaagaaccagtataagctcatccaatgtctgaaagccttcatgaataacaaattcggactgcaacgtattttgggagatgagaggagcctgcttctattggctcgcgccatcgaccccaagcagcccaatatgatgaccgaaatcgtcaaaattctcagtgcaatatgtattgtcggggaggaaaacatcctcgacaagttgctgggagcgatcaccacggctgccgaaaggaataatagagagcgcttttcccccattgtagagggtcttgagaatcaagaagccctccagctgcaggtggcttgcatgcagttcattaacgctctggtaacttccccctatgagctagacttcaggattcacctcaggaatgagttccttcgtagcgggctgaagacaatgctgcctgatctgaaggaaaaggagaacgacgagttagatattcagctgaaggtatttgacgagaataaggaagacgatttgaccgaattgtctcaccgtctgaacgatatcagggccgaaatggacgatatgaacgaagtgtatcaccttctctacaatatgctgaaggacacagctgctgagaattacttcctgtctatcctgcagcatttcctgctaatccgcaatgattactacatcagaccccaatattataagatcattgaggaatgtgtctcccaaatcgttctgcactgctcaggcatggatccagacttcaaatatcggcagcgcctggacatcgatctcacccaccttatcgactcatgcgttaataaagcaaaggtggaggagtccgagcagaaggctgcggaattctcaaagaagtttgatgaagaattcaccgccagacaagaggcccaggccgagctgcagaagagggatgagaaaataaaagaactcgaggcagagattcaacagttacggacccaggcccaggtacttagtagcagcagtggcatccctggcccacccgcagccccccctctgcccggtgttggtcccccccctcctcctcccgctcctccactaccagggggcgcacctctacctcctcccccaccaccattaccgggtatgatgggcattcccccccctccaccaccaccccttctgtttggagggcctcctccgcccccacccctcgggggcgttccaccacctccaggtattagcctaaacctgccttacggaatgaagcagaaaaaaatgtacaagccagaggttagtatgaaacgtatcaattggtccaaaattgagcctacagagcttagtgagaactgcttctggcttcgggttaaagaggataaatttgaaaaccccgatctatttgcgaaactggctttaaactttgcaacccagatcaaagtccaaaaaaatgccgaggctctcgaggagaagaagacaggtcccaccaagaagaaggtaaaggagctcagaatccttgatccaaaaactgcgcagaatctgagcatctttctcggctcctatcgaatgccgtatgaagacatcagaaacgtgatactggaagtaaatgaagatatgttgtcagaggccttgatccaaaacctggtgaagcacctaccggaacagaagatcttaaatgaattagctgagctcaagaatgagtatgacgatctgtgtgagccagagcagttcggagtcgtgatgtcttccgttaagatgttgcaaccccggctgagttctatcttatttaaactgacgttcgaggaacatatcaacaacattaagcccagcatcatcgcggtgaccctggcatgcgaagaactcaagaagtccgagtcattcaatcggctccttgagctcgttctcctcgtcggaaactacatgaacagcggctcaaggaacgctcaaagtctaggatttaagatcaacttcctttgtaaaatcagggacacgaaaagtgccgatcagaagaccactctgttgcactttatcgccgacatctgcgaggagaaataccgggacatcctcaagttccctgaggagctggaacatgtagagagcgcttccaaggtgtcggctcagatattgaagtccaacctggcctctatggagcagcaaatagtgcacctagagcgagacatcaagaagttccctcaagcagagaaccagcacgataaattcgtggagaaaatgaccatcttcactaaaacagccagagagcagtatgagaagctcagcaccatgcataacaacatgatgaaactatacgagaatctaggtgagtatttcatctttgactctaaaaccgtctcaatcgaggaattcttcggcgacctgaataactttagaacgttgttcctggaggccgtgagggaaaataacaagcgcagagagatggaagagaaaacaagaagagctaaactagcaaaggaaaaggcagagcaggaaaagctggagcgacagaagaaaaagaagcagctcatcgatattaacaaggaaggggacgagacgggggtgatggataatttattggaggcgctacagtcaggggctgcctttcgggacagaagaaagcggatcccccgaaaccccgtggttaaccacccatgtgccactcgggctaaccccagaagcgccacatag

SEQ ID NO: 185320 - DNA, 3291 bp, Artificial Sequence
  Description of Artificial Sequence: Synthetic coding sequence
atggagcagcccggcgccgccgccagcggcgccggcggcggcagcgaggaaccaggcggcggccgatccaataaaagaagcgcgggcaatcgcgcggccaacgaggaagagaccaaaaacaaacccaaactgaacatacagatcaagaccctggccgatgacgtgagggatcgcatcacgagtttcaggaagagcaccgtgaaaaaagagaaaccgctgatacagcatcccatcgattcacaagtagcaatgtccgagttccccgcagcccagccattatatgacgaacggtctttgaacctgtctgaaaaagaggtcctcgatttgtttgaaaagatgatggaagatatgaatctgaatgaggagaagaaggctcccctgcgaaacaaagacttcacgacgaaaagggagatggtggtgcagtatatttcagcaacagctaagagcggcgggctcaagaactcaaagcatgagtgcactttatcctctcaggaatacgtgcacgagctgcggagtgggatctccgatgaaaagcttctgaactgtctagagtcccttcgcgtgtccctaacttctaaccccgtgtcctgggtcaataactttgggcatgaggggttgggcctcctgctggatgagctggagaaactcctcgacaagaaacagcaggagaacattgacaagaagaaccaatacaaacttatccagtgcctgaaggccttcatgaacaacaaatttggcttgcagcgcatactaggcgacgaacggagtctgctcctcctagcaagggccatcgacccaaaacagccaaacatgatgaccgaaatcgttaaaatcctgtctgcaatctgtattgtgggcgaagaaaacatactagataaactgctgggggcaatcacaaccgcagccgagcggaataatcgggagcggttctcccccatagtcgaggggctggagaatcaggaggcattacagctgcaagtcgcatgcatgcaattcatcaatgctttggtgacatccccatacgagctagacttccgcatccatctgcgcaacgagtttctgcgttcaggactgaaaactatgctgcctgatctcaaagagaaggaaaacgacgagctggatatccaacttaaggtctttgatgagaacaaagaggatgacctgacagagctgagtcatcgcctgaacgacatcagggcggagatggatgatatgaacgaagtgtaccacttgctgtataacatgcttaaggacaccgccgcagagaattacttcttatcaatcctgcagcacttcttgctgattcgcaacgactactatattagaccacagtactacaagattatcgaggaatgcgtgtcccagatagtcctgcattgtagtggcatggaccctgattttaagtaccgacagaggcttgatatcgatctgacacatctgattgatagctgcgtgaacaaagccaaggttgaggagagtgagcagaaagcagcagaattctcaaaaaagtttgacgaggaattcacagccagacaggaggcacaggctgaactccagaagcgcgatgaaaaaatcaaagagctcgaagcggaaattcaacaacttagaacccaggcacaggtactttcatccagcagtgggatcccagggcccccagccgccccgcccctgcccggggttgggccccccccgccaccccccgccccacccctgcccggtggggccccactccctcccccacccccacctctgcctgggatgatgggcatccctccccctccacccccaccactcttatttggcggcccccctccccctcctcccttagggggggtgccaccccctcccggtatatcccttaatctgccatatggcatgaagcagaagaaaatgtacaaacccgaggtgtccatgaaaagaataaattggtctaagattgagcctactgagctgtccgagaactgtttttggctccgcgtcaaggaagataagtttgaaaaccctgatttgttcgcaaaacttgccctgaattttgcaactcagatcaaagtgcagaagaatgctgaggcactggaggagaaaaagacagggcctactaaaaagaaggtcaaagaactgcgcattttggatcccaagacggcacagaacctgtccatctttctgggatcctacagaatgccatacgaggacatccggaatgtaatcttggaggttaacgaggacatgttgagcgaggccctcatacaaaatttggtcaagcatctgcccgagcaaaaaatcctgaatgaactcgcagaattgaagaatgaatatgacgatctgtgcgagcctgagcagtttggcgtggtgatgtctagcgtgaaaatgctgcaaccacgcctttcttctattctgtttaagctgacgtttgaagaacacatcaacaacattaaaccctccattatcgccgtgacccttgcgtgcgaagagctgaaaaagtcagaaagcttcaatcgcctcctggaactggttctgttagttggaaattatatgaacagtgggtctcgcaatgcacagagtttagggttcaagatcaattttctctgtaagattagagacacaaagtcggccgaccagaaaacaaccttacttcacttcatagctgacatctgtgaggaaaaatatcgcgatatactgaaattccctgaggaattagagcacgtagagtccgcctctaaagtatcagcacaaatcctcaagtcaaatctagctagcatggaacagcaaatagttcaccttgagagagacataaaaaaatttcctcaggccgaaaaccagcacgacaagttcgtggagaaaatgacatcattcactaaaaccgcacgggagcaatatgaaaagctgagtacaatgcacaataacatgatgaagctgtatgaaaatctgggcgagtatttcattttcgattcaaagactgtatcaattgaagagttctttggagatctgaataattttcgaacgctgttcttggaagctgtgcgggagaataacaagcgacgtgagatggaagagaagacacggcgtgccaagttagcaaaagaaaaggctgaacaggaaaaactcgagaggcaaaagaagaagaaacagcttatagatataaacaaagagggagacgagaccggggtaatggacaatctactggaggccctgcaaagcggggccgctttcagagaccgcaggaagcggatcccaaggaatcccgttgtgaatcacccatgcgccactcgagccaatcctcgctccgcaacctag

SEQ ID NO: 185321 - DNA, 3294 bp, Artificial Sequence
  Description of Artificial Sequence: Synthetic coding sequence
atggagcagcccggcgccgccgccagcggcgccggcggcggcagcgaggagcctggcggtggaaggtccaacaaaagatcagcagggaacagagcggcaaatgaagaggagaccaagaataaaccaaagctacgagatcgaattacctcatttcgtaaatccacagtgaagaaggagaaaccccttattcaacaccctattgattcccaagtggctatgtcagaatttcctgccgcacagcccctgtacgacgagaggtcccttaacctcagcgaaaaggaagttctcgatctgtttgagaagatgatggaggatatgaatctgaacgaggaaaagaaagcacctttgcggaacaaggactttactacaaagagagagatggtcgtccagtatataagcgcaacagccaaaagtgtaataagctctcatatcaagggtgggcttaagaatagcaaacatgagtgcacactctcgagccaggagtacgtgcacgagctgagatcggggattagcgacgaaaaactgctgaactgcctggaaagcctgcgggtaagtctgactagcaacccggtatcttgggttaataacttcggacacgagggactgggcctcctgcttgacgagcttgagaagttgctcgacaaaaagcaacaagaaaacattgataaaaaaaaccagtacaaactgatccagtgcttaaaggcatttatgaataataaattcggactacaacgcatcctgggagacgagcggtcactgctcctgctggccagggctatcgatcctaaacagcctaacatgatgactgagatcgtgaaaatattgagcgcaatctgcattgtgggggaagagaacatactggacaagttgcttggcgccataacaactgctgccgaacgcaataatcgggaaagattttccccaatcgtggagggcctggagaaccaggaagctttacagttgcaggttgcttgtatgcagtttataaacgcgttggtcacctctccctatgaactggattttaggatacatttacggaatgagtttttaaggtccggtctgaagaccatgctccccgacctcaaagaaaaggaaaacgatgagcttgatatacagcttaaagtgtttgacgagaataaggaagacgacttgacagaacttagtcatcggctgaatgacatcagagcggagatggatgacatgaacgaggtctatcacctgctgtacaatatgcttaaagacaccgctgcagagaactacttcctgtctattctgcagcacttcctcctaattcggaatgattattatatccgcccacaatactataaaatcatagaagagtgtgtgagccagattgtgcttcattgttccggcatggatccagacttcaagtaccgccagcgactggacatagatttaacccatctgatcgactcatgcgtaaataaggccaaagtggaagaaagcgagcagaaggcagccgaattctcaaaaaagtttgacgaagaatttaccgcgcgacaggaagctcaggctgaactgcagaaacgtgatgagaaaattaaagaacttgaagcagagattcaacagcttcgaactcaagctcaggtgctgagctcgtccagcgggattccgggccctcccgccgccccgccactcccgggtgtggggcccccccctcccccccccgccccccccttacctgggggcgctccccttcccccgcccccaccaccactgcctggaatgatgggaatcccgccaccgccaccccccccacttttgtttggggggcctccaccaccccccccactgggaggcgtgcctccaccgcctggcataagccttaacctgccttacggtatgaagcagaagaagatgtataagcccgaagtctctatgaaacgaattaattggtctaagatcgaaccaactgagctcagcgagaattgtttctggctgagagtcaaggaagacaaatttgaaaaccctgatctgtttgccaagcttgccctaaactttgcgacacaaatcaaggtgcagaagaacgccgaggcactggaagagaagaagactggcccaaccaaaaagaaagtcaaggaactgcgaatcttggatcccaagacagcccagaacctttctatatttctcggctcctacagaatgccttatgaggacatccgcaatgtaatcctggaggtgaacgaggatatgctgtcggaggctctgattcagaatctggtcaagcacctccccgaacagaaaattctcaacgagctggccgagctgaaaaatgaatatgacgatctgtgcgaacctgagcagttcggggttgtgatgtctagcgtaaagatgcttcaaccaagattgagctctatcctttttaagttaacatttgaagaacatatcaacaacatcaagccatccatcatcgccgttaccctggcgtgtgaggaactgaagaagtctgagagtttcaataggctgctggagctggtgctgctggtgggaaactacatgaatagcggctcccggaacgcacagagcctggggttcaagattaattttctttgcaaaatccgagacaccaagagcgccgaccaaaagacaacccttctgcacttcattgcagatatttgtgaggagaagtatagagacatcctaaagtttcctgaggaattggaacacgttgaaagtgcttcaaaagttagtgctcagattttaaagtctaatcttgcttctatggaacagcagatcgtgcatttggagagagatattaaaaaatttccccaagccgagaaccagcacgacaaattcgtcgagaagatgactatctttacaaagactgctagagagcagtatgagaagctctctacaatgcataataacatgatgaaattatatgaaaatttaggagagtactttatcttcgattccaaaacggtttctatagaggagttcttcggggatctgaataattttagaactcttttcctagaggctgtgcgggagaacaataaaagacgcgaaatggaggagaagacccggcgggcgaagctggccaaagagaaggccgagcaggagaaactggagcggcaaaaaaagaagaaacagctaattgatataaacaaagagggcgatgaaaccggtgtcatggacaatctgctggaggctcttcagtctggggccgcattcagagaccggcgtaaaaggattcctcgaaatccagacaaccgtcgagtgccccttgagcgtagtaggtctcgtcacaacggtgcgataagcagtaagtag

SEQ ID NO: 185322 - DNA, 3306 bp, Artificial Sequence
  Description of Artificial Sequence: Synthetic coding sequence
atggagcagcccggcgccgccgccagcggcgccggcggcggcagcgaagaaccaggaggtggacggtctaataagaggtctgccggaaacagggcagctaacgaggaagagaccaagaacaagcctaagctgaacattcaaatcaagactcttgcggatgacgttagagacaggatcacaagttttaggaagtcaacagtcaaaaaagagaagcccctcatccaacacccaattgactctcaagtcgcaatgtccgagtttccagctgcacagccactctatgatgaacgatcattgaacctcagcgaaaaagaggttttggatctgtttgagaagatgatggaagatatgaatctgaacgaggagaaaaaggctcctctgcgcaacaaagacttcactactaagcgagagatggtcgtccagtatatctctgctactgcgaagagtggaggactgaagaacagcaaacacgaatgtactttaagttctcaagagtatgtccatgagctgaggtccggcatctctgacgagaaattgctgaattgtctagagtcactgagggtcagtctgacttcaaatcctgtaagttgggttaacaatttcggccatgaaggactgggactgttgctggatgaactggagaaactgctcgacaagaagcagcaggaaaatatagataaaaaaaaccagtataaactgatccagtgtctcaaagcattcatgaacaataagtttggcctccagcgcatcttgggtgatgagcgtagtctattgttgttagcacgggccattgaccctaagcaaccaaacatgatgactgaaatcgtgaaaatactgtctgccatctgtattgtaggagaagagaacattttggataaacttcttggcgcaataaccaccgcagcagagcgcaataacagggaaaggttttcccctattgtggagggtttagagaaccaggaagcgttgcagctccaggttgcctgtatgcagttcatcaatgctctggtcactagcccctacgagttagatttccggattcacctgcgtaatgagttcctgcggtctggcctgaagacaatgcttccagatcttaaggaaaaagagaacgacgagttggatatacagctgaaggtgttcgatgaaaacaaagaggacgatttaacggagctgtctcacaggttaaacgatatcagggccgagatggatgatatgaatgaagtgtatcacttgctgtacaatatgctcaaggataccgctgcagaaaattacttcctgtcgattttgcagcactttctgctgatccgaaatgattattacatcaggccccagtattataaaattatcgaagagtgtgtctctcagatcgtcctccattgttccgggatggacccagatttcaagtatagacagaggctcgatattgacttaactcacctgatcgactcatgcgttaacaaggcaaaggtagaggagtcagagcagaaagctgctgagttttcaaaaaagtttgatgaggagtttaccgctcggcaggaggcccaggccgaattgcagaaaagggacgaaaagattaaggaactcgaagcagagatccagcaacttcgcacccaggcccaggtgctatcctcatcgagcggcattccggggcctcctgcggccccaccactgcctggagtggggcctcccccccctccccccgccccgcctctccccgggggcgcaccacttccccctcccccaccccccttgcctggaatgatgggcattcctccccctcctccccccccgctcctgttcggaggcccccccccccctcccccgttgggcggtgtccctcccccgccgggcatcagtctgaacctaccgtatgggatgaaacaaaagaagatgtataaacccgaggtgtctatgaaacgtatcaattggtccaagatcgaaccaacggaactgtcagagaattgtttttggctgcgagtgaaagaggataagtttgagaatcccgacttgtttgctaaactggctctaaactttgccacccaaataaaggttcagaagaatgcggaagcactggaggagaaaaagaccgggcctaccaaaaagaaagtgaaagaactgcgtattttggatcctaagacagctcagaacctgtctatatttctaggctcttatcggatgccttacgaggatatcagaaatgtgattttagaagtgaatgaagacatgttgagtgaggcattgatccaaaacctagtcaaacatttgcctgagcagaagattctaaacgagctggctgagctgaagaatgagtatgatgacctctgcgagcccgagcaatttggagtcgtaatgagcagcgtcaaaatgttgcaacctagattgtcttccattctcttcaagctcaccttcgaggaacatatcaataatattaaaccctcgatcatagctgtcaccctcgcctgtgaggagctgaaaaaaagcgaatcctttaatagacttctcgaattagtgctgcttgtcggaaattacatgaattcaggctctaggaacgcccaatccctgggcttcaagatcaacttcctttgcaagatccgggatactaaatcagccgaccagaagacaaccctccttcactttattgcggatatctgtgaagagaagtaccgcgacatattgaaatttcccgaggagttagagcatgttgagtcggcgtctaaggtcagtgcacagatcctgaagtccaacctcgctagtatggaacagcagatcgtgcatctggaaagagacataaagaaattcccacaagctgaaaaccaacatgacaaattcgtcgagaagatgaccatctttactaaaacagctagagaacagtatgaaaaactgtcaactatgcataataatatgatgaagttatacgagaacctgggggagtacttcatttttgactcaaagacagtgtcaatagaggagttcttcggggatttaaacaattttcgcacacttttcctggaagcggtcagagaaaacaacaaaaggagagagatggaagagaaaaccaggagggctaaactagccaaggaaaaggcggaacaagagaagctggagaggcaaaaaaagaaaaagcagttgattgatatcaataaggaaggagacgaaactggcgtgatggacaatctcctggaagcactccagagcggcgccgcttttagagaccgcaggaagcggattcctcgcaaccccgacaacaggcgcgtgcccttagagagaagccggtctcgtcacaatggggctatttcttccaaatag

SEQ ID NO: 185323 - DNA, 3312 bp, Artificial Sequence
  Description of Artificial Sequence: Synthetic coding sequence
atggagcagcccggcgccgccgccagcggcgccggcggcggcagcgaggagcccgggggaggccgcagtaataaaagaagcgccggcaatagggctgccaatgaagaggaaacaaaaaacaagccaaagttaaacatccagattaagaccctggcagatgacgttagagacaggattacgtcctttagaaagagtacggtgaaaaaagaaaagcccttaattcagcacccaatagacagccaggtcgccatgagcgaattcccagctgcacagccactgtatgatgaacgctcactcaacttaagcgagaaagaagttcttgatctgtttgagaaaatgatggaagatatgaatctgaatgaggagaagaaggccccactgcggaacaaagatttcacgacaaagagagaaatggtggttcagtacatatctgctactgccaagtccatagttgggagcaaagttacaggaggcttgaaaaactcaaagcacgagtgcacactcagctcccaagagtacgtgcacgaacttcgctcgggaatctccgacgagaaactgctcaattgtctggaatctctgcgtgtttcgctcacttccaatccagtatcgtgggtgaacaatttcgggcacgaaggcctcggactgctcttggacgagttggagaagttgctggacaagaagcaacaggaaaatattgataagaagaatcagtacaaactgatccagtgcctgaaagcttttatgaataacaagttcggtctgcagaggatcttgggcgacgaaagaagccttctcctgctagcccgcgccatagacccgaaacagcctaatatgatgactgagatcgttaagatcctttccgcaatctgtatcgtcggcgaagaaaatattctcgacaaactgctcggggccatcacaacggccgctgaacggaacaacagagagaggttcagcccgattgtggagggcttagaaaatcaggaagccctgcagttgcaagtggcttgtatgcaatttataaacgccctagtaacctctccatatgagttggacttccggatacaccttaggaacgaatttctgcgttcaggcctcaaaacaatgcttccagacttgaaagagaaggagaacgacgaactcgatatccagctgaaggtgtttgatgaaaataaagaagatgatttgacggaattgagccacagactgaacgacatccgcgctgaaatggacgacatgaatgaggtgtatcatctgctgtacaacatgctcaaggacaccgccgctgagaactactttttatctattctacaacattttctcctcatcaggaatgactactatatccggccgcagtactataagattatcgaagaatgtgtatcccagattgtgctgcactgctccggaatggacccagatttcaagtaccggcaaagactcgacatcgacttgactcacctaatcgactcatgtgttaataaggctaaagtagaggagtctgagcagaaggcagccgaattcagtaaaaaattcgacgaagagtttaccgccagacaggaggctcaagcagaattgcagaaaagggatgaaaaaatcaaagaattagaagccgagatccagcaattacgtactcaagcacaggtcttgtcctccagctccggcattccaggccccccagcggctccgcccctccctggcgtgggaccccccccaccccctcctgctccccccctgccgggcggggcaccgctgcctccaccacctccccctttgccaggcatgatggggattcctcctccaccgcccccccctttgctgtttggaggtccccctccgcctccccccctgggtggggtgccccctccccccggcattagcctgaaccttccatacggcatgaaacagaaaaaaatgtacaaaccggaggttagcatgaaaagaatcaattggagcaagattgaacccacagaactgtccgaaaactgtttctggcttcgagtgaaagaggataagtttgaaaatcccgaccttttcgccaaattggctctaaactttgcgactcagataaaggttcagaaaaatgccgaggctctggaagaaaagaagaccgggcccactaagaagaaggtgaaggaattgcgcatcttagatcccaaaactgcgcaaaacctgagcatctttttggggagttatagaatgccatacgaagacatcagaaacgtaattttggaggtcaacgaagacatgctcagcgaagcgcttatccagaatcttgtcaagcacctcccagaacagaagatcttaaacgagcttgcggagctcaagaatgaatacgacgatctgtgtgagcccgagcagtttggagtggttatgtcaagtgttaagatgttgcagccccgcctaagttctattctgttcaagctgacctttgaagaacacattaacaacatcaagccctctatcatcgcagtgaccctggcatgcgaggagctgaagaaaagcgaatccttcaaccgcctgctggaactggtgctgctggtgggaaattacatgaactctggctctcgtaacgcacagtccctcggattcaaaatcaatttcctgtgcaagattcgagataccaaaagcgcagatcagaagaccacactgcttcacttcattgccgatatctgtgaagagaaatatagggacatactgaagttccccgaggaactcgaacatgtggagagtgcaagcaaggtgagcgcacaaatacttaagtcgaacctggctagtatggagcaacagatagttcaccttgagcgcgacatcaagaaatttcctcaagcagagaaccagcatgacaagttcgtggagaaaatgaccattttcaccaagaccgcacgggagcagtacgaaaaactctccacaatgcacaacaacatgatgaaattgtacgagaacctgggcgagtattttatttttgattctaagacggtatctatcgaggaattcttcggcgatttaaacaactttcgtaccttgtttctggaggccgtccgggaaaacaacaaaaggagagagatggaagagaaaacgcggcgggccaaactagccaaggagaaagcagaacaggagaaactggagaggcaaaaaaaaaaaaagcagctgattgatatcaataaggagggcgacgagaccggcgtgatggacaatctcctggaggctttacagtccggcgccgcatttcgcgatcggcggaaacggattcctcgcaacccagtggtaaaccacccatgtgctacacgcgccaatccacgctctgccacttag

SEQ ID NO: 185324 - DNA, 735 bp, Artificial Sequence
  Description of Artificial Sequence: Synthetic coding sequence
atggagctgttcctggccggccggcgggtgctggtgaccggcgccggaaagggtattggacgaggaaccgtacaagcactgcatgccactggcgcccgggtagtggcagtcagtaggacgcaggccgatttggattctctggtcagggaatgccccgggattgaacctgtttgcgtcgacctcggcgattgggaagccaccgagcgcgccctgggctctgtaggcccagtagacctgctagtgaacaatgcagcagtcgcacttttacaacctttccttgaggttacaaaggaagcgtttgacagaagcttcgaagtcaacttgcgcgcggtgatccaggtaagtcaaattgtagcccgaggactgattgcacgcggcgtacccggggcaattgtgaatgtttcatctcagtgctcacagagagcagtgacgaatcatagcgtgtattgctcaaccaagggtgcacttgatatgctgacgaaagtaatggccctagagctcggcccccataaaattcgggtaaacgcagtgaatccgacagtggtgatgacatccatgggacaggccacgtggtctgacccgcacaaagcaaagaccatgctcaacagaatcccactgggcaaattcgccgaggtcgagcacgttgtaaatgccatccttttcttactctcagataggtccggtatgaccacgggctcaaccctgcctgttgaaggaggattttgggcatgttag

SEQ ID NO: 185325 - DNA, 5769 bp, Artificial Sequence
  Description of Artificial Sequence: Synthetic coding sequence
atgaagagccccgccctgcagcccctgagcatggccggcctgcagctcatgacccctgcttcttcgcctatgggacccttctttggtctcccttggcagcaggaggccatccacgataatatctatacaccgagaaaataccaggtcgagctcctcgaggctgcccttgaccataacacaattgtgtgcctgaacacgggtagtggcaagacttttatcgctgtgctgctgaccaaggaactgagctaccagatcagaggagacttcagccgcaatggaaaaagaacagtgttcctcgtcaatagcgctaaccaagtggcgcagcaggtatcagcggtgcgcacccacagcgatctgaaggtcggcgaatattcaaacctggaagtgaacgccagctggactaaggagcgatggaaccaagaattcaccaaacatcaggtgctgattatgacatgttatgtggcccttaacgtcctgaagaatggatacctatccctgtccgacatcaatttacttgtttttgatgagtgtcatctggctatactggaccacccatatagagagattatgaagctgtgtgaaaactgtccatcttgccctcgcattctgggcttaacggcttctatattaaatggaaagtgtgatcccgaagagttagaagagaagattcagaaactcgaaaaaatcttgaaaagcaacgcagagaccgcaacggatcttgtggtgctggataggtacacctctcaaccttgtgagatagtggtcgattgtggccccttcacagaccggtccgggctgtacgagcggctccttatggagcttgaggaggctctcaattttattaacgactgtaatatatcggttcactctaaagaacgcgattcaacgctcatttctaaacaaatccttagtgactgcagagccgtgctcgtagtgctggggccgtggtgtgcagacaaagtcgccggaatgatggttagagaattgcaaaagtatattaaacacgaacaagaggagctccacaggaagtttttgctttttactgacacttttctgcgcaagattcatgcactctgtgaggagcacttctcacctgcgtcactggacttgaagttcgttacacctaaggtgatcaagcttctggaaattttacggaagtataaaccttatgaaagacaacagttcgagagtgtcgaatggtataataaccggaaccaggataactacgtgtcatggtccgatagcgaagatgatgacgaagacgaagagatcgaggaaaaagaaaaaccagaaaccaacttccctagcccgtttactaatatcctgtgtggaataatcttcgtggaacggaggtatactgcagtcgtactgaatagattgattaaggaagccggtaagcaagaccccgaactggcatacatctcctctaatttcatcaccggacacgggattggcaagaaccagcccaggaacaagcagatggaggccgagtttcgcaagcaggaagaggtgctgcgaaagtttcgtgcacatgaaactaatttactcattgcaacatcgatcgttgaggagggggtggacattcccaaatgtaacctggtcgtgcggtttgatcttcccacggaatacagatcttatgtgcagtccaaaggaagagcgcgcgcgccaatctccaattacattatgctcgctgacacagacaagattaagagctttgaagaggacctgaagacatacaaggccatagagaaaatcttacggaacaagtgtagcaagagtgtcgatacgggggagacagacatcgatcccgtgatggacgacgatgacgtgttccccccctatgttctcaggccagatgacggcggtcccagagtgacaatcaacacagcaatcggtcatatcaacagatattgcgccaggctaccgtcagacccttttactcatctggctccaaaatgcagaacaagagagctgccggatggtacgttttactccacactgtacctccctatcaattcgccactgagggcgagcattgttggaccccctatgtcctgcgtgaggctcgccgagcgcgtcgttgcgcttatctgttgtgaaaagttgcacaaaatcggcgaattggacgatcacctgatgcccgtgggcaaggaaacagtcaaatacgaagaggagctagatttgcacgacgaagaggaaacatcagtcccaggaaggcctgggtccactaaaagacggcaatgctacccgaaggccatacctgagtgccttcgcgatagttatccgcgccctgatcagccttgttacctgtacgtgattggtatggtccttactaccccattgccagacgaattgaattttaggcgcagaaaactatacccgcctgaggataccactcgatgcttcggcattcttacggcaaagcccatcccacagataccccatttccccgtctatacccggtctggagaggttactatcagtattgaactgaagaagagtgggttcatgctgtctttacaaatgctcgaattgatcacccggctgcaccaatatatattcagccatatcctaagacttgagaagccagccttggagttcaaacctacagacgccgattcagcctactgtgttttgcccttgaacgtggtgaatgattcgagcactctggacattgattttaaattcatggaagacattgaaaaaagcgaggctcggatcggtatacccagcaccaaatacaccaaggagactcccttcgttttcaaactcgaggattaccaggacgcggtaataattcctcgctatcgaaacttcgaccaacctcataggttctatgtcgccgacgtctataccgatttaacccccctttcaaagtttccatccccggagtacgagacatttgcagaatactataaaactaaatacaatcttgacctgactaatttgaaccagcccttacttgatgtagaccatacttcatccaggttaaatctgcttactcccagacacttaaatcagaaggggaaggcgcttccactcagttccgcagaaaagcgcaaagctaagtgggaatctctgcagaataagcagatcctggtcccagaactttgtgccattcaccccatccctgccagcctgtggcgcaaggccgtctgccttccatctattctgtatcggctgcactgtttgctgactgcggaggagctgagagctcagacagcctctgatgccggtgtgggggttcgctcactaccagctgatttcagatacccaaacctggactttggatggaagaagtctattgattctaaatctttcatttccatttctaactccagctctgcggagaacgacaactactgtaaacactcaacaattgtccccgaaaacgctgctcatcagggtgcaaacaggacgagttccctcgagaatcacgaccagatgagtgtgaactgccgaacactgctttcagagagcccaggtaagctgcatgttgaggtttccgcagacttgacagccatcaatggactcagctataaccaaaatctggccaacggctcatacgacctcgccaatagggacttttgccaaggtaatcagctgaattattacaaacaggaaatccccgttcaacctaccacctcctattcgatccaaaatttgtattcctatgagaatcagccccaacctagcgacgaatgcactctcctctctaataagtacctagacggcaatgcaaacaaaagcacctcagacggttctcctgtgatggctgtgatgcctggcacaacggacactattcaggttctgaagggccggatggacagtgaacagagccctagcatcggttattctagtaggactctggggccgaacccaggcttgatcttgcaggctctgaccctgtcaaatgcctctgatggttttaatctggaacgcctcgagatgcttggcgattcatttttgaagcacgcaataactacttatttgttctgcacataccccgatgcgcacgagggccgcctgtcctacatgcggtcaaagaaagtctcaaactgcaatctgtaccgcttgggaaagaagaagggccttcccagtcgcatggtggtctctatattcgacccgcccgtcaattggcttccacccggctacgttgtgaaccaggacaagagcaacacagacaagtgggagaaggacgagatgactaaggactgcatgttggccaacggaaagctggacgaggattatgaggaggaggacgaagaagaggaatcactcatgtggagggctcctaaggaagaagctgactatgaggatgacttcctcgagtatgatcaagaacatattcgcttcatcgacaatatgctgatgggttccggcgcattcgtcaagaagatcagcctcagccctttctcaaccactgatagcgcctacgagtggaaaatgcccaagaaaagttcactcggcagcatgccattttcctctgacttcgaggatttcgattatagtagctgggatgcaatgtgctacctggatccaagcaaggccgtcgaagaggacgatttcgttgtaggcttctggaaccctagcgaggagaactgcggtgtggataccgggaaacagagtataagttatgacctccataccgaacagtgcattgcagataaatccatcgcagattgcgtggaggctctgcttgggtgctacctgacttcttgcggcgaacgggccgcccagctttttctgtgtagcctgggacttaaagtgctgccggtcattaagaggacagacagagagaaggctctgtgccccacccgagagaatttcaattcacaacaaaagaatctttccgtaagctgtgccgccgcgtccgtggcctcttcaaggagttccgttctgaaggacagtgaatatgggtgcctgaaaatcccccctcgatgcatgttcgaccaccccgatgccgacaagaccttaaaccaccttatctccggcttcgagaatttcgagaaaaagatcaactaccgctttaaaaacaaggcctacctgctgcaggcttttacacatgcctcctaccactacaacactatcacagactgttaccagagactcgaattcctgggggacgccatcctggactacctgataacgaaacatctgtatgaggatccgagacagcactcccctggagttctgaccgacctgcgtagcgcgttagtgaataacaccattttcgcctctctggcggttaagtacgactatcataaatattttaaagcagtgagtcccgagctctttcacgtaatagacgattttgtgcagtttcagctcgaaaagaatgagatgcaagggatggattccgaactgagacgaagtgaagaggatgaggaaaaggaggaagacatcgaagttccaaaagctatgggagacattttcgagtctctagccggcgccatctatatggactcagggatgagcctggagacagtctggcaagtgtattatcctatgatgcgccccttgatcgagaaatttagcgcgaacgtcccacggtctcccgtcagagagctactggagatggaaccagaaaccgctaaattttcgcccgccgagaggacctacgatggaaaggtgagagtcaccgttgaggtggtcggaaagggtaaatttaagggcgtggggcggtcctaccgaattgccaagtctgcagctgcaagaagggctctcagatcactcaaggccaaccaaccacaggtccctaattcctag

SEQ ID NO: 185326 - DNA, 5769 bp, Artificial Sequence
  Description of Artificial Sequence: Synthetic coding sequence
atgaagagccccgccctgcagcccctgagcatggccggcctgcagttaatgacccccgcctcttccccaatggggccattctttggcttgccctggcaacaggaagctatccatgacaatatctatacaccaagaaaataccaggtggagctccttgaggctgctttggaccacaacacgatcgtttgtctgaataccggcagcggaaagacctttattgcagtgctgttaaccaaggaactgtcctaccagatccgtggagacttcagtcggaacggaaagaggacagtgttcctagtaaacagcgctaaccaagtggcacagcaggtgtctgctgttcgtacacactcagacctgaaggtcggcgaatactccaacctggaagtgaatgcttcatggactaaggaacggtggaaccaggagttcactaagcaccaggtactcatcatgacatgctatgttgcactcaacgtgttgaagaatggctacctgtcactttcggacattaatctactggtttttgacgaatgccacctggccattctggaccacccctacagggagattatgaaattgtgcgaaaactgtccctcatgccccaggattctgggattgacagcgtccattcttaacgggaagtgtgatccagaagaactcgaggaaaaaattcagaagctggagaagatcctgaagtccaacgctgaaaccgcaactgacctggttgtcctggacaggtacacttcccagccttgcgaaattgttgttgactgcggtccatttaccgataggtccggcctgtacgagaggctgcttatggagcttgaggaagccctgaacttcatcaatgactgtaatatctctgttcacagcaaagagcgggacagcactcttattagtaaacagatccttagcgactgtagggcagtgctggtggtcttagggccttggtgcgccgataaggtggccgggatgatggtgcgagaactgcagaagtatataaagcacgagcaggaggaacttcacaggaaattcctcctgtttactgacacatttctgcgtaaaattcatgccctttgtgaagagcactttagtccggcgagcctggaccttaaattcgtcacccccaaggttatcaagctcttagagattctgagaaagtacaaaccatatgaaaggcaacagttcgagagtgtcgagtggtacaataacagaaatcaggacaattacgtcagttggagcgattccgaggatgacgatgaagatgaggagatcgaagagaaggagaaacccgaaacaaactttccaagcccttttaccaacatcctttgcggtattattttcgtggaacgtcgatacactgccgtcgtgctgaataggttgattaaggaggcaggcaagcaggaccctgaattagcctacattagttctaactttatcaccgggcacggcattggtaagaaccagcctaggaacaagcagatggaggctgagttccgcaaacaggaagaagtcttgcggaaatttcgagctcacgagactaacctgcttatagctacatccatcgttgaagaaggtgtggacatcccaaaatgtaatctggtggtgcggttcgatctgcccaccgagtacaggtcctacgtgcagtcgaagggcagggcaagagcccccatttccaactatatcatgctggcagacaccgataagattaaatcctttgaagaggacctcaagacttacaaggcaatcgagaagattttgagaaataaatgcagtaaatcagtggatactggagaaacagacatcgaccctgtgatggacgacgacgatgtgtttcctccttacgtccttagaccagacgacggaggaccccgggtgacaattaacacagctattggccatataaacagatattgcgctcgtttaccgagtgacccatttactcatcttgctcccaagtgccgcacccgggagctgccagatggcacgttttacagtacactctatctgccgatcaattctcccctgagggcaagcatcgtgggtcctcccatgagttgcgtgcggttggccgagcgggtggtggccctcatttgctgtgaaaagttacacaaaattggcgaactcgatgatcacctgatgcccgtaggtaaagagaccgtgaaatacgaggaggagcttgacctccacgacgaagaagagacatcagtccctggcaggcccggaagcacaaaacggaggcagtgctatcccaaggccatacctgagtgtctccgcgactcttatccacggcctgatcagccttgctatctgtatgtgattgggatggtcctgacaaccccactgccagacgaactgaacttccgaaggcgcaagctctatccccccgaagacacaacgagatgcttcggaatccttactgcaaagccgatcccccaaatcccccacttcccagtgtatacaagatccggtgaggttacaatttctatagaactgaaaaagtccgggttcatgcttagtctgcagatgctcgagctcattactcgcctgcatcaatacattttctcccatatcctgaggcttgaaaagcccgcattggagtttaagcccacagacgctgactccgcgtactgcgttctgcccctgaatgtagttaacgattcctccactctggacattgatttcaagttcatggaggatatcgagaagtccgaggctcgcatagggattcccagcactaaatacaccaaggagacacccttcgtcttcaagctggaagattatcaggacgccgtcatcatacccaggtaccggaatttcgaccagcctcataggttctatgttgcagatgtgtatactgacctgaccccattgtctaagtttccatctcccgagtacgagacgtttgcggagtattacaagactaagtacaacttggatctgacaaacctcaaccaaccattgctggatgtggaccacacaagctcccggctaaatctgcttaccccccgtcatttgaaccagaagggcaaagccttacctctctccagtgccgaaaaacgaaaggcgaagtgggagtcactccagaataaacagatcttggtgcccgaattatgcgccatacaccccatcccggccagtctgtggcgaaaagcagtatgtctgccctccattctgtatcgccttcactgcctcctgaccgcagaggagctgcgggcgcagacagcctccgacgctggggtgggcgtgagatcattacccgccgatttccggtatccaaatctggacttcggatggaagaagagtatcgacagtaaatcttttatctctatctccaatagctcctctgccgaaaacgataattactgtaaacacagcacaattgttccagaaaacgccgcccaccagggcgcgaatagaactagctctctggaaaaccatgaccagatgtcagtaaattgcaggacccttctctctgagtctccaggaaagctccatgtagaagtgagcgcagatcttacagcaatcaatggcctctcatacaaccagaatctggctaatggttcatatgatcttgccaaccgggacttctgccaggggaatcagctgaactactacaagcaggagatccccgtgcaaccaaccacctcttatagcatccagaacctgtactcctacgagaaccagccccagccatccgacgagtgcacacttttgtctaacaaatacttggacggaaacgccaataagtctacgtcagacggcagtccagtgatggcggtgatgcccggcacaactgacacaattcaggtcctgaagggccggatggactcagagcagtcaccttctatcggttattcttctaggactctgggccccaacccaggcctgatcctgcaagccctgactttaagtaacgcaagcgacggctttaacttagagcggttagagatgctaggtgattccttcttgaaacacgccatcacgacctacttgttctgtacctaccctgatgcacacgagggaagactaagctatatgaggagtaagaaggtgagtaattgcaacctttaccgacttgggaaaaagaaggggttaccatcaagaatggtcgttagcattttcgatccacccgttaattggcttcccccaggctatgtagtcaaccaagataagtccaatacagataaatgggagaaggatgagatgaccaaggattgcatgctcgcgaacggtaaactcgatgaagattatgaggaggaagacgaggaggaagagagtttgatgtggcgggcccctaaagaggaggcagattacgaggatgacttccttgagtacgatcaggaacatattaggtttatcgataacatgcttatgggcagtggagctttcgtgaaaaagatcagtctgtccccattctcaaccacggattccgcctacgagtggaaaatgccaaagaagagttcactggggagcatgcctttttcttctgacttcgaggacttcgactacagcagctgggatgcgatgtgttacctggatcccagcaaggccgtagaggaagacgatttcgttgtgggtttctggaatccttccgaagagaactgcggtgtggacacagggaagcagtccatttcctatgacctacataccgaacagtgtattgccgataagagcatagcggactgcgtagaggcactgctggggtgctacctgacgagttgcggagagcgggcggcccagctttttctctgttctctgggcctgaaagtgctccctgtaataaagagaacagacagggagaaggcactgtgcccaaccagagaaaactttaactcccagcagaagaatctgtctgtcagctgcgccgcagcctctgttgccagctcaaggagttctgtgttgaaagacagcgagtatgggtgcctaaagattcctccccgctgtatgttcgaccaccctgacgcagataaaactttgaatcacctgatctctgggttcgagaacttcgagaagaagataaactacaggtttaagaataaagcttacttacttcaggctttcacccatgccagctaccattataatacaatcaccgactgctaccagagactagagtttttgggcgacgccatcctggattatctgatcacaaagcatttgtatgaggacccccggcaacattccccgggggtactgacagatctgcggtccgctctcgtgaacaatacaatatttgcctctctcgctgtgaaatacgactaccacaaatattttaaagccgtgagcccggaactcttccatgtaattgatgactttgtgcaatttcagctcgaaaaaaacgagatgcagggaatggactccgaactgaggcggtcagaggaggacgaggagaaggaggaggatattgaagtacccaaagcgatgggggacatttttgagtccctggcaggagccatttacatggatagtgggatgtctttagagacagtgtggcaggtgtattaccctatgatgaggcctcttattgagaagttctctgcaaacgtccctagatccccagtgagggagctcctggaaatggaacccgagacggccaagttctcccccgcagaaagaacttacgacggcaaagtccgggtcactgtggaagtggtgggaaagggcaagttcaagggtgtgggcaggtcttataggattgctaaatctgccgctgcccggagggctttacgctccctgaaggccaatcaaccacaagtgcccaactcctag

SEQ ID NO: 185327 - DNA, 5769 bp, Artificial Sequence
  Description of Artificial Sequence: Synthetic coding sequence
atgaagagccccgccctgcagcccctgagcatggccggcctgcagctgatgactccagcttccagccccatgggaccttttttcggcctcccatggcagcaggaggctatccacgacaacatctacaccccgcgtaaataccaggtggaactgctggaagctgccctcgaccacaacactatcgtctgccttaatacgggatctggcaaaacgtttattgccgtattgctaactaaggaactgagctatcagattcgtggggattttagccgcaacggaaaacgcacagtttttcttgtaaattctgcaaatcaagtagcccagcaggtatccgccgtgcgaactcactccgacctcaaggtgggcgagtactccaacctggaggtaaatgcatcttggacaaaagagagatggaaccaggaattcactaagcatcaggtgttaataatgacttgctacgtcgccctgaacgtgctgaaaaacggctacctgagtctgtctgacattaacttgctggtgtttgacgagtgtcacctggccattctggaccatccttatagagagattatgaaactatgtgagaactgcccctcttgtccccgcattctcggattgacagcatctatcctgaacgggaaatgtgaccccgaagagctggaggaaaagatacaaaaactcgagaagattctcaagagcaatgcagaaacagcgacagacctggtggtgctggatcgatacacaagccagccatgtgagatcgtggtggactgcggcccattcacagaccgcagtggcctgtatgaacggcttctaatggaactggaggaggcactcaactttattaatgactgtaacatctcagtgcatagcaaggaacgagactccaccctcatttctaagcagattcttagtgattgccgagccgtgctggtggtgctggggccatggtgcgcagacaaggtggccggaatgatggtgcgggaattgcagaaatatataaaacacgagcaggaagagctgcaccgaaagtttctgctgtttacagacaccttcctgcgcaagatccacgcgctttgcgaagaacactttagcccagcatctctggacctgaagtttgttactcctaaagtcataaaactgctggagatattgcgcaaatataaaccctatgaaagacagcagtttgaaagtgtggagtggtataacaatcgtaaccaggacaattacgttagctggtcagattcagaggacgatgacgaggacgaggaaatcgaggagaaggagaaacccgagacaaatttcccctccccctttaccaacatcctctgtggaatcatcttcgtagaaaggcgctacacagcagtcgtcctcaatcggcttatcaaagaagccggcaagcaggatcctgagctggcatatatctcttccaattttatcactgggcatgggatcggcaagaatcagcctcgcaataaacaaatggaagcggagtttcgaaagcaagaagaggtgctccgcaagttccgggcacacgagaccaacctcctcatcgctactagtattgtggaggagggagttgatattccaaaatgtaatttagtagtcagattcgatctcccgacagagtaccgctcttatgtccaaagcaaaggacgcgcaagagcaccaatatcaaattatataatgctcgctgacacagataagattaaaagcttcgaggaggacctcaagacttacaaagctatcgaaaagatattgcggaataaatgttcaaagagtgtggacaccggagaaacagatatcgatcctgtaatggacgatgacgatgtgttccctccttatgtgttgcgccccgacgatggcgggcctcgcgttacaataaatactgcaatcggccacattaatcggtactgcgcccgtctgcccagtgacccttttacacacttagccccaaaatgtagaacacgtgaattgcccgacggcacattctactcaactttgtacctgcctattaactccccgctacgggcgtctatcgtggggccccccatgtcgtgtgtccgactggcagagcgtgtggtagcattgatctgctgcgaaaagctgcacaagataggagaacttgacgaccacctgatgcccgtcggaaaagagaccgtgaagtatgaggaagaactggatttgcacgatgaggaagaaacttcagttcctggccgccccggttcaaccaaacgcaggcaatgctatcctaaagccatcccagaatgcctccgcgattcctacccacggcccgaccagccatgttatttgtacgtgatcggtatggtgctgacaactcccctccccgacgaacttaattttcgcagaaggaaattgtacccccccgaggatacgaccaggtgctttggcatcctaactgcaaagcctatcccacagatcccacattttccagtgtacacacgaagcggcgaggtcacaatatctattgagttgaagaagtccgggttcatgttaagtttgcagatgctggaactgattacaaggctgcaccagtatatattcagccacattttacggttggagaagccagcgctggagttcaaaccgacagacgctgacagtgcctactgtgtgctacccctgaacgtggtcaatgattcaagcactctggatatcgactttaaattcatggaggatatcgagaaatcagaggcccggattggtattccctctacaaagtacaccaaggagactcccttcgtctttaagttggaggactatcaagacgcagttattataccgagatatagaaacttcgaccaaccccacagattttatgtcgcagacgtttatactgatcttacccccctgagcaaatttccgagcccagagtatgagacttttgcagaatattataagacgaagtacaacttagatcttactaacctcaatcaacccttgttagacgtggaccacacttcttccagacttaacttactgaccccccgtcatctcaatcaaaagggcaaagcccttcccctttccagcgctgaaaagaggaaggccaagtgggagtctttacaaaataagcagattctggtgccggagctgtgcgccattcaccccatcccagcgagtctctggaggaaggccgtgtgcctgccttctatcctgtatagactgcattgtctgcttacagcggaagagttgcgtgctcagactgcgtcagacgcgggtgttggcgtcagaagtctgcccgccgacttcaggtatccgaatcttgacttcggatggaagaagagcatcgactcgaagtcttttatctccatcagtaattcttccagtgcagagaacgacaactactgtaagcacagtacaatcgtaccggagaacgccgcgcatcagggcgctaacaggaccagctctctggagaatcacgaccagatgtccgttaactgtcgtacgctgttgtctgagtcaccgggaaaattgcatgtcgaagtcagcgctgaccttactgctataaatggactgtcctacaatcagaatctggcgaacggcagttatgacctggcaaaccgggatttttgtcagggcaaccagctcaattattacaagcaagagatccctgttcaacccacgaccagctacagcatccagaacctgtacagctatgagaatcaaccccagccaagcgatgaatgtacccttctgtctaataaatatctagacggcaatgcgaataaatctactagcgatggatcgccggtgatggcggtcatgcccggaactaccgacactattcaagttttgaagggacgcatggacagtgagcaaagcccaagtatcggctactcaagtcgaaccctggggccgaatcctgggctgattctacaggcccttactctgagtaatgcgtcagacgggttcaatctggagcgcctggagatgctcggggatagcttcctcaaacatgctataaccacttatcttttttgcacctatcctgacgcccacgagggtcggcttagttatatgaggtcaaagaaggtgagcaactgcaacctgtatcggcttggaaaaaaaaaaggcctcccatcacgtatggttgtttcaattttcgatccacctgtaaactggcttccaccaggctatgtagtcaatcaagataagagtaacactgataagtgggagaaagatgaaatgacaaaggattgtatgctggccaatgggaaattggacgaggactatgaggaagaggatgaagaagaagaatctctgatgtggagagcacccaaggaagaggccgattatgaagacgactttctagaatatgaccaagagcatatccggtttatcgataatatgttgatgggcagcggcgctttcgtgaaaaagatcagcctctcacccttcagcactaccgactcagcgtacgagtggaagatgcccaagaagagcagcctcggaagcatgcccttctcttcagattttgaggattttgattattcatcttgggacgcgatgtgctatctggacccatccaaagcagtggaggaagatgatttcgtggtaggcttctggaatccgtcagaggagaactgcggggttgacactgggaagcagtccatttcctacgaccttcacacagaacagtgtattgctgacaaaagtattgctgactgtgtcgaagctctgctcggctgctatctgacttcctgcggagagcgggccgcccagctattcctgtgcagcctgggtctgaaggtccttccagtgatcaaaaggacagatagagaaaaagctctgtgcccgacaagggagaacttcaactctcaacaaaagaacctgagcgtgagctgtgccgctgcctctgtggcctcgtcccgaagctcagttttgaaagactctgagtatggctgtcttaagatcccacctaggtgcatgtttgatcacccggatgcggacaagacactgaaccatttgataagtggattcgagaacttcgaaaaaaaaatcaactaccggttcaagaacaaggcgtatctgctccaggcctttactcacgcctcctatcactacaacacaatcaccgattgttatcagagattggagttcctgggcgacgctatccttgattacctaatcacaaaacacctgtatgaggacccaaggcagcattcacccggagtgctgactgatttgaggtctgctttagtgaacaatacaatctttgcctcactcgctgtgaagtatgactaccataagtactttaaggccgttagtccagagctctttcacgtaattgacgacttcgttcagtttcagctggaaaagaacgaaatgcaggggatggactcagaactgcggcggtccgaagaggacgaagagaaagaggaggacatcgaggtccccaaggctatgggggacatttttgagagcctggccggagccatctacatggacagcggtatgtctctggaaacagtttggcaggtctactacccgatgatgagaccactgatcgaaaaattcagcgctaatgtgcctagatcccctgtgcgagagctcctagaaatggagcctgagactgctaaattttctccggcagagcggacctacgatggcaaggtccgggtgactgtagaggtagtagggaagggaaagtttaaaggggtcggacgctcataccggatagccaagtctgccgccgccaggagggcattgagaagcctaaaggccaaccaaccacaggtccccaacagctag

SEQ ID NO: 185328 - DNA, 5769 bp, Artificial Sequence
  Description of Artificial Sequence: Synthetic coding sequence
atgaagagccccgccctgcagcccctgagcatggccggcctgcagctcatgacccctgctagctcccccatgggccctttctttgggctcccttggcagcaggaagccattcatgataatatctacacgcctcggaagtatcaagttgagttgttggaggccgccctggaccacaataccattgtttgtctgaatactgggtccggcaagacatttattgccgtgttgctgaccaaagagctttcctaccagattcgcggggacttcagtagaaacgggaaaagaacagtgtttcttgtgaacagtgctaatcaggtggcgcagcaggtgagcgctgttagaactcattcggacttgaaagtgggcgagtactccaacctggaagtgaacgcaagttggaccaaagagagatggaatcaggaatttacgaagcatcaggttctcattatgacatgctatgtggcactgaatgtgctcaagaacgggtatttaagtctgtcagatatcaacctcttggtgttcgacgagtgtcacctggccatcctggatcatccctaccgcgaaattatgaagctgtgcgagaattgtccgtcctgcccgagaatcctgggtcttacggcatctattctaaacggcaaatgtgaccctgaggagctggaagagaaaatccaaaagctggaaaagattcttaaatcaaatgcagagacagcgactgatctcgttgtgctggatagatataccagccagccatgtgagatcgtcgtagactgcggccccttcacggatagaagtggactttacgaaagactcctcatggagctggaggaggctcttaacttcatcaacgattgcaatattagtgtgcacagcaaagagagggatagtactctgatctccaaacaaattctaagcgattgcagagccgtgctggtggtgctaggcccgtggtgtgctgacaaggtggccggaatgatggtccgggagctgcagaagtacataaagcacgagcaagaggagctacatagaaaattccttctttttaccgacacatttttgaggaagatccacgccctctgtgaagaacatttttcgccggcctccctcgacctgaagtttgtaacccctaaggtgatcaagttgttggaaatactgcggaagtataaaccgtacgagaggcaacagtttgaaagcgttgaatggtacaataacaggaatcaggacaactacgtatcatggtcggactctgaggacgatgacgaagatgaggagattgaagagaaggagaaacccgaaaccaatttcccatcaccgttcactaacatcctctgcggcatcatctttgtcgagaggcgctacaccgccgtggtcctgaacaggctcattaaagaggcgggcaagcaggacccggaattggcctatattagttctaactttatcacaggtcatggcatcggtaagaaccagccccgcaataaacagatggaggctgagttccgaaagcaggaagaggttctaaggaaattccgagcacatgaaacaaatctcctgatcgccacaagtatcgtggaagaaggagtggacatccctaagtgtaacctcgttgttaggttcgacctacctaccgaatataggagctatgtgcaaagcaagggcagggcacgcgcacctatcagtaactacatcatgctggctgatactgacaaaatcaagtcctttgaggaagatttaaagacctataaggccattgaaaaaatcctgcggaataaatgcagtaagagtgtcgataccggggagaccgacatcgaccctgttatggacgatgatgatgtcttcccgccctacgttctgcgacccgacgacggtggccccagagtcacgattaacacagctattgggcacatcaatagatattgtgctcgtcttcccagcgaccccttcacccacctggcaccaaaatgccgtacacgggaactgcccgatggcaccttctatagcacactttaccttccaataaactctccacttagggcttcgattgtaggaccccctatgtcttgcgttcgcctggccgagcgagtggtagcgttgatttgctgcgagaagcttcacaaaattggggagctcgacgatcacctgatgccggttgggaaagagacagtgaaatacgaggaggaattagacttgcacgacgaagaagaaacgagtgtccccggtcgtccaggcagcaccaagcgaagacagtgttatccgaaagcgatcccagagtgcctgcgggattcctatcccaggcctgaccaaccctgctatctgtatgttattggcatggtgctaacgacgcccctcccggacgagctgaattttcgaaggcggaaactctacccacccgaggataccaccaggtgtttcggcattcttaccgccaaacccattcctcagatcccccactttccagtgtacaccagaagcggagaggtgactatttcaatagaactaaaaaaatcggggtttatgttgtccttacagatgctcgagcttattactcggctgcaccagtatatcttctctcacatactgaggttagaaaagccggcactggagtttaaacctacagacgccgactcagcttattgcgtcctacccctgaacgttgttaatgatagttctaccctggatatcgatttcaagttcatggaagacattgaaaagtcagaagcgcgtatcggaatcccaagtacaaaatatacgaaggagactccattcgttttcaaattagaagattaccaggacgccgtgataatacctcgttacagaaatttcgaccagccccatcgcttttacgttgcagatgtgtatacagatctgactcccctatcaaagttcccctccccggagtacgagacttttgcagaatactataaaactaaatataacttggatcttactaacctcaaccaaccgctgctcgacgtggatcataccagttccagacttaatttgcttactcctagacatctgaatcagaaaggcaaggccctccccctgtccagtgccgagaagcggaaagccaagtgggagtccctgcaaaacaaacaaatcctggttcccgagctgtgcgctattcatccaattcctgcctcactgtggcggaaagctgtgtgtttgccatctattctgtaccggctgcactgtttgctgaccgctgaggaactgcgtgcccagacggcaagcgacgcaggtgtgggagtgcgctcactccctgctgattttaggtatcctaaccttgatttcggctggaagaaaagtatagactcaaaatccttcatcagtatatcaaatagctcgagcgccgagaatgacaactattgcaaacatagcaccattgttcctgagaacgctgcccaccagggtgcaaataggacaagcagtctggaaaatcacgaccagatgagtgtcaattgccgcacactgctgtctgagtcccctggaaaattacacgtggaggtgagcgcagatctcaccgctattaatgggctttcgtataaccagaatttggctaacggctcctacgatctggccaaccgggatttctgtcaaggaaatcaactcaactactataagcaggaaattcccgtgcagcccactacatcatacagcatacaaaatttatactcctacgagaaccagccacagcctagcgatgagtgtactctgttgtctaataagtatcttgatggaaacgccaacaagagcacttcagacggcagcccagtcatggctgtgatgccagggaccactgacaccatacaggtcctgaagggaagaatggattctgagcagtcgcccagcatcggatactcctccaggacgctcggacccaatccagggcttatacttcaggcattgaccctgtcgaacgcctcagacggatttaatctagagcgcctagagatgctcggcgacagtttcctcaaacacgctattacaacctatttattctgtacttatccagatgcacacgagggcagactgagctacatgagaagcaagaaggtgagcaactgtaatctatatcggctgggcaagaagaaaggcctgccttcaaggatggtcgtttccatctttgatccccccgtcaattggttgcctcccggttacgtcgtgaaccaggataaaagcaataccgacaagtgggagaaagatgaaatgactaaagactgcatgttagccaatgggaaactggacgaagattacgaggaggaagatgaggaagaagagtccctgatgtggagagcccctaaggaggaggcggattatgaagatgattttttagagtatgaccaggagcatatccgattcatagacaatatgttaatgggaagtggagccttcgttaagaaaatctccttgagccctttctccactacagattcagcctacgagtggaaaatgccaaagaaaagctcgttgggctcaatgccattctcgtcagatttcgaggacttcgattactccagctgggatgctatgtgttatctggatcctagcaaagccgtggaggaagacgattttgtggtgggattttggaatccttcagaggaaaactgcggtgtagacactggaaagcaaagcatcagctacgacttacacacggaacaatgtattgcagataaaagcattgcagactgcgtggaagcgctgttgggctgctaccttaccagctgcggggagagagcggcacagctgttcctttgttctcttggtctgaaggtactccccgtaataaaacggacggaccgcgagaaagctctttgtccaactagagaaaactttaactcccagcagaagaacctgtccgtttcatgtgccgctgcttctgtggcttccagccggtcctctgttctgaaggattcagaatacggatgtctcaagattccaccaaggtgcatgttcgatcaccctgatgccgacaaaacccttaaccatcttatcagcgggttcgagaacttcgagaaaaagatcaactaccggtttaagaataaggcctatctcctgcaagcgttcactcatgcctcataccactataacacaattactgactgctatcagaggctggagtttctcggcgacgctatcctggattatctcatcacaaagcacctttatgaggacccccgccaacatagcccaggagttctgactgacctgcggtccgcgttggtcaataacaccatcttcgcgtcactggctgtcaaatacgactatcacaagtatttcaaggcagtgtcaccagagctcttccacgtgatcgacgacttcgtgcagtttcagcttgagaagaacgaaatgcagggcatggactccgaactgagaaggagcgaagaagacgaggaaaaagaggaggacatagaggtgccgaaagcaatgggggacatctttgaatccttagcaggggccatctacatggactcgggaatgagcctggaaacggtgtggcaagtatattacccgatgatgcgtcccctaatcgaaaaatttagcgccaacgtgccaaggtcacctgtgagagagctcctggagatggagcccgagactgctaaatttagtcccgctgaacgcacatatgatggcaaggtgcgagtaacagtggaagttgtcgggaagggcaagtttaaaggggtcggccggtcctaccgtatcgccaaatctgcagccgcacggcgggccctgaggtctcttaaagccaaccagccacaggttcccaatagttag

SEQ ID NO: 185329 - DNA, 213 bp, Artificial Sequence
  Description of Artificial Sequence: Synthetic coding sequence
atgaagagccccgccctgcagcccctgagcatggccggcctgcagcttatgactcctgcttcctctccaatgggcccattcttcggcctgccctggcaacaggaggctatccacgacaacatctacactccaaggaagtatcaggtggagctgctagaagctgcactggaccataacactatagtttgcttgaacaccgggagcggaaagtag

SEQ ID NO: 185330 - DNA, 213 bp, Artificial Sequence
  Description of Artificial Sequence: Synthetic coding sequence
atgaagagccccgccctgcagcccctgagcatggccggcctgcagctcatgacacccgcgagcagtcccatgggtccttttttcggtctgccttggcaacaagaggccattcacgacaatatttacacaccgagaaagtaccaggttgaactgctcgaggcagccctggatcataacaccatcgtatgtctgaacacaggctcaggcaagtag

SEQ ID NO: 185331 - DNA, 5490 bp, Artificial Sequence
  Description of Artificial Sequence: Synthetic coding sequence
atgaagagccccgccctgcagcccctgagcatggccggcctgcagcttatgacccccgccagtagtcccatgggacctttttttgggctgccttggcagcaggaagctattcacgacaacatctacacccctaggaaataccaagttgagctgctggaagcagctctggatcacaatactatcgtatgtctcaacaccggctctggaaaaacctttattgccgtcttgctgactaaagagttaagttatcagatcagaggcgacttctctaggaatggcaaaagaaccgtctttctggttaactctgcaaatcaggtagcacaacaggtttccgccgtgcgcacccactcagatcttaaggtgggggagtactccaatctcgaggttaatgcttcctggacaaaggaacgctggaatcaggagttcactaagcaccaggtactcataatgacttgttacgtcgctttgaacgtcctcaaaaacggatacctgagcctgtctgacataaacctccttgtcttcgatgagtgtcatctcgctatcctggatcatccatacagggagattatgaaactctgtgagaattgcccctcctgccctcgaattcttgggctcactgccagcatcctgaatggcaagtgcgatcctgaggaacttgaggaaaaaattcagaaactggagaagattctgaaaagcaatgctgagaccgccacagacctggtggtgctagaccgatacaccagccaaccatgcgaaatcgtagtcgactgcggaccttttaccgatcgaagcggcctttacgaacggttgttgatggagctggaggaggccctgaactttatcaatgactgcaatatcagcgtccattcaaaggaacgcgattcaacactgataagcaagcagattctgagcgactgtcgcgccgtgttagtcgtgctgggcccatggtgtgctgacaaggtcgccggtatgatggtgcgggagcttcagaaatacattaagcatgaacaagaggaattgcaccgtaaatttctgctcttcacggataccttcctaagaaagatccacgcgctttgcgaagagcacttcagccctgcttctttggatcttaagttcgtgactccaaaggtgatcaaactcctggagattctcaggaaatataagccctacgaacgccagcagttcgaatcggtggagtggtataataacaggaatcaggacaactatgtgtcctggtccgactccgaagatgatgatgaagatgaagagatcgaggaaaaggagaaaccagagaccaacttcccaagccctttcaccaacattctctgcggtattatcttcgttgagcgtagatacacggcagtcgtcctcaaccgcttgatcaaggaggccggtaagcaagaccctgaactggcttacatatccagcaatttcatcactggacacggcattggcaaaaatcagccccgaaacaagcagatggaagcagaattccgtaaacaggaggaggtgctgcgcaagtttagagcccacgagactaatctccttatcgctactagcattgtagaggagggagtggatatacctaagtgtaacctggttgtgcgctttgacctccccacagaataccggtcttatgtccagagtaaagggagggctcgtgccccaattagcaactatatcatgttagcagacacagacaagattaaaagctttgaggaggatttaaagacatataaagcgatagagaagattttgcgtaataaatgcagcaaatccgtagacacaggggaaaccgacattgacccagtgatggacgacgatgacgtgtttcccccatacgtattgcgcccggatgacggcggaccaagagtgactatcaatacggccataggccatatcaaccgttattgtgccaggctgccttccgacccttttactcatttagctcctaagtgtcgcaccagagagctacccgatggcactttctacagcactttgtatcttcctatcaattcccctttaagagcgtcgatcgtcgggcctcctatgagctgcgtgcggctggccgaaagagtggtggccctgatttgctgtgagaaattacacaaaattggagaactggacgaccacctcatgcccgttggcaaggaaactgtgaagtacgaagaggagctggatctgcacgacgaagaggaaacaagtgtcccagggcgccccgggagcacaaagcgcagacagtgttaccctaaggccatccccgagtgtcttcgagattcatacccccgacctgatcagccctgttatctttatgtgatcggaatggtgctgacaactccattgcccgacgaactgaacttcagaaggcgcaagctttaccccccagaagacacaacaaggtgcttcgggatcctgacagcgaaacccataccacagatcccgcactttcccgtctacacacgttctggagaggttactatctccatcgagctgaagaaaagcggcttcatgctgagcctgcagatgcttgagcttataacccggctccatcagtacatcttttctcacatactgagacttgaaaagccagccttagagttcaaaccaacggatgctgactcggcatattgcgtgctgcctctaaacgtcgtgaacgattcaagcactttagatattgattttaaattcatggaggacatagaaaagtctgaagccaggatcggcatccccagcactaaatacactaaggaaaccccctttgtattcaagttggaggattaccaggacgccgtgatcattccccggtatcgcaacttcgaccagccacaccggttctatgtcgcagatgtctataccgacctgacccctctgtctaagtttccttcacccgaatatgagacttttgcagaatattacaaaacaaaatataatctcgacttgaccaatttgaatcagccactgctggatgtcgatcatacaagttcacggctcaacctactgactccccgccatctgaatcaaaagggcaaggcacttccactcagtagtgctgaaaagcgtaaggccaaatgggaaagcttgcagaacaagcaaattctggtgcctgagctgtgcgccattcacccaatccctgcctctctctggaggaaggcagtttgtttaccctctatcctatatcgcctccattgcctgctgacagccgaagaactgagagctcagaccgcgagcgatgccggggttggagttcggtccctgccagcggactttaggtaccctaacctggattttggatggaaaaagtctatagattccaagagctttatatcgatttccaacagtagttctgctgagaacgacaactactgtaaacactcaacaatcgtgcccgagaatgctgcccaccagggcgccaacagaaccagttcccttgagaatcacgatcagatgagtgtgaattgccggacactactgtctgaatcacctggaaaactgcatgtggaagtgtctgctgaccttacagccattaacggtctgagctataatcaaaatctggcaaatggttcgtatgatcttgccaatcgcgacttctgccagggaaaccagcttaactattacaagcaagagattcctgtccagccaaccacatcatacagcatccagaacctgtatagctacgagaaccagcctcaaccaagtgacgagtgcacacttttgtcaaataaatacctcgacggcaatgctaataaatccacgtctgacggctcaccggttatggccgtcatgccagggaccacagacacaatacaggtccttaagggtcgcatggactctgagcagtcaccatccatcggctattcctccagaacactgggacctaaccctgggctcattctgcaggccctcactctctccaatgcttcggacggctttaacctggagcgcctggagatgctaggcgattccttcctgaaacacgcgatcactacatatctcttctgcacatacccggacgctcatgaagggcgcctgtcctacatgcgctccaagaaagtgtcaaattgcaacctctaccggcttgggaaaaaaaaggggctgccaagccgaatggttgttagcatcttcgacccacccgtgaattggctcccgcccgggtatgtcgtgaatcaggacaagtccaataccgataagtgggaaaaagacgagatgaccaaggattgcatgttggcaaacggaaaactagacgaggactacgaagaggaagacgaggaagaagaaagcctgatgtggagggccccaaaggaggaggccgactatgaggatgactttctggagtacgaccaggaacacattcgtttcatcgataatatgctgatgggctctggcgcatttgtgaagaaaataagtttgtccccattctccactacagacagtgcatatgagtggaaaatgcccaagaagtcatcgcttggctccatgcctttcagctctgacttcgaggatttcgactatagcagttgggatgctatgtgttatttggacccttccaaggcggtggaggaagatgacttcgtggttgggttctggaacccttccgaggaaaactgtggtgtggacactggcaagcagtctatcagctacgacctgcatactgaacagtgtattgctgacaagagcatagctgactgcgtggaggcgctgctaggatgctatctgacaagttgtggtgaacgggcggctcagctttttctctgctccctcggcttgaaggtccttcccgtgatcaaacggacagacagagagaaggctctgtgccccactagggaaaacttcaatagtcagcaaaaaaacctgtctgtttcttgcgcagcagccagcgtggcttccagcagatcttctgtattgaaggatagcgagtacggatgccttaagatcccaccaagatgcatgttcgatcatcctgacgccgacaaaactttaaaccacctaatctcggggtttgaaaatttcgaaaaaaaaatcaactatcggtttaagaacaaagcttacttgcttcaggctttcacccatgctagctaccactataacacgattaccgattgttaccagaggctggaatttctcggggacgccatcctggactacttgataacgaagcacctgtacgaagatcctcgccagcactcccccggtgtgctcacagacttgaggtcagccctcgtcaacaacaccatctttgcgtcgctggctgttaagtacgattaccataagtactttaaagcagtaagtccagagctgtttcatgtcatagacgatttcgtgcagttccaactggagaaaaacgagatgcaggggatggattctgagaagtctttcctacaaatgtaccccgtgccgctctgcgagaactgtctgaagtggaaccagaagctgcccaatctcgccagactccgcgaactgaccacgggccgctctgaatctctgtggaaatag

SEQ ID NO: 185332 - DNA, 2463 bp, Artificial Sequence
  Description of Artificial Sequence: Synthetic coding sequence
atgctggcctgggagagcgaccacttcctgcggatcctggccgagaatgacaattattgcaagcacagtactatagtgccggaaaacgctgcccatcagggagctaaccgaacctccagcctggagaatcatgaccagatgagcgtgaattgccggaccctactgtcggagagtcccgggaagttgcatgttgaggtgtcagcagatctgactgccattaacggattgagttataaccagaacctagcaaacggtagttatgatcttgccaatagggacttttgccagggcaatcagctgaactactacaaacaggagatccctgttcagcctactacctcctactccattcaaaatctgtattcctacgaaaaccagccacaaccctcagacgagtgtaccttattgagcaataagtacctggacggcaatgcaaataagagcacgagcgatgggtcaccggtcatggcggtcatgccaggaacgaccgacaccatacaggtccttaagggtaggatggactctgaacagtccccctccatcggatacagttcccggaccctcggcccgaaccctggattgatcctccaggcactcactctgtctaatgcttcagacgggtttaacctggagaggctcgagatgctgggcgatagctttctcaagcacgccatcaccacgtacctgttctgtacttatccagacgcacacgagggacgtctgtcgtacatgcggtccaaaaaggtttcaaactgcaacctgtatagactgggtaaaaaaaaggggctaccatcaagaatggtggtctccatattcgatccccctgttaattggctgccaccaggttatgtcgtgaatcaagacaagtcgaacaccgacaaatgggaaaaggacgaaatgaccaaggactgcatgctcgccaatggcaaactagacgaggactacgaggaggaggatgaggaggaagaatccctgatgtggagagctccgaaggaggaggcagactacgaggatgattttcttgaatacgaccaggagcacatcagattcatagacaacatgttaatgggttctggggcatttgtgaagaaaattagcctgagccctttttcaactacagacagtgcctacgagtggaagatgccaaagaagagcagtctcggtagcatgcctttttcatccgactttgaggactttgactattctagctgggatgctatgtgctacctcgatccgtcaaaagccgtggaggaagatgactttgttgtgggcttttggaatccgtctgaggagaattgcggagtggataccgggaagcagagcatcagctatgacctccacaccgaacagtgcattgctgataaatcaattgctgattgcgtggaggctttactggggtgctatcttacttcttgcggtgaacgggccgcccaactgtttttgtgttctttgggcctcaaggtgctgcccgttatcaagcgaacagaccgagaaaaggcactttgtcccaccagagagaacttcaactcacagcagaaaaacctaagcgtgtcttgcgcagccgcctccgtcgcaagcagcaggtcctcagttcttaaggattcagaatatggttgtctgaaaatacctcctaggtgtatgttcgatcaccccgatgctgataagactctgaatcatctgatctccgggttcgaaaatttcgagaaaaaaattaactatcggtttaagaacaaggcatatctgttgcaggctttcactcacgcgagctaccactataacacaatcaccgactgctaccagaggcttgaattcctgggagatgccattctcgattaccttattacaaagcatctttatgaagacccaaggcagcacagtcccggcgtgttaacggatctccgctccgctctggtgaacaatacaatcttcgcttcactggctgtcaagtatgactaccataaatatttcaaggccgtctccccggagctgtttcatgtgatcgatgactttgtccagtttcagcttgagaaaaatgagatgcagggaatggactcggagctccgccgcagcgaggaggacgaggagaaagaggaagacatcgaggtgcccaaagctatgggcgatattttcgaatccttggcgggtgcaatctatatggacagcgggatgtcattggaaactgtctggcaggtatattatcctatgatgcggcccctgatcgagaaattctctgccaatgtgcctcggagtccagtgagggagctgctggaaatggaacccgaaactgctaagttttcccccgcggagcggacctacgatgggaaggtccgggtaaccgtggaggtggtcggcaagggaaaattcaagggcgtgggaagatcctatcggatagcaaagtccgcggctgcgaggagagccctgcgctcgctaaaggcgaaccaacctcaggtaccaaatagctag

SEQ ID NO: 185333 - DNA, 801 bp, Artificial Sequence
  Description of Artificial Sequence: Synthetic coding sequence
atgatggccctgggcgccgccggcgccacccgggtgttcgtggccatggtcgccgctgcactgggggggcacccattgttgggtgtctctgccacgttaaatagcgtcctgaactcaaacgcaatcaaaaatctgccccctcccctgggcggcgcagctgggcatcctggctccgccgtgtctgctgctccaggaattttatatcctggaggaaataaatatcagactattgacaattatcagccctacccttgcgctgaggatgaagaatgtggcaccgatgaatactgcgcgagccccacccggggaggggacgcgggagtccagatttgcctggcctgtaggaaacgcaggaagcgctgtatgcgtcatgctatgtgttgcccaggtaattactgcaagaatgggatttgcgtgtcatctgatcagaatcatttcagaggcgagattgaagagaccattactgagtcatttgggaatgatcactccactttagacggatatagccggcgaactaccctgagcagtaagatgtatcacactaagggtcaggaggggtccgtgtgtctgagaagtagtgactgtgcttccggtctgtgttgtgccagacacttttggtccaagatctgcaaacccgtactgaaggaggggcaggtgtgcaccaaacatcgccgcaaaggaagccatggcctcgagatttttcagcgatgctattgtggcgaaggcctgtcgtgcaggatacagaaagatcatcatcaggcctccaattcatctcgactccacacctgtcagaggcactag

SEQ ID NO: 185334 - DNA, 1689 bp, Artificial Sequence
  Description of Artificial Sequence: Synthetic coding sequence
atggacgccatgaagcggggcctgtgctgcgtgctgctgctgtgcggggccgtcttcgtaagcccctcccaggagattcacgccaggtttcgcagaggagcccgaagctatcaggtaatatgcagagacgagaagacccagatgatataccagcaacaccaatcctggctgcgtcccgtcctgagatctaatcgggtggaatattgctggtgtaactcggggcgagcccaatgtcattccgtgccagttaaatcatgttctgaacctaggtgttttaatggcggaacttgccagcaggccctttactttagcgactttgtgtgtcagtgtcccgagggatttgcgggtaagtgctgcgaaatcgataccagagcgacttgttacgaagatcaagggatttcgtatcgggggacgtggtctacagccgagagcggcgctgagtgcactaattggaactccagcgccctagcgcagaagccatatagcgggcgaaggccggatgctattcgcctggggttaggaaaccataactattgtcggaaccccgaccgcgattccaaaccttggtgttacgtcttcaaagccgggaaatatagttccgagttttgctccaccccggcatgctcagagggaaacagtgactgttattttggcaatgggtctgcctatcgcggaacccattctttgactgagtccggagcgtcctgcctgccatggaattcgatgattctcattggaaaagtatacacagcccaaaatccaagcgcccaggctctggggctcggaaaacataactattgccgcaaccctgatggcgacgcaaagccttggtgccatgttctcaagaatagacggcttacatgggagtactgtgacgtgccctcgtgttcaacttgtggcctgaggcaatactcccagcctcagtttcggatcaagggcggcctatttgctgatatcgcaagccacccatggcaggctgctatattcgctaagcacagacggtctccgggcgagagattcttatgcggcggaatactgatttcttcttgttggatactgagtgccgcacactgttttcaggagagattccctccccaccatctcactgtgattctcgggcggacctatcgagtggttcccggagaggaggagcagaagttcgaggtggaaaagtatatagttcataaggaattcgacgacgatacctacgataacgacattgccctgctacagctcaagagcgattcctctaggtgtgcacaagaaagcagcgtggtcagaacggtgtgtttacctcccgcagacctgcagctgcccgattggacagagtgcgagctaagtggctatggaaagcatgaggctctgagtcccttctactcagagcgtctgaaggaggctcacgtgcgactctacccaagttctagatgtacgtcccagcatcttttgaatcgaaccgttacagataacatgttgtgcgccggggataccagaagcggggggcctcaagccaatctacacgacgcctgccaaggcgacagcgggggcccactcgtttgcctgaacgatggaagaatgaccttggtgggcattatttcttggggcttgggatgtggtcagaaagacgtccctggagtgtatactaaagtgaccaattacctcgactggatcagggataacatgcgcccatag

SEQ ID NO: 185335 - DNA, 420 bp, Artificial Sequence
  Description of Artificial Sequence: Synthetic coding sequence
atggtggccgccgtgctgctgggcctgagctggctgtgcagccccctaggcgccttagttttggattttaataatataaggagctccgccgacctgcacggagcgcggaaaggaagccaatgcctgtcagacaccgattgcaatacacggaaattctgcctccaacctagagacgaaaaacccttttgcgctacatgtaggggccttcgcaggaggtgtcagagagatgccatgtgttgtcccggcacactgtgcgtgaatgacgtatgtacgactatggaggatgccacacccattctggagcgccagctggatgagcaggatggcacccacgcagaagggacaacgggccatcccgtccaagagaatcagcctaagcgaaagccttccataaagaagagcagcagtatgctagactag

SEQ ID NO: 185336 - DNA, 1683 bp, Artificial Sequence
  Description of Artificial Sequence: Synthetic coding sequence
atgcgggacctgcccctgaccagcctggccctggtgctgagcgccctgggggccctgttgggaaccgaagctctcagggccgaggagcctgcagtgggcacatcgggcctcatctttcgggaagacttagactggcctcctggaagcccacaggagcccctctgcttggtggcgctaggcggcgatagcaatggcagcagctcacccctgcgggtggtgggggccctctctgcttatgaacaagctttcctgggtgccgtgcagcgggcaagatggggtcctcgcgacctcgccacatttggcgtctgcaacaccggtgaccgacaggccgccctcccctccctgagaagactgggggcctggttgcgcgatcctggaggacaacgactcgtggtcctgcacctcgaggaggtgacctgggaaccaacaccttcccttcggtttcaggagcccccgcccggcggggccggcccacctgagctggctctgttagtcctgtaccctggcccaggtcccgaggttacagtgactagagctggactccctggggcgcaatccctctgtccatcacgggacacaagatacttggtgctggcggtggatagacctgccggagcgtggcgtggatctggcctagcacttactctgcaaccacgtggtgaggactcccggctgtctaccgctaggcttcaggccctcctgttcggcgatgatcatcggtgcttcacccggatgactcctgccctgctgcttctgcctagatctgagcctgcccccctacccgcccacggccagctggacaccgtcccctttccccccccgagacccagcgccgagctggaggaatctcccccatccgcagatccctttcttgaaacactgacccggttagtgagggcactgcgggtgccgcccgctagagcttcagcaccgcgccttgctctggaccctgatgcattggccgggtttccacagggcctggtgaacctcagcgaccctgccgctctcgagagacttctagacggcgaggagccgctgctgctactgctgcggcccacagcggcaactacaggcgatccagccccactccacgatcccaccagtgcgccctgggccacagctctggctaggagggttgctgctgaactgcaagccgctgcagctgagctgagatctcttcccggtctgccaccggctacggccccactgctggcccgactgttggccttatgtccgggcggccctggtggtttgggtgatccgcttagagctttgctgcttctcaaggctttacagggacttcgcgtagaatggcgagggcgcgatcccagaggccctggtcgtgctcagagatcggcaggcgccacagcggctgatggcccatgcgccctgagggagctgtctgtggatctgcgagctgagcgttccgtgctgatcccggagacgtaccaggcaaacaactgccagggcgtgtgcggatggccacagtctgataggaatccccgttacggaaaccacgtggtgctccttttaaagatgcaggtgcggggcgctgcactcgctaggcctccttgctgcgtgccaaccgcttatgcagggaaactactgatcagtctctctgaagagagaatatccgctcatcacgtgcccaacatggtcgccactgaatgcggctgtcggtag

SEQ ID NO: 185337 - DNA, 600 bp, Artificial Sequence
  Description of Artificial Sequence: Synthetic coding sequence
atgggcgaggccagcccccccgcccccgcccggcggcacctgctggtgctgctcctgctcctgtctactctggttatccccagcgcagcagcacccatccatgacgccgatgcccaagagagctcacttggcttgacagggctgcagagtttgcttcaaggtttttctcgactttttctgaaggggaatctgttacgcggaattgactcgctcttctcagccccaatggattttcggggcctgcccggaaattatcataaagaggaaaaccaagaacaccagctcggaaataacaccttatccagtcacctgcagatagacaaagtcccaagaatggaggaaaaagaagcgctcgtaccaattcaaaaggcgacagacagttttcacacagaactccaccctagggtagcattttggattattaaactccccagaagacgaagccatcaggatgcactagaggggggacactggttgtcagagaagcggcatagactccaggcgattcgcgacggactccgcaaagggactcacaaagatgtcttggaggagggaactgagtcgtcttcacactccagactgtccccaagaaagacctag

SEQ ID NO: 185338 - DNA, 1896 bp, Artificial Sequence
  Description of Artificial Sequence: Synthetic coding sequence
atggccctgcggaaggagctgctgaagagcatctggtacgccttcactgctctggacgtggaaaaatctgggaaagtatcgaaatcacagctgaaggttttgtctcacaacctgtataccgtgctccacatcccacatgatcctgtcgcactcgaggagcacttccgcgacgacgatgatggccctgtgagcagccaaggatacatgccctatcttaataagtatattttagacaaagtcgaagaaggcgcatttgtgaaagagcacttcgatgagctctgttggaccctgactgctaagaagaactaccgcgccgactctaatgggaactctatgctctccaaccaggatgcatttcgcctatggtgtttatttaacttcttatcagaagataaataccctctcatcatggtaccggatgaagtagagtacttacttaagaaagtccttagctctatgtccttagaagtctcccttggtgagcttgaagagctcctcgctcaggaggcgcaggtagcacagacaacgggtggactttctgtctggcagtttctggaactgttcaattctggcaggtgcctgcggggggtgggacgtgacacactgtctatggcaatccatgaagtgtatcaagaacttatccaagacgtccttaagcaggggtacctctggaagaggggacacctccgccggaactgggcagaaagatggtttcagctgcaaccctcctgcctttgctatttcgggagcgaggagtgtaaggaaaagagagggatcatcccacttgatgcccactgctgtgtggaagtgctcccagacagagatggaaagcgctgtatgttttgcgtgaaaaccgcgaaccgcacgtatgaaatgtccgcttctgatacgagacagcgacaagaatggacggccgcgatacagatggccatcaggctccaagcggaaggcaagacatccctacacaaggacctaaagcagaaacgcagggaacagcgtgagcaaagagagaggcggcgagccgctaaggaggaagaactgctgcgccttcagcaactccaggaagagaaggagaggaagttgcaggagcttgagttgctgcaagaagcacagcggcaagcagaaaggttactacaggaagaggaagagcggcgccgttctcagcaccgcgaactgcagcaggccctggagggtcagctgagagaggccgagcaggccagagcctctatgcaggcagaaatggaattaaaagaggaggaggccgcccggcagcgtcagcgcatcaaggagctggaagaaatgcaacagcgcctgcaggaggctttgcaactggaggttaaggcaagacgggacgaggaaagcgttcgcatcgctcagaccaggcttctggaagaagaagaagaaaagctcaagcaactgatgcaactgaaggaggagcaggaaaggtacattgaacgcgcgcagcaggaaaaagaggagctgcagcaggagatggcccagcaatctaggtctctgcaacaagcccagcagcagcttgaggaggtaaggcagaatcgccagcgtgccgacgaggatgtggaggccgctcagcggaagctccgccaggcaagcacaaatgtgaaacattggaatgtacagatgaatcggctgatgcaccctattgaaccaggggataaaaggccagtcacgtcttcgtccttttccgggttccagccacccctgctcgctcacagggattctagcctcaagcgtctcacccgatgggggtcacagggaaaccggactccctctccgaactctaacgagcagcagaagtctctgaacggaggcgatgaagccccagctcctgcgagtactccgcaggaggataagcttgatccagctccagaaaactag

SEQ ID NO: 185339 - DNA, 555 bp, Artificial Sequence
  Description of Artificial Sequence: Synthetic coding sequence
atggccctgcggaaggagctgctgaagagcatctggtacgccttcactgccctcgatgtggaaaagtctggcaaggtgtcaaagtcacagctcaaagtgctgagtcataatctgtacacagtcctgcacattccccacgatcctgtggccctggaggagcacttcagggacgatgacgacggacctgtatcaagccagggctatatgccctacctcaacaaatatatcctggacaaggacgcattccggctttggtgtctcttcaattttctctccgaggacaagtatcccttaatcatggtgcctgatgaggttgagtacctgctgaagaaggttttatcgagcatgtcactagaggtgagtctcggggagttagaggagctgttggcccaggaggcccaggtggctcagaccaccggcgggttgagcgtttggcagttcctggaactttttaactcagggaggtgtctacgcggagtgggaagagatactttgagcatggccatccacgaagtgtaccaggagctcatccaggacgtactcaaacagggctag

SEQ ID NO: 185340 - DNA, 393 bp, Artificial Sequence
  Description of Artificial Sequence: Synthetic coding sequence
tgacgggacgacgacgacggccccgtgagcagccagggctacatgccttacctcaataagtatatactagacaaggatgcattccgtctctggtgcctgtttaactttttatccgaggacaagtacccactgattatggtaccagacgaggtggaatacctgttgaagaaagtcctcagctctatgagcctcgaggtcagcttgggcgaacttgaagagctgctggcacaggaggcgcaggtggcacagactacagggggattgagcgtttggcagtttcttgaattgtttaacagtggtcgatgtctccgaggtgtcgggcgggataccctttctatggctatacatgaggtgtaccaggagctgatccaggatgtcctgaagcaaggttag

SEQ ID NO: 185341 - DNA, 1131 bp, Artificial Sequence
  Description of Artificial Sequence: Synthetic coding sequence
atgatctgccccccccggccccccaaggtgctgggcctgcaggtgctgccagatcgggacggcaaacgctgtatgttctgcgttaagacggctaacaggacatatgaaatgtccgcatcggatacccggcagagacaggaatggaccgctgctatccagatggccatccggttgcaggctgaaggcaagaccagtctgcataaggaccttaagcagaagcggagagagcagcgggaacaacgcgagagacgccgagctgctaaggaggaggaattactacgactgcagcagcttcaagaagagaaggaaagaaagttacaagagctggagctgcttcaggaggcccagcggcaggccgaaaggctgctccaggaggaggaggaaaggagacggtcccagcatcgggagttgcaacaggcgctggaaggtcagctgcgggaagctgagcaggcccgcgcatcaatgcaagctgagatggagctgaaggaagaggaggcagctcggcagagacagagaattaaagagctggaagagatgcagcagcggctccaggaggcgctgcaactggaggtcaaggccaggagagacgaagagagcgtgcgcatcgcccaaactagattgttggaggaggaggaagagaaactaaagcagctcatgcagctgaaggaagagcaagagcgttacatcgaacgcgcccagcaagagaaggaggagttacagcaagaaatggcccaacagtcaagatctctgcaacaggcgcagcaacagttggaagaggttcgccagaaccgacaacgggcagatgaggatgtggaagcggcacagaggaagctccggcaggcgtcgactaacgtgaaacactggaacgtccagatgaatcgcctgatgcaccccattgagcccggtgataagcgccctgtaacatcgtcctccttcagtgggtttcagccccctttattggctcacagagatagctctcttaaacgattgactaggtgggggagtcagggtaaccgcactccctcacccaatagcaacgagcagcagaaatctctcaacggaggggatgaagcacctgcccccgccagtactccccaggaggataagctggatcccgccccggagaactag

SEQ ID NO: 185342 - DNA, 708 bp, Artificial Sequence
  Description of Artificial Sequence: Synthetic coding sequence
atgacccaggtgaccgagaagagcaccgagcaccccgagaagaccacgtcgacaactgagaagaccacccgcactccagaaaagcccacactgtacagcgaaaagacaatctgtacaaagggtaaaaacactccagtgcctgagaaacctactgagaaccttggcaacactaccctgaccacagagacaatcaaagcccctgtaaagtcaacagagaatcctgagaaaaccgctgctgtgacaaagaccatcaagccatcagtgaaggtgactggcgataagtcacttacgactacatcctcccatctgaacaaaaccgaggtgacgcatcaggtcccaactgggagcttcacactaatcaccagccggacaaaactgtcgtctatcaccagcgaagctaccggaaatgagtcacacccctatctgaacaaggacggcagccaaaaaggcatccacgctggtcagatgggcgaaaatgatagcttcccagcctgggcaattgttattgtggtgttggtggctgtgattctcctcctggtctttttagggctgatttttctggtatcatacatgatgaggactcggaggacgcttacacagaatacacagtataatgatgcggaagacgagggcggaccaaactcatatcctgtctatctgatggaacagcaaaacctgggcatgggccagataccctcgccacgctag

SEQ ID NO: 185343 - DNA, 1524 bp, Artificial Sequence
  Description of Artificial Sequence: Synthetic coding sequence
cccctggccaacgagaagaccaccctgagccccgccgagcccaccgagaatggcgagaggacaccattcactaatgagaagacaaccccctccagcgcagaacctacagagcatggcgaaagaacaccactggctaacgaaataacgaccccatccagagctgagccaacggagcacggggaacggattgccaacgagaaagccactcctagcccagctaaaccgaccgaacacggcgaaactacggttaatgaagacactacaccttcatcagcagagccaactgagaacggtgagcgcaccccccttgcaaatgagaataccaccacctcccccacggaatcaactgagcacggcgaaagaaccgccaatgagaagaccactcccagccccgccgagcctacagagcacggtgagagaactccatctgctaacgagaagactattccgtcccccgctaagcccactgaacacgaggagatgactcctagcgcaaatgagaataccaccccaagccccgtgaagccaacagagcatggcgaaaaaacaacactggccaacgagaaaattactttatcccctgaaggccctaccgagcacggcgctaagacgacatcagctaacgagaaaataactccaagtttagccaagcctaccgaacacggtgaacggaccacatccccaaacgacaagataacatcttcggctgccgagtctactgagcaccgagaccgcgctacgagcgccaatgtgataacgcccgccccagctgagccgattaagcacgcaaagcgcaccactctggcccacgagaaaatgacacaggttacggaaaagtcaactgaacatcccgagaagaccaccagtacgacagagaagactactcggactcccgaaaaacccacactttactctgagaagacaatttgcactaaggggaagaacacccccgtgcctgagaagcctacagaaaatctcggtaacaccacactcactacagaaacaatcaaagcccccgtgaaatccaccgagaatcctgaaaaaactgccgccgtgactaaaactataaagccttctgtgaaggtgacaggcgacaagagcttgacgaccaccagttctcatttgaataaaaccgaggttacacatcaagtccccactgggagtttcactcttattacaagcaggacaaagctgtcgtcaataacttcggaagcgacaggcaacgaatctcacccttacttgaataaggatggctcccagaagggcatccatgccggtcagatgggagagaatgactctttccctgcttgggccatagtaattgtcgtgcttgtggccgtgattctgctgctggtttttctgggcctaatttttttagtcagctacatgatgcggacacgcagaactctgacccaaaacacacaatacaatgatgctgaagatgaaggaggcccgaattcataccctgtgtacctgatggaacagcaaaatctgggtatgggacagatccccagccctcgctag

SEQ ID NO: 185344 - DNA, 1524 bp, Artificial Sequence
  Description of Artificial Sequence: Synthetic coding sequence
cccctggccaacgagaagaccaccctgagccccgccgagcccaccgagaacggtgaacgtaccccctttacgaatgaaaagacgacgccttcgagtgcagaacccactgaacatggcgagaggacaccgcttgctaatgagatcactaccccatccagggctgagcctaccgaacacggagagaggattgcaaacgagaaggccacaccttccccagctaaacccacggagcacggtgaaaccaccgtgaacgaggataccaccccttcatcggcagaacctaccgagaacggagaacggacccctctggcaaacgagaatacaactacctcccccactgaatccaccgagcacggtgagcgcaccgcaaacgagaagactacaccttcgcccgctgagcccacagagcacggagagcgaacaccttcagctaacgagaaaaccatcccatctcccgccaaacccaccgaacacgaagaaatgacacctagcgccaacgagaatacaaccccatcacccgtgaagcccactgagcatggcgagaaaaccacactggccaacgagaaaattaccctatctccggagggtccgactgaacacggcgctaagacgacatctgcgaatgagaagatcactccttcactggcgaagcccacagaacatggagaacggaccacgagtcccaatgacaaaattacatccagcgctgcagagtccactgaacacagagatcgtgctacttctgctaatgtgatcacccccgctcccgctgagcctattaaacacgctaaacgcacgaccctcgcccatgagaagatgacacaggtaaccgaaaagtcgactgagcatcccgagaaaaccaccagcacaacagagaaaactacccggactcccgaaaaacctacgttatattcagagaagactatctgtactaaagggaagaacacaccggtgcccgagaagccaaccgagaatctgggaaatacgacacttactaccgagacaataaaggcgcctgtaaagtctacagaaaaccccgaaaaaaccgcagccgtaaccaagaccattaagccgtctgtgaaagtgacaggcgataagtcactgacgaccacttcttctcaccttaacaagaccgaagttactcaccaggttcccacaggctccttcacactgattacctcacggactaaactttcctcaataacatctgaagcgactggaaataagtctcacccgtacctcaacaaagacggatcccaaaaaggcatacacgctggtcagatgggggagaacgactctttccccgcctgggcaattgtgattgttgtgctcgtcgcggtcatcctgttgctggtattcttggggctgatctttctggtatcctacatgatgcggacaagacgaacgttgactcaaaacactcaatacaacgacgcggaggatgagggtggacccaacagctacccagtgtacctcatggaacagcaaaatctagggatgggccagatcccatcacctagatag

SEQ ID NO: 185345 - DNA, 1524 bp, Artificial Sequence
  Description of Artificial Sequence: Synthetic coding sequence
cccctggccaacgagaagaccaccctgagccccgccgagcccaccgagaacggtgaacgcaccccctttaccaatgaaaagacgactccatcttcagccgagccgaccgagcatggggaacggacgcccctggccaatgagattaccacccctagtcgtgccgagccaaccgagcatggcgaacgaatcgccaatgagaaggccaccccatccccagcgaaaccgaccgagcacggcgagaccacagttaacgaagatacaacaccttcttcagcagaaccgaccgagaacggtgaacgtacccccttggccaatgaaaacactacgactagtccaaccgaaagcaccgagcacggtgaaaggacagcaaacgagaaaacaactccttcacccgcggagcctaccgaacatggagagcgaactccatcagcaaacgaaaaaacaattcccagcccagcaaaaccaacagagcacgaggaaatgacgccaagcgccaacgaaaacacaacacctagccctgtaaagcccacagagcacggcgagaagaccacattggctaacgagaagatcaccctcagccccgagggccccaccgagcatggggcaaagactaccagtgctaatgagaaaattaccccgtccctggcaaaaccaaccgagcacggagaacgaacaacctcccccaacgacaagataacctcttctgccgccgagtcaactgagcatcgggacagggctactagcgctaatgtaataacacccgctcccgccgagccaatcaaacatgccaaaagaaccactctggctcacgaaaagatgacacaggtcaccgaaaaaagcactgaacaccccgagaaaacaaccagtactaccgaaaagacaacacggacacccgagaaacccaccctctactcggagaagacaatctgtacaaaagggaagaatacccccgtgcccgagaaacccacggagaacctgggaaacacaactctgactaccgagacaatcaaggcaccggtgaaatcgacagagaaccccgaaaaaaccgctgccgttaccaagacaatcaaaccatcggttaaagtcaccggggataaaagcctcacgaccacaagtagccatttgaacaaaacggaagtgacccaccaggtgcccaccggaagcttcacgctgattaccagccgaacaaagttgtccagcatcacgagcgaagcgactgggaacgaatcacatccatacctcaataaggacggttcacagaagggcatccatgccgggcagatgggagaaaacgactcctttcccgcatgggccatcgtgattgtcgtgctggtggcagttatcctgttactggtttttctgggactgattttcctggtatcctacatgatgagaactcgccgtaccctgactcaaaacacacagtataatgatgccgaggacgaaggtgggcctaattcatacccggtgtatctcatggaacaacagaacctcggcatgggacagatcccttctccccgctag

SEQ ID NO: 185346 - DNA, 1554 bp, Artificial Sequence
  Description of Artificial Sequence: Synthetic coding sequence
atggcccagcccgtgcacagcctgtgcagcgccttcggcctgcagtgttgcctcctattcctcttggcaagctggggagctggggcaactacattccaggagtatcagaagaccggggagctctcaacctcagaccatattttcccgctgactcccggcctcgtgtattctattccgttcgaccatattgtccttcatagtggccaaaggcctccagaactgcctaaatccaccgagatacacgaacagaagcgccattgcaacaccaccaggcactccaaacctacagataaacccacaggaaattctaagaccatcgatcacaaatcctcaaccgataatcacgaagcaccccctaccagcgaagaaaactcttcaaaccagggcaaggatccaatgatcagaaatcaacgctctgtggatcccgccgactctacaaccacccacaaggaatcagctggcaagaaacatataacaccggctccgaaatccaagatcaattgccggaagtcaaccacagggaaatcgaccgttactagaaaatccgacaaaacggggcggcccctcgagaaaagcatgtcaaccttggacaagactagcacctcctcccataagactacaaccagttttcacaattctggaaacagtcagactaaacaaaaatcaacttcattccccgagaagatcacagccgccagtaagactacttacaaaaccacgggcacacccgaagagtctgaaaagacagaggatagcagaacaacagtggctagcgacaagctgctgactaagaccacaaaaaatatacaggaaacaatttctgccaacgagctgacccagagtctggccgaaccaaccgaacatgggggccggactgctaatgaaaataacacaccctccccagcagagcccaccgaaaatcgagagcgcacagccaacgagaataaaaaaaccatatgcaccaagggaaaaaacaccccagtgcccgaaaagccaacagagaacttaggtaacactaccctgacaaccgagaccataaaggcaccagtgaaaagtaccgagaaccctgagaagacggccgcagtcaccaagacaataaaacccagtgtgaaggtgacgggggataaatctctgacaacaacaagctcccacctgaacaagacagaggtgactcaccaggtccctaccggcagtttcacactgatcactagccggaccaaactctcctctatcaccagcgaggctacaggcaacgagtcccacccatacctgaataaggacgggagccagaagggtatccatgccggacagatgggagaaaatgattcattccctgcgtgggcaattgtgatcgtggtcctggtggccgtaatcttactgctggttttccttgggcttattttcctggtgtcatatatgatgaggacaagacgcaccctgacccagaacactcagtacaatgacgcagaagacgaaggaggaccaaacagttaccctgtgtatctgatggagcagcaaaatctcggaatgggccaaataccatcacctcgctag

SEQ ID NO: 185347 - DNA, 1554 bp, Artificial Sequence
  Description of Artificial Sequence: Synthetic coding sequence
atggcccagcccgtgcacagcctgtgcagcgccttcggcctgcagtgctgcctcctgtttcttctagcctcatggggcgccggagccacaaccttccaagagtaccagaagaccggggagcttagcactagtgaccacatatttccgttgaccccaggactcgtctacagcatcccatttgatcatatcgttctccacagcggtcagaggcctcccgagctacccaaatccactgagattcacgaacagaagcggcactgcaatactacacgtcatagcaagcctacggataagcccactgggaactctaaaacgattgatcacaaatcttcaaccgacaaccacgaggcccctcctacgtctgaagagaattcttctaatcagggtaaagatcccatgatccgcaatcaaaggagcgtggaccctgccgattctaccactactcataaagaatccgcaggcaagaagcatattacacctgcgcccaaaagcaagattaactgtaggaagagcaccactgggaaatcaactgtcacgcggaaatcagacaaaactgggcggccactggagaaatcaatgagcaccttagataagacatctacatctagccataagacaacgacgagcttccacaattctggcaacagccagaccaaacagaagagcacctcgtttcctgagaaaatcaccgcggcgagcaaaacgacatataagaccaccggtaccccggaggagtcagagaaaaccgaggatagcaggaccaccgtcgcaagtgacaagctgttaacaaagacaacaaaaaacatccaagagactatatctgcgaacgaactgacccagtccctggccgaaccaaccgagcatggaggacggaccgcgaatgagaacaacacgccctcacccgccgaacctacagaaaaccgggaacgtaccgcgaacgaaaacaaaaagacaatttgtacaaaggggaagaacactcctgtacctgagaaaccaacagagaatcttggaaacacaactctgactactgaaacaatcaaagccccggtgaagagtacagaaaatccagagaagacggctgccgttactaagactattaagcccagtgtgaaggttacaggcgacaaatcactgacaacaaccagcagtcacctgaacaagacagaggtgacacaccaggtccccacggggagtttcaccctcatcacttctcgaacgaagctgtccagcattacttccgaggcaacgggcaatgagtcacacccatatctcaacaaggatggctctcagaaggggatccatgctggtcaaatgggggaaaacgacagcttcccagcttgggctatcgtgatcgtggtgttagttgcagtcattctcttgctggtctttctgggccttattttccttgtttcttacatgatgagaacccgacggacccttactcaaaatacccaatataatgacgccgaggatgaaggaggaccaaattcatacccagtgtacttgatggaacagcagaacttgggcatggggcagatccctagccctagatag

SEQ ID NO: 185348 - DNA, 1554 bp, Artificial Sequence
  Description of Artificial Sequence: Synthetic coding sequence
atggcccagcccgtgcacagcctgtgcagcgccttcggcctgcagtgctgcttactcttcctgctggcgtcttggggagcaggagcgacaacctttcaggagtatcagaaaacaggggaactttctactagcgatcacatttttccgctcaccccaggcctggtgtacagcatcccgttcgatcatattgtgctgcattccgggcagcgtccacccgagttacccaagtcgaccgagatccacgagcagaagagacactgtaacacaactcggcacagtaagcccacagataagcctaccggcaactcaaaaacgatcgaccacaaaagcagcactgacaatcacgaggctccgcctacctctgaagagaatagcagtaaccagggcaaggatcctatgatccggaaccagcggagcgttgacccggccgactcaaccaccacacataaggagtctgctggcaagaagcatatcacccctgcccccaaatcgaagatcaattgcagaaagtctactaccggcaaatcgacagtgacgaggaagtcggacaaaactggacggcctctagagaaaagcatgtccacgctcgacaaaaccagtacttcttcacacaagacgacaacaagctttcacaattcaggaaattctcaaactaaacaaaagagcacgagtttccctgagaagatcacagctgcatccaaaaccacgtacaagacaacaggcacaccagaagagtccgaaaagaccgaggactctcggacaactgttgccagcgacaagctcctaacaaagacaactaagaatattcaggaaaccatcagtgcgaatgaactcacacagtctctagccgaacctacagagcacggaggccgaacagctaacgaaaataatacacccagtccagccgagcccactgagaatcgggagaggaccgctaatgaaaataagaaaacaatttgtaccaagggtaagaataccccagtgcccgagaaaccgactgagaatctgggtaacactactttaaccacagagaccatcaaagccccagtgaaatctacagaaaaccccgaaaaaacagccgcagtgacaaagacaatcaaaccctccgttaaagtcactggcgataagagcttgaccacaaccagctctcatctcaataagacagaggtcactcaccaggtccccaccggctccttcaccctgatcaccagtcggactaagctctccagcattacctccgaagcaacaggaaatgagagccacccttatcttaacaaggatgggtctcagaagggcattcacgccgggcagatgggcgagaacgatagtttccctgcatgggccatcgtcatcgtagtccttgtggccgtaattttgctgttagtgttcttgggactgatttttttggtatcttacatgatgcgtacccggcggactctgacccagaacactcaatataacgacgctgaagacgaggggggccctaatagctatccagtttaccttatggagcaacagaacctgggaatgggccagataccaagcccgagatag

SEQ ID NO: 185349 - DNA, 4182 bp, Artificial Sequence
  Description of Artificial Sequence: Synthetic coding sequence
atggcccagcccgtgcacagcctgtgcagcgccttcggcctgcagtgctgcttgctgttcctgttagctagctggggggcaggagccactacctttcaggaataccagaaaacaggtgagctctccaccagcgaccacatcttcccactgaccccagggctcgtgtactctattccatttgaccatattgttctccactctggccaaaggcccccagagctaccaaagagcaccgagattcatgaacaaaagagacattgtaataccacacggcactccaaacctaccgataagcccaccggaaattctaaaactatcgaccacaaatccagcacagataatcacgaggccccccccaccagtgaggagaactctagcaaccaaggaaaggatcctatgattcgcaaccagcggagcgttgaccccgctgactctaccaccactcataaggagagcgcggggaaaaaacacattaccccagcccccaagtctaaaattaattgtaggaaatccaccactggaaaatctaccgtgacgagaaaatccgacaaaaccggacgtcccctcgaaaagtccatgagcactctggataaaaccagcacctcatctcacaagacaacaacttcgtttcacaactcaggaaattcccagactaagcagaaatcgacctctttcccggagaagatcacggcggcgtctaaaactacctacaagaccaccggcacgcccgaagaatctgagaagaccgaggactctaggacaaccgtagcttccgataagctccttacaaaaactaccaagaatatccaggagaccatatcagccaacgagctgacacagtcgctggcggagcccaccgaacacgggggtcgtacagccaacgaaaataatacacctagccctgctgaacccacagaaaacagagagcggactgcgaacgaaaacacaacattgtctccagccgaaccaaccgagaaccgcgaaaggacggccaatgagaataccgcccctttccctgctggccccacggaaaatagagagatgacagctaacgagaacaccactttatttcccgcagaacctacagaacacggagaacgaactgcaaacgagaatactacacctagtcctgctgagcccaccgaacatggagagaggaccgcgaacgagaacaccacaccctcacctgcggagccaactgagcatggggagagaacaccctttgcgaacgacaagactacgagctctagcgctgaatctacggaacacggcgagaggaccccactagcgaatgagaacaccacgccgtcccccgccgaacccactgagaacagagagaggactgctaacgagaatactacaccctctcccgctggacctactgaaaaccgggagacaactgcgaatgagaagacaaccctgagtcccgtcgagcctacagagaatcgggagaccactgccaacgagaagaccacacccagccctgctgaacccacagagaacggccagcggacccctttcgccaacgagaaaaccaccagttcatccgctgagccaactgagcatggagagagaactcccctcgcaaacgagaataccaccccttccccggctgagccaacagagaacagagaacgtacagccaatgagaaaactacaccctcaccagcagaaccgacagagaatggggaccgaactccactggcgaacgaaaagactactccctcattggccgaacctactgagaatggacagaggactcccttcgctaacgagaagaccactagttccagcgctgaaccaacggagcatgaggagagaactccgctcgcaaacgagaacaccaccccctccccagctgagccaactgaaaacagagaaaggacagctaacgagaatacaaccccaagtcctgcaggccctaccgagaaccgggagatgactgctaacgaaaaaaccacattgtttcctgccgaaccgactgagaacagggaaaggactgccaatgaaaagaccacctcttctccagccgagcccaccgagaacggtcagaggacgccgtttgccaacgaaaagacgacgtctagttctgccgaaccaaccgagcacggagagcgcacacctctggccaatgagaacactactttgtcccctgctgagcctaccgagaaccgggaacgcacagcaaatgaaaaaactacaccattccctgcggaacctaccgagaaccgcgaacgcacagccaatgaaaataccaccccttctccggctcagccaaccgagaacggggatcggacccccttggcaaacgagaagacaactcccagcctggccgagcctactgaaaacggaaaaagaactccattcgcaaacgagaaaaccacaagcagttcagctgagcccactgagcatgccgagcggacaccacttgctaatgagaatactacgagcagtcctgccgaacccacggaaaacagggagcgcacggccaacgagaagactacacagttcccagccgaacctacagagaatcgagaatcaaccgctaacgaaaagacaacccccttccccgcggaacccacggaaaatcgggaatggacagccaatgagaacactactctgtcaccagcagagccaactgagcacgaagagatgacccctttagcaaatgagaagaccactctgtctcctgctgagcctaccgagaacggtgagcggacaccttttaccaatgaaaaaacaaccccctcaagcgctgaaccaacagagcacggcgaaaggacccccctagccaacgagattacgaccccaagcagagccgaaccaaccgaacacggcgagagaatagccaacgagaaggcaactccatcgcctgccaaacccacagagcatggggaaacgactgtcaatgaggatacaactccttccagtgcagagccaaccgagaacggcgaacgcacacctctcgcaaatgaaaacaccaccacttctcccacggaaagcacagagcacggcgagagaacagccaacgaaaagactaccccatcaccagcagaacccacggagcatggagaaagaaccccatccgccaacgaaaagactataccaagccccgctaagccaacggagcacgaggagatgactccgtccgccaacgagaacacaacaccttcccctgtcaagcctaccgagcacggagaaaagacgacattggctaatgagaaaatcacactgagtcccgaaggacccacggaacacggtgctaagaccacctctgcgaatgagaagattaccccgagcctggcaaagcccacagaacacggcgagaggacaacatcaccgaacgacaagattacatctagcgctgccgagagtactgagcatagagatcgggctacgtcagccaacgtgataactcccgcccccgcggaaccaatcaaacacgctaaacgcacaactctagctcacgagaaaatgacccaggtgacagaaaaatctactgagcacccagagaagacaacatccaccacagagaagactacaagaacgccagaaaagcccacactctacagtgagaagacaatctgcacaaaaggcaaaaatacgcctgttcctgaaaagcctaccgagaatcttggcaacaccaccctgacgactgagaccattaaggccccagtgaaaagtaccgagaatcccgagaagaccgctgctgtgactaaaaccattaaaccctcagtaaaagttaccggcgacaagtccctaacaacgacaagctctcacctcaataagacggaagtcactcaccaggtgcccactggcagctttaccttaattacttctcgtacaaagctttcttcaatcaccagcgaggctactggcaacgagagccatccctacctaaataaggacgggtcacagaaaggcatccatgcgggacagatgggcgagaatgactcattccctgcctgggccatcgtgattgtcgtgctagtcgctgttatacttctgcttgtgtttctcggtttgattttcttggtatcctatatgatgcgcaccagacggaccctaacacagaatacacagtataatgacgcagaggacgaggggggacctaattcttaccctgtttacctgatggaacagcagaaccttggtatggggcagatcccttcccctagatag

SEQ ID NO: 185350 - DNA, 2670 bp, Artificial Sequence
  Description of Artificial Sequence: Synthetic coding sequence
atggcccagcccgtgcacagcctgtgcagcgccttcggcctgcagtgttgcctcttgttcttgctcgcttcatggggtgcgggcgccactacgttccaggagtatcagaagactggcgaacttagtactagtgaccacatttttcccctcacacccggcctcgtttattccattccttttgatcatattgtcttgcattctggccaacgcccgcccgaattgcccaagagcaccgagattcatgagcagaagaggcactgtaacacaactaggcattcaaagcctactgataagcctacaggcaacagcaagactatcgatcacaagtccagtacagacaatcacgaggcccctccaaccagtgaagagaattcttctaatcagggtaaggatcccatgattagaaaccagaggagcgtggaccctgctgactccacaactacccacaaggaaagcgctggtaaaaagcacattacaccggcccctaagtcaaagatcaattgccgtaagtccaccacaggaaaatcgaccgtaaccaggaaatcagataagaccggacgaccgcttgaaaagtctatgtccaccctggacaagacatcaacctcttcgcacaaaaccacgacctcgttccacaacagcggcaactcacaaaccaagcagaaatctacctcctttcctgagaagatcactgccgcctctaagacaacatataaaactactgggactccggaggaaagcgaaaagaccgaagactctcggacaactgtggccagtgacaagcttcttaccaagactacaaaaaacatccaggagaccatcagcgcaaacgaattgacacagagtctcgccgagcccacggaacatgggggaagaacagcaaatgagaataataccccctctccagctgagccaactgagaaccgtgagcgcaccgccaatgagaacacaacactctcacccgccgagccgactgagaatagggagcgtaccgcaaacgaaaatacggcacccttccctgccggtcctactgaaaaccgggagatgaccgccaatgagaataccacgctgtttcctgcagagcccacagaacacggtgaacggactgccaacgaaaatactaccccgagccccgccgagcctactgaacatggtgaacggaccgccaatgaaaacacgactccatcccccgccgaaccaaccgagcatggagagaggacgccattcgccaatgacaaaaccacctctagctctgcagagtccacagaacatggggaacggacccccctagccaacgaaaataccaccccttcccctgcagaacctaccgaaaatcgggaaaggacagctaatgaaaataccactccaagcccagcgggtcctacagagaacagggagacgacggctaacgaaaagacaacactgtcccctgtcgagccgaccgaaaatcgtgaaacgacggctaatgagaagactaccccatcccccgctgagcctaccgaaaacggacagaggaccccatttgcaaacgagaaaacaaccagtagctccgctgagccaaccgaacacggggaacgaactcccctagctaacgagaacacgacaccatctcctgcagaacccaccgagaatagagagagaaccgcaaatgaaaagaccaccccctcccccgccgagcccaccgaaaatggtgaccggaccccacttgccaatgaaaagaccacacccagcctagccgagccaaccgaaaacggccaacgcacgccatttgctaatgaaaaaacaacttcgagttccgcagaacccaccgaacatgaggaaaggactcctcttgccaatgaaaacacgacacctagtcctgccgaacctacagagaaccgagagcggacagctaacgagaatactaccccatcaccagccggtcctacggagaatcgggagatgactgccaacgagaagacaacactgtttcctgctgagccaaccgaaaaccgagagagaaccgcaaatgagaagacgacatctagtcctgccgaacctactgaaaacggacagcgaacgcccttcgccaatgaaaagaccacttctagttcagccgagccaacagaacatggggagcgcactcctctggcgaatgagaacacgactctatccccagctggtcccacagagaacagagagagaaccgcgaacgagaaaactacccctttcccggcggaacctaccgagaacagagagaggactgccaacgagaacaccacaccttctcccgcccagcccaccgagaacggagatcggacaccactggccaacgagaagactactcccagtctggccgaacctaccgagaatggtaagcgaacgcccttcgccaacgagaagaccaccagcagtagcgctgagccgactgagcatgccgaaagaacgcccttagcaaacgagaatactacaagcagtccagctgaacccaccgagaatagggaaagaaccgccaatgaaaaaacaacacagtttccggcggaacctaccgaaaacagagagtctacggcaaatgagaaaaccacaccattccctgctgagcccaccgagaacagggagtggacagcaaacgaaaatactaccttgtcacctgctgagcccaccgaacacgaggagatgacgccactggcctag

SEQ ID NO: 185351 - DNA, 1653 bp, Artificial Sequence
  Description of Artificial Sequence: Synthetic coding sequence
atggtgcccaaggccgacagcggcgccttcctgctgctgttcctgcttgtgttaaccgtgaccgagccgttaagacctgagcttagatgcaacccagggcagttcgcctgcagatccggcaccatccagtgcatacctctgccttggcagtgcgacggctgggctacctgtgaagatgagagcgatgaagccaactgcccagaggtaacgggagaagtgagaccccaccatggcaaagaagccgtagatcctcggcagggaagggcaagaggcggcgatccatcgcactttcacgccgtgaacgtggctcaacctgtgagatttagctcttttctgggaaagtgcccaaccggctggcaccactatgaaggtactgcttcgtgctatagagtgtatctctcaggggagaactactgggatgcagctcagacttgccaacgcttaaacggatccctcgccacattttcaaccgatcaagaactaaggttcgttttggcccaggaatgggatcagcctgagagaagttttggatggaaggaccagagaaaactctgggttggatatcagtacgttataaccggacgaaataggtctctggagggacgatgggaggtcgctttcaaaggaagttctgaggtttttttgcccccagatccgatctttgcttccgccatgtcagagaacgataatgtgttttgtgctcagcttcaatgcttccacttccctaccctgagacatcacgatcttcactcttggcacgctgaatcctgttatgaaaagagcagcttcctgtgtaagcgatctcaaacctgtgtggatataaaggacaacgtagtagatgaagggttctactttacccctaagggagatgacccttgcctttcttgtacatgccatggaggggaaccggaaatgtgcgtggctgccttatgtgagcgaccccagggatgccaacagtacagaaaggatccgaaggaatgctgtaaattcatgtgtttagatcccgacgggaatagccttttcgattccatggcctctgggatgaggctggtggttagttgcatctcctcattcctcatacttagtctgctcttgtttatggtgcacaggcttcgccaacgccgccgtgagaggatcgaatctctcataggagctaatctccaccatttcaacctgggccggcggattcccggattcgactacggccccgatggcttcggcacaggcttaacccctctgcacctgagcgacgacggagagggaggtactttccattttcacgatccccctcctccttacaccgcctataagtacccggacatcgggcagcctgacgatccaccacctccgtatgaagcctccatccacccggattcggtattttatgacccagctgatgatgacgccttcgaacccgtcgaagtgtccttacccgctcctggagacggagggagtgaaggagctttactgagaagattggagcagccccttccaactgcgggtgcatcactggccgatctggaagacagcgccgattcctccagcgctctgctcgtacctcccgaccctgcgcagtccggatctacccctgctgccgaagcactcccgggcgggggcagacatagccgctctagtctcaataccgtggtctag

SEQ ID NO: 185352 - DNA, 984 bp, Artificial Sequence
  Description of Artificial Sequence: Synthetic coding sequence
atggtgcccaaggccgacagcggcgccttcctgctgctgttcctgctggtactaaccgtgacagaacctcttcgccctgagctgcggtgcaatcctggccagttcgcttgccggtcaggtactattcaatgtattccccttccctggcaatgcgacgggtgggccacatgcgaggacgagtccgacgaggcgaattgtcccgaagtcactggcgaagtacggcctcatcacggtaaggaagcggtggacccacggcaaggcagggccagaggcggagatccatcacattttcacgcagtgaatgtcgcccaacctgtccgcttcagtagtttcctgggcaagtgtccaaccggctggcaccactacgaggggaccgcatcctgttatagagtgtatcttagcggtgaaaactactgggatgcagcacagacatgccagcgtctgaatggatccctggcgacgtttagcaccgatcaagagttgagatttgtacttgcccaagagtgggaccagccagagcggtcattcggatggaaagatcagcggaagctgtgggtgggttatcagtacgttatcaccggacgcaaccggagcctggaggggaggtgggaagtggcctttaagggaagcagcgaagtttttcttccaccagacccaatcttcgcttctgcgatgtcagagaatgacaacgttttttgcgcacaattgcagtgctttcatttcccaacacttaggcaccatgacttacactcttggcatgcagaaagctgctatgagaagtcttcgttcctttgcaagagatcccagacatgtgtggacataaaagacaacgtagtggatgaggggttctacttcacccccaaaggagacgacccttgcctgtcctgcacatgtcatggaggcgaacccgagatgtgtgtggcggccctatgcgagcggcctcaaggttgttctccactcagctgcaccgcgagggcgacttag

SEQ ID NO: 185353 - DNA, 1530 bp, Artificial Sequence
  Description of Artificial Sequence: Synthetic coding sequence
atggtgcccaaggccgacagcggcgccttcctgctgctgttcctgctggtcctgaccgttacagagcctttacggcctgaggttactggcgaagtaaggccacaccatgggaaagaggctgtggacccccgccagggtcgtgcccggggcggcgatccttcacacttccatgccgtcaatgtcgcccagcctgtgcgattcagcagcttcctgggaaaatgtccaactggctggcaccactatgaaggcacagcaagctgctaccgcgtttatctgagcggtgaaaattattgggatgctgcccagacatgccagcgtctgaacggatcactcgctacgtttagcacagatcaagagttgcggtttgtgttagctcaggaatgggatcaaccggaacgatcctttggctggaaggaccagcggaaactgtgggtcggctatcaatatgtgataaccggccggaaccgctcgctggaggggagatgggaagtggcattcaagggcagtagtgaggttttccttcctccagatccaatttttgccagcgcaatgtccgagaacgataacgtgttctgtgctcagctacagtgttttcattttcctaccctaaggcaccacgatctgcactcctggcatgccgagtcttgctatgaaaaatccagtttcctgtgtaaacgctctcaaacttgtgttgacatcaaagataatgtggttgacgaaggcttctatttcaccccaaagggggatgatccgtgtctgtcttgcacctgccatggcggggagcctgagatgtgtgtggccgctctctgcgagcggccccaggggtgccagcaataccggaaggaccctaaagaatgctgtaagtttatgtgcctggatcctgacggtaacagcctgttcgatagcatggccagcgggatgcgcctggtcgtcagttgtatttcatcttttctcattctcagtctcctgcttttcatggtacacaggctgcggcaaaggcgccgtgagcgcattgaaagcttgatcggggccaacctgcaccacttcaacctcgggcgccggatccccggctttgattacggccccgatggttttggcactggactgaccccgcttcacctttcagacgacggtgagggtggcactttccactttcacgatcctcccccgccctataccgcctataagtacccggatattgggcaacccgatgacccccctcctccatacgaggcttcaatacatcccgacagcgtgttttacgatcccgcagacgacgacgcctttgaacccgtcgaggtgtcattgcccgcccccggcgacggtgggtccgagggggctctgctgaggagactggaacagccactgcccaccgccggagcctctctggccgacctcgaggattcggctgactccagttcagccctcctggtcccacctgatcccgcacaaagcggcagcacaccagcggcggaagccctgcctggaggtggacggcattctcgatcctccctgaatactgtggtgtag

SEQ ID NO: 185354 - DNA, 810 bp, Artificial Sequence
  Description of Artificial Sequence: Synthetic coding sequence
atggtgcccaaggccgacagcggcgccttcctgctgctgttcctgttggtgttgacggtgaccgagccgctcaggccagagttgaggtgtaatcccggccagttcgcctgccggtccggtacaatccagtgtatcccccttccctggcaatgtgacgggtgggcaacctgcgaggacgaaagcgacgaggctaactgtcccgaagtcactggagaggtgaggcctcaccacgggaaagaggccgtggatcccagacagggacgggcccgagggggtgatccttctcacttccacgctgttaatgttgcacagccggtaagattcagcaggaaatgccctacaggatggcatcactatgaaggaaccgctagttgttatagggtctatctttctggcgagaattactgggacgcagctcagacatgtcagaggctgaatggttccctggcaacatttagtacagatcaggagctccggtttgttctggcacaggaatgggaccaacctgagaggtcttttgggtggaaggaccaacgcaaactgtgggtgggttatcaatacgttatcactggccggaacaggagtcttgagggaagatgggaggtcgctttcaaagattggggggtcagcgacacaatggtacatcggcgcttgctgtgtccctgcgtgggaaccctacacacacacctgaagttgggcgccagattcagaagggtccctgtgcgcctcggcggggcactaagtcggcgtagtccaagacccaccccagcctgcgagccaaggctgggcgcgaagaccttacaggtttag

SEQ ID NO: 185355 - DNA, 663 bp, Artificial Sequence
  Description of Artificial Sequence: Synthetic coding sequence
atggagcggtacgccggcgccctggaggaggtggccgacggcgcccggcagcaggagcggcattatcaacttctgtccgccttgcagagtttggtgaaggaactgccatcttctttccaacagaggctgtcatacactacacttagcgacctggctctggccttgctcgatggcactgtgtttgaaatcgtccagggcctgctcgaaattcagcacttaactgagaaaagtctgtataaccaacggctacggttgcagaatgaacacagggtactgagacaggctctgcgtcagaaacatcaagaagctcagcaggcctgtcggccacacaatctgcccgtgttacaggctgcacagcaacgcgagctggaagcagtcgaacaccgcataagggaggagcaaagggccatggaccaaaagattgtgctagagctggacaggaaagtggcggatcagcaatctactttagaaaaggccggtgttgccgggttctacgtgacgactaatccacaggaacttatgcttcaaatgaatctcctcgaattaatcagaaaactccagcagcgaggttgttgggccggaaaagccgctctcgggctgggggggccatggcagctgccagccgctcagtgcgatcagaagggtagccccgtccctccttag

SEQ ID NO: 185356 - DNA, 663 bp, Artificial Sequence
  Description of Artificial Sequence: Synthetic coding sequence
atggagcggtacgccgccgccctggaggaggtggccgacggcgccagacagcaggagcgtcactaccagttgctcagcgccctgcagtcgctggtgaaggagctaccatcctcattccagcagaggttaagctatacgacattgagcgacctcgcactggcactcttagacggtacagtgttcgaaattgtacaaggtctgctggagatccagcatctgacggaaaagtcgttgtataatcagcgcctgagacttcagaacgagcatcgggtgttgagacaggctcttcgtcagaaacatcaggaggcacaacaggcttgtagaccacacaacttgccggtggtgcaagccgcacaacaaagggagcttgaagccgttgagcataggatccgggaggaacaaagagccatggatcagaaaattattctcgagttggatcgaaaggtggctgaccagcagtccaccctggagaaagccggcgtagcgggattttatgtcacaactaacccccaggaactcatgttgcagatgaacctgctagaattgattagaaagctgcagcagagaggatgcagagcaggaaacgctgccctcggcctgggggggccgtggcagtcaccggcagcacaatgcgatcaaaagggcagtcctgtgcccccttag

SEQ ID NO: 185357 - DNA, 2322 bp, Artificial Sequence
  Description of Artificial Sequence: Synthetic coding sequence
atggagaccgacgagagccccagccccctgccctgcggccccgccggcgaggctgttatggagtcacgcgcccgacctttccaagcgttaccgcgcgagcagtcccctccgcccccactacaaacgagctctggcgccgaggtgatggacgtgggctctggaggagacggccagtccgagctgcctgccgaagatccttttaatttctacggcgcttctctcctgtcgaaggggtccttcagcaaaggccgtctactgatagaccccaattgtagcggccattccccaagaacagcccgccatgcccctgctgttcgcaaattctcgccagaccttaagctgcttaaggatgtaaaaatctcagtgagtttcacggaaagctgccgaagcaaagacagaaaggttctgtatacgggcgccgaaagggacgttcgcgctgagtgcggactccttctgagtccggtgtctggtgacgtgcacgcatgcccgttcgggggctcagttggcgatggtgtgggaatcggcggagagagcgccgacaagaaagacgaggaaaacgagctcgaccaagagaaaagggtggagtatgcagtgttggacgaactcgaggatttcacggacaacttagagttagatgaagaaggcgcgggagggttcacggctaaggccatagtgcagagagaccgggtggacgaggaagccttgaattttccctatgaagacgatttcgataacgacgttgacgctctgctggaagagggcttgtgtgcaccaaagaaacgccgcacggaagagaagtacggcggggattccgatcacccaagcgacggggaaactagcgtccagcctatgatgactaaaatcaaaactgttctgaagtcgaggggaagacccccaaccgagccccttcccgacggttggataatgacattccataactctggggttcctgtgtacctgcatagagagagccgcgtggtgacatggagcagaccttacttcttgggaactggctcgataagaaagcatgatccccctctcagctccataccgtgcctacactacaagaaaatgaaggacaatgaagagcgagaacaatctagtgacctcacgccatccggcgatgtctctcctgtgaagcctctgagcaggtccgctgaacttgagtttcctctcgacgagccggacagtatgggggcagaccccgggcctccggacgaaaaagatcctctcggcgcagaagcggctcctggtgcactgggtcaagtcaaggcaaaggtcgaggtgtgtaaagatgaatctgtggaccttgaggaatttaggagttatctcgagaaacgttttgacttcgagcaagtgactgtgaagaaattcaggacatgggctgagagacgccagttcaacagagaaatgaagagaaagcaagcagaaagcgagcggcctatccttcctgcaaaccagaagctaatcaccctttcagtccaagacgcccccaccaaaaaagagtttgtcattaatcctaacggaaaatccgaagtgtgcattctgcacgagtatatgcagcgggtgctcaaagtgcgcccagtgtacaatttcttcgagtgtgagaacccctcagagccgtttggggcgtcagttaccatcgacggagtcacctatgggagcggcaccgcaagttctaagaaacttgcaaagaacaaggccgccagagctactctggaaattttgattcccgattttgtgaagcagaccagcgaggagaagcccaaggattccgaagaattggagtacttcaaccacatcagcatcgaggatagtagggtttacgagttgacaagcaaagcagggctccttagcccgtaccagatcctccacgaatgcttaaaaaggaaccacgggatgggggataccagcatcaaatttgaggtggttcccgggaagaaccagaagagtgaatacgtgatggcttgtggcaaacatactgtgagaggttggtgcaaaaataagagggtcggaaaacagctagccagccagaaaatcctccaattgttgcatccccatgtgaagaattggggctctctccttagaatgtacggtcgggagtcctcaaagatggtgaagcaagagaccagtgacaagtcagtcattgagctacagcagtacgcaaaaaagaataaacccaacttgcacatactctccaaactccaggaggaaatgaaaaggctcgctgaggagagagaagagacgcgaaagaagcctaaaatgtccatcgttgcttctgcacagccaggcggggagccactctgcaccgtggacgtatag

SEQ ID NO: 185358 - DNA, 2223 bp, Artificial Sequence
  Description of Artificial Sequence: Synthetic coding sequence
atggagaccgacgagagccccagccccctgccctgcggccccgccggggaagctgtgatggagagccgagctcgtccattccaggctctcccgagagagcagtcccctcccccaccgcttcagacctcaagcggtgctgaggtgatggatgtaggctctggcggagacgggcagtctgagctgcccgctgaagatcccttcaatttttacggcgcctctttgctgtctaaagggtcctttagcaaggggagacttctaatagacccgaattgctccgggcatagcccgaggacagctcggcacgctcccgcggtgcgaaagttcagcccagaccttaaactgcttaaagacgtgaaaataagcgtgtcattcacggaatcatgccgatctaaggacagaaaagttctgtatactggcgctgaacgagacgtgagggcggagtgcggactcctgcttagccctgtttctggcgatgtgcacgcatgtccctttggcgggagtgtgggagacggcgttgggatcggtggagaatctgccgataaaaaagacgaagagaacgaactggatcaggagaaaagagtggagtacgcagtgctggatgagctggaggactttacagacaatctagagctcgatgaggaaggtgctggaggattcaccgcaaaggccatagtgcagcgcgatcgcgtcgatgaggaagccctgaacttcccatacgaagacgacttcgacaatgacgtggacgccctcctggaggagggactgtgtgcgcctaaaaaacggagaactgaggagaagtatgggggggacagcgatcatccaagcgacggggaaacatctgtccagcccatgatgacaaagatcaaaacagtgttgaagtccaggggcagaccccctacagaacccttacccgatgggtggatcatgacctttcataattccggcgtccctgtctacctccaccgcgaatcccgagttgttacatggtcacggccttacttcctgggcacaggatctataagaaagcacgacccacccttgagcagcattccctgtctccactacaagaaaatgaaagacaatgaagagcgagagcagagcagcgatcttacaccctcaggcgacgtgtcccctgtgaaacccttatctcggtcggccgaactggagttcccactggatgagcccgattccatgggagccgatccgggtcccccagatgagaaggatcctctgggagctgaagcggccccgggcgcactcggccaggtgaaagccaaagtggaggtctgtaaagacgaatctgttgacctcgaggagttccggagctatctggagaagcggtttgacttcgaacaagtcacagtgaagaagtttaggacttgggcggaacgtcggcagtttaacagagagatgaagcggaagcaggcggagagcgagcgtcctatcctgcctgctaatcaaaagttaatcaccctgagcgttcaggatgccccaacaaagaaggaattcgtgattaaccccaatggaaaatccgaagtgtgtatcttacatgaatacatgcaaagggtgctgaaagtaaggcccgtgtataatttcttcgaatgtgccagggccactctggaaattctgatacctgactttgtcaaacaaacgagtgaagaaaaaccaaaagatagcgaggagctcgagtacttcaaccatatcagtattgaggattcacgtgtgtacgaactgacctctaaggccggcctactgtcaccatatcagattttacatgaatgcctgaagaggaaccacggcatgggcgacacgagcattaaatttgaagtggtgcccggaaagaaccagaaaagtgagtatgttatggcttgcggcaaacacacagtaagaggctggtgcaagaacaaaagagtggggaagcagttggcctctcagaagattctgcagctgttacacccacacgtcaagaattggggcagtttactgagaatgtatggccgagaatcctcaaagatggtaaagcaggaaacctcagacaagagcgtgatagagctgcagcagtacgccaagaaaaacaaaccgaacctgcatattctgtctaagctacaggaagagatgaagagactcgctgaagaaagagaggagacaaggaagaagcctaaaatgagcatcgtcgcaagcgcgcagcctggaggtgaacctctctgcaccgtcgacgtgtag

SEQ ID NO: 185359 - DNA, 2223 bp, Artificial Sequence
  Description of Artificial Sequence: Synthetic coding sequence
atggagaccgacgagagccccagccccctgccctgcggccccgccggagaggctgtaatggagagcagagcccggccatttcaagctctgcctcgggaacaaagtccacccccccctctgcagacctcatctggagctgaggtgatggacgtgggatccgggggcgatggccagtctgaattgcctgcagaggatcctttcaatttttacggcgcgtcgctcctgagcaagggttcattttcgaagggaagactcttaattgaccctaactgctccggccactccccgcgtacagctcgacacgccccagccgtaagaaagttctctcccgacctgaagctgttgaaggatgtgaagattagcgtgtccttcactgaatcctgtaggtccaaggaccggaaggtcttgtacacgggggccgagcgtgatgtgcgggctgagtgcggtctgcttctgagtcctgtcagtggcgatgtacatgcatgcccttttggcgggtcagtcggggacggggtggggattgggggagaatcagccgataagaaggatgaagagaacgaactggatcaagaaaagagggttgagtatgcggtcttagacgaactcgaggacttcaccgacaatctggagcttgacgaggaaggcgccggcggattcacggccaaggcaattgttcagcgtgaccgggttgacgaggaggcgctcaacttcccctacgaggatgacttcgataacgacgtggacgctctgttggaggagggcctatgcgcccctaaaaaaaggcgcaccgaggagaagtatggcggtgattcggatcatcccagcgacggtgagaccagcgtgcaaccaatgatgacaaaaatcaagacagttttaaaaagtaggggccgcccaccaacagaacccctgccggacggctggattatgacattccacaactcaggagtgcccgtctacctgcatagggaaagcagagttgtgacctggtcccggccctactttcttggcaccggctcaattcggaagcacgatcctccactcagctccattccgtgcttgcattacaagaagatgaaagacaatgaggaaagggagcagagcagtgacctgacgccaagcggggatgtgtcccccgtcaaaccacttagtagatctgctgaacttgagttcccgctcgacgaaccagatagtatgggtgctgacccggggcctccagatgagaaagacccgctcggggccgaggccgcccccggggctctgggccaagttaaggcaaaagttgaagtttgtaaagatgaaagtgtggatctggaggagttccggagttatctggagaaaaggtttgactttgagcaggtgacagtgaaaaagttccgcacctgggccgagcggagacagtttaaccgtgaaatgaagcgaaaacaggcggaatcagaaagaccaatcctcccagccaatcagaaactaattaccttgagtgtacaggatgctccaacaaagaaagaattcgtgatcaacccgaatggcaaatctgaagtgtgcattttgcatgaatacatgcagcgggtcttgaaagtacggcctgtgtacaacttcttcgagtgtgcaagggcaacactggaaattctaataccagacttcgtgaagcagacaagcgaagagaagcccaaggactcagaagagttggagtattttaaccatataagcatcgaagactctagggtgtacgagttaacatccaaagcaggcctactgagtccataccagattcttcatgaatgcctgaaacgaaatcacggcatgggcgacacaagcataaagtttgaggtcgttcccggcaagaaccagaagagcgaatacgtgatggcttgcggaaagcatactgtgcgcggttggtgcaaaaacaagcgcgtgggtaagcaattggcatcgcagaaaatcctgcagttgttgcaccctcatgtcaaaaactggggctcactgctacgcatgtacgggagagaatcttccaagatggtcaaacaggagacgagcgataagagcgtaatcgagctgcagcaatacgctaaaaagaataaaccaaacttacacatcctctctaaactgcaagaggaaatgaagagactcgccgaggaacgtgaagagacccggaaaaagcccaagatgagcatcgtcgccagcgcccagccagggggcgagcccctgtgtaccgttgacgtttag

SEQ ID NO: 185360 - DNA, 378 bp, Artificial Sequence
  Description of Artificial Sequence: Synthetic coding sequence
atggagaccgacgagagccccagccccctgccctgcggccccgccggcgaggccgtcatggaatcacgcgcgcgaccatttcaggcgttgcctagagaacagtcccccccacctcctctccaaacatcatccggagctgaggtgatggatgtggggtcgggcggtgacggacaatctgaattgcctgctgaggatccgttcaacttctacggagcctctctgctgtctaaaggcagcttctctaagggacgcctcctgattgaccctaattgttctgggcattccccaaggaccgcccgtcacgcccccgccgtgcggaagttttcaccggatctgaaacttcttaaggacgttaagataagcgtgtcctttacctag

SEQ ID NO: 185361 - DNA, 564 bp, Artificial Sequence
  Description of Artificial Sequence: Synthetic coding sequence
atggtgggcagcctgaactgcatcgtggccgtgagccagaacatgggaatcggcaagaatggagacctgccatggcccccactgcgcaatgagtttcgctactttcagcgtatgactaccacaagctcagtcgagggaaagcaaaaccttgtcattatgggcaagaaaacttggttctccatccccgaaaagaacaggcctctcaaggggaggattaatctggtgcttagccgagaactgaaagagccaccccagggagcccacttcttgagcaggtctctggatgacgcccttaaactcaccgagcagcccgagctcgccaacaaggtggatatggtgtggattgttggcggcagcagtgtttataaggaggctatgaaccacccaggacatcttaagctgttcgttacccgaataatgcaagatttcgagtctgataccttctttccggagattgacctcgaaaagtacaagctgttacccgaatacccgggcgtattgtcagatgtgcaggaagaaaagggtatcaagtataagtttgaggtgtatgagaagaatgactag

SEQ ID NO: 185362 - DNA, 564 bp, Artificial Sequence
  Description of Artificial Sequence: Synthetic coding sequence
atggtgggcagcctgaactgcatcgtggccgtgagccagaacatgggaatcggaaaaaacggggacctgccgtggccccccctcaggaacgaattccgctatttccagagaatgacaacaactagtagcgtcgagggcaaacagaatttagtgatcatgggtaagaaaacctggttctccatcccagaaaagaacagaccgctgaagggccgtatcaacttggtgctctcacgagagctcaaagagccgccccagggcgctcatttcctgtcacgaagcttggacgacgccctcaagcttaccgaacagcctgagctggctaataaggtcgatatggtgtggatagtgggaggctctagcgtctacaaggaggctatgaatcacccgggccatctgaagctattcgtgacaagaattatgcaggacttcgagagcgacaccttctttcctgagatagacctggagaagtacaagctcttaccagagtacccaggtgtgctgagtgacgtgcaggaggagaagggaatcaagtacaaatttgaggtgtacgaaaagaatgattag

SEQ ID NO: 185363 - DNA, 963 bp, Artificial Sequence
  Description of Artificial Sequence: Synthetic coding sequence
atggccgccgtgcggatgctgcggacctggagccggaacgccggcaagctgatttgcgtcagatatttccaaacttgcgggaacgttcatgtgctcaagccaaactatgtttgctttttcggatatccatcgttcaagtactcccacccccaccactttctgaagaccactgctgctcttcggggccaggtcgtgcagttcaagttaagtgacatcggcgaaggcattagagaggtgacagttaaggagtggtacgtgaaggagggtgataccgtcagccaattcgactcaatttgcgaggtgcagtccgacaaggccagcgtgaccatcacctcacgatatgacggtgtcattaaaaagctgtactataacctcgatgacattgcttatgtcgggaaaccccttgtggacatcgagactgaagcactgaaagatagtgaagaggacgtcgtagagacaccagccgtgagccatgacgaacacacacaccaggagatcaagggccgcaagacattggctactcccgccgtccgtcgattggccatggagaacaacatcaagcttagcgaagtcgtgggtagcgggaaggatgggagaattctcaaagaggacatcctaaactatttggaaaaacaaaccggggcgattctgcctcccagtccgaaagtggaaataatgcctcctcctcctaagcctaaggacatgacggtccccatcttggtgtctaagccacccgtgttcactggcaaggacaaaacagagcctatcaaaggtttccagaaggccatggtgaaaactatgagcgctgcccttaaaatcccccatttcggatattgcgacgagatcgacctgaccgagctcgtgaaactgcgggaggagctcaagcccatcgccttcgctcgcggcataaaactctctttcatgccttttttcctgaagtactatttcagttggaaatcctag

SEQ ID NO: 185364 - DNA, 1449 bp, Artificial Sequence
  Description of Artificial Sequence: Synthetic coding sequence
atggccgccgtgcggatgctgcggacctggagccggaacgccggcaagctgatctgcgtaagatattttcagacatgtggaaacgtgcatgtcttgaagcccaactatgtgtgctttttcggatatccgagctttaaatattctcaccctcaccactttctgaagaccacagctgcccttagaggtcaggttgttcagtttaagctttctgacatcggggaaggaattagggaagtgacagtgaaagaatggtacgtgaaggaaggagatacagtcagccagtttgatagcatctgtgaggttcagagtgacaaagcctctgtgaccattacatccaggtatgacggtgtcatcaaaaaattgtattacaacttggacgatatcgcatacgtcggcaagccgttggtggacatagagactgaagccctgaaagatagcgaagaggacgtcgttgaaactcccgccgtgtcacacgatgagcacacacatcaggaaatcaaagggcggaagaccctggcaacacctgcagtgcgcagactggccatggaaaacaacatcaagctgtccgaggtggttggctctgggaaggacggtagaattctcaaggaggacatccttaactaccttgaaaagcagacgggtgctattttaccaccatcgcccaaagtcgagatcatgcccccaccccccaagccgaaagatatgacagtacctattctcgtctccaagcctcccgtgtttaccggcaaagacaagacagaaccaattaaaggattccagaaagctatggttaaaacgatgagcgctgctttaaagattccacatttcggctattgcgacgagattgacctgacggaactggttaagctgcgagaagaattgaaacccatcgcttttgccagaggcattaaactgtccttcatgccttttttccttaaagcagctagcctgggactactccaatttccgatactaaacgcgagtgtcgatgagaattgccaaaatattacctacaaggcatctcacaatatcggcattgcgatggatactgagcaagggttaatcgtgccgaatgtcaaaaatgtgcagatctgttctatcttcgacattgcaaccgagctgaaccggctgcagaagctgggctctgtaagtcagctgagtacaactgatctcacgggcggcacatttaccctgtcaaatatcggtagcatcggcggaaccttcgccaagcctgttatcatgccacccgaggtcgccatcggcgcacttgggagcatcaaggccattcccaggttcaaccagaagggcgaggtgtataaagcccagattatgaacgtctcatggtcagctgaccacagagtgatcgacggcgcaaccatgtcacggttcagcaacctttggaagagttacctcgaaaacccagcttttatgctgttagatctgaagtag

SEQ ID NO: 185365 - DNA, 906 bp, Artificial Sequence
  Description of Artificial Sequence: Synthetic coding sequence
atggagaacaacatcaagctgagcgaggtggtgggcagcggcaaggacggaaggatcctcaaggaagacattctgaattacctggagaagcagacaggggccatcctcccaccatctcctaaagttgagattatgccccccccccccaagcccaaggatatgaccgtgccaattctcgtgagcaagcccccagtcttcaccgggaaggacaagaccgagccaattaagggctttcagaaggccatggtcaaaacaatgagtgccgctcttaagattccccattttggatattgcgacgagatcgacctgactgagttagtgaagctgcgtgaagaattgaaacctatcgcgtttgctaggggtatcaaactcagcttcatgccctttttcctgaaggctgccagtctgggccttctccagtttcctatacttaacgcctctgtggacgagaattgtcagaacatcacctacaaggcgtcacacaatatagggatcgcgatggataccgaacagggcctcattgtgcccaacgttaagaatgttcagatatgttcaatcttcgacattgcaaccgaactgaaccggcttcagaaattggggagcgtctctcagcttagcactaccgatctgacgggtggtactttcaccctgtccaacatagggtcaatagggggaacgtttgccaagccagtgatcatgcctcccgaggtggcaattggagcccttggttcaattaaggctattcctcgattcaaccaaaagggggaagtgtacaaggctcagattatgaacgtctcttggagtgcagatcatcgggtgattgacggagccactatgagccgcttctccaacctgtggaagtcttacctggaaaaccctgcttttatgctcttagacctcaagtag

SEQ ID NO: 185366 - DNA, 5286 bp, Artificial Sequence
  Description of Artificial Sequence: Synthetic coding sequence
atgcagttccagctgaccctgttcctgcacctgggctggctgagctactctaaggcacaagatgattgtaaccgtggcgcctgtcaccccactacaggagacttactggtggggcgcaacacccagttaatggcttcatcaacatgtggcttaagtcgggcgcagaagtactgtattttgtcctaccttgagggtgagcagaagtgctttatctgcgattcccggtttccttatgacccctatgatcagcctaatagtcatactatagaaaatgtgatcgtatctttcgaacctgaccgggagaagaagtggtggcagtcagagaatggcctcgaccacgtcagcatacgactcgatctcgaggcactctttcgcttctcccatctgatcctgacctttaagactttcagaccagcagccatgctcgtggagaggtcaacagactacggacacaattggaaagtttttaaatattttgctaaggattgcgctacaagttttcctaacataactagcgggcaggctcagggagtgggggatattgtgtgtgattcgaagtactcagacattgagcccagcaccggaggagaggttgtgcttaaggtcttggatcctagctttgagatcgagaatccatactccccttacatccaagatcttgttacactcaccaatttacggataaacttcaccaagctgcacaccctgggcgacgccctgttaggccggaggcagaacgactccctggataagtattactacgccctatacgagatgatcgttcggggttcatgcttctgcaacgggcatgctagcgagtgtcggcctatgcagaagatgcggggggacgtcttcagtccccccgggatggttcacggacaatgcgtctgccaacataatacggatgggcccaactgcgagcggtgtaaggatttctttcaggatgccccctggaggcccgccgccgacctgcaagataatgcgtgtagaagttgttcctgcaattctcatagtagtagatgtcactttgacatgactacgtacctcgcctccggggggctgtcaggcggcgtatgcgaagactgccagcacaatacagagggccaacattgcgaccgctgcagaccactgttttaccgggacccgctgaaaactatctccgacccctacgcctgtatcccttgtgaatgcgatcccgatgggacaattagtggcggcatatgcgttagccatagtgatccagcgctaggcagcgtggcaggacagtgcttgtgtaaagaaaacgttgaaggggcgaagtgcgaccagtgtaaacccaaccattatggactgtccgcgaccgatccccttggctgtcaaccttgcgattgcaatcccctcggaagcctgccattcctcacctgcgatgtggacacggggcagtgcctttgtcttagttatgtgactggagcccactgtgaggagtgtacagtaggctattgggggctgggcaatcatctgcacggatgctctccatgcgattgtgatataggtggcgcctacagcaacgtctgctcccctaaaaacgggcagtgtgaatgccggccgcacgtgactggcaggtcatgttctgaacctgctccaggatacttttttgctccgttgaatttttatttgtatgaggccgaggaggccacaacccttcaagggctggcacccttgggatccgaaacttttggtcagtccccagccgtgcatgtggtgctgggcgaaccagtgcccggtaacccagtcacctggaccggacctggcttcgcaagagtgctcccaggagctggtctgcggttcgctgtgaacaatattcccttccctgtcgattttaccattgctattcattacgaaacacagagtgccgccgactggactgtccagatcgtggtgaaccccccaggcggcagtgaacactgcattccgaagactctccagtccaagccccagtctttcgccctgccagcagctacacggataatgctactgccaactccaatctgtttagagcctgatgtgcagtacagcattgatgtctatttctcccagcctctgcaaggggaatcccacgcccatagccacgtgctggtggatagcctgggactcattcctcagattaattcccttgagaacttctgttcaaaacaggatcttgatgagtaccaactgcataattgtgtggagatagccagcgctatgggccctcaggtgctgcccggagcctgtgaacggctcattatctccatgtccgcaaaactgcacgatggcgcagtagcctgcaaatgccatcctcaaggtagcgtgggcagctcatgtagccggttgggcggacagtgccaatgcaagcctctggtagtgggccgttgttgtgacagatgctcaacaggctcatacgacctgggccaccatggatgccatccttgccattgccacccccagggcagcaaggacaccgtctgtgaccaggttacagggcagtgcccttgccacggggaggtgtctggccgcagatgcgaccggtgccttgctggctacttcggtttcccatcttgtcacccttgcccttgcaataggtttgccgaactgtgcgatcctgagactggctcctgcttcaactgcggagggttcacaacaggcaggaactgtgagcgctgtatcgatgggtactacggcaaccctagcagcggccagccctgccgaccgtgcctgtgtccagatgatccaagctcgaatcagtacttcgctcacagctgttatcagaacttatggagctcagatgtgatctgcaattgccttcaaggctacacagggacacaatgcggggagtgttccactggattctatggcaacccacgcatatccggcgcgccctgtcagccatgtgcctgcaacaataatatcgacgtcaccgatcctgagtcatgcagccgggtgactggtgaatgtcttcggtgtctacataacactcaaggggctaattgtcagctttgtaagcccgggcactatggcagcgccttgaaccagacatgtcggcggtgctcttgccacgctagcggggtctccccaatggaatgtccaccgggagggggggcctgcctgtgcgaccccgtgacaggcgcctgtccctgcctacccaacgtcaccggattggcttgcgaccgttgtgcagacggttactggaacctggtgcccggccgtggttgccagtcgtgtgactgcgatccccggacctctcagagcagtcattgtgatcaattgacgggccagtgtccatgcaagctcggctatggggggaaaaggtgcagcgaatgtcaagagaattactatggggatccccccggccggtgcatcccttgcgattgtaacagagccggaacccagaagccaatctgcgaccctgacactgggatgtgccgttgtcgagagggagtgagtggccaacggtgtgatcggtgtgcccgggggcactcccaggagttccccacctgtttgcaatgccacctgtgctttgatcaatgggatcatacgatctcgtcgctgtccaaagcagtgcagggactgatgcgactcgcggccaacatggaagataaacgagagaccttgcctgtttgtgaggcggatttcaaggaccttagaggtaatgtttccgagatcgagaggatcctcaaacatcccgtatttccctctgggaagtttctgaaggtgaaggactaccacgatagtgtccgccgtcagattatgcagctgaacgaacagctgaaggctgtatatgagttccaagacttaaaggatacaatcgagagagccaagaatgaagccgatctgctcctcgaagatctccaggaggagatcgatttacaaagtagtgtgctgaacgcttccatcgcggacagttccgagaatatcaaaaaatactatcatatctccagctcagctgagaagaagatcaatgagactagctctacaatcaatacgagcgctaacactcggaatgacctgttgaccattctggatacactgaccagtaaaggtaatctctctctagaacggctcaaacagatcaaaatacccgacattcagattttaaatgagaaggtttgcggcgatcccgggaacgtcccttgtgttcctctgccgtgcgggggagccttatgcacaggtcggaaaggtcatagaaaatgtaggggaccgggatgccacgggtctctcacactttctactaacgccctccagaaagcccaggaagctaaaagcattattaggaacctggacaagcaggtcaggggactgaagaaccaaatcgagtccatttcggagcaggccgaagtctcaaagaataatgctctgcagctgagagaaaagttaggcaacatccgtaatcagtctgactccgaggaagagaacatcaacctcttcatcaaaaaagtgaagaattttttgctagaagaaaatgtgcctccagaggacattgaaaaggtggctaacggcgtcttggacatacacctccccatccctagtcagaatcttactgatgagctggtcaagattcagaaacacatgcagctttgtgaggactatcggactgatgagaaccgcctgaacgaggaagccgatggggcccaaaagctgctcgttaaggcaaaagccgcagagaaagcagcgaatatcctcctcaacttagacaagacacttaatcagcttcaacaggcccagattacccaaggccgcgctaactctacaatcacacaattaaccgcaaacatcacaaaaattaagaagaacgtgctacaggctgagaaccagactagggagatgaagtctgaactggagctcgccaagcagcggtcaggcttagaagacggactatcactattacaaaccaagcttcagagacatcaagaccacgccgtgaatgctaaggttcaggccgaatctgcccaacatcaggcggggagcctggagaaggagttcgtggaactcaaaaagcagtatgctatccttcaacgaaagactagcactactgggctgacgaaggagactcttggcaaagtgaagcagctgaaggacgcggcagagaaactggcaggggataccgaggcgaagatacgcaggattaccgaccttgagaggaaaatccaggacttgaacctttcacgccaggcgaaggcagaccagcttagaattctcgaagaccaggtggtagcaattaaaaacgagattgtggaacaggaaaaaaaatatgcgaggtgctattcatag

SEQ ID NO: 185367 - DNA, 1530 bp, Artificial Sequence
  Description of Artificial Sequence: Synthetic coding sequence
atgcagagctggagccgggtgtactgcagcctggccaagcggggccacttcaatcggatctcacacggactccagggcctaagcgcggtgccattacgaacttatgccgaccagcctattgacgccgacgtgacagtcattggctccggacctggggggtacgtggccgccattaaagccgctcagctcggattcaaaaccgtgtgtatcgagaaaaatgagacgctaggtggtacctgcctgaacgtcggatgcattccctccaaggctctgctgaacaactcccactactaccatatggcacatggcaaggacttcgcttccagaggtatcgaaatgtccgaagtaaggttgaatctagataaaatgatggagcagaagtctactgccgtgaaagcactgactgggggtatagctcacttgtttaaacagaataaggtggtgcacgtgaatgggtacgggaagatcacggggaagaaccaggttactgccaccaaagccgatggagggacacaggtgatagacaccaaaaatatcctcattgccacagggtccgaagttaccccttttccaggcatcacaattgacgaagataccattgtgagcagtaccggcgctctctccctgaaaaaggtgcctgagaaaatggttgtgattggagctggggttataggcgtggagctgggaagcgtatggcagcggctgggtgccgatgtaacagctgtcgagtttctcggacatgtaggcggcgtaggcatcgacatggagatctcaaagaatttccagcggattctccagaagcaggggtttaaattcaagttgaacacaaaggtcacaggagcaaccaaaaagagtgacggcaagattgacgtgagtattgaggctgcatccggggggaaggctgaggtgatcacatgcgacgtcctgctggtgtgtatcggcagaaggccctttacgaagaatctcggcctagaggaattaggtatcgaactcgatccccgagggaggatacctgtgaacactaggttccagactaaaattcctaacatttatgccatcggagacgtggtcgccggtcctatgctggctcacaaggcagaagacgagggtatcatttgtgttgagggtatggccgggggagcggtgcacattgactacaactgtgtaccatccgtgatctacacacacccggaggtggcttgggttgggaagtccgaagaacaactaaaagaggaaggcattgagtacaaagttggaaaatttccattcgctgcaaacagccgggcgaaaacaaacgccgacactgatggaatggtgaagatccttggtcagaagtctaccgacagagtgctaggggcccatatcctgggccccggtgcgggggagatggtcaatgaggcagcacttgctttggagtacggcgcttcatgcgaggatattgcacgcgtttgccatgcgcatcctacgttaagtgaagcgtttagagaagccaacttagctgcatcatttggcaagtctataaatttctag

SEQ ID NO: 185368 - DNA, 1386 bp, Artificial Sequence
  Description of Artificial Sequence: Synthetic coding sequence
atgcagagctggagccgggtgtactgcagcctggccaagcggggccacttcaaccgtatctcacacggattgcagggcctcagcgccgttccacttcggacctatgccgatcagcccattgacgcggacgtgaccgtgatcggcagcggacccgggggatacgtggccgcaataaaggcagctcagctaggattcaagacagtgtgcattgaaaaaaacgaaactctggggggcacttgtctgaacgtgggctgtattccttctaaagccctcctcaacaacagccattactaccacatggcacacggcaaagattttgcttcccggggcatcgagatgtcagaagtaagactgaatctcgataagatgatggagcaaaaatctacagccgtgaaagcactgactggggggatcgcacatctcttcaaacagaataagatagacgaggatacaatcgtcagttcaaccggggcactttccctcaaaaaggtcccggagaagatggtggtgatcggtgccggcgtaatcggcgtggaactcgggtcagtctggcagcgcctgggagcagacgtgacggcggtggagtttctcggccacgtcggcggggtcggcatcgatatggagatctcaaaaaactttcagagaatcctccagaaacagggtttcaaattcaagctcaacaccaaggtgaccggggctactaaaaagtccgacggtaaaatagatgtgtcaatcgaggccgcgtccggtgggaaagccgaagtaatcacatgcgacgttctgctggtgtgtatcggccgtcggccatttaccaaaaacctgggcctcgaggagctgggcatagagctcgatccaaggggccggatacctgttaatactaggttccaaactaagattcccaacatctatgcaataggagatgtagtggcaggccccatgctggctcacaaagctgaggacgaagggatcatctgtgttgagggaatggcaggaggggctgtacacattgattacaattgtgtcccaagtgttatatatactcatccagaagtcgcctgggttggcaagagcgaagaacaactgaaggaggaaggaattgaatacaaggtgggtaagttcccatttgcagccaatagccgagcgaagaccaatgccgatactgacggcatggtgaaaatcctcggccagaagagtacggaccgggtgctcggtgcacatattctgggacctggcgccggggaaatggtgaacgaagctgccctggccctggagtatggcgcctcgtgtgaagacattgcgcgggtgtgtcacgcgcatcccacgctgtcagaggccttccgcgaggctaacctggctgcctcatttgggaaaagcattaatttttag

SEQ ID NO: 185369 - DNA, 1461 bp, Artificial Sequence
  Description of Artificial Sequence: Synthetic coding sequence
atgcagagctggagccgggtgtactgcagcctggccaagcggggccactttaacagaatcagccacggtctgcagggactgtccgctgtcccactccggacatacgccgaccagccaatcgatgctgatgttaccgtgatcggatcaggacccggaggttacgtcgcagccatcaaggctgcccagctggggttcaaggctctgctcaacaattctcactactaccatatggctcacggtaaagactttgcatcgcgaggcattgaaatgtccgaagtccgactcaatttagacaaaatgatggagcagaaaagtaccgctgttaaagccctcacaggcggaatcgctcacctgtttaaacaaaacaaagtcgtgcacgtgaatggctatgggaaaattacgggtaagaatcaggtgactgcaaccaaggcagacggcgggacccaggtgatcgataccaagaatatattaatcgcaactggttctgaagtcacccccttccccggaattaccatcgatgaggacactattgtctcttcaacaggcgccctgagtctgaagaaagtcccagaaaaaatggttgtgatcggggctggcgtgatcggagtcgagctgggctccgtctggcagcgactgggtgccgacgtaacagcagtggaattcctcggccacgtgggaggagtcgggatcgacatggagatatctaagaattttcagcgcatcctacagaagcagggtttcaagtttaagttaaacacgaaagtcaccggtgccacaaaaaagtccgatggcaagatcgatgtttcaatcgaggctgcctcaggtggaaaagcagaagtgatcacttgtgatgtgctgttggtctgtatcgggcggcgtcctttcactaagaacttaggccttgaggaactgggcattgagctcgacccacgcggacgcattcccgtgaacacccgctttcagaccaagatcccaaacatttatgccataggagacgtagtcgcgggcccaatgcttgcccacaaagcagaagacgagggaatcatatgtgtcgaaggaatggcaggcggcgccgtgcacattgattacaactgtgttccctcagtcatttatacacacccggaggtggcctgggtagggaaatcagaggaacaactcaaagaggaaggtatagaatacaaagtaggaaaattcccattcgctgctaattctagagctaagaccaacgccgacactgacggtatggtgaagattttgggtcagaagtcaacggatcgggtcctgggcgcccatatcctcgggcccggcgctggggaaatggtaaacgaagcagctctcgccttggaatacggcgccagttgtgaggatattgcccgggtctgccatgcacacccaacgttatcggaagcctttcgggaagcaaacctggctgcaagtttcgggaagagtatcaatttctag

SEQ ID NO: 185370 - DNA, 1233 bp, Artificial Sequence
  Description of Artificial Sequence: Synthetic coding sequence
atggcccacggcaaggacttcgccagccggggcatcgagatgagcgaggtaaggctcaatttggacaagatgatggaacagaaaagcactgccgttaaggccctcacaggcggaatagcccacctgtttaagcagaataaggtagtgcacgttaacggctacgggaaaattaccgggaagaaccaggtcaccgcaaccaaggcagatgggggcacgcaggttatcgacactaaaaatatcctcatcgccacaggctccgaggttacacccttccccggcatcaccatcgatgaggataccatcgtctcctcaaccggcgcgctgtcactcaagaaagtccccgagaaaatggtggtgatcggtgcaggcgtcatcggcgtggagttgggttcagtgtggcaaagattgggggctgacgtcacagccgtcgaatttctaggccacgtgggtggcgtgggtatcgacatggaaatatccaagaatttccagcgtatcctccagaaacagggctttaaatttaagttgaatacaaaagtgactggcgcaactaaaaagtcggatggaaagattgatgtatcgatagaggccgcttcaggaggcaaagccgaagtcatcacctgcgacgtgcttctcgtctgtatcggacggagacctttcacaaaaaatctcggcctggaagagttgggtatcgagctggaccctcgcgggagaatcccggtgaacacccgcttccagaccaaaatccccaatatttacgcaataggggatgtggtcgctggtcccatgctggcccataaagccgaagatgagggtattatctgcgttgaggggatggccggtggcgccgttcatatagattacaattgtgtcccatccgtcatctatactcaccctgaggtcgcatgggttgggaaatcagaagaacagctaaaggaggaaggtattgagtacaaggtgggcaaatttccctttgccgctaacagcagggctaagacaaacgccgatactgacggcatggtgaaaattttaggacaaaagtcaaccgatcgagtgcttggagctcacatcctcgggcccggggccggggagatggtcaatgaggctgcattggctctggagtacggggctagctgcgaggatatcgccagagtttgccacgcccaccctactctctccgaggcttttcgggaagcaaatctggccgcatcattcggcaaaagcatcaatttctag

SEQ ID NO: 185371 - DNA, 1380 bp, Artificial Sequence
  Description of Artificial Sequence: Synthetic coding sequence
atgctgatctacgtggccgccatcaaggccgcccagctgggcttcaagacagtttgcattgagaagaacgagaccctcggcgggacctgtctcaatgtcggctgcattccatccaaggctctgctgaataacagccattactatcatatggctcacggcaaagatttcgcatccagaggaattgagatgtcagaggtgcggttaaacctggataagatgatggagcaaaagtccactgccgtgaaagctctaacaggcggcatcgcccacttattcaaacagaacaaagtggtacacgtgaatggttacggtaagatcactggaaaaaaccaggttactgcaactaaagccgatgggggtacgcaggtcattgacactaagaacatccttatcgctactggctccgaggttaccccctttcctggcattactatcgatgaagacaccatcgtctcctcgactggcgctctatccttgaagaaagtgccagagaagatggtggtgattggggcaggagtgataggagttgagctgggctcagtgtggcagcggctaggtgcagatgtcacagcagttgagttcctcggacacgtaggcggcgtcggcatagacatggagatttccaagaactttcagcggattctgcagaaacagggctttaagttcaaactaaatacgaaggtgactggagccaccaagaaaagcgacgggaagattgacgtttctatagaggcagctagcggtggcaaggctgaagtcataacctgcgacgtgttgctggtgtgcatcggtagaaggccattcaccaaaaatcttgggttggaggagcttggcatcgaactagaccccaggggacgcatccccgtgaatacgcggtttcagacgaagatccctaacatttacgccattggggacgttgtcgccggcccgatgttagcacacaaggccgaagacgaaggaatcatatgtgtggaaggtatggctggaggggccgttcacattgactataactgtgtgcccagcgtgatatacacgcatcctgaggtcgcctgggtcggaaaatccgaagagcaactcaaggaagagggaattgaatataaggttggcaaattcccatttgcggccaacagtagagcgaaaaccaatgctgatactgacggtatggtaaagattctggggcagaagtctacggatagggtccttggggcgcacattctgggtcctggggccggagagatggttaatgaagccgcgctggcacttgagtatggggcgtcatgtgaggacatcgctcgggtgtgccatgcgcatccaactctcagcgaggctttccgagaagccaatctggccgcaagcttcggcaaatccatcaatttttag

SEQ ID NO: 185372 - DNA, 1944 bp, Artificial Sequence
  Description of Artificial Sequence: Synthetic coding sequence
atgtggcgggtgtgcgcccggcgggcccagaacgtggccccctgggccgggctggaggcgcgctggactgccctgcaggaggtgcccggtaccccccgggtgacttcccgttccggtcccgccccggccaggcggaactcagtgaccacaggatacgggggcgtgcgcgctctgtgcggctggacacccagcagtggggctaccccccgcaataggctcctgctccaactgctaggctcacctggaaggaggtattattcgctgcccccccaccagaaagtcccgctgccaagcctgagtccaaccatgcaggctggaactattgcacggtgggaaaagaaggagggagacaagataaatgaaggagatttaatcgctgaagtggaaaccgacaaggctactgtaggattcgagtcacttgaggaatgctatatggcgaagatcctcgtagcagaaggaaccagagacgtgcctattggtgccataatctgcataacggtcggaaaacctgaggatatcgaggccttcaagaactataccttggatagtagtgccgcacctacaccacaggcagcgcctgctcctacccccgccgctaccgcttctccaccaaccccgagcgcccaggcaccagggagttcataccctccgcatatgcaggttctgctgcccgcgctgtcacctacaatgacaatgggaactgtgcaaaggtgggaaaaaaaggttggggagaagctctctgagggagacctgctcgccgagatcgagaccgacaaggctacgatcggtttcgaggtgcaggaagaaggctatctagccaaaattttggtgcctgaggggaccagagacgttcctttaggcactcctctgtgtatcatcgtcgagaaagaggcagatatttctgccttcgcggattatcgcccaacggaagttactgacctgaaaccccaggtccccccgcccacgccccccccggttgccgcagtcccaccaacccctcagccactggcacccacccccagcgccccctgtcccgctacgcctgcggggcctaagggccgggtatttgtctcccccctcgctaagaaactggctgttgagaaagggatagatttgacccaggtcaaaggaacaggtcctgacggtcgcatcaccaaaaaggatattgattcgtttgttccatctaaggtcgcaccagccccagccgccgtcgtgcctccaaccgggcccgggatggctcctgtccctacaggagttttcactgacatcccaatcagcaatatcaggcgcgtcatagcgcaacggctgatgcaatccaaacaaaccattccccactactacctatccattgacgtcaatatgggagaagtgttattggtcaggaaggagcttaataagatcttggaaggcagatctaaaatatcagtcaacgacttcattatcaaggcatcagctctggcctgcttgaaggtccccgaggctaactccagttggatggatacagttatccgtcagaatcacgtggtcgacgtgtcggtggccgtctcaacacccgcaggcctcataacccctatagtcttcaacgcacatattaaaggggtggagactattgcgaacgacgtggtgtcactggcgaccaaagctagggaaggcaaactccagccgcatgagttccaaggcggaacattcactatttccaatctcggtatgttcggcatcaagaatttctcagcaatcatcaacccaccacaggcttgtattctggcgataggcgcatccgaggacaaactggtgcccgctgataacgagaagggttttgatgtcgccagcatgatgagtgtgactctcagttgtgatcaccgggtggttgacggggctgtgggagcccagtggctcgccgagttccgcaagtatcttgagaaaccgatcactatgcttctctag

SEQ ID NO: 185373 - DNA, 678 bp, Artificial Sequence
  Description of Artificial Sequence: Synthetic coding sequence
atgtggcgggtgtgcgcccggcgggcccagaacgtggccccctgggctggtctggaggcaaggtggacggcacttcaggaagtccctggcaccccccgtgtgactagccgctcaggcccagcacccgcacggagaaattcagtgactactggttatggcggggtgagggccctctgcgggtggacccccagcagcggagctacacctcgcaaccgtctgctcctccagctgctgggatcccctggtcgtagatactattcactgcccccccaccaaaaggtcccgttgcccagtctcagcccaactatgcaggctggtaccatcgctaggtgggaaaaaaaggagggcgacaaaataaacgaaggcgatttgattgccgaggtggagacagacaaagccacagtcggaaagccggaagatattgaagcatttaagaattataccctggacagttccgctgctccaaccccccaggccgctccagcaccaactccagctgccacagcttcgcctccaacgccctctgcgcaagcccccgggtctagttaccctccacatatgcaggttcttcttcctgcactcagcccgactatgaccatgggtacggtccagcgttgggaaaagaaagtcggggaaaagcttagtgaaggagacttactcgcggagatgagcttatag

SEQ ID NO: 185374 - DNA, 1257 bp, Artificial Sequence
  Description of Artificial Sequence: Synthetic coding sequence
atgcaggccggcaccatcgcccggtgggagaagaaggagggcgacaagataaatgagggcgatcttctggcagaaatcgagacagataaagcaacgatcggctttgaggtgcaagaggaaggatatctggccaaaatcctggtgccagagggtacacgagatgtccctttggggactccactttgcattatagtcgaaaaggaggctgatatttcggcctttgcggattacaggcccaccgaagtcactgaccttaaaccacaagtcccacctcccacacctccacccgtggccgcggtgcctcccacaccgcagccccttgcccccacaccatctgcaccctgccccgctacaccagcaggacccaaaggcagagtgttcgtgagccctttggcaaagaagcttgccgttgaaaaaggcattgatctcactcaggtcaagggcacaggtcccgacggtagaataacaaaaaaggacattgattcttttgtgcccagcaaggttgctcccgcaccagccgccgtagtcccaccaacagggcctggtatggctcctgtccccactggtgtgttcactgacatccctatcagtaatatacggagagtcatagcacagagactgatgcaatccaagcagactattcctcactactatctctcaattgatgtaaatatgggcgaggttctattagtgcgtaaagaactgaataaaatacttgagggacggtccaagatctccgtgaacgattttatcatcaaagcctctgccctggcctgccttaaggtcccagaagctaacagttcttggatggatactgtaatcagacagaaccacgtggtggatgtgtccgtcgcagtgtcaacccctgccggcctcattacgcctatcgtcttcaacgcccacattaagggggtcgagactatcgcaaacgatgtggtgtccctcgctacaaaagcacgtgaggggaagcttcagcctcatgagtttcaaggcggcaccttcacaatctcaaaccttgggatgttcggtattaaaaatttcagtgctatcataaacccaccccaagcttgcattctggcgattggggcgagcgaagataaactggttccagccgataacgaaaagggattcgacgtcgccagcatgatgtcagtgaccctgtcttgtgaccatcgggtcgtggacggcgcagtaggcgctcagtggttagccgaattccgtaagtatctagagaaacctatcacaatgcttctctag

SEQ ID NO: 185375 - DNA, 1104 bp, Artificial Sequence
  Description of Artificial Sequence: Synthetic coding sequence
atgacctggctgcagagcaagccccagcggctgcagaacctgagccaacgcgagatgagcgggggcagaaagactagcgtgcaagtgccttctcccgccaacggcgtgatcgaagccttgttggtgcctgacggtggcaaagtggagggaggcactcctctgtttacattgcgtaagactggggctgccccggcaaaagctaagcccgcggaggcgccagctgccgcagcccccaaggccgagccgacagcagctgctgtgccccccccagctgcccccattcccacccagatgcccccagtgccttccccgtcgcaacccccctcggggaagccagttagcgccgtaaagccaaccgtggcgccccccctcgcagagccaggagccggaaagggcctccgaagtgaacacagggaaaaaatgaaccggatgcgtcagcgcatcgcccagcgcctgaaggaggcacagaatacttgtgcaatgctgacaacattcaatgagattgacatgtctaatattcaggagatgcgggcacgacacaaagaggcttttttgaaaaagcacaatttgaagctgggatttatgtcagcgtttgtaaaagccagcgcctttgcccttcaagagcagcctgtggtgaatgcagtgattgacgatacaaccaaagaggtagtttacagagactatattgacattagtgttgccgttgcgaccccaagagggctggttgttccagtcatccgcaacgttgaggccatgaatttcgccgatatcgagcgcaccatcacagaactgggcgagaaggctaggaagaacgagctcgccatagaagacatggatggcgggacatttaccatttccaacgggggcgtctttggatcactgtttggcacccccataatcaatcctccgcagtccgccatcctggggatgcatgggattttcgaccggcctgtggccataggaggaaaagtggaagtcagacccatgatgtacgtagcgttaacatatgaccatagactcattgacgggagggaggctgtgaccttcctgaggaagataaaggccgctgtggaggacccgagggtgctgcttctggatctctag

SEQ ID NO: 185376 - DNA, 1362 bp, Artificial Sequence
  Description of Artificial Sequence: Synthetic coding sequence
atgctgagccggagccggtgcgtgagccgggccttcagccggagcctctccgcattccagaagggcaattgccccctggggcgaaggagcctgccaggggtgtccctctgccagggccccgggtacccaaatagccgcaaagtggtaattaacaattcagtgttttccgttcgtttcttccggacaaccgctgtgtgtaaggatgatcttgtgactgtcaaaacgcccgccttcgccgaatctgtgaccgagggagatgtccgatgggagaaggccgtgggagatactgtcgctgaggacgaagtcgtttgtgagatcgaaacagataagacctcagttcaggtgcccagccccgccaacggggtaatcgaagcactactggtacctgatggcggaaaagtcgagggaggaactccgctttttactctaaggaagactggtgcggcgccagccaaggccaagccagcggaggcacccgcagctgccgctccgaaagctgagcctaccgccgctgccgttccaccacccgcagcccccattccaacccagatgcctcccgttccatccccatcccagccaccttccggaaaacctgtgtctgccgtgaaacctaccgtggcacctccactggccgaacccggggccggtaaaggtctacgcagcgaacatcgagagaagatgaatcgaatgaggcagcgtatagcacagcgattgaaggaagctcaaaatacttgtgcaatgctgacaacattcaatgaaatagacatgtccaacattcaagaaatgagggcccgtcacaaggaggcatttctaaagaagcataacctgaaactcggcttcatgtcggcttttgtgaaggctagcgccttcgcgctgcaggagcagccagtggtgaacgcggttatcgacgacactaccaaagaagtggtctatagagattacattgatatatcggtagccgtggctaccccaaggggactcgtggtgccagtcatcagaaacgttgaggctatgaactttgcggatatcgagaggaccatcactgaactgggagaaaaagcgaggaaaaatgagctggcaatcgaggacatggacgggggtactttcacaatatccaacgggggcgtctttggaagcctcttcggtacccccataataaaccccccccagtctgccattcttggtatgcacggcatattcgaccgcccagtcgctattggaggaaaggtggaggtccgaccaatgatgtacgtggccttgacttatgaccaccgtctgatcgatggacgagaagccgtgacatttttgagaaaaatcaaggccgccgtggaagacccacgcgtactacttttagacctgtag

SEQ ID NO: 185377 - DNA, 282 bp, Artificial Sequence
  Description of Artificial Sequence: Synthetic coding sequence
atggaccggctgcagaccgccctgctggtggtgctggtgctgctggccgtggctctacaagccacagaggcaggaccgtatggggcaaatatggaagactcagtttgttgtcgggactatgttagatataggctgcccctgcgcgtcgttaagcatttttattggacaagtgactcatgtccccggcccggagtcgtcctgctgacattcagggacaaagaaatttgcgcggatccacgcgtaccttgggtcaagatgatactgaataaactgtcccagtag

SEQ ID NO: 185378 - DNA, 1560 bp, Artificial Sequence
  Description of Artificial Sequence: Synthetic coding sequence
atggccgcccccagccggctgctgatccggggcggccgggtggtgaatgacgactttagtgaagtggcagacgtgctggtggaggacggagttgttcgagctctggggcacgacttgctcccgcctggcggagcacctgccggactgagagtgctagatgctgccggaaaactcgttctccccgggggcatcgatacgcacacccatatgcagttcccgtttatgggttcacgcagtatcgatgacttccatcaggggaccaaggcagccctgtccggcggtacaactatgattattgattttgccatcccccagaagggcggctccctgattgaggcttttgaaacctggagaagctgggcggatccaaaagtttgttgtgattactcactgcacgtggctgtgacatggtggagcgatcaggtgaaggaagagatgaaaatcctggtgcaagacaagggggttaattctttcaaaatgttcatggcatataaggacctgtatatggtgacggatctagagttgtacgaggccttttccagatgcaaggaaattggagcaatcgctcaggttcacgcagaaaatggcgacctgatcgctgaaggggccaagaagatgcttgctcttggcattacaggccccgaaggccatgagctgtgcagacctgaggctgtggaagcagaggctactctgagggccatcacgattgcctctgctgtcaactgcccactatacatcgtgcatgtcatgagtaaatcagcggccaaagtgattgccgatgccaggcgagacgggaaggtggtgtacggggagcctatcgccgcttcactggggacagacggcactcattattggaataaggaatggcaccacgcggctcaccatgtgatgggacctccccttcgccctgacccttctacaccggattttttgatgaacttactcgcaaacgacgacctgaccaccacgggcaccgataactgcacttttaacacatgtcagaaagctttaggaaaagatgatttcacgaagataccaaacggggtgaacggggtagaagatagaatgagcgtgatttgggagaagggggtgcactccgggaaaatggatgagaaccggtttgtcgccgtgacttctactaatgccgcaaagatcttcaacctttatcccaggaaaggcagaattgcagtgggcagtgatgcagatatagttatttgggaccctaagggcacacgcactataagtgccaagactcaccaccaggcagtgaattttaatatatttgaaggaatggtctgccacggagtgcctctagtcacaatctcacggggcaaggtggtatatgaggccggagtgttcagcgtgactgccggtgatggaaagtttataccaaggaagccctttgcagagtacatttacaagcgtatcaagcagagggaccgaacctgcacacccactcctgtggaaagagccccctataagggcgaggtggcgaccctgaagtcccgtgttactaaagaagatgcaacagcagggacaagaaaacaagctcatccctag

SEQ ID NO: 185379 - DNA, 1719 bp, Artificial Sequence
  Description of Artificial Sequence: Synthetic coding sequence
atgagctaccagggcaagaagaacatcccccggatcaccagcgaccgtctgctgatcaaagggggcaagatcgtgaacgacgaccagtctttttacgccgatatctacatggaggacggactgataaagcagataggggaaaatctgatcgtgccagggggtgtgaagacaattgaggcgcattccaggatggtcatcccagggggtatagacgtgcacactcgcttccagatgccagaccaagggatgacctctgctgacgactttttccagggcacaaaagctgccctggccggcggaaccacaatgataattgaccacgtagtaccagaaccaggtacatcactgttagctgccttcgatcagtggcgtgagtgggccgatagtaaaagttgttgcgattactctctgcatgttgacatttctgaatggcacaaggggatccaagaggagatggaagcattggtgaaagatcatggggtcaatagttttctggtgtatatggcctttaaagacaggtttcagctcaccgactgccagatctatgaagttctatccgtcatccgagacatcggcgccatagctcaagtgcacgccgaaaacggggatatcatcgcagaggagcagcagcgcattctcgatttaggaattaccggaccggagggacatgtcctctcaaggccagaggaagtggaagccgaggccgttaatagagccatcacaattgcaaaccagaccaactgtcctttgtatatcactaaggttatgtccaaatcctctgcggaggtgattgcacaggccagaaaaaaaggaaccgtggtgtacggggaacccatcacagcatctctcggcactgacgggtctcattactggtcgaagaactgggcgaaagcagcggcattcgtgacatctccacccttatccccagacccgaccacccccgattttttgaacagcctcctcagttgtggcgacctgcaggtgacaggaagtgcccactgcacattcaacacggcacagaaggcagttggtaaggataactttactttaatccccgagggaactaacggcaccgaagagcgtatgagcgtgatttgggataaagccgtcgttactgggaagatggacgaaaaccaattcgttgccgtcacctccaccaacgccgcgaaggtgtttaacctgtatcctcggaaaggaaggatagctgtgggatctgacgctgatctcgtgatctgggaccctgattctgtgaaaacaatttccgcaaagacacataattcttccctcgaatacaatatatttgagggtatggaatgccggggcagcccccttgtggtgattagtcagggcaaaattgttttggaggatggaactctgcacgtcacagagggaagtggaaggtatattccgcgaaaacccttccctgatttcgtgtataagaggatcaaggccaggagccgcctagctgaacttagaggcgtgcccagaggtctttatgatggccctgtatgcgaggtgtcggttaccccaaaaacggtgacccctgcgagtagcgcaaagacttccccagccaaacagcaggcccctcccgtcaggaatctgcaccaaagcggcttcagtttgtctggcgcgcaaatagatgacaatatccctagaagaactacccagcggatcgtcgccccccccggcgggcgcgcaaatatcacctctctggggtag

SEQ ID NO: 185380 - DNA, 1611 bp, Artificial Sequence
  Description of Artificial Sequence: Synthetic coding sequence
atggaggacggcctgatcaagcagatcggcgagaacctgatcgtgcctggcggggtgaaaaccattgaagctcattcgagaatggtgatcccagggggtattgacgtgcataccagattccagatgcccgatcaggggatgacttctgcggacgattttttccagggcaccaaggcagctctggcaggcggaaccactatgatcatcgaccatgtggtacctgagcccggcaccagtctcctggccgcattcgaccagtggagggaatgggcagactctaagtcctgttgtgactattctctgcatgtagacatctccgaatggcataaggggattcaggaagagatggaagccctggtgaaggaccatggcgtcaactcatttcttgtatacatggctttcaaggacagattccagttaaccgattgccagatttatgaggtgttgtcagtgattagagacatcggcgccatcgcacaggtgcatgccgagaatggagacataatcgccgaggaacagcagcggatcctcgatttgggcatcactggacctgagggacacgtgttgagtaggcccgaggaagtggaggctgaggctgtcaaccgtgctatcactattgccaatcaaaccaactgccctctctacatcacaaaggtgatgtccaaatcaagcgctgaagtgatagcccaggcgcgtaagaagggtaccgtagtgtacggcgagccaataactgcctcccttgggaccgacggctcccactactggtcgaaaaactgggccaaggctgccgcttttgtcaccagcccacctctgtcacccgaccccaccactcctgatttcctgaattccctgctctcttgcggcgacctgcaagtaaccggctccgcccattgcactttcaataccgcccagaaggcagtgggcaaagataattttaccctgatcccagagggtacgaacggcacagaggagcgcatgagcgttatctgggacaaggcggtcgtcaccggtaaaatggacgaaaaccagtttgtcgctgtgacctcaaccaacgcggccaaggtttttaatctgtacccaaggaagggcaggatcgctgtcggcagtgatgcagatctcgttatttgggatcctgacagcgtgaagactatatcagctaagactcataatagctctttggaatataacattttcgaagggatggagtgtcgaggctctcccctcgtagtgatttcccaggggaagatcgtgctggaggacggaacattgcacgtgaccgaaggatctggcaggtacatacctcgcaagccgttccctgatttcgtgtataaacggatcaaggcgcggtctcggctcgctgagttacggggcgtcccccggggcctctacgacgggcctgtctgtgaggtcagcgtgacgccaaagaccgtcacccccgcctcatcagccaagaccagtccggccaagcagcaggccccccctgtaaggaatttacaccaaagcgggttcagcttgagcggggcccagattgacgacaacatccctaggcgaacgacccaaaggattgtggccccgcctggtgggagggccaacatcaccagcctgggttag

SEQ ID NO: 185381 - DNA, 1719 bp, Artificial Sequence
  Description of Artificial Sequence: Synthetic coding sequence
atgagctaccagggcaagaagaacatcccccggatcaccagcgacaggctcctgattaaaggcggcaaaatagttaacgacgatcagtccttctacgctgacatttacatggaggatggtttgattaagcagataggcgagaatctcatcgtaccaggtggagtaaaaactatagaggcgcatagccgaatggtcatcccaggggggattgatgtccatacaaggttccagatgcctgatcaggggatgaccagtgccgacgacttcttccaggggaccaaggcagcgttggccgggggaactaccatgatcattgaccacgttgtaccagaaccggggacttctcttttagctgcttttgatcagtggcgggaatgggcagatagcaaaagttgctgcgattattctttgcatgtagatattagcgaatggcacaagggaattcaggaggaaatggaggctctggtcaaagaccatggtgtcaattcattcctggtgtacatggcgttcaaggaccggtttcagctaacagactgccagatttacgaggtgcttagcgttatcagagacattggggctattgcccaggtgcacgcggagaatggtgatattatagccgaagagcaacagagaatccttgatctcggcataactggcccggaaggccatgtattatctcgtcccgaggaggtggaggcggaagctgtgaatcgggctatcaccatagcaaatcagacaaattgccctctgtatattactaaagtgatgtcaaagagttcagctgaggtgatcgcccaagctcggaaaaagggtaccgtggtgtacggggagcccattacagcctccctgggaaccgatggttcccactactggagcaaaaattgggctaaagcggccgcgttcgtaacaagtccccctctgtcccccgaccccacgacaccggactttctaaactctctcctctcctgtggcgacctccaggtcacgggtagtgcgcactgcacctttaacactgcacaaaaggctgtgggtaaagacaacttcacattaattcccgaagggacaaatggcaccgaggagcgtatgtccgttatatgggacaaggccgttgtcaccggcaaaatggatgaaaaccagttcgtggcagtgacctccactaacgctgcgaaagtgtttaacttatatccaaggaaaggaaggattgccgtgggttcggatgcagatctggtaatctgggatcccgatagtgtcaagacaatcagtgctaagacgcacaacagttccctggaatacaatatttttgaagggatggaatgtcgggggagcccgctggtggtcattagtcagggtaagatcgtcctcgaggacggtacgctccacgtcactgagggcagcggcagatatataccccgtaaacccttccccgacttcgtctataaaaggatcaaagccaggagccgattggccgagcttcggggggtcccccgaggactgtacgatggaccggtctgtgaggtaagtgtgacccccaagaccgtgacccctgcttctagcgccaagacatcgcctgcaaaacagcaggccccacccgtgcgtaacctgcaccagtcaggctttagcttatccggggcccagatcgatgacaatatcccaagacgtacaacacagcgaattgttgcaccacccggggggagggctaatattacaagcctgggatag

SEQ ID NO: 185382 - DNA, 1611 bp, Artificial Sequence
  Description of Artificial Sequence: Synthetic coding sequence
atggaggacggcctgatcaagcagatcggcgagaacctgatcgtgccaggcggcgtcaagacaatcgaagcgcacagcaggatggtgatcccaggcggcatagacgttcacacccggtttcaaatgccagaccaggggatgaccagcgccgatgatttcttccagggcacaaaggccgccctcgccgggggaaccaccatgatcattgaccatgtggtgcctgagccaggaacgagtctcctggctgcttttgaccagtggcgagaatgggctgattctaagagctgttgtgactactccttacatgttgacatatctgaatggcacaagggcatacaggaggagatggaggctctggtcaaggaccacggggtgaattctttcctggtctacatggctttcaaagacaggtttcagctgaccgattgccagatctacgaagtgctgagcgtgatccgagacatcggtgcaatagcccaagtccacgctgagaatggcgacattattgcagaggagcagcaacgaattcttgatctcggcatcaccgggccagaaggccatgtgttgtctcggccagaggaggtcgaggcagaggctgtgaaccgcgccatcactatcgcaaaccaaaccaactgcccgttgtacatcacaaaggtcatgtctaagagcagtgctgaagttattgcccaagcgcggaaaaaaggtacagttgtctacggagagcctattactgctagcctgggtaccgacgggagccactactggtccaaaaactgggccaaagccgccgcgtttgttacttcaccaccgctatctccagatcccaccacaccagactttctgaattccctgctgtcatgcggggatctgcaagtcacagggtccgcccactgcacatttaataccgcccagaaggcggtcggcaaggataactttacccttataccagaggggactaacggtaccgaggaaaggatgagtgtcatctgggataaagctgttgtcacggggaagatggatgaaaaccaattcgtggcggttacatctactaatgccgccaaagtgtttaatctgtatcctcgcaaggggcggatcgcagtcggctcggacgccgacctggtaatttgggacccagacagtgtaaagaccatttcagcaaaaacacacaacagctcactcgaatataacattttcgaggggatggagtgtagggggtccccactggtcgtaatctcccagggaaaaatcgtgttagaagacggcaccttacatgtaaccgaggggtcaggaaggtacatccccaggaaacccttcccggatttcgtgtacaaaagaataaaggcgcgctctcggcttgctgagttgcgaggggtgccacgcggtctgtatgacggtccagtgtgcgaggtcagcgtcacaccgaaaaccgtgacacccgcatctagcgctaaaactagtccagccaagcagcaggctccacccgtgaggaatctgcatcagagcggatttagtctcagcggggcgcagattgacgataatatcccaagaagaaccactcaacgaatcgtcgccccgcccggaggcagagcaaatattacaagcttagggtag

SEQ ID NO: 185383 - DNA, 597 bp, Artificial Sequence
  Description of Artificial Sequence: Synthetic coding sequence
atgagcgtgatctgggacaaggccgtggtgaccggcaagatggacgaaaatcagttcgtggccgtgaccagcaccaacgcggctaaagtatttaacctgtaccctagaaaaggcagaatcgccgtaggctcggacgccgacctggtgatatgggatccggacagtgttaagacaatctttgagggcatggagtgtcggggctcacccttggtggtgatcagccaagggaagatcgtcctagaggacggcactctgcatgtgactgaggggtccggccggtacatcccgcgaaagcctttcccagacttcgtttataaacgcatcaaagcgcgttccagactagccgaactgcgcggcgtaccacggggcttgtatgacggacccgtctgcgaagtgagcgttacgccaaaaaccgtcacccctgcatcttctgctaaaacctcacccgcgaaacagcaggccccccctgtgagaaacctccaccaatccggcttttcgctgagcggagcccagattgatgacaatattcccaggaggacgacccagagaattgtggcccctccaggtggcagggctaacattaccagccttgggtag

SEQ ID NO: 185384 - DNA, 2055 bp, Artificial Sequence
  Description of Artificial Sequence: Synthetic coding sequence
atggccagcggccggcggggctgggacagcagccacgaggacgacctgcccgtttaccttgcccggccaggaactaccgatcaagtgcccaggcagaagtacggcggcatgttttgcaatgttgagggcgcttttgaatcaaagacactggattttgatgcgctatccgtcggtcagagaggagccaaaaccccaagaagtgggcagggaagcgatcggggcagcggatctcgcccaggaatcgaaggagacaccccaaggagaggtcaagggcgcgaggagtcacgggagccggcacccgcatcccctgctccagccggagttgaaattcggagcgcgactgggaaggaggtgcttcagaacttaggaccgaaggataagagcgatagactgctgatcaaaggcggtcgtatcgttaatgacgatcagagcttctatgctgacatttatatggaggatgggctcatcaaacagattggagacaacctgattgtgcctgggggcgtcaaaaccattgaggcgaacggaaagatggtcatccccggagggatagatgtccatactcatttccagatgccctataaaggtatgacaactgtggatgactttttccagggaaccaaagctgccctggctggggggactacaatgatcattgaccatgtggtgcccgagcctgagagtagcctcactgaggcttacgaaaaatggagagagtgggctgacggaaaaagctgttgcgactacgcgctccacgtggatattacacactggaatgattcagtcaagcaggaagtgcagaatctaattaaggacaagggcgtgaattcttttatggtgtacatggcctataaggatctgtatcaggtgtctaatacggaattatacgagatatttacctgcctgggcgagctcggagccatcgcgcaggttcacgcggagaatggggacattatcgctcaggagcaaacacggatgctggagatggggatcaccgggcctgagggccacgtgctgagccggccggaggaactcgaggcggaagctgtctttcgcgccattactatagccagtcagactaactgccctctttatgtgacgaaagttatgtctaaaagcgcagctgacttaatctcacaggccagaaagaagggtaatgtagttttcggcgaaccaatcacagcgagcctgggcatcgacggtacccattattggagcaagaactgggcaaaagcagctgccttcgtgaccagcccccctctcagtcctgacccaactactcctgattatatcaactccctcctggcctcgggagacctgcagctatcgggcagcgcccattgtacattttctacagcgcagaaggccataggtaaagacaattttactgcaataccagagggaaccaatggcgtagaggaacggatgagcgtcatatgggataaggctgttgccacaggtaagatggatgagaatcagttcgtagcagtcactagcaccaacgctgcgaagatctttaatctttaccccaggaaagggcggatctctgtgggatccgattcggacctcgtgatctgggaccctgatgccgtcaaaatcgtgtccgcgaaaaatcatcagtccgccgccgagtataatatcttcgaagggatggaactgcgaggagcaccactcgttgtcatctgtcaaggcaaaataatgttagaagacggaaatctgcacgttacccaaggcgcggggcggttcatcccctgttccccgttcagtgattatgtgtacaaaaggattaaggcgcggcgcaagatggcggatttacatgccgtcccaagaggaatgtatgacggccccgtgttcgacttaaccactacacctaagggtggaacccctgccgggtctgccagaggaagcccaaccaggccaaaccctcccgttaggaacctgcaccagagtggcttttcgttatctggcactcaagtggacgagggcgtccgctccgcctccaaacggatcgtggccccacccggaggacgcagtaatatcacatcccttagttag

SEQ ID NO: 185385 - DNA, 1713 bp, Artificial Sequence
  Description of Artificial Sequence: Synthetic coding sequence
atgagctaccagggcaagaagaacatcccccggatcaccagcgaccgcctgcttataaaggggggtcgtattgtgaacgacgatcagagcttctatgctgacatatacatggaggacggcctgatcaagcagatcggcgacaacctaattgtgccaggcggtgtgaaaacaattgaagccaatggaaagatggtgattcctggcgggatagacgtacacacccactttcagatgccgtacaagggcatgactacagtggatgatttttttcaggggaccaaggctgcccttgccggcggcaccacgatgattattgatcacgtcgtgcctgaacccgagtcctccctgaccgaggcttacgagaaatggcgggaatgggcagacggcaagtcttgctgtgactatgccttacatgttgacataacgcattggaatgactccgtgaaacaggaagtccaaaacctgattaaggataagggcgttaactcctttatggtatatatggcctacaaagacctgtaccaggtttcaaataccgagctttacgagatcttcacatgtcttggggagctgggcgcaatcgctcaggtgcacgctgagaatggcgacataatcgcacaggaacagacgcggatgctggaaatgggaataacgggacccgaaggacacgttctctcccggcccgaggagcttgaagccgaagcggtgttccgagctatcacaatcgccagtcaaacaaactgccctctgtacgttacaaaagttatgtccaaaagcgctgccgacctcatttcccaggctcgaaagaaaggcaacgtcgtctttggtgaaccaatcactgcttcgttggggatcgacggaacacactattggtctaaaaactgggctaaggcagctgctttcgtcacaagtccgcccctatctcccgaccccacgactcctgactacatcaacagcttacttgcatcaggggacctgcagttaagtggttccgcccattgtacgttctctacagcccaaaaggctattggcaaggacaacttcacggccatccccgagggtacgaacggcgtagaggaaagaatgagcgtgatttgggataaagccgttgctaccggaaagatggacgagaaccaattcgtggccgtgacatccacaaatgctgcaaaaatatttaacttgtaccctcgaaaggggaggatctcggtgggcagcgacagtgatcttgttatttgggaccccgatgccgtgaagattgtgagcgccaagaatcaccagagtgcagccgaatacaatattttcgaaggcatggaacttagaggcgctcccttagtggttatttgtcagggcaaaattatgcttgaggatgggaaccttcacgtgactcaaggcgccgggaggtttattccatgctctccattcagcgactacgtgtacaaaagaatcaaggcgagacgcaagatggccgacctccatgctgtcccccgcggaatgtacgatggaccagtattcgacctcacgaccacccccaaaggcgggactcccgcaggttctgccagaggatccccgaccagaccaaatccgcccgtccgaaacctgcaccagtccgggtttagcctgtcaggaacgcaagttgacgagggggtacgctccgcaagtaagcggatcgtagctccccccggggggcgcagcaatattacgtccttgagttag

SEQ ID NO: 185386 - DNA, 279 bp, Artificial Sequence
  Description of Artificial Sequence: Synthetic coding sequence
atgagctaccagggcaagaagaacatcccccggatcaccagcgaccggctcctcattaagggtggaagaatcgtgaatgatgatcagagcttttacgctgacatctacatggaagatggattgatcaagcagatcggcgacaacctaatcgtgccaggcggcgttaagacgatcgaagctaatggaaagatggttattccaggcggaattgacgtacacacacacttccaaatgccctataagggcatgaccactgtcgacgacttcttccaggggtag

SEQ ID NO: 185387 - DNA, 591 bp, Artificial Sequence
  Description of Artificial Sequence: Synthetic coding sequence
atggacgagaaccagttcgtggccgtgaccagcaccaacgccgccaaaatctttaatctgtacccccgcaaggggaggatcagtgttggaagcgactcagacctggtcatatgggatcccgacgctgtgaaaattgtctccgcaaagaatcaccagtctgccgccgagtacaatatatttgaaggtatggaactgcggggcgcacccctggtagtcatttgtcagggtaaaatcatgctggaagatggcaatctgcatgtcacccagggtgcaggacgctttattccatgtagcccgttttctgattacgtctacaagcgaatcaaggccagaagaaaaatggccgacctccatgctgtcccgcgcggaatgtatgatgggcccgtgtttgacctgacgacgacgcctaagggaggaacccctgctggaagcgcacgaggctcgccaacgagacctaaccctcccgtacgcaacttgcatcaatctgggttttcgctgtctgggacacaggtggacgagggtgtgcgcagcgcgagcaagagaatagtagcgcctccgggtggccggtcgaatataaccagcctttcctag

SEQ ID NO: 185388 - DNA, 1719 bp, Artificial Sequence
  Description of Artificial Sequence: Synthetic coding sequence
atgagcttccagggcaagaagagcatcccccggatcaccagcgacagacttctaatccggggcggcagaattgtcaatgacgaccagagcttttatgccgacgttcatgtggaggacgggcttatcaagcagattggcgagaatctgattgtccctggcgggatcaagacgattgacgcacacggcctgatggttttaccgggcggcgtggacgtgcatacccggctgcagatgccggtcctcggaatgacaccagcggacgatttctgccagggtacaaaggccgcacttgcggggggcaccacaatgattctagatcacgtgttccctgatacaggagtgtctctgctggccgcctacgaacagtggcgcgaacgtgccgatagcgccgcctgttgcgactatagcttgcatgttgacattactaggtggcacgagagtataaaggaggagctcgaagctctagtaaaggagaagggggtgaatagtttcctggtctttatggcatataaggaccggtgccagtgttccgactcccagatgtatgagatcttctccataattagggatctcggggctctcgcccaggtccatgctgagaatggggatattgtagaggaggagcagaagaggttgctggaactcggtattaccgggccagaagggcacgtactgagccatccagaagaggtcgaagccgaagccgtttaccgggccgttaccatagcaaagcaagcaaattgtccgttgtatgtgacaaaagtgatgtctaagggcgcagccgacgctatcgcccaggcaaagcgtaggggcgtcgttgtgtttggcgaacctattacggcaagtctagggaccgacggatctcattattggagcaagaactgggccaaggctgcggcgtttgtcacgagccccccggtcaacccggatccgaccactgccgatcacttgacttgtctgctaagcagcggggatctccaggtcactggttctgcccattgcacatttacaaccgctcaaaaggccgtcggtaaggacaatttcgcactaattcccgaaggcactaacggcatcgaagaaaggatgagcatggtctgggaaaagtgcgttgccagtggcaagatggacgaaaacgaatttgtggctgtgacctcaaccaacgctgcaaagatttttaatttttaccctaggaaggggcgggttgccgtggggagcgatgctgatttggtgatctggaaccccaaggcaactaagatcatttcagccaaaactcacaacttaaatgtcgaatataacatcttcgagggagttgagtgtcggggcgcgccagctgtggtgatctcccagggtcgcgtggcactggaagacggcaaaatgtttgtgactccgggggcgggacgattcgtaccccggaaaacgtttcccgattttgtgtacaaacgcattaaagcccgcaatcggttggccgagatccacggcgttcccagaggtctctacgacggtcctgtgcatgaagtaatggtcccagccaagcctgggtccggagcccccgcgcgtgccagctgccccgggaagatcagtgtgccaccagtccggaatctgcaccagtcgggattttctctcagcggaagccaggctgatgaccatattgctcgacgaaccgctcagaaaatcatggcccccccgggtggccgctcaaatataacaagtcttagttag

SEQ ID NO: 185389 - DNA, 1239 bp, Artificial Sequence
  Description of Artificial Sequence: Synthetic coding sequence
atgcccgtgctgggcatgacccccgccgacgacttctgccagggcaccaaagccgctctcgctggaggcacaactatgatcctggaccacgtattccctgataccggagtctctctcttagccgcctacgaacagtggagggaacgagctgactcggccgcttgttgcgattacagtctgcatgtggacattacgcggtggcatgaatctatcaaggaggaacttgaagccttagtgaaggagaagggtgtgaattcattcctggtgttcatggcctataaggacaggtgtcaatgctcagactcgcagatgtacgagattttctcgatcatccgagacctcggcgctctagcacaagtacatgccgagaacggcgatattgtcgaggaagtcgaggccgaagcagtgtacagggctgtcacgatcgccaaacaggccaactgtcctctgtacgtgaccaaggtgatgtcgaagggcgccgctgatgccatcgcccaggcgaagcgtcggggcgtggtggtgttcggcgaaccaattactgccagcctcggaacggacggctcacactattggagcaagaactgggccaaggcggccgccttcgttacttctcccccggtcaatcccgatccgaccacagccgatcacctcacatgcctcctgtctagtggcgatttacaggtgaccggatcggcacattgtaccttcaccacagctcaaaaagccgtgggaaaggacaattttgcattaatcccagagggaaccaatggtatcgaagaacggatgtccatggtgtgggaaaaatgtgtggcttccggcaagatggacgaaaatgagttcgtagccgtgacatctaccaatgcagccaagatctttaatttctatccaagaaagggtcgggtggccgtcggctctgatgctgatctggtgatctggaacccaaaagcgaccaagataatctctgctaaaacacacaatctgcttgcggagattcacggagtgccgcgaggactatacgacggacccgtgcatgaggtgatggtgcccgcaaaacccggatctggcgctccagcaagggcgtcttgccctggcaaaatctccgtaccaccggtgaggaatctgcaccaatcaggattttccctctccggaagtcaggccgacgaccacattgctcggagaacagcgcagaaaattatggccccacctggaggacgaagcaacatcaccagcctgtcttag

SEQ ID NO: 185390 - DNA, 1239 bp, Artificial Sequence
  Description of Artificial Sequence: Synthetic coding sequence
atgcccgtgctgggcatgacccccgccgacgacttctgccagggcactaaggcagcactcgctggaggaactactatgatcttagaccacgtgttccccgatacgggggtgtcactactggccgcctacgagcagtggcgagagagagcagatagcgctgcctgctgtgattatagtttgcatgtggacatcacccggtggcacgaatccataaaggaagaactggaagctctcgtgaaagagaaaggtgtgaacagcttcctggtcttcatggcatacaaagatcggtgccagtgttccgatagccagatgtatgagatcttttctattatcagagacttgggcgccctggcccaggtccatgctgagaacggtgacatcgtagaggaggtggaggcagaggccgtttaccgggccgtcacgattgctaagcaggccaactgccccctgtacgtgacaaaagtcatgtccaagggtgccgctgatgccatagcccaagccaagcgtaggggtgtcgtggtgttcggtgagccaattactgccagtttagggaccgatggttcccattactggagtaagaactgggccaaggccgcagcttttgtcacctctccccccgtcaacccggatcccaccacagccgatcatcttacatgcctcctgagttccggggatctgcaggtcacaggtagtgcccactgcaccttcaccaccgcacagaaagcggtgggcaaggacaactttgccctgattcctgaagggacaaatggaattgaggaacgaatgtctatggtgtgggaaaagtgcgtagcctctggaaaaatggacgagaacgaattcgtagctgttacctccacgaacgcggctaaaatttttaatttctaccccaggaaaggcagagtagccgtgggctccgatgccgacctggtgatctggaatccaaaagctaccaagatcatctcagcaaaaacccacaatctgcttgctgagatccacggggtgccccggggtctgtacgatggtcctgtgcatgaagtgatggttccagcaaagcctggatcgggtgctccagcaagagcttcatgcccagggaagatcagtgtgccgcctgttcggaaccttcaccagtctgggttctcactgtccggaagtcaggccgacgaccacatcgctaggcggactgcacagaaaattatggctccaccagggggcaggagcaacataacttcattaagctag

SEQ ID NO: 185391 - DNA, 1695 bp, Artificial Sequence
  Description of Artificial Sequence: Synthetic coding sequence
atgctggccaacagcgccagcgtgcggatcctgatcaagggcggcaaggtggtcaatgacgattgtacccacgaggccgatgtctacatcgaaaacggcatcattcagcaggtgggacgggaactgatgattccagggggcgccaaggtaatcgatgctacgggtaaattggtgattccaggcggcatcgatacctcaacgcatttccatcagacattcatgaacgccacatgcgtggatgatttttaccacggcactaaggctgctctggtgggggggaccaccatgataattggacatgttttaccggataaggagacatctttggtggatgcctacgaaaaatgtaggggtctggctgatcctaaggtttgctgcgattacgccctgcacgtgggaattacctggtgggctccaaaagtgaaggccgaaatggaaaccctcgtgagggagaagggggtgaacagttttcagatgtttatgacttacaaggatctctacatgcttcgcgattcagagttataccaggtactccacgcctgcaaggacatcggggcaatcgccagggtgcatgccgaaaacggcgaactggtcgccgagggagctaaggaggctctagatctgggaattacggggccagagggcatcgagatatcccgacctgaagagctcgaagctgaagccacacatcgggtaatcaccatcgctaaccgcacccactgcccaatatacctggtaaacgttagttccatcagtgctggcgatgtgattgcagccgcgaagatgcaaggcaaagtcgtgctggccgagaccaccactgctcacgccacgctcactgggctacactactaccaccaggactggtcccacgcagcagcctatgtgaccgtgcctccccttagactagacactaatacttcaacctatctgatgtccctcctcgccaacgataccctgaacatcgtggcttctgaccacaggccctttacaacgaagcagaaggcaatgggcaaagaggacttcacaaaaatcccgcatggcgtgtccggtgtccaggaccggatgagcgtcatttgggaacgaggagtggtggggggaaaaatggacgaaaacagattcgtcgccgtcacaagctccaacgctgctaagttactcaacctgtaccccaggaaaggcagaattattccaggagccgacgccgacgtcgtggtttgggatcccgaagccacaaaaactatcagcgcttccacccaggttcagggtggggatttcaatctgtatgaaaacatgcgatgtcacggggtaccactggttaccatctcaaggggcagagtcgtgtatgagaacggcgtattcatgtgcgctgaagggacaggcaaattttgccctttgagatcgttccctgatacggtttacaagaagctggtacagcgggagaagactctcaaagtgcgcggggtggaccgcacaccttatctgggcgatgtggccgtcgtcgtgcatccaggaaaaaaggagatgggaacaccactggctgatacccccacccgacctgttactcggcacggcggtatgagagacctgcatgagtcaagtttctccctgtctgggtcacagatagatgatcatgtgcctaagcgcgccagtgcccggatcttggctccccccggcggccgctcctctggaatctggtag

SEQ ID NO: 185392 - DNA, 1695 bp, Artificial Sequence
  Description of Artificial Sequence: Synthetic coding sequence
atgctggccaacagcgccagcgtgcggatcctgatcaagggcggcaaagtggttaatgacgattgcactcacgaagctgacgtgtacatcgaaaatggcatcatccagcaggtgggcagagaactgatgatccccggcggggccaaagtcattgacgcaactggtaagctggttatcccggggggtatcgacacctccacacactttcaccaaaccttcatgaacgcaacttgcgttgacgacttctaccacggtacgaaggccgccttggtggggggcacaacgatgattataggccatgtcctccctgacaaggaaacttcattagtggacgcatacgaaaagtgcagaggcctggccgacccaaaggtgtgttgtgactacgctctccatgtcggaattacctggtgggcaccaaaagtcaaggctgagatggagactctcgtgcgagagaagggggtgaacagctttcagatgttcatgacctacaaggatctatatatgctacgcgacagtgagctataccaggttttacatgcctgtaaagacatcggggcaatcgcaagagttcacgctgagaatggggaattggtggccgagggtgcgaaagaggcactggatctcggaattacagggccagaggggatagaaatcagccggcccgaggaactggaggctgaagcaacccacagggtcatcaccattgccaaccgcactcactgccccatctatctggtcaacgtctcttccatcagtgcaggggacgtgattgcagcagccaagatgcagggaaaggtggtgctggccgagaccacaacggcccacgccacactcacaggactgcactactaccaccaggactggtcccatgcggctgcttatgtgactgtacctcccctgagactcgacacaaatacctctacatacctcatgtcactgctggccaacgacacattaaacattgtggcaagtgaccaccgaccattcactacaaaacagaaggctatgggtaaagaggacttcaccaagatcccccatggcgtgagcggtgtgcaggaccgcatgtccgtgatttgggaacgaggcgtagtgggaggaaagatggatgagaaccggtttgtggctgtgacaagttctaacgccgcaaaacttctgaatctctatcccaggaaaggcaggataattccgggggcggacgccgacgtggtggtgtgggatcctgaagctactaagacgatctccgcctcaacacaggtccagggtggcgatttcaatctgtacgaaaatatgcgctgtcatggggttccacttgttacaatttcgagagggagggttgtgtatgagaatggcgttttcatgtgcgcggagggaactggtaagttttgtccgctgaggagcttccccgatactgtttacaagaaactggtacagcgggagaagaccctaaaggtgaggggggtcgaccgcacgccctatttgggtgatgtcgcggttgtggtccaccccggcaagaaagaaatggggacacccctggctgatacaccgactcggccagtgacgcgacatggtggaatgagggacctgcacgagtcaagcttttctttgtctggatcacagatcgatgaccacgtccctaaaagagccagtgcgcgtattctcgccccaccggggggtaggtccagtggcatctggtag

SEQ ID NO: 185393 - DNA, 573 bp, Artificial Sequence
  Description of Artificial Sequence: Synthetic coding sequence
atgctggccaacagcgccagcgtgcggatcctgatcaagggcggcaaggtggttaatgatgactgcacacacgaagcagacgtgtacatcgagaatggaatcatccagcaggtagggagagagctaatgatcccaggaggtgcaaaggttattgatgcaacaggcaaactggttattcccggaggtattgatacaagtacacattttcatcaaaccttcatgaacgccacatgcgttgacgatttctaccatggcaccaaggcggctctagtcggcggcaccaccatgatcatcgggcatgtcctgccggataaggagacaagccttgtggatgcctatgagaagtgtagaggccttgccgatccaaaggtttgctgtgattatgcattacatgtcggtattacttggtgggctcccaaggtgaaagccgagatggaaaccttggttcgtgagaagggggtcaactcattccagatgttcatgacatataaggacctgtatatgctgcgggattccgagttataccaagtgcttcatgcttgtaaggatattggagcaatcgcgcgggtttag

SEQ ID NO: 185394 - DNA, 525 bp, Artificial Sequence
  Description of Artificial Sequence: Synthetic coding sequence
atgctggccaacagcgccagcgtgcggatcctgatcaagggcggcaaggttgtgaatgatgattgtacccatgaggccgatgtgtacatcgaaaacggaattattcagcaggtaggacgagaactgatgatccccggcggtgccaaagttatcgacgctaccggcaagttggttatccccggaggcattgatacctctacccattttcaccagacgtttatgaacgcgacttgcgttgacgatttttatcacggcacaaaagcagcccttgttgggggcacaaccatgataatcgggcatgtgcttccagacaaggaaacttcattagtcgacgcttatgagaagtgcaggggcctcgcagaccctaaggtctgctgcgactatgccttgcatgtgggtatcacctggtgggccccaaaagtcaaagctgaaatggagacactcgtgagggagaaaggagtgaattccttccagatgttcatgacatacaaggacctctacatgctgcgagacagcgaactgtag

SEQ ID NO: 185395 - DNA, 498 bp, Artificial Sequence
  Description of Artificial Sequence: Synthetic coding sequence
atgctggccaacagcgccagcgtgcggatcctgatcaagggcggcaaagtggtcaatgacgactgtacccatgaggcagatgtgtatattgagaacggaatcattcagcaagtgggtagggagctgatgatcccgggaggcgctaaagttatcgatgcaactgggaaattagtgattccgggcggtatcgatacaagcacacacttccatcagacattcatgaatgccacatgcgtggacgatttctaccacgggactaaagcagccttggtcggtggaaccactatgatcataggtcatgtgctacccgataaagaaactagtctggtcgatgcctacgagaagtgtcgtggcctggcagatccaaaagtttgctgcgactacgccctccatgtcggcattacttggtgggccccaaaagttaaggccgagatggagacgcttgtcagagagaagggagttaattcgttccagatgttcatgacttataaagactag

SEQ ID NO: 185396 - DNA, 522 bp, Artificial Sequence
  Description of Artificial Sequence: Synthetic coding sequence
atggcccccgtgctgagcaaggacagcgccgacatcgagagcatccttgcattaaacccaaggacacaaactcacgccacactcaggagtacctctgcgaaaaagctggacaaaaagcactggaagaggaatccagacaaaaactgtttcaactgcgaaaaattggaaaataattttgatgacattaagcataccacactaggtgagagaggagcgctccgagaggctatgagatgcttgaagtgcgccgatgcaccatgccaaaagtcctgcccaacaaatcttgacattaagtcgtttataacaagtatcgccaacaaaaactactacggggccgctaagatgatctttagcgataatccactgggactgacctgtggaatggtgtgccccacctccgacttgtgtgtgggcggctgtaatctgtatgcaaccgaagaaggcccaattaatatcggagggttacagcaatttgctactgagactctgatcctggccttctctctgatgaaccacctgtag

SEQ ID NO: 185397 - DNA, 3078 bp, Artificial Sequence
  Description of Artificial Sequence: Synthetic coding sequence
atggcccccgtgctgagcaaggacagcgccgacatcgagagcatcctggccctgaaccctcgcactcaaacccacgccacgttgagatccacatccgctaaaaaactcgacaagaaacactggaaacgaaatcctgacaagaattgcttcaactgcgagaagttggaaaataatttcgatgatatcaaacacacgacgttaggcgagaggggggcattacgagaggccatgcggtgcctgaaatgtgccgatgcgccttgtcagaaatcctgccctacaaacttggacatcaaatcatttattacttccatcgccaacaagaattactatggggccgcgaaaatgatctttagcgacaaccctctgggcctgacctgcggcatggtgtgtccaaccagcgacctgtgcgttggcgggtgtaacctgtacgctactgaagaagggcccattaacatcggaggactccagcagttcgcaacggaggtatttaaagccatgtctataccccagatcaggaacccaagcctccccccaccagaaaagatgagtgaagcctatagcgccaagatcgccctgttcggggcaggcccagcatctatcagttgcgcttcatttctggcacgtctgggctattcagatatcacaattttcgagaagcaggagtacgttggtggactcagtactagcgaaattccacagtttcgcctgccatacgacgtcgtgaactttgagatcgaactgatgaaggatctgggggtgaagatcatttgtggcaaatcgctctcagtgaacgaaatgaccctgagtacgcttaaagagaaaggctacaaggccgcattcattggcataggccttccagaacctaacaaggatgctatcttccaagggctgacccaggaccagggattctacaccagcaaggatttcttgccgcttgtcgctaaaggatccaaagcggggatgtgtgcctgtcattctccactcccatcaattcggggcgtcgtgatcgtgctgggtgcaggcgacacagcattcgattgtgccacatcagccctccgctgtggcgcgcggcgcgtgtttattgtgtttcgcaaaggattcgtgaacataagagcagtgcccgaggaaatggagctcgctaaggaagagaagtgtgaattcctgccgttcctcagcccccgaaaggtaattgttaaaggagggcgaatcgttgcgatgcaattcgtgcggacagaacaggacgaaactggtaaatggaacgaagacgaagaccagatggtgcacctgaaggcagacgtggtgatctctgcttttggctctgtgctttccgatccaaaagtgaaagaggccttgagtcctattaaattcaatcgctggggactccccgaagttgatcccgagaccatgcagaccagcgaggcttgggtctttgcaggcggagacgtggtagggctagccaatacgaccgtagaatcagttaacgatgggaagcaggcaagttggtacattcacaagtacgtgcagagccaatatggagccagcgtgtccgctaagccggagctgcccctgttttatacaccaattgatctagtggatatttccgtggaaatggcgggcttgaaatttatcaatcccttcggccttgcgtctgcaacccccgccactagcacgagcatgatcagaagggccttcgaagccggctgggggtttgctcttactaaaacattcagcctggacaaggacatcgtgacaaatgtgtctccccggataatcagaggaactaccagtggacctatgtatggtcctgggcaatcctcgtttctcaacattgagctgatttccgagaagacagctgcctattggtgccaatcagtgacagaactcaaggctgatttcccggataatattgtgatagcctccattatgtgctcttataacaagaatgattggactgaactggccaaaaagagcgaagattcgggcgctgatgccctggagctaaatctgagctgcccacatggcatgggggagcggggtatggggctcgcatgcgggcaggaccctgaactcgtgagaaacatctgcaggtgggtgagacaggcagtgcagattccattctttgcgaaactcacgcctaatgtgacggacattgtaagtatagcaagggcagccaaggaaggaggggccaatggcgtcaccgcaaccaataccgtgagtggactcatgggactaaagtccgatggcacaccctggccagcagtagggattgcgaagcgcaccacctatggtggggtgtcgggaacggctatccgcccgatagccctgcgtgccgtaacctccatcgcgcgggcgctgccaggattcccgatactcgccaccggcggcatcgacagtgcggaaagcggcctccagttcctgcactccggcgctagtgtcttgcaggtttgcagcgcaattcagaatcaggattttacagtaattgaagactactgtacaggcttaaaggccctcctctatctcaagagcatcgaagagctccaggattgggacggccagagccctgccacggtctcccatcagaagggcaagcctgtgccacggatcgccgaacttatggataaaaagttgccttctttcgggccttatcttgaacaacggaagaagatcattgctgaaaacaaaatccgtctcaaagagcaaaacgttgcattcagcccccttaaacggaactgtttcatccctaaacgcccgattcccaccattaaagatgtgattgggaaagctctgcagtacctgggcacctttggcgagctgagcaatgtcgagcaggtagtcgctatgattgatgaggaaatgtgtattaactgtggaaagtgctacatgacatgcaatgacagcggataccaggcaatccaattcgaccccgagacacatctcccaacgataacagatacatgtacaggctgtacgctgtgcctgtcagtgtgtccaatcgtggattgcattaaaatggtgtcacgcacaaccccatacgagcccaaacgcggcgttcccctaagcgtgaacccagtgtgttag

SEQ ID NO: 185398 - DNA, 471 bp, Artificial Sequence
  Description of Artificial Sequence: Synthetic coding sequence
atggcccccgtgctgagcaaggacagcgccgacatcgagaactgcgagaagcttgaaaacaatttcgacgacattaaacatactacactgggagagcgaggagctttaagagaggccatgcgctgccttaagtgtgccgacgctccgtgccagaagtcatgccctacaaacctggacataaagtccttcataacgtccatcgccaacaagaattactatggcgcagccaaaatgatcttcagcgataacccactgggtctcacttgcggcatggtttgccccacaagcgatctgtgcgtggggggctgtaacctatatgccacagaggagggaccaataaacattggcggcttgcagcaattcgcaaccgaagtgaatgggttgctccactttcaaaattccgtctccctgtggttccagaaaactgccaatatttccttcttgtcttgtgggagcctgcaagacgcctag

SEQ ID NO: 185399 - DNA, 1482 bp, Artificial Sequence
  Description of Artificial Sequence: Synthetic coding sequence
atgatcctgaacagcctgagcctgtgctaccacaacaagctgatcttggcccccatggttcgggtggggacccttccgatgcgactgctggcactggattacggggccgatattgtatattgcgaggagctgattgaccttaagatgatccagtgtaagagagttgttaacgaagttctgagcactgttgattttgtggcgcccgatgacagagtggtgttccgaacgtgcgaacgcgaacagaacagggtagtgttccagatgggaaccagtgacgctgagcgagcactcgccgtcgcccggctcgtcgagaacgacgttgctggtattgatgtgaatatggggtgccccaaacaatatagtactaaaggtggcatgggcgcagcactgctttctgatcccgacaagatcgagaaaattctgtccactttggtgaagggaactcggagacccgtgacatgcaagattagaatacttccttctctggaggacacactgagccttgttaagcggatagagaggaccggaatagctgctatagcagttcatggtagaaagcgggaggagcgaccccagcatccagtatcttgtgaagtaatcaaggccatcgctgacactctgtccatcccagtgatcgccaacggaggcagccatgatcatattcaacagtactccgatattgaagacttcagacaagcaaccgcggcttccagtgtgatggttgcccgagcagcgatgtggaacccaagcattttcttaaaagaagggctaagacccctggaggaggtgatgcagaaatacatccggtatgccgtacaatatgacaatcactataccaatacaaaatactgcctatgtcagatgttacgagagcagttggagtctcctcagggccgtctgctccatgccgcacaatcctcccgagaaatctgtgaagctttcggtcttggggcgttctacgaggagaccacccaagaactagacgcccagcaggcacgcttgagcgcaaagaccagcgagcaaaccggcgagcccgcagaagacacaagcggcgtaattaagatggccgttaaattcgacaggcgagcttaccccgctcagatcactccaaaaatgtgcctgcttgaatggtgtagacgcgagaagcttgcccagcctgtgtatgaaaccgtacagaggcctttagataggctcttctcttccatcgtcacggtggctgagcagaagtatcaaagcacgctgtgggacaagagcaagaagctcgcagagcaggcagcagcaattgtgtgcctgcgttcacagggcttgccagagggccgactgggagaagagagcccgagcctccataagcgcaagagagaagctccggaccaggatccaggcggacctagagcccaagaactcgctcagcctggcgatttatgtaagaaaccttttgtcgcactgggcagcggggaggagagccccctcgaaggatggtag

SEQ ID NO: 185400 - DNA, 1482 bp, Artificial Sequence
  Description of Artificial Sequence: Synthetic coding sequence
atgatcctgaacagcctgagcctgtgctaccacaacaagctgatcctggctcctatggtgagggttggcaccctgcctatgcgactgttggctttagactacggagcggacattgtttactgtgaggagctcatagatctgaagatgatccagtgtaaaagagttgtaaacgaggtgctgagtaccgtggatttcgtggctccagatgaccgagtcgtatttagaacctgcgaaagggagcagaatcgagttgtctttcagatgggaacatcagatgccgagcgtgctctggccgtggcgagactcgttgaaaacgatgtagctgggatcgatgtcaatatgggctgccccaagcaatactccaccaaaggcggtatgggagctgcactgctctctgatcctgacaaaattgaaaaaattctctctacactggttaaggggacccgcagaccagtgacatgtaagattcgtattcttccgagcctcgaagacactctgagcctagtgaaacgcatagagcggacaggcattgctgcaatcgcggtgcacggtcggaagagggaggagaggccccagcacccggtttcttgcgaggtgatcaaggcgattgccgacacgctgtctatccccgtgattgccaacggcggctcacacgaccacattcagcaatacagcgacatcgaggacttccggcaggctacagccgcctcgtcggtcatggttgctagggccgccatgtggaacccttcaatttttctaaaagagggcctgcgccccctggaggaagtaatgcagaagtacatccggtacgcagtacagtacgataaccattataccaacacaaaatattgtctgtgtcaaatgcttcgggagcaattagagtcgcctcagggaagactgctacacgcagcacaaagcagcagggaaatctgcgaagcatttggcctgggagctttctatgaggaaactacacaggagttagatgctcagcaggcccgactgtccgccaaaacttcagaacagaccggcgaacctgccgaagatacctccggcgtgatcaaaatggccgtgaagttcgatagaagggcctaccccgcccagatcacacccaagatgtgcttgttggagtggtgccggcgcgaaaagctggcacagcccgtgtacgagaccgtacagcggccactcgatcgcctgttctctagcatcgtgactgtggctgagcagaaataccaatctacattgtgggataagtccaaaaagttagccgagcaagcggccgccatcgtttgtctcagatcccaaggactccccgagggacgcctcggcgaggagtctccatccctgcacaaacggaagcgcgaagctcccgaccaagatcctgggggaccaagagcacaggaactcgcccagcccggcgacttgtgcaagaaaccattcgtggccctgggttctggagaggagagcccactggaagggtggtag

SEQ ID NO: 185401 - DNA, 1377 bp, Artificial Sequence
  Description of Artificial Sequence: Synthetic coding sequence
atgatcctgaacagcctgagcctgtgctaccacaacaagctgatcctcgcccccatggtgcgcgtgggcacactgccaatgcgcctgctggcactggattatggggccgacattgtgtattgcgaggagctgatcgacctgaagatgatacagtgcaaaagagttgtaaatgaagtgttaagcaccgtagacttcgtggcgccggacgatcgagttgtcttccgcacgtgcgaaagggagcagaacagggtggtatttcaaatgggtgggatgggcgccgccctactcagcgatccagataagatcgagaaaattctgagtaccctggtcaagggcacaaggagaccagtaacatgcaaaattcgcattttacccagccttgaagataccctctctctcgtgaagcgcatcgagcggaccggcatcgcagccatcgctgtgcacggtcgcaagagagaggagcggccccaacacccagtttcctgtgaggtgatcaaagcaatcgcagacaccctctcaatcccagtgattgccaatggtggtagtcatgatcatatccaacagtacagtgatattgaagacttccggcaggctactgccgcttcctctgttatggttgcgcgggctgcaatgtggaacccctccatctttctcaaagagggactcagacccctcgaggaagttatgcagaagtacattcgatatgctgtccaatatgacaatcattacaccaacactaaatactgtctgtgtcaaatgctcagagaacagctggaatcgccccagggcaggctgctacatgccgcgcagagtagccgggagatctgcgaagctttcggccttggcgccttttatgaggagacgacgcaagagctggacgcacagcaggccaggctctctgctaagacttctgaacagaccggtgagccagctgaagatacctcgggtgtgatcaagatggcagtaaagttcgaccgcagggcgtatccagctcaaatcacacctaagatgtgcctactggagtggtgtagacgcgaaaagttggctcagcccgtgtacgagacagtccagcgcccccttgatcgactgttcagtagtatcgtgactgttgccgaacagaaatatcaaagcactctgtgggacaagtccaaaaagctggccgagcaggccgcagccattgtctgtctgagaagccaaggactgcccgaaggccgtctgggtgaagaatccccttctctgcataagcgaaagagggaagctccggatcaggatcccggtgggccacgcgcccaggagcttgcgcaacccggtgatttgtgcaaaaaacctttcgtggccctcgggagcggcgaggagagcccgcttgagggatggtag

SEQ ID NO: 185402 - DNA, 858 bp, Artificial Sequence
  Description of Artificial Sequence: Synthetic coding sequence
atggccggcctgggccaccccgccgccttcggccgggccacccacgccgtggtgagggcactaccggaatccttaggccaacatgcacttagatccgcaaaaggagaagaggtggatgtcgcacgtgcagagaggcagcatcagctctacgtgggagtgctcggtagtaagctaggcctgcaggtagtggaactacccgccgatgagtctttgcctgattgcgtgtttgtggaagatgtggctgtagtgtgcgaagaaacggccctcatcactagaccaggggcgccgtctcggaggaaagaggtggatatgatgaaggaagctttggagaaactgcagcttaatatcgtggagatgaaggacgagaacgccacgttggacggcggcgacgttctttttacaggaagggaattttttgttggcttgtcgaaacgaaccaaccagcgtggtgcagagattctggccgatacctttaaggactacgccgtgtcaaccgtgcccgtggccgacgggctccacctaaagagcttctgctccatggccggtcccaatcttatcgccatcgggtctagcgagtcagcgcagaaagccttaaagattatgcaacagatgtccgaccaccggtatgacaaactgacggtgccagacgacatcgccgcaaactgtatttatttaaacattccaaacaaggggcacgtgctgctgcacaggacacctgaggaatatccggagagcgccaaggtatatgaaaagttgaaagaccacatgcttatcccggttagcatgtccgaactggagaaagtcgacggcctcctgacgtgttgtagtgtgctcatcaataaaaaagttgattcatag

SEQ ID NO: 185403 - DNA, 579 bp, Artificial Sequence
  Description of Artificial Sequence: Synthetic coding sequence
atgtggctgtacggcctgggccaggtggacatgatgaaggaggcccttgaaaaactgcagctgaacattgttgaaatgaaagacgagaacgcgaccctcgatggaggagacgtgctgtttaccggtagggagtttttcgttgggttgagcaagcgaacaaaccagcggggcgccgaaatcctcgctgatactttcaaggactatgctgtctcgactgtgcctgttgccgatggtctgcatctgaagagcttttgctcaatggcaggcccgaatttgatcgctatcggttcaagcgaatcagcacagaaggccctcaaaattatgcagcagatgagcgatcatcgctatgacaagctgaccgtccctgacgacattgcagcgaattgcatttatctgaatatccccaataaggggcatgtcttgctgcatcgcacaccagaggaatatcccgagtccgcaaaagtgtatgagaaactgaaggatcatatgctgatccccgtatccatgagcgagttagagaaagtggatggcctgcttacttgctgcagcgttctcatcaataagaaagtggactcttag

SEQ ID NO: 185404 - DNA, 549 bp, Artificial Sequence
  Description of Artificial Sequence: Synthetic coding sequence
atgatgaaggaggccctggagaagctgcagctgaacatcgtggagatgaaagatgagaacgccaccctcgatggaggagatgtcctttttacggggcgagagttctttgtggggctcagtaagaggacaaaccagagaggcgccgagatcctagcagacacgtttaaggattacgctgtctctacggtcccagttgcagatggactccacctgaagtccttttgctcaatggcaggacccaacctgatcgccattggctcttctgagtccgcgcagaaagctctcaagataatgcagcagatgtcagatcacaggtacgacaaactcacagtgcccgacgacatcgcagcaaactgcatttatctcaatatcccaaataagggccatgtgctgctccatagaacccccgaagaatatccagagagtgcaaaggtgtatgaaaagttaaaagaccacatgttgatccctgtgagcatgagcgagttggagaaggtagatggcttgctgacttgttgctctgtgctgatcaacaaaaaggtagattcctag

SEQ ID NO: 185405 - DNA, 858 bp, Artificial Sequence
  Description of Artificial Sequence: Synthetic coding sequence
atggccggcctgggccaccccgccgccttcggccgggccacccacgctgtggtgcgagctctgccggaatctctgggccagcatgcgctacgctctgctaagggggaagaagtggacgtcgctcgtgctgagaggcagcatcagctttatgtgggcgtgcttggaagcaaactgggtctgcaagtggtggaactgcccgccgacgagtcactgccagactgtgtctttgttgaagatgtcgcagtggtctgcgaagagacggcactgatcacccggcccggcgcacctagtcggaggaaagaggttgatatgatgaaagaggcattggagaagctgcaacttaatattgtggagatgaaggacgaaaatgccacactggatgggggggacgtgttattcaccggtcgagaattctttgtgggcctatcaaagaggacaaatcaaaggggagcggagatccttgctgacacgttcaaggattacgcagtgtctactgttccagtagccgacggtctgcatctcaaatcattctgttccatggccggtcctaatctgatcgctattgggagctccgagtcggcacagaaggccctgaagattatgcagcagatgtctgatcacagatatgacaaactgactgtcccagatgacattgccgctaattgtatctacctgaacatcccaaataagggtcatgtgcttctgcaccgaaccccagaggagtacccagaatcagccaaggtctacgaaaaattaaaggatcacatgctcattccagtttcaatgtccgaactagagaaggtggacgggttgctgacttgctgcagcgtcttaattaacaaaaaggtcgactcctag

SEQ ID NO: 185406 - DNA, 558 bp, Artificial Sequence
  Description of Artificial Sequence: Synthetic coding sequence
atggtggacatgatgaaggaggccctggagaagctgcagctgaacattgtggagatgaaagatgagaacgctaccttggacgggggtgacgtgctgttcaccggacgggagttctttgtcgggctgtcgaagcgaaccaaccagaggggagctgagattctggcggataccttcaaggactatgcagttagcaccgtgcctgtggccgacggactacacctcaaaagcttctgtagtatggctggccctaatctgatcgccattggttcctcggaaagtgcacagaaggcattaaagattatgcagcaaatgtctgatcatagatatgacaagctgacggtgcctgatgacattgcagctaactgcatttatcttaacattcccaacaaaggacatgttctgctgcacagaacacccgaggagtatccagagtcagcaaaagtttatgaaaaactcaaagaccacatgttgatcccagtgtctatgagcgaattggagaaagtcgatggtttgcttacctgctgctcagtcctcatcaacaagaaggtcgattcttag

SEQ ID NO: 185407 - DNA, 858 bp, Artificial Sequence
  Description of Artificial Sequence: Synthetic coding sequence
atgggcacccccggcgagggcctgggccggtgcagccacgccctgattcgaggcgtccccgagagtttggccagtggagaaggggcaggggctggcctgccggccttggatcttgcgaaggctcagagggaacatggtgtacttggaggcaaattgaggcagaggcttgggttacagctcctcgaacttccacccgaagaatctctacccctgggcccactgctcggtgacaccgccgttattcagggggataccgctctgattacaaggccctggagccctgcaagaagacctgaagtggatggggttaggaaggccctgcaggacctgggcctgagaattgtggagatcggtgatgaaaatgccacattggacggtactgatgtgttgttcacagggcgcgagttcttcgtgggattaagtaagtggacgaaccatcgcggcgccgagattgtggccgatacgtttcgcgactttgccgttagcaccgtgcccgtgagcggacctagtcacttacggggcttgtgcggcatgggcggacctcgaactgtcgtggctggatcctctgatgccgcccagaaggcagtgcgggccatggccgtacttactgaccatccttatgcctccctgaccctgcccgacgatgccgcagctgactgtctcttcctgagacctggacttccgggcgtgcccccgtttcttctgcaccgaggagggggtgacttgccaaattcccaggaagccctccagaagctttccgacgtcacactggtgcccgtgtcctgctccgaactcgaaaaggccggcgcaggcctgtcgtcactttgcctcgttctgtccacacggcctcactcttag

SEQ ID NO: 185408 - DNA, 858 bp, Artificial Sequence
  Description of Artificial Sequence: Synthetic coding sequence
atgggcacccccggcgagggcctgggccggtgcagccacgccctgatcaggggtgtccccgaatcactggctagcggcgaaggcgccggtgccggcctgccagctctggaccttgctaaagctcagcgagaacatggggtgttggggggaaaattgaggcagcgtctgggactgcaactcttagaactgccccctgaggagtcccttccactaggccccctgttaggggatactgccgtaatccagggcgacacagcacttataactaggccctggtccccagcacggagacccgaggttgacggcgtccggaaggcgttacaggacctgggcctaagaatcgtggagatcggcgacgagaacgccacattggacggtactgatgtattgtttacagggcgtgaattctttgtcgggctctctaagtggacaaatcaccgtggcgctgaaatcgttgccgacacgttccgtgatttcgccgtgagcacagtgcctgtgagcggcccttcccatctgcgtggcctttgtgggatgggtgggcctcgcactgtagtggccggctcatctgacgctgcccagaaggctgtgcgggcgatggcagtcctgaccgatcatccatacgcctcactgacattgccggacgatgccgcagccgattgcctgtttctgaggccagggcttcccggggtgcctcctttcctgctgcaccgcggtggaggagacctcccaaactcgcaggaggccctacagaaactctcggatgtgactcttgttccagtgagctgctcggaactggagaaggcaggggctggcctgtcctcgttatgcttggtgctgtcaacgcgaccccactcctag

SEQ ID NO: 185409 - DNA, 858 bp, Artificial Sequence
  Description of Artificial Sequence: Synthetic coding sequence
atgggcacccccggcgagggcctgggccggtgcagccacgccctgattaggggggtccctgagtcgctggcttctggcgaaggggcaggagccggtctgccggctttagatctcgctaaggcacaacgggaacatggcgtgctgggaggaaagctgcgtcagcgcctgggactccagctgctggagttgcctcccgaggaatccctccctcttggaccactccttggcgacacagcagtgattcaaggcgataccgcattgattacccggccctggagcccagcaagaaggccagaggtagatggtgtcaggaaagcattacaggacctagggctgcgcatcgtggaaataggagatgagaatgccacactcgatggaacagatgtgctattcacaggcagggagttctttgttgggctctcaaagtggacaaaccaccggggcgccgagatcgtcgcggatacatttcgggatttcgcagttagtaccgttcctgtctccggtccatcacacctgcgcggtctctgcggcatgggcgggcctcgcactgtggtcgctggtagttccgacgccgcccagaaggcagtaagagccatggcggtactgacagaccatccttatgctagtctgacattgccagacgacgctgccgccgactgcttatttctgaggccagggcttccaggagtgcccccttttttacttcaccgaggaggaggagacctcccaaatagccaagaggctctgcagaagctatccgacgtcacactcgtgcccgtatcatgttctgagctggagaaggcaggggctggactgtcctcgctctgcctagttctttccacacgtccccatagctag

SEQ ID NO: 185410 - DNA, 858 bp, Artificial Sequence
  Description of Artificial Sequence: Synthetic coding sequence
atgggcacccccggcgagggcctgggccggtgcagccacgccctgatccgcggcgtccccgaaagcctagcgtcaggagagggcgccggggctggactacctgcactggacctcgctaaagcacaacgagaacacggagttctgggcggtaagttgaggcaacgtctgggactgcagttattagagctgcccccggaggagtcactgcccctcggccccctgctcggggacacagctgtcatccagggcgataccgccttgatcaccagaccatggtctccagcccgacgccctgaagtagacggtgtgaggaaagccctgcaggaccttggcctgcgcatcgttgaaatcggtgatgaaaacgcaacgctggatggaactgacgtgctgttcacgggtcgcgagttcttcgtgggtttatcaaaatggacgaaccataggggggctgagattgttgccgacaccttcagggattttgccgtgagcactgtgccagtgagtggcccctcccacctgagaggcctgtgtggaatggggggtccaagaacagttgtcgcaggttcttccgatgctgctcagaaggctgtgcgtgccatggctgtgctgactgatcacccttatgcctcgcttacactgcccgacgacgccgctgccgactgcttgttcttgcgccccggccttcctggtgtgcctcccttccttcttcacaggggcggcggagacctgccaaacagccaggaagcactgcagaagttatcagatgtgacactcgttcccgtatcctgcagcgagctcgagaaggccggcgctggcctgtcatcattgtgtttggtcctcagtacaagacctcactcctag

SEQ ID NO: 185411 - DNA, 858 bp, Artificial Sequence
  Description of Artificial Sequence: Synthetic coding sequence
atgggcacccccggcgagggcctgggccggtgcagccacgccctgattcggggcgtacccgagagcttagcctctggtgaaggcgcaggagctgggctgccagccttggatctcgcaaaggctcagagggaacatggagtgctgggaggtaaacttcgtcagaggctcggacttcagcttctcgaactgccccccgaagagagcctgcccctgggacctctgctgggcgataccgcagtgattcagggcgatactgccctcatcacccgcccatggagccccgccaggaggccagaagtggatggcgtcaggaaggctctccaagatctggggttgcggatcgttgagataggcgacgagaatgctaccctcgacggcactgatgtcttattcacaggtcgcgaattttttgtaggactgtccaagtggactaaccatagaggcgccgagatcgtggccgacactttccgggacttcgctgtgagcaccgttcctgtgagcggaccatcacacctgcgcggattgtgcggaatgggtggcccacggactgtcgtcgccggttcttccgacgccgctcagaaagccgtgcgcgcaatggcagtactcacagaccatccatatgcctctctcaccctgcccgatgatgctgccgcggattgtctgttcctccggccaggacttccgggtgtccccccattccttctgcacaggggaggaggcgacctgcctaatagccaggaggccctccagaagcttagcgatgtgaccttggttccggtgagctgtagcgagctcgaaaaggccggggcgggactttccagtctgtgcttagtgttgtcaacccggccccattcttag

SEQ ID NO: 185412 - DNA, 858 bp, Artificial Sequence
  Description of Artificial Sequence: Synthetic coding sequence
atgggcacccccggcgagggcctgggccggtgcagccacgccctgataaggggggtgcctgagtccttggcatccggcgagggggcaggcgccgggttgccagctcttgatctggctaaggcccagcgtgagcacggcgttctcgggggcaagctccgccaacggctcggtctgcagttattggaattacccccagaggagtcactgcccttgggcccactgttaggggataccgccgtgattcagggtgatactgccctgattacccgcccatggagtccagcaagacgccccgaagtcgatggcgtgcgaaaagctcttcaagacctgggcctgcggattgttgagatcggtgacgagaatgccaccctagacggaacagatgtgctttttacaggaagagaatttttcgtgggactgtcaaagtggacaaatcatcgcggcgctgagatcgtggccgataccttcagagacttcgcggtatctaccgtgcctgtgtcgggtccgtcccatctccggggcttgtgcggcatgggcggcccgagaactgtggtagccggtagcagcgatgccgcccagaaggctgtgagagccatggctgtgcttaccgatcacccctatgcctcactgacccttccagacgacgctgctgctgactgcctgttcctaagaccgggcttgcctggggttccccctttcctactgcacagaggcggtggtgacctgcccaatagccaggaggccctccagaagctgtccgatgtgactctggtgcccgtctcgtgctccgagttagagaaggctggcgctggtctttcatcgctgtgtttggttctgagtacacgacctcattcgtag

SEQ ID NO: 185413 - DNA, 858 bp, Artificial Sequence
  Description of Artificial Sequence: Synthetic coding sequence
atgggcacccccggcgagggcctgggccggtgcagccacgccctgatccgcggcgtgcccgagtcccttgctagtggtgagggcgccggagccggattacccgctcttgacctcgcaaaagcacagcgcgaacatggagtcctgggtgggaagctcagacagaggctaggactccaattactagagcttccccccgaggagtcactacccttgggccccctcttgggtgataccgccgtaatccagggggatactgcactcataactaggccctggagtccagccagacgtccagaggtcgatggcgtccggaaggcactgcaggatctcgggttacgcattgtagagatcggagatgaaaacgctactctcgatggtaccgacgtgttgttcaccggaagggagtttttcgtaggactttctaaatggaccaaccaccgcggtgccgagattgtggcggatacctttcgcgattttgcagtgtctactgtgcctgttagcggtcccagtcatctgcgtgggctctgcggaatgggcggacccaggaccgtcgtagcaggaagtagcgatgcagctcagaaagctgtgcgggccatggcggtactgacagaccacccttacgccagcctcaccttgcccgatgatgccgctgcagattgcctgttcttgagaccgggcctgcctggtgtcccacccttcctgctccatcggggcggcggcgacctacctaattctcaggaagctctgcagaagctaagcgacgtgaccttagtgcccgtttcctgctccgagttagagaaggccggggccggactgtcctccctttgtctggtgttgtcaacgcgtccccatagctag

SEQ ID NO: 185414 - DNA, 567 bp, Artificial Sequence
  Description of Artificial Sequence: Synthetic coding sequence
tgacggcggcccgaggtggacggcgtgcggaaggccctgcaggacctgggacttcgtatcgtggaaattggagacgaaaatgcaacactcgacggcactgatgtcctgttcaccgggagggagttttttgtggggctttcaaaatggaccaaccacagaggcgcagagatcgtggcagatacatttagagattttgccgtctctaccgtacccgtgtcagggccctctcatctgcgtggcctctgcgggatgggaggacctcgcacagtggtcgccggctccagcgatgccgcacagaaagccgtccggatgacacagctgctgactgtctcatttttcgtcctgggctgcttggtgtgtcccctgagctcttgcaccgtagaggtcgggatatgtccaacggcgaggaggcattgcaggagctcactgatgtctccttggtacctctgtcccgcccagaactggaggcgcctggctcccggaagcgctccgtcggcctggtgcagcgctcacgcaccaacggctgagggcttagcactggggtattgctggcccggtgtaggttag

SEQ ID NO: 185415 - DNA, 567 bp, Artificial Sequence
  Description of Artificial Sequence: Synthetic coding sequence
tgacggcggcccgaggtggacggcgtgcggaaggccctgcaggacttgggattgagaatagtagagatcggggatgaaaacgcgacactggacggaacagatgtcctgtttacagggcgggaattctttgtcgggcttagcaaatggacaaatcatcgaggcgccgaaatcgtcgcggacacattccgggattttgcagttagcactgtccccgtctctggaccctcccatctgcgcggcctttgcgggatgggtgggccaagaaccgtcgtcgcaggttcctccgacgccgcgcagaaggccgtcagaatgacacagttactgacagtttctttctttgtgctcgggtgcctagtttgtccattatccagctgtaccgtcgaagtgggaatctgcccgaccgcgaggcggcattgcagatcgtctcttatgagcccctggtacctgtgcccagcacagaactggagacgcctggctccaggctccgctccttccgcatggtgctccgcgcatgctcctaccgctgaggggttggctctaggctactgttggcccggagtcgggtag

SEQ ID NO: 185416 - DNA, 858 bp, Artificial Sequence
  Description of Artificial Sequence: Synthetic coding sequence
atgggcacccccggcgagggcctgggccggtgcagccacgccctgattcgcggcgtcccggagagtcttgcatcaggcgaaggcgcaggagctggcctgcctgccctcgacttagctaaagctcaacgtgagcacggtgtacttggcggtaagctgcgtcagagactaggattacagctgttggaacttccccctgaagaatctttgcctttaggccccctattgggtgacaccgcagtgatccagggtgacacggcattaataactaggccgtggagccccgcccggcggcctgaggtggatggtgtgcgcaaggcactgcaagacctcgggctgcggatagtggaaattggtgatgagaatgccacactggacgggacagatgttcttttcaccggaagagaattcttcgtcggcttgagcaaatggactaaccacagaggggccgagatcgtagccgataccttccgcgattttgcagtctctacagtcccagtgagcggaccctcccaccttcgtggcctttgtggaatgggtggcccccgaactgtcgtagctggcagctctgacgccgcccagaaggctgtccgggcaatggccgtgctgacagaccacccctacgccagtctcacgcttcccgatgacgcggccgcagattgtttgtttctgcgtccggggttgcccggagtgcctccatttctcctccaccgaggggggggtgacttaccgaattcccaggaggcgctgcaaaagctctcagatgtgactctggtgcctgtgagctgcagtgagttggagaaggctggcgcagggttgagttccctgtgtttggttctgtcaaccagaccacactcatag

SEQ ID NO: 185417 - DNA, 858 bp, Artificial Sequence
  Description of Artificial Sequence: Synthetic coding sequence
atgggcacccccggcgagggcctgggccggtgcagccacgccctgattagaggagtgccggagtcactagcttccggagagggtgcaggagcggggctccctgctttggatctggctaaagcacagcgggagcacggagtgctcggtggcaaactccgacaacgattgggtctacaactgctggagcttcccccagaagaatcgcttccactgggccctctgcttggggataccgccgttatccagggcgacacggccctgattacacggccctggtcccccgctaggcgccctgaggtggatggggttcgaaaagcactccaggaccttgggctcaggatcgtggagataggagacgaaaatgcaacattagacggtactgacgtcctgtttaccggccgagagttttttgtgggactgtccaagtggacaaaccaccggggcgcggaaatcgtggcagacacattccgagatttcgcagtctccactgtgcccgtgtcaggtccgtcccaccttcgaggtctgtgcggaatgggcggacctcgaacagtagtggcgggctcatccgacgccgcccaaaaagccgtcagagccatggccgtgctcaccgatcacccttacgcctcccttacgttgccagacgatgctgccgcagactgcctcttcttaagacccggactgcctggcgtgcctccgtttttgttgcacagaggtggaggtgatttacctaacagccaggaagcccttcagaagctgagtgacgtgacactcgtgccagtcagctgttctgagctggagaaggctggcgctgggctaagctcactctgcctggtgctgtcgacgcgccctcactcttag

SEQ ID NO: 185418 - DNA, 858 bp, Artificial Sequence
  Description of Artificial Sequence: Synthetic coding sequence
atgggcacccccggcgagggcctgggccggtgcagccacgccctgattagaggtgtgcctgagagcctggccagcggagagggcgccggagcgggcctgcccgcattagatttagctaaggcccagcgagagcacggcgttctagggggcaagctgagacagcgcctcgggctgcagctgctcgagttgcccccggaagagtccctgcccttaggccccctcctgggggacacagccgtcatccagggggatacggcactcatcaccaggccttggtctccagctcgtagacctgaggtggatggagtacgtaaagcactgcaagatctggggctgagaattgtcgaaatcggcgacgaaaacgctactcttgatggcacagacgtacttttcaccgggcgcgagttttttgtgggtctgtccaaatggacaaatcaccggggtgccgagatcgttgccgatacatttcgggactttgccgtctctactgtaccggtctctggcccaagccacttgagaggactatgcggcatgggaggcccgcgcacggtggtggcgggctcctccgacgcggcacagaaggcggtacgagcaatggctgtgctgacagaccatccttatgcttctttgacactgcctgacgatgccgcagccgactgtttatttctgagaccagggctgcccggggtcccgccatttctgcttcaccgaggcggaggcgacttgccaaactctcaggaagctctccaaaagttgagcgatgtgaccctggtcccagtgagttgctccgagcttgaaaaagctggggccgggctttcttcattgtgtttggtcctctcaaccaggcctcactcttag

SEQ ID NO: 185419 - DNA, 711 bp, Artificial Sequence
  Description of Artificial Sequence: Synthetic coding sequence
atgggcacccccggcgagggcctgggccggtgcagccacgccctgattaggggagtgccggagtccttggcttcaggggaaggtgccggcgctggcctacctgccttggacctggcaaaggcccagcgcgagcacggggtcctgggtggcaaactgagacagcggcttgggttacagctcttggaactccccccagaagaaagtctgccgttgggacccctgctgggtgacaccgccgtcatacagggtgacaccgccctgataacgagaccctggtcgcctgctaggagaccagaagttgacggggtccgtaaggctctgcaggatctcggcctgcgtattgtagagatcggagatgagaacgccaccctagatggcaccgatgtcctctttactggacgagaattcttcgtgggtctttctaagtggacaaatcatcgcggagcggagatcgtcgcggacacctttcgggacttcgccgtgtcgacagtacccgtgtccggcccaagtcatctacgcgggctctgtggaatgggaggtccaagaacagttgttgctggcagttcagatgccgcccagaaggctgttagggctatggctgtactgacagaccacccgtacgcttcacttacactcccggacgacgccgccgctgactgcttgttcctcagacccggactacctggggtgcctcccttccttctgcactag

SEQ ID NO: 185420 - DNA, 681 bp, Artificial Sequence
  Description of Artificial Sequence: Synthetic coding sequence
atgggcacccccggcgagggcctgggccggtgcagccacgccctgattaggggtgtccccgaaagcttggcttcaggagagggggctggggcaggactcccagctctggacctcgccaaagcccagcgggagcacggagtcctgggtgggaagctgagacaacgtttgggacttcagttgttagagttgccccccgaagagagtttaccactggggcccctgttgggggacacagctgtcatccagggagataccgctctcatcactaggccttggtcccctgcaagacggcccgaggttgatggcgtgcgcaaggccctgcaagaccttggactcagaatcgtggagattggcgatgaaaacgccacactggacggtacagatgtgctctttactggccgggagttttttgttggactgagtaaatggaccaaccacagaggagccgaaatcgtggctgatactttcagggactttgctgtttccaccgtacccgtcagcggtccctcgcacctgcgggggctctgcggtatggggggacccaggactgtggtggcagggtcatcggacgcagctcagaaggcagtaagggctatggccgtcttaactgaccacccctatgccagtctcactctgccagacgatgccgccgccgattgtttgttcctaagacctggatag

SEQ ID NO: 185421 - DNA, 711 bp, Artificial Sequence
  Description of Artificial Sequence: Synthetic coding sequence
atgggcacccccggcgagggcctgggccggtgcagccacgccctgatcaggggcgtgcctgagtctttggcgtccggggaaggagcaggggccgggctccctgctcttgatctcgccaaggctcagagagagcatggggttcttgggggaaagctaaggcagcgtctcgggctgcagctgctcgagttgccccctgaggaatctttacccctggggcctttgctgggagatacagcggtaatccagggagacactgcattaataactcgaccatggtcaccagcccgccgacctgaagtcgatggtgtgagaaaagccctgcaggatctggggctgaggattgtggaaatcggggacgagaatgctacactcgatggtacagacgtgctcttcaccgggcgcgagttcttcgtgggactgagcaaatggacaaatcaccgcggggcagagatcgtcgccgacaccttccgagacttcgctgtgtcaacagttccagtgagcggcccgtcccacctcaggggtctctgtggcatgggaggacccagaactgtcgtggccggaagcagcgacgccgcccagaaggcagtacgagcaatggctgtcttgaccgatcacccttatgcctctttaacattgccggatgacgccgccgccgattgtctctttctgaggccgggattgcctggtgtgcccccgttcctcctgcattag

SEQ ID NO: 185422 - DNA, 858 bp, Artificial Sequence
  Description of Artificial Sequence: Synthetic coding sequence
atgggcacccccggcgagggcctgggccggtgcagccacgccctgatcagaggcgtccctgagagcctggctagcggtgaaggcgccggggccggcttgcccgccctggatctggctaaagctcagcgggagcacggcgttttgggtggtaagctgcggcagaggctgggactacagcttttggagctgcccccagaggaatctctgccactggggccactcctcggcgacacggccgtcatacaaggtgacacagccctgatcactcggccttggagccccgcccgcaggcctgaagtcgatggcgtacgaaaggccctccaggacctcggcttgcgcattgtcgagatcggtgacgaaaacgcaacccttgatggtacagacgtgctgttcaccggtagagaattctttgtgggcctttctaaatggaccaaccacagaggggctgaaatcgtggccgacaccttcagagatttcgccgtaagtacagtgcctgtgtccggcccaagtcacctgcgagggctgtgcggcatgggcgggcctagaacagtagtcgctggatccagtgacgcagcgcaaaaagccgttagagccatggcagtgcttactgaccacccctacgcctcactcacactgcctgatgacgctgccgcggactgcttgtttctccgaccaggcctcccaggggttcctccctttctgctccacaggggcggaggagatttgcccaattctcaggaagccctgcaaaagctgtcagacgtgactctggtgccggtttcttgctcagagctggagaaggcaggcgctggccttagctccctgtgcctggtcctgagcactcgaccacatagctag

SEQ ID NO: 185423 - DNA, 858 bp, Artificial Sequence
  Description of Artificial Sequence: Synthetic coding sequence
atgggcacccccggcgagggcctgggccggtgcagccacgccctgattcgcggcgtgcctgagtctcttgcaagcggcgagggagcaggtgctggactccctgccctggacctcgctaaggcgcaacgagaacacggagtgcttggagggaaactccggcagcgcctgggactgcagctgctggaactacctcccgaggagtccctccctctgggtcctctccttggagacactgctgtgatacaaggtgataccgcacttattactagaccatggtcgccggctaggcgccctgaagtcgatggtgttcggaaagctctgcaagacttaggcctgcggattgtcgaaatcggcgatgaaaatgcaacgctggatggaaccgacgttttgttcacaggaagggagttctttgtgggactgagtaaatggaccaaccatcggggagcagaaatcgttgccgatacctttcgtgacttcgccgtgtctaccgttccagtgagtggacccagccacttgcgcggactttgcggcatgggggggcctaggaccgtggttgctgggtcatcagacgccgcacagaaggccgttcgcgcgatggccgtgctgactgaccacccctatgccagtctgaccctccccgacgacgctgccgctgactgcctgttcttaagacctggcttgccaggggtgccaccttttcttctccatcggggcggcggagacctgcccaattcacaggaagccttgcagaagctgtcggacgtgaccctcgtccctgtctcatgctctgagttagaaaaggccggagcggggctctcgagcctgtgtcttgtactgtccaccagaccacactcgtag

SEQ ID NO: 185424 - DNA, 858 bp, Artificial Sequence
  Description of Artificial Sequence: Synthetic coding sequence
atgggcacccccggcgagggcctgggccggtgcagccacgccctgatacgtggggttcctgaaagtctggcttcgggggaaggcgcaggtgccggacttcccgcgctggatctggcaaaagcccagcgcgaacacggggtcttaggcggtaagctccgtcagaggctggggctacaacttctcgagctgcctccagaggaatcccttcctcttgggcccctgctgggcgatacggctgtgatccaaggtgatactgctttaattaccaggccttggtcgccagcccgtagaccagaagttgacggtgtgaggaaagccttgcaggacttgggactgagaatcgttgaaattggagatgagaatgcaacactcgatggcaccgacgtgctgttcacaggtcgcgagttcttcgtgggtttgtcgaaatggaccaaccacaggggcgcagaaattgtggccgacacctttagagattttgcagtgagtacagtacccgtatcaggaccttcccatttgaggggactgtgcggaatggggggaccgagaactgttgtggccggaagctcagacgccgcacagaaggctgttcgcgctatggctgtccttaccgatcatccttacgcatcactgactctaccggacgatgctgctgccgactgtctgtttttacgccccggtctgcctggcgtgccccccttcctgttacatcgaggcggaggtgacttacctaactcccaggaagccttgcagaaactctcagacgtcacactggtccctgtctcgtgctctgaactggagaaggctggggcaggactgagctcgttatgcttggtacttagtactagacctcactcatag

SEQ ID NO: 185425 - DNA, 681 bp, Artificial Sequence
  Description of Artificial Sequence: Synthetic coding sequence
atgggcacccccggcgagggcctgggccggtgcagccacgccctgatccggggtgtcccagagtcattagcctcaggtgagggggccggcgcagggcttcctgccctggatcttgctaaggcccagcgggagcatggggtcctgggtggcaagctcaggcagcggctgggtctccagttgctggaactgccaccagaagaaagcctgccattagggcctctgctgggagacacggccgttattcagggagacactgcccttattaccagaccttggtcacccgcgagacgaccggaggtagatggagtgaggaaggctctgcaagatctgggcctgagaatcgtggaaattggtgatgaaaatgccaccctggatggtacggatgttcttttcaccggtagagagttttttgtcggtttgtcaaagtggaccaatcatagaggcgccgaaatcgttgctgacacctttcgtgatttcgcggtgagcaccgttcctgtcagtggaccctctcacctgcggggtctctgtgggatgggcgggcctcgcaccgtggtggccgggtcttctgacgccgcccaaaaagcggtcagggccatggccgttcttacagatcatccctacgcatcccttacattgcctgatgacgctgccgctgattgcctctttctccgaccagggtag

SEQ ID NO: 185426 - DNA, 858 bp, Artificial Sequence
  Description of Artificial Sequence: Synthetic coding sequence
atgggcacccccggcgagggcctgggccggtgcagccacgccctgattaggggcgtgcccgaaagcctggcttcaggggaaggggcaggggccggccttcctgccctggatctagctaaggctcagcgggagcacggcgtgttaggagggaagctaaggcagagactgggactgcagctgctggaattacctcccgaagaaagtctgccacttggaccactcctgggagataccgccgtcattcaaggggacaccgcactaatcacccgcccctggtccccagctagaagaccagaagtcgacggcgtgagaaaggccctgcaggacctggggcttcggatagtggaaatcggcgacgagaacgccaccttggatggaacggacgtactgtttaccggaagggagtttttcgtgggcctaagtaaatggacaaatcacaggggcgctgagatcgttgcagatacattccgagattttgctgtgtccacagttcccgtgtccggccctagccatctgcggggcttgtgtgggatggggggtcctcgtaccgtggtcgcgggaagttctgacgcagctcagaaagccgtgagagcaatggccgtgctcaccgatcatccctacgcctcattgacattgcccgacgatgcggccgcggactgtctgttcctgcggccgggactgcctggtgtgccaccatttctcctacacaggggaggcggcgacctgccaaattcgcaggaagccctacagaaattgagcgacgttactttggtgcccgtgtcttgttccgagctggaaaaggccggcgccggattgtcctccctgtgcctggttcttagtaccaggcctcattcgtag

SEQ ID NO: 185427 - DNA, 681 bp, Artificial Sequence
  Description of Artificial Sequence: Synthetic coding sequence
atgggcacccccggcgagggcctgggccggtgcagccacgccctgatccggggcgttcccgagagcttggcctcaggggagggagcaggggctggtctacccgctctggacctcgctaaagcacaaagggagcacggggtcctgggagggaagctgcggcaaagactcggattgcaacttttagaactgcctcctgaggaaagcctgccactgggacccctccttggtgacacagcggttatccagggcgacacggcgctcataacccgcccctggtccccagcgaggagacccgaagtagacggcgtccgaaaggcgctgcaggatttgggcctccggatcgttgaaattggagatgagaacgcgacgctagacggaaccgacgtcctcttcacaggtagagaattcttcgttgggttgtctaagtggaccaatcacagaggagcggagatagttgcggacacctttcgggattttgcggtctccactgtgcctgtcagtggccccagccatctgcgggggttatgtggcatgggaggccctagaaccgtcgtggcgggatcaagtgacgccgcacagaaagcggtgcgcgctatggcagttctgacagatcatccttatgcttccctgaccctccctgacgatgccgctgcggattgcctcttccttcgacccggctag

SEQ ID NO: 185428 - DNA, 681 bp, Artificial Sequence
  Description of Artificial Sequence: Synthetic coding sequence
atgggcacccccggcgagggcctgggccggtgcagccacgccctgatcaggggtgttccggagtcactcgcctcaggtgaaggggccggagcagggctccccgcccttgacctggcaaaagcccagagggagcacggagtcctgggtgggaaactgcgacaacgcttaggattgcagctcttagaactccctccagaggaatccctcccgctgggccctctgctgggggacactgccgtgatccagggcgatactgccctgatcacaagaccttggtctcccgcccgacggccggaggtggacggcgttcgcaaggctctgcaggatctcgggctgcgaatcgtggagattggcgacgagaatgccactctcgatggtactgacgtgctgtttaccggtcgggaattttttgtaggactttctaagtggacaaatcataggggcgcggagattgtggccgatacatttagggatttcgcagtaagcactgtgccagtttcagggccttctcaccttagaggactgtgcggaatgggcggaccccggactgttgtggcaggctcgtcagacgccgcccagaaggcagtgcgagccatggcagtccttacagaccatccttatgccagcctgacactccccgacgatgccgcggcggattgtcttttccttagaccgggatag

SEQ ID NO: 185429 - DNA, 858 bp, Artificial Sequence
  Description of Artificial Sequence: Synthetic coding sequence
atgggcacccccggcgagggcctgggccggtgcagccacgccctgatcagaggagtcccagagagtctggcgtcaggagaaggagccggcgccggcctgccagccctggacctagctaaagctcagcgggagcacggagttctgggggggaaactgcgccagaggttgggactgcaactgctcgaactgcccccggaggagagtttgcctctgggtccattgttgggagatacggccgtgattcaaggagatactgcgctgataactcgcccctggtctccggctcgtcgtcccgaagtggatggtgttaggaaggctctgcaagatctaggcctgcggattgtggagatcggagacgaaaatgctactctggatggcacagacgtgctgttcactggtagagagttctttgtcggactgagtaaatggactaatcataggggggccgagatcgtagcagacacgttccgtgatttcgccgtgtcgacagtgcccgtgagcgggccctctcatctgcggggcctctgtgggatgggcgggcccaggaccgttgtagcagggagtagtgacgccgcccaaaaggctgtccgggcgatggctgtgctgacggatcacccatacgcttccctgacgctgcccgatgacgccgctgccgactgtctgtttctcaggcccggtttgccgggagtgccacccttccttctgcacaggggggggggcgacctgcctaacagccaggaagcgctacagaagctctcagatgttacactcgttcccgtcagctgttcggagcttgaaaaggcgggcgctgggttgagctcattatgcttagtgctgtcaactcggccgcacagctag

SEQ ID NO: 185430 - DNA, 681 bp, Artificial Sequence
  Description of Artificial Sequence: Synthetic coding sequence
atgggcacccccggcgagggcctgggccggtgcagccacgccctgatccgcggcgtccctgaaagtttagcctctggggagggcgccggggccggcttacccgcgcttgatctcgccaaggcccagagagagcacggcgttctagggggtaagttgcggcagagactgggccttcagctgcttgagctcccgccggaggaatctctccccctgggacctttacttggggacaccgcagttattcagggagacactgcacttattacacgtccgtggtcaccagcaagacgccctgaagttgacggagtccgtaaggccctgcaggacttgggactgcgaattgtggaaatcggcgatgagaatgcaactttagacggaaccgacgtcctttttactggccgggaattcttcgtgggcctgagcaaatggacaaaccacaggggtgccgaaatcgtggctgatacattccgcgatttcgcagtttccactgtgcccgtttctggacctagccatctccggggactgtgcgggatgggcggtccacgcacggtagtggccggctccagcgatgccgcgcagaaagctgttagagcgatggcagtgctaacagatcatccctatgcttcgctgacgctgccagatgatgcggctgccgattgtcttttcctacgacccggatag

SEQ ID NO: 185431 - DNA, 567 bp, Artificial Sequence
  Description of Artificial Sequence: Synthetic coding sequence
tgacggcggcccgaggtggacggcgtgcggaaggccctgcaggacctaggactgcgcattgttgagatcggtgatgaaaatgccactcttgacggcactgacgtcctgttcaccggcagggagttcttcgtgggactatcaaagtggacaaaccatcggggcgctgagatcgttgctgatacattcagggattttgccgtcagtaccgtgccggtgtcaggccctagccacctccgtggtctgtgcggcatggggggccctcgaaccgtcgtggccggctcatcagacgcggcccagaaagcagtcagaatgacccagcttttgaccgtaagtttttttgtattgggttgtctagtctgccccctgtcctcatgcactgtggaggtgggcatatgccccactgccaggcgtcattgtaggtcttccctgatgtccccatggtacctgtgtcctgcccagaactggcggagattggcgccaggatctgctcctagtgcttggtgtagcgcacacgcacccacagctgagggactggctctagggtattgctggcctggggtcggatag

SEQ ID NO: 185432 - DNA, 567 bp, Artificial Sequence
  Description of Artificial Sequence: Synthetic coding sequence
tgacggcggcccgaggtggacggcgtgcggaaggccctgcaggacctaggtttaaggatcgtagagataggcgacgagaacgccacactggatggcaccgatgtcctgttcaccggacgcgagttcttcgtagggttgagcaaatggactaatcatcgaggggctgagattgtagccgacactttcagagacttcgctgtgtctactgtccccgtcagcggcccatcccatttgcgagggctgtgcggcatgggcggaccaagaacagtggtcgctggctcttcagacgctgcacagaaggcagtaaggatgacacagttactaaccgtttcattcttcgtactcggctgcctggtgtgccctctgtctagttgcacagtcgaggttggaatctgtcccactgcccgccgccattgtcgctctagcctgatgtctccatggtacctgtgccctgctcaaaactggagacggctggccccaggatctgccccatcggcttggtgctcagctcacgctcccacggcagaaggcctggcactcgggtattgttggccaggggtgggatag

SEQ ID NO: 185433 - DNA, 681 bp, Artificial Sequence
  Description of Artificial Sequence: Synthetic coding sequence
atgggcacccccggcgagggcctgggccggtgcagccacgccctgatccggggtgtacctgaatctctggcaagtggagaaggagcaggtgccggattgcccgccctggatttggctaaagcccagcgggaacacggggtattgggggggaaactcagacaaaggctgggcctccagctcctggaactgccgcccgaggagtcactacctctgggacccttactgggcgacactgcagtgattcagggcgataccgcccttatcaccagaccctggtccccagccagaagaccagaagttgatggagtccgcaaggcactgcaggatctggggctcaggatcgtggagatcggtgacgagaatgccaccctggacggcacagatgtgcttttcaccggccgggagttcttcgtgggcctgagtaagtggacgaaccaccggggcgctgagatcgtagccgatacattcagagacttcgccgtgtctaccgtgcctgtgtccggcccatcccacctaagaggactgtgcggaatggggggcccacgcaccgttgttgctggttcgtcagacgcggcgcagaaggcagttcgggctatggccgttctcactgatcacccatatgccagcctcacgttgcccgatgacgcagcagcggactgtctgtttcttcggcccgggtag

SEQ ID NO: 185434 - DNA, 858 bp, Artificial Sequence
  Description of Artificial Sequence: Synthetic coding sequence
atgggcacccccggcgagggcctgggccggtgcagccacgccctgatcagaggcgtgccggagagtttggcctcaggcgagggagcaggcgccggcctgcctgctctggatctggccaaggcgcagcgagagcatggagtactgggcgggaagcttcgacagcgtcttgggttacagcttctcgaactgccccccgaggagtctctcccactgggtccgctgttaggcgatacggccgtaattcagggtgacacagcattgataacgcggccatggtcaccagccaggagacccgaggtggatggagttcgaaaggccttacaagatctcggactgcgtattgtggagatcggggatgagaacgcaaccttggacggcacagatgtgctcttcacgggtagagagttttttgtgggattgagcaaatggactaaccatcggggcgctgagattgtggcagacacatttagggattttgcagtgagcactgtccccgtgtcaggaccttcacatctgcgaggactgtgcggtatgggtggcccgcgaactgtggtggccggcagctcagacgccgcccagaaagccgtgagagctatggcagtcctgactgatcacccatacgcctcactgaccctccccgacgacgcggcagccgattgtcttttcttgcggccaggacttccgggcgtgcccccgtttttgctccaccgcggtggaggtgatttaccgaattcacaagaggccctgcagaagctgtccgacgtgaccctcgtgccagtgtcgtgttccgagctagaaaaagcgggagctggcctcagttccctgtgcctggtactgtctactcgtccacatagctag

SEQ ID NO: 185435 - DNA, 711 bp, Artificial Sequence
  Description of Artificial Sequence: Synthetic coding sequence
atgggcacccccggcgagggcctgggccggtgcagccacgccctgatacgcggtgtgccagagagtcttgcaagcggagagggggccggcgctggactgcctgccctggacctcgcgaaagcgcaacgcgagcatggagtcttagggggcaagctgcgccagaggctggggctgcaactcctcgagctgccacccgaggagtccctcccactcggcccattgctcggcgacaccgctgttatacagggggacacggcactgataactcgcccctggtcccctgctcgccggccagaagttgatggggtgagaaaggcactgcaagacctgggtctgcgtattgttgaaataggtgacgaaaatgccacattggatgggactgacgtgttgttcacaggcagggaattctttgtgggactttcgaaatggacaaatcatcgcggcgctgaaatagtggccgacacctttcgcgacttcgccgtgtccacggtcccagtttccggtccatcacatttgaggggactgtgcggaatggggggccccaggactgtggtggctgggagctctgatgctgcccagaaggccgtacgcgcgatggcagtgttaacagatcacccttacgcatccctcacgctcccagacgacgcagcagccgattgtctttttctccggcccggactgcccggcgtgccccctttcctgctgcactag

SEQ ID NO: 185436 - DNA, 711 bp, Artificial Sequence
  Description of Artificial Sequence: Synthetic coding sequence
atgggcacccccggcgagggcctgggccggtgcagccacgccctgatacgtggggtgcccgagagcttggccagcggagagggagcaggggctgggctcccagctctggacctcgctaaggcccagagggaacacggggttctgggaggcaaactgaggcagcgcctaggtctccagctgcttgaactcccaccagaagaatctctccccctcggtcccctgctgggcgataccgccgttattcagggcgatactgctctgataacgcgcccttggtctcccgcaagacgtccagaggttgatggagtgcggaaagccttgcaagacctgggcctgcggatagtcgaaataggcgatgaaaatgcgacgctggacggtactgacgtgctcttcacaggtagggaattcttcgtcggtctctctaagtggaccaatcatcggggggcagagattgtggccgatacgttccgggatttcgctgtttcaacagttccagtatccggtcctagccatctcagggggctctgtggtatggggggcccccgtacagttgtggctgggagttccgacgcagcacagaaggccgtcagggcgatggctgtgctaacagaccatccttatgcgagcctcactctgcctgatgacgcagcagccgattgcctgttcttgaggccaggtctccctggtgttccaccttttttattgcactag

SEQ ID NO: 185437 - DNA, 858 bp, Artificial Sequence
  Description of Artificial Sequence: Synthetic coding sequence
atgggcacccccggcgagggcctgggccggtgcagccacgccctgatacgaggggtgcctgaatctctcgcctccggggaaggggctggggctggattgcctgctcttgatctggcaaaggctcagcgcgagcacggggtgctcggtggaaagctgagacagcgattagggctgcaactgttggagctgccgccagaagagtcccttccactggggccactcctgggcgatactgcagtgattcagggggataccgccctaatcaccagaccatggtcccctgcgaggagaccagaggtcgatggcgttagaaaagcccttcaggatctgggcctccggatcgttgagattggcgacgagaacgcaacattagatggaaccgacgtgctatttactggtagggaatttttcgtgggtctcagcaagtggactaaccacagaggagccgaaatcgtcgccgatacttttagggattttgctgtgtccaccgtgcctgtgagtggaccctcccacctgcgtggactctgtggaatgggggggccgcgtaccgttgttgccggaagctcagatgccgctcagaaggccgtccgagccatggccgtgttaactgaccatccgtacgccagccttaccctgccagatgacgcagccgccgattgcttgttcctgcggcccggactacccggcgtccctcccttcctgctccaccgggggggaggggacctgcccaattcacaagaggccctgcaaaagctctctgatgtgacactcgtccccgtgtcatgcagcgaacttgagaaggctggagctggcctctcatcgctgtgcctcgtcctcagcacgcgccctcatagctag

SEQ ID NO: 185438 - DNA, 678 bp, Artificial Sequence
  Description of Artificial Sequence: Synthetic coding sequence
atgggcacccccggcgagggcctgggccggtgcagccacgccctgattcgtggagtcccagaatccctggcgtccggggaaggggcaggagcgggtttgcctgctttagacctcgccaaggcccagcgagaacacggagtactgggaggaaaactgcgacagagattaggcttgcagttgcttgagcttcctcctgaggaaagtctccccctggggcccttactcggggacaccgctgtcattcagggtgatactgctctgatcacaaggccttggtcacccgccaggcgccctgaggtggatggcgttcggaaagccctgcaggatctcggtctgcgcatcgtcgagattggagatgaaaacgcgactctggatgggaccgacgtgttgttcactgggcgtgagtttttcgttggactctccaagtggactaatcaccgcggcgcagagattgtcgctgatacctttcgggacttcgcagtgagcactgtccccgtatcaggaccgtctcacctgaggggattgtgtggtatgggcggtcctagaacagtggtcgctggctcaagcgacgctgcacagaaggccgttagggccatggctgttcttactgaccatccatatgccagcttgacattgcctgatgatgccgccgcagattgtttatttcttcgaccatag

SEQ ID NO: 185439 - DNA, 858 bp, Artificial Sequence
  Description of Artificial Sequence: Synthetic coding sequence
atgggcacccccggcgagggcctgggccggtgcagccacgccctgatacgaggagtcccggagtcgctggccagtggagaaggcgcgggagctgggcttccggccctggatctggcaaaggcgcagagagaacacggcgtgctggggggtaaactcaggcagaggcttggtctgcaactacttgagctccctccagaggaatcactgcctcttggaccacttttgggagacaccgctgtcatacagggcgacactgccctgattacgcgcccctggtccccagcccggcggcctgaggtggacggagtccgcaaggccctccaggatctaggattaaggatcgttgagattggggacgaaaatgcgacactggatgggaccgacgtcctgtttactggacgggagttttttgttggcttgtctaagtggacaaatcatcggggcgccgagatcgtcgctgacacctttagggacttcgcagtcagcacagtccctgtctctggtccttcacatctaaggggcttatgtggtatggggggccctcgcactgttgttgccggctcatcagatgccgcacagaaagcggtcagagccatggccgtcctaaccgatcacccttacgcttccttaaccctccccgatgacgcggcggccgactgtctgtttttgaggccaggacttccgggagtgccacccttccttttgcaccggggtggcggagatctgccgaattcccaggaagcactccagaagctttcagatgtaacgctggttcccgtaagctgctccgagttggaaaaagccggcgctggtctgagttcactgtgtcttgtcctgtcaactagaccacactcatag

SEQ ID NO: 185440 - DNA, 567 bp, Artificial Sequence
  Description of Artificial Sequence: Synthetic coding sequence
tgacggcggcccgaggtggacggcgtgcggaaggccctgcaggacttaggcctcaggatcgtcgagatcggggatgagaacgcaactctggacggaacagatgtgctcttcaccggccgagagtttttcgtaggactatcaaagtggacgaaccatcgaggggctgaaatcgtagccgacacgtttagggacttcgcggtctccaccgtacctgtatccggtccatcccatctgcgcggcttgtgcggaatgggggggcctcggactgtggtcgcaggatcgtccgatgcggctcagaaggccgtgcgtatgacacaactgctgacagtgtcattcttcgtactgggatgtctcgtctgtccactgagttcatgtacagtggaggtgggtatttgtccgaccgcacggcggcattgcagatcatcacttatgtctccctggtacctgtgtccggcccagaactggagaaggctggcacccggttctgctccttcggcttggtgctccgctcatgcccctactgcagagggtcttgccctgggttactgttggcccggagtcggatag

SEQ ID NO: 185441 - DNA, 567 bp, Artificial Sequence
  Description of Artificial Sequence: Synthetic coding sequence
tgacggcggcccgaggtggacggcgtgcggaaggccctgcaggacctcggcttgaggattgtggagatcggggatgagaacgcaactctcgatgggaccgacgtgttgtttaccggaagagaatttttcgtgggtctctccaaatggaccaaccacaggggcgctgaaatcgttgcggataccttcagagactttgccgtgtccactgtccccgtgtctggcccaagccacctcagagggctgtgcggcatgggcgggcccagaaccgttgtggccgggtctagtgacgccgcacagaaggccgtgcgtatgactcagctgctgactgtgtcattttttgtgctagggtgcctcgtttgccccttaagctcctgtaccgttgaagtgggaatctgtcctacagcgagaagacactgtagaagctcactgatgagcccttggtacctctgtccagctcagaattggaggaggctggctccaggctcagctccatccgcttggtgcagtgcccacgctcctaccgcagaaggactggctctgggatactgttggcccggtgtaggatag

SEQ ID NO: 185442 - DNA, 858 bp, Artificial Sequence
  Description of Artificial Sequence: Synthetic coding sequence
atgggcacccccggcgagggcctgggccggtgcagccacgccctgatccggggagttcccgagagtttagcttccggcgagggggccggggccgggctcccagctctagacctggccaaggcccagagagagcatggcgtgctggggggcaaactgcgacaacggctgggactacagttgctcgagcttcccccagaagagtccctgccgctcggtcctctgctaggggatacagccgttattcagggagacaccgccctcataacccgcccatggtctcccgcgcgtaggcctgaagtcgatggggtgagaaaagccctgcaagatcttggcctcagaatcgtagagattggtgacgagaacgccacacttgacgggactgatgtgctcttcactggccgggagttttttgtggggctttctaaatggaccaaccatagaggcgccgagatcgtcgctgacacttttcgtgactttgcagtctctaccgttccagtcagtgggccatctcacctacgcggactctgcggaatgggcggacctcgcaccgtcgtggctggttcaagcgacgccgcacaaaaagccgtgagagccatggcagtgctgacagaccatccgtacgccagtctgacgctgcccgatgatgcagccgcagactgcttattcttgcgccccggactacccggagtacctccattcttacttcaccgcggcggcggggatctgcccaattcccaggaggccctccagaaactgagtgatgttaccctggtgcccgttagctgtagtgaactcgagaaggccggcgccggtttgtcttcattgtgccttgttctgtccactcgtccccactcctag

SEQ ID NO: 185443 - DNA, 711 bp, Artificial Sequence
  Description of Artificial Sequence: Synthetic coding sequence
atgggcacccccggcgagggcctgggccggtgcagccacgccctgatcaggggcgtcccagagagcctggccagtggtgaaggagcgggtgccggcctgcccgccttggacctggccaaagcccagagggaacacggcgttcttggggggaaattgagacaacgcctcgggctccagctccttgagctccctcctgaggaaagcttgcccttaggtccactgcttggagacaccgcagtaattcagggagacaccgctcttattacacgtccctggtcccctgctaggcggcctgaggtggatggggtcaggaaggcgctgcaagacctagggctcagaatcgtcgagattggcgatgaaaacgctacactcgacggaacggacgtactgttcaccggccgagagttttttgtgggcctttccaaatggaccaaccaccgcggcgctgagatcgttgccgacacattcagagatttcgccgtgagtaccgtaccggttagtggcccaagtcatttgagaggtctgtgtggaatggggggacctcgaacagttgttgctgggtcaagcgacgccgcgcagaaagcagtgcgtgctatggccgtgctaactgatcatccttatgccagcctgaccctgccggatgatgctgcggccgactgcttgttccttcgtcccggactccctggtgtgcctcccttcttgttgcactag

SEQ ID NO: 185444 - DNA, 567 bp, Artificial Sequence
  Description of Artificial Sequence: Synthetic coding sequence
tgacggcggcccgaggtggacggcgtgcggaaggccctgcaggacctgggcctgagaattgtcgagattggggacgagaacgctaccctggatggcactgatgtgctctttaccggacgcgagttttttgtaggcctatccaagtggaccaaccacaggggagcagagatcgtggcagatactttccgtgacttcgccgtgtccacagtgcctgtatccggtccatcccatctcagaggtctgtgtgggatgggcggaccgcgcacagtggtggcaggcagttcagatgccgcccagaaagccgtacggatgacccagctgctgacagtcagtttttttgttcttgggtgtttggtgtgccctctgagctcctgtacggtcgaggtcgggatctgtcctacggctcgccgccactgccgctcctctctcatgagtccatggtacctctgtccagctcagaactggcgaagacttgcacccgggagcgcaccttccgcttggtgctcagcacacgccccaaccgccgaaggactggcactgggctactgctggccgggggttggctag

SEQ ID NO: 185445 - DNA, 858 bp, Artificial Sequence
  Description of Artificial Sequence: Synthetic coding sequence
atgggcacccccggcgagggcctgggccggtgcagccacgccctgattagaggagttcctgagtccctggccagtggtgagggagccggcgccggcctccccgcactggatctggcgaaggctcagagggagcacggcgtgctgggcggaaaattacggcagcgtctggggctgcagctgctcgagcttcccccagaagagtctctgccgttaggacctctgctgggagatactgcagtgattcagggagacacagcactcattacgagaccctggtcccccgctcgacggcctgaggttgacggagtcagaaaggcactccaggaccttggtttgagaatcgtagagattggagacgagaacgctacactggacggaactgatgtgctgttcaccggccgcgagttcttcgtgggactctctaaatggactaaccatagaggcgcagagattgttgctgacaccttcagggacttcgccgtgtccacagtgcctgtgagcgggccatcacatctgcgtggtctgtgcggaatgggtggacctcgcaccgtggtggccggatcgagtgacgccgcgcaaaaggccgtacgggcgatggctgtgctcaccgaccacccatacgcttctctaaccttgcccgatgacgctgctgccgattgtctgttccttaggccaggcctgcctggggtgcctcccttcttactgcacagggggggcggcgatctacccaatagccaggaagctctacaaaaattgagcgacgtaacgttggtacctgtttcttgctctgagctggagaaggcaggcgccggcctaagctccttatgtctagtattaagcaccagacctcattcatag

SEQ ID NO: 185446 - DNA, 858 bp, Artificial Sequence
  Description of Artificial Sequence: Synthetic coding sequence
atgggcacccccggcgagggcctgggccggtgcagccacgccctgatcaggggggtgcctgagtctttggccagcggagaaggagccggcgcgggtctgcccgccctcgatttagcaaaagcccagcgtgaacatggcgtgctcggcggcaaacttagacaacgactcggactccaacttctggagttacctcctgaggaatctctacctttaggtccgttgctgggcgacacagccgtgatccagggcgacaccgctcttatcacaagaccatggagccccgcaaggaggcctgaggtggacggcgttcggaaggctctgcaggacctcggactcaggattgtggaaatcggagacgaaaacgccaccctggacggcacggatgtgctgtttacggggagggagttcttcgtcggactgtctaaatggaccaaccatcgtggagcagagatagtggccgacacctttagggattttgctgtttccaccgtgccagtatccggaccgagtcacctcaggggtctctgtgggatgggcggaccacgcacagtcgttgccggttcttccgacgctgcacagaaggcggtgagagcaatggcagttctcaccgaccacccttacgcaagtctgacgctgccggacgacgccgctgctgattgtctatttctaagacccggtttgcctggcgttccaccatttttgttacatagaggaggtggtgatctgccgaatagccaggaagctctgcagaaactgtctgatgtgacgctagtgcccgtgtcctgctcagagcttgaaaaggctggagctggtctcagcagcttatgcctcgtcctgtccaccagaccacactcctag

SEQ ID NO: 185447 - DNA, 711 bp, Artificial Sequence
  Description of Artificial Sequence: Synthetic coding sequence
atgggcacccccggcgagggcctgggccggtgcagccacgccctgatacgtggcgtgccggagtctctcgcctccggggagggtgctggcgccggcctgccagccctcgatttggctaaagctcagcgagagcatggcgtgctcggcggcaaactccgccaacgcctggggctacagctgttggaattacccccagaggagagccttccactgggcccacttctgggcgacactgccgtgatccaaggggacaccgcccttattacgcgcccttggagtcccgcgcgccggccagaggtagacggcgtgagaaaggcactgcaagacctgggcctgcgtatcgtagaaataggtgacgaaaatgccacactcgacggcaccgacgtcctattcacgggtcgtgaattttttgtgggcttgtccaaatggaccaaccatcggggggctgagatcgtcgccgacacctttcgcgacttcgccgtgtctaccgtgccagtatcaggtccctcccacctgcgcggactgtgcggaatgggaggccctagaactgtggtggcaggaagttctgacgcagcccagaaagctgtgagggccatggccgtgttgaccgaccacccatacgcctctctgacattgcccgatgatgcagccgccgattgtcttttcctgaggccagggctccctggcgttccaccgttcttgctccattag

SEQ ID NO: 185448 - DNA, 711 bp, Artificial Sequence
  Description of Artificial Sequence: Synthetic coding sequence
atgggcacccccggcgagggcctgggccggtgcagccacgccctgatccgcggtgtgccagagagcctcgctagcggcgagggcgcaggagccggcctgcctgctctggatctggctaaagctcagcgagagcatggtgtactgggggggaagctgaggcagcgtctaggactgcagctgctagaactgccccctgaagaaagcctgccactaggaccattattgggcgacacggcagttattcagggcgataccgcccttatcacccgcccctggtcccccgctcggcgccccgaagtggacggcgtcagaaaggccctgcaggatctcggtctgaggatcgtggagatcggcgacgagaatgccaccttagatggtactgacgttttatttacaggccgggaattcttcgtgggcctgtcaaaatggaccaaccacagaggagcggaaatcgtagccgatacctttcgtgatttcgctgtgtccacggtgcccgttagcgggcccagccatctcaggggattgtgtgggatgggaggtccacggaccgtggtagccgggagctcggacgccgcccagaaggccgttcgcgccatggcagtccttaccgaccatccctacgcaagccttaccctgccagatgacgccgctgcggattgtttattccttagacccggtctgcctggcgtccccccatttctcctgcactag

SEQ ID NO: 185449 - DNA, 2601 bp, Artificial Sequence
  Description of Artificial Sequence: Synthetic coding sequence
atgctgcggcccggcgcccagctgctgcggggcctgctgctgcggagttgcccattgcagggttccccgggccggccccgatctgtttgtggccgggagggagaagagaaaccccctctttctgccgaaacccaatggaaagaccgcgcagagacagttatcattgggggcggctgcgtcggtgtaagcctggcctaccatctggcaaaagcgggcatgaaggatgttgtgcttttagagaaaagcgagttgaccgcaggatcaacctggcacgctgccggacttactacctattttcacccggggatcaacctgaaaaaaatacactatgattccataaaactgtacgaaaagttggaggaggaaactggccaagtggtgggctttcaccaacctgggagtataaggcttgccactacacccgtcagagtggacgagttcaagtaccagatgacaagaaccgggtggcacgccaccgaacagtatctcatcgaacctgagaaaatccaagaaatgtttccattgttgaacatgaacaaggtgcttgcaggcttgtacaatcccggcgacggtcacatagacccctattccctgacgatggcgctggccgccggtgcccggaagtgcggggctctgttgaagtatcctgccccagtcacctctcttaaagctaggtccgacgggacgtgggatgtggaaactccccagggcagcatgcgggctaaccgcattgtgaacgcagcaggattctgggcaagagaggttggaaagatgattggactggagcatccattaattcccgtgcagcaccagtacgttgtaacgagcactattagcgaggtgaaagccctaaaacgagagctccctgtgctgagggacctggaagggagctattatctgcgacaagaaagggatggcctgctatttggtccatacgagagccaggagaaaatgaaagtacaggatagttgggttaccaatggtgtgccacccggctttggcaaagaactattcgaatccgacctggaccgaattatggagcacataaaggctgcaatggagatggttcctgttctgaaaaaggcagacatcataaacgtggttaatgggccaatcacttactctccggacatcctgcccatggtgggcccccatcagggcgtccgcaactattgggtggctatcgggtttggctacgggatcatccatgccggtggtgtgggcaagtatctctctgattggattctgcacggagaaccccccttcgatctgatcgagctcgaccccaaccggtacggtaaatggactactacgcagtacactgaagctaaggctagggagtcctacggctttaacaatatcgttggttatcctaaagaggagcggttcgctggccgcccgacccaacgcgtttccggtttgtaccagcgcttagagagtaagtgttccatggggtttcatgccggatgggaacagcctcactggttctacaaacctgggcaggacactcagtatagaccatcctttaggagaacaaattggtttgaacctgtgggaagtgagtataaacaggtgatgcagagagtggcagtgactgacctaagcccattcggtaagtttaacatcaagggacaggattccattcgtttactagaccacctgtttgcaaacgttatccccaaggtgggctttacaaacatcagccatatgctgacaccgaaggggagagtatacgccgagctgactgtctctcaccagtcacccggcgaattcctgctgatcacaggatcagggtcagagctccacgacctgcgctggatcgaagaagaggctgtgaaagggggatacgacgtcgaaatcaagaacataacagacgagctcggagtgttgggtgttgctggcccccaggctagaaaggttttgcaaaaactgacatccgaggatttgagtgacgacgtctttaaattcctgcagacgaaatcactgaaagtgagcaacatccctgttaccgcaatccgtattagttacactggagagctggggtgggaactctatcatcgccgcgaggactcggttgccctgtacgatgcaatcatgaatgctggccaagaggagggtatagacaacttcggaacatatgccatgaatgctttgcgtctcgaaaaggcctttcgagcttggggcctcgagatgaactgtgataccaacccgctagaggccggcctagaatattttgtgaaactcaataagcccgcagactttatagggaaacaggcactgaagcagatcaaggcaaagggattgaaacggaggctggtgtgcctgaccttagctactgacgacgttgacccagaggggaacgaatccatatggtataatggaaaggtggtggggaacactacctcaggctcctactcctactccattcaaaaatcactagcctttgcatacgtcccagtacagctcagtgaggtggggcaacaggttgaggtggaactactggggaaaaactacccagcggttatcattcaggagcctctagtcctcactgaacccaccagaaatagacttcaaaagaaaggtggaaaggacaagacatag

SEQ ID NO: 185450 - DNA, 1722 bp, Artificial Sequence
  Description of Artificial Sequence: Synthetic coding sequence
atggagcggcagagccggaacagcgacaactggcggtggctgtgctggtgcgaatccggtttgtcccctggccagtctcgggacgagcggtgcgggccagcgggtgagatccgggcacacgggtggatttacctagcccgcagattctgggcccgagaagttggcaaaatgatcggccttgaacacccacttatccccgtacagcaccagtatgtcgtgaccagcactatatccgaggtaaaagctttgaaaagggaactgcccgtgctgcgagatctggaaggctcctactaccttcggcaggagagggacggcctgctctttggcccctacgagtctcaagaaaagatgaaggtgcaggactcctgggttaccaatggcgtgccgcctggcttcggcaaagagctttttgagtccgatctcgataggattatggagcacatcaaagctgctatggaaatggtgccagttttgaaaaaggccgatatcatcaatgtggtgaacgggcctattacctacagtcccgatatcctcccgatggtgggtccgcatcagggcgtgcggaattattgggtggcgatcggcttcggttacggcatcattcacgccggcggtgtcggaaagtacctctccgattggatcctacacggagaaccccctttcgacctgatcgagttggacccgaataggtacggtaagtggaccactacccagtacaccgaagctaaggccagagagtcgtacggcttcaataatatcgtcggctaccccaaggaagaaagatttgctgggcgacccactcagcgggtgtctgggttgtaccaacgcctcgagtctaaatgtagcatgggctttcacgcaggatgggaacagccccactggttctataaacctggtcaggatactcagtacagaccttccttccgaaggaccaattggttcgagccagtggggagcgaatacaaacaggtcatgcaacgggtagccgtcacagacctgtcaccctttggcaagtttaatatcaagggacaagactcaatacgattgttggatcacctctttgcaaacgttatcccgaaagtggggttcaccaacatctcccacatgctaactcctaagggaagagtatacgccgagctgaccgtgagccaccaatcccctggcgagttcctgttaattaccggctctggttctgagctgcacgacctgagatggatagaggaagaagcggtgaagggcggatacgacgtggagattaagaacatcacagacgagctcggcgtgctgggagtagccggaccccaagcacgcaaagtcttgcagaagctgactagtgaagacctatccgacgacgtctttaaatttctgcagaccaagagcttaaaggtctctaacattcccgtgacagcaattcgcatttcttatacgggagagctcggttgggaattgtaccacagaagagaagattcggtcgccctatatgatgctataatgaacgcaggccaggaagaaggcattgataactttggaacctacgctatgaatgcattaagactcgagaaagcgttccgggcctggggactggaaatgaactgtgacactaatcccctagaagccggcctcgaatacttcgtgaagctgaataaggaccagaactcttgctttgcacacttcaaagaagagaatggttgggtctcgaggtgggctattcgcccctattag

SEQ ID NO: 185451 - DNA, 1842 bp, Artificial Sequence
  Description of Artificial Sequence: Synthetic coding sequence
tacctgatcgagcccgagaagatccaggagatgttccccctgctgaacatgaataaagtcctggcgggtctgtataaccctggagatgggcacatagacccctattcactgactatggccttggcagccggtgcgcggaaatgtggggctttgcttaagtaccccgcacctgtgacaagcctaaaggccagaagtgacggaacatgggacgtcgaaactcctcagggatcaatgagggccaaccggatagtgaacgcggcaggcttctgggcaagagaggtcggaaaaatgatcggcctcgaacaccccctgatcccagtacagcatcagtacgttgtcacttcaacaatttcggaggttaaagcgcttaagagagaactgccagtactgagagatctcgaggggtcttattacctgagacaggagcgcgacggcctcctctttggaccatatgagtcgcaggagaagatgaaagttcaggactcatgggttaccaatggagtccctccagggtttggtaaggagctttttgaatcggacctggatcgcatcatggaacacattaaagctgccatggaaatggttccagtcctgaagaaggccgacatcataaacgttgtcaacggtcccattacttacagcccagacattctaccaatggtgggtccacaccaaggtgtgcggaattattgggtggctatcgggttcggctacggcatcatacacgccggtggcgttggcaagtacttgagtgattggatccttcatggggagcctccttttgatctgatcgaacttgacccaaacaggtatggaaagtggaccacaacacagtatacagaagccaaggcacgcgagagctacggttttaacaacatcgtaggctacccaaaagaggaacgtttcgccgggagacctacacagcgcgtgtccggattgtatcagcgacttgagtccaagtgctccatgggctttcacgcggggtgggagcagccacactggttctataaacctggacaggatactcaatatcgtccctcctttagacgtactaactggttcgagcctgtgggctctgaatacaaacaagtcatgcagcgcgtcgccgtgaccgatcttagccccttcggcaagttcaacatcaaaggacaggacagcattcgcctgctggatcatttatttgccaacgttatacccaaagtagggttcacgaatatttctcatatgctaacacctaaaggccgtgtgtatgccgaactcaccgtgtcccatcagagcccaggcgaatttctgctgatcaccggttcgggttcggaactccatgatctccgttggatcgaagaagaagccgtcaaaggcggatacgatgtagaaataaagaatataacagatgaactgggcgtactcggggtggcgggccctcaggcgagaaaggtgcttcagaaactcacctctgaggacctctctgacgacgtgtttaagttcctccaaaccaaaagcttgaaggtgtcgaacatcccggtgaccgccatcagaatcagctacaccggtgaactaggatgggaactttaccacaggcgggaggattccgtcgccctctacgatgccataatgaatgccggccaggaggagggcattgataactttggtacttacgccatgaacgcactccgcttggaaaaggcctttagagcctgggggctggaaatgaactgtgacactaaccctctggaggccggtctcgagtactttgtgaaactgaacaaggaccaaaattcctgttttgctcattttaaggaggagaatggctgggtcagccggtgggcaattaggccttactag

SEQ ID NO: 185452 - DNA, 1875 bp, Artificial Sequence
  Description of Artificial Sequence: Synthetic coding sequence
atgacccggaccggctggcacgccaccgagcagtacctgatcgagcctgagaagattcaggaaatgttcccccttctgaatatgaacaaggtgctggcaggactgtacaatcctggcgacggccatatagacccctacagcctgaccatggcattggccgcgggcgctcggaagtgcggtgccttgctcaaatacccagcgcctgtgacctctttaaaggcacggagtgacgggacatgggatgtcgaaactccccagggaagcatgagggctaatagaattgttaatgcagccggcttctgggcaagggaagtaggaaagatgatcgggttagagcacccactgattccggtgcaacaccaatatgtcgtgacatccaccatctctgaggtgaaggcactgaaacgggaactcccagtccttagggatctggaaggttcgtactaccttcggcaagaacgcgatgggctgctttttggaccatatgaatcacaagagaagatgaaagtccaggactcttgggttacaaatggcgtgcctcctggattcggcaaggaactgttcgaaagcgacctggacagaatcatggaacacatcaaggctgccatggagatggtgccggtgctcaagaaggccgacatcattaatgtcgtcaatgggcccatcacctactctcctgatattttgcccatggtggggccgcaccagggcgtaagaaactattgggtggcgatcggctttggctacgggatcatccacgcagggggcgtgggaaagtatctgagcgattggattctgcacggcgaaccaccctttgatttgatcgagctcgacccgaatcggtatggcaaatggacgactactcagtacactgaggcaaaggcccgagagtcgtacgggtttaacaacattgtcggttatccaaaggaagagaggtttgcaggacggcccacccaacgggtctccggcttgtatcagcgcctagagtccaagtgcagcatggggttccacgccggatgggaacaaccgcactggttctacaagccaggacaggacacacagtataggccatcatttcgccgcacaaattggtttgagcccgttggctctgagtacaaacaggtcatgcagcgggtcgctgtgaccgacttatcccccttcgggaaattcaatatcaaaggccaggattcaatccgactgctggatcatctctttgccaatgtgatcccaaaagtcggctttactaatatttctcacatgcttacccccaaaggtagggtttacgctgaactgactgtctcacaccagagccctggcgaatttctcttaatcacgggctctggcagtgagctgcacgacctgcgatggatcgaagaagaagcagtgaagggtggatacgatgtagaaattaagaacataactgacgagctgggagtgctgggagttgcaggccctcaggcccgtaaagtgttacagaaacttacaagcgaggacctgtcagacgatgtgtttaaattcctgcagaccaaatctctgaaggtctccaatatcccagtgactgccatcagaatcagctataccggcgaactgggatgggagctctaccatcggagagaggacagtgtcgcactctatgatgcaattatgaatgcaggccaggaagagggcattgataacttcggcacttacgccatgaatgccctaagactggagaaggccttcagggcctggggcctcgagatgaattgcgacacaaaccctcttgaggctggtctcgaatactttgtgaagctgaacaaagaccaaaactcttgcttcgcgcactttaaggaggagaatggctgggtgagtaggtgggccattaggccttattag

SEQ ID NO: 185453 - DNA, 1185 bp, Artificial Sequence
  Description of Artificial Sequence: Synthetic coding sequence
atgtggagctgctggcggaaccagagcagccggctggacctgcccgggacacaatacggtattatccatgctggaggggtcggcaaatatctgtccgattggatcctgcacggcgaaccccccttcgatcttattgagttagatcctaaccgttatggcaaatggacaacgactcagtatactgaagccaaagctcgagagagctacggatttaacaatattgtcggttatcccaaggaggagaggttcgctggccgacctacacagcgggtgagtggcctgtatcagagattagagtcaaagtgctccatggggtttcacgccggatgggagcagcctcattggttctacaaaccgggacaagatacgcagtatagaccttcctttcggaggaccaattggttcgagcctgttggatctgagtataagcaggtaatgcagagggtagccgttacggatttgtcaccttttggtaaatttaatatcaaaggccaggactccatcaggcttcttgatcatctcttcgccaacgtgataccgaaagtaggttttacaaatatttcacatatgctcacgccaaaaggacgagtttatgccgaactgacagtgagccatcagtcccccggagagtttctactaattaccgggtcaggatctgaactccatgatctgcgctggatcgaggaagaagctgtaaagggaggttatgatgtcgaaatcaaaaacatcaccgatgaactgggggtgttgggagtcgctgggccccaggctcgcaaggtgctgcagaagctcacatccgaggaccttagcgacgatgtgtttaaatttctccaaactaagagcctcaaagtctctaatatccctgtcaccgccattaggatctcatacaccggagaactgggttgggaactgtaccatcgcagagaggatagtgtcgcgctatatgatgctataatgaacgcagggcaggaagagggtatcgataattttggtacgtacgccatgaacgcccttcgactggagaaggcctttcgagcctggggcctagagatgaactgcgacaccaatcctctcgaagcggggctggagtactttgtgaagctgaataaggaccagaactcctgtttcgcccacttcaaggaggagaatggctgggtgagccgctgggccatccgcccttattag

SEQ ID NO: 185454 - DNA, 4731 bp, Artificial Sequence
  Description of Artificial Sequence: Synthetic coding sequence
atggccgagcggggcctggagcccagccccgccgccgtggccgccctcccgcccgaggttcgggcgcagctcgccgagctcgagttggagctctccgagggggacatcacacagaagggctatgagaagaagcggagcaagctcctgagtccctactccccacagacccaagagacagacagcgcggttcagaaggaattacggaatcagacacctgcgccgtccgccgctcagacctctgcaccaagcaaataccacaggacccgaagcggcggcgctcgggacgagcgttaccgctctgatatacataccgaggcagtgcaagctgccctggccaagcataaggagcaaaagatggcactgcccatgcccactaagcggcgctccacattcgtgcagtccccagccgacgcctgcacaccccctgacacaagctcagctagcgaggacgaagggtctctgaggcgccaggctgccctaagcgccgcccttcaacagtccctgcagaatgcagaaagctggatcaacaggagcatccaggggtcatcaacctcatcctctgcgtccagcactctgtcccacggggaggtgaaaggtacatctggatcacttgccgacgtgtttgctaatactagaatcgaaaacttttcagctcctccagacgtgaccactacaacatcaagctcttccagttccagctccatccgtcctgccaatatcgatctgccaccttcaggaatcgttaaaggaatgcataagggtagtaaccgaagtagccttatggatactgccgacggcgtcccggttagtagtcgcgtgagcaccaagattcagcaattactcaatacattgaaacggcctaagagacctcccctgaaagagttctttgtggatgacagcgaagagattgtggaggtgccccagccagatcccaaccaacccaaaccagagggccgacagatgacaccagtgaaaggggagccactgggagttatatgtaactggcctcccgccttggagagtgccttgcagcgctgggggaccactcaggctaagtgctcttgtctgactgcgctggacatgaccgggaagccagtatacacgctgacttatggcaaactgtggtccaggtccttgaaactcgcttacaccttgctgaacaagctgggaacaaaaaatgagccagtcctgaagcctggggatcgcgtggcactcgtgtacccaaacaacgaccctgtcatgttcatggttgctttttatgggtgcctgctcgccgaagttatacctgtacctatagaagtcccccttaccagaaaagatgccggggggcagcaaataggtttccttttaggatcttgcggcattgcactggctcttacctcagaagtgtgtctaaagggtctgcccaaaacacagaatggtgagatcgttcagtttaaaggttggcccagactgaagtgggtggtaacagattcgaaatatctgtccaagccccccaaggactggcagccccacatcagccccgccgggaccgaacctgcatacattgagtataagacgtcaaaagaaggcagcgtgatgggggtcaccgtgtcaagacttgcgatgctttcacactgtcaggcccttagtcaagcctgtaattacagtgaaggggaaactattgtgaacgttctggactttaagaaggacgccggattgtggcacggcatgttcgctaacgtgatgaataagatgcacaccatctctgtcccatattcagtgatgaagacatgtccactcagctgggtccagcgagtgcacgctcataaagctaaggttgccttagtaaaatgccgagatcttcactgggctatgatggcgcatcgggaccagcgggatgtgagcctgtcgagtctgagaatgctcatcgtcacagacggcgctaacccatggtctgtcagcagctgtgatgctttcctcagcctgtttcagtctcacggtctgaagcctgaggctatttgcccatgcgccacatcagcagaggccatgacagtggctattcgacgacctggcgttcccggcgccccacttcccggccgcgccatactttccatgaacgggctgagctacggagtcattagagttaataccgaagacaaaaattctgcactaaccgtccaggatgtcgggcacgttatgcctggtggaatgatgtgtatcgtgaaacctgatggccccccgcagctctgtaaaactgacgagataggagaaatttgcgtgtcttcacgtaccggcgggatgatgtatttcggtcttgctggagtcactaaaaacacttttgaggttatacctgtgaacagtgccggcagccccgtgggagacgtgccgttcatcagaagcgggctgctaggattcgtgggccccggcagcttggtgtttgtggtcgggaagatggacgggttgctaatggtgagtggccggcgccataatgctgatgacattgtggctacaggtctcgccgtcgagtctatcaagactgtttatcgtggccgcattgccgtgttctcagtgtctgtcttctacgatgagcgtattgtcgtggtggcagagcagcgcccagacgcctccgaagaggattcgtttcagtggatgagtcgcgttcttcaggccattgattccattcaccaggtcggagtgtactgtctcgcactggtaccagcaaacaccctgcccaaaaccccactcggggggattcacatatcacagaccaagcagcttttcctggaaggatcattacatccttgcaacattctgatgtgtccgcacacctgcgtaaccaatctgcctaaacctaggcaaaagcagcctggagtcgggccagcatctgttatggtcggcaacctggtagcaggaaaacgcattgctcaggctgccggccgcgatctcggacagatcgaggagaatgatctcgtgcggaagcatcagttcctggccgagatcttgcaatggagagcgcaggccactccagaccacgtgcttttcatgctgctgaacgcaaaagggactactgtgtgcacggcaagctgccttcagctgcacaagagagccgagagaatcgcatcggtgcttggtgacaaggggcacctgaacgccggagacaacgttgtgctgctctatcctcctgggatcgagctaattgccgccttctatggctgtctgtatgccggctgtatcccagttaccgtaagacctcctcacgctcaaaacctgaccgcgactttgccgaccgtgaggatgattgtggatgtctcaaaagccgcctgcatattaacctcccagaccctgatgagattgcttaggtcaagggaggccgcagctgccgtagacgtgaaaacctggcctactataatcgatacagacgacctgcctaggaagcggctccctcagctgtacaagccccctaccccggaaatgctggcttatctggatttttccgtgtccactacgggaatgctgactggcgtcaaaatgtcgcattcagcagtgaacgcgctgtgtagggctattaagctccagtgtgagctgtattcttcccgacaaattgctatttgcttagacccttattgtggcctagggttcgctttgtggtgcctctgttctgtctatagtggacaccaaagcgttctcattcccccaatggagctagaaaacaatcttttcttatggctgagcaccgttaaccagtataagataagagataccttctgcagctattccgtaatggagttatgtactaagggactgggaaatcaggtggaggtgctcaagacgcgtggtattaacttgtcttgtgttaggacatgtgtggtagtggccgaggagaggccaagggtggcactgcaacagtctttctcaaagctttttaaagacattggtttatcacctagagccgtgagcacaacatttggaagtagagtgaatgtcgcaatctgtctgcaggggactagtggtccagatccaacaacggtatatgtcgacctgaagagcctgaggcacgacagagtaagacttgtggagcgcggtgctccacagagcctcctcctttccgagagcggaaagattctccccggcgtaaaggttgtcatcgtcaatccagaaactaaagggccagtcggcgacagccatctgggagaaatctgggttaatagccctcacaccgcaagcgggtactacactatctacgactctgagactctgcaggccgatcattttaacactagactgtcattcggggatgccgcacagaccctgtgggcgcgcactgggtacctggggtttgtgagaaggactgaactcaccgccgctacaggcgagcgacatgatgctctctatgtagtgggcgcattagatgagacgctggagttgagaggactgcggtaccatccaattgacatcgagacctcagtgtctcggatccatcgctcgatcgctgaatgtgctgtattcacctggaccaatctgctggtggtggtggttgaactgtgcggctccgaacaggaggctcttgatttggtgcctctggtcaccaatgtggtgctggaggagcactaccttattgtgggcgttgttgtcgtagttgatccaggtgtcattccgattaacagccgtggtgaaaaacagcggatgcatctccgggactccttcctggcagaccagctggatcctatttacgtggcttataacatgtag

SEQ ID NO: 185455 - DNA, 1179 bp, Artificial Sequence
  Description of Artificial Sequence: Synthetic coding sequence
atggccgagcggggcctggagcccagccccgccgccgtggccgcccttccgcctgaggtgcgggcccagctggctgagttggagctggagctgagcgaaggagacataacacagaaaggctatgagaagaagcgatctaagctcctgtctccatattctccacagacccaagaaacggactcggcagtccagaaagagttgaggaatcaaactcccgctcccagcgcagcacaaactagtgccccaagcaaatatcatcggactaggtccgggggagcccgcgacgagagataccgcagcgagtttagtctcgtccgcatttactccgaggacatccacactgaagcagtgcaggctgcacttgcaaaacacaaggaacaaaaaatggccctgcctatgcccaccaagcggcgcagcacctttgttcaatctccagccgatgcctgtacccctccagatacctcgtcagcttccgaagatgaggggagcttgaggcggcaggcggctctgtccgccgcattacaacaaagcctacagaatgccgaatcatggataaataggagcatacagggctcctctacatcttcatcagcaagcagtacgctttcccacggtgaagtgaaagggacctcgggatctctcgctgacgtgtttgcaaacacacgcatcgagaatttttctgcccctcctgatgtgaccaccaccacatcgagcagctcctcgtcctcgtccatccggcccgctaatattgacctccctccctctgggattgtaaagggcatgcacaagggaagtaatagatcgtccctgatggacacagcagatggcgtgccagtgagtagccgggtttcgactaaaattcaacagctcctgaacacactcaaacgccccaaaagaccccctttgaaggagtttttcgtcgacgatagcgaagagatcgtggaggttccccagccagatccaaaccaacctaagcctgagggccggcagatgacgccagtgaagggcgaacctctgggggtgatatgcaactggccccccgcccttgaatcagccctacaacgatgggggacaacccaggccaagtgttcttgcttaacggctctggacatgaccggaaagcccgtatatacgctgacttatggagagtcagcaagattccagatcctgctgagctag

SEQ ID NO: 185456 - DNA, 4671 bp, Artificial Sequence
  Description of Artificial Sequence: Synthetic coding sequence
atggccgaccggagcctggagggcatggccctgcccctggaggtgcgagcccgactcgccgaacttgagctcgaactttccgaaggcgacattacccagaaggggtatgaaaaaaagcgctctaaactgatcggcgcatacctaccgcagccaccacgggtggaccaagcactgcctcaggagcggcgggcgccggtgacaccttcttccgcttcaaggtatcatcgtaggagatcttcagggagccgcgatgaacggtatcggagcgatgtacatacagaggccgtgcaggctgccctggccaagcataaagagcgcaaaatggcagtacccatgccatccaagcgacgcagcctggtggtccaaacctccatggacgcatacacccctcccgacaccagtagcgggagtgaagacgaggggtccgtgcagggagacagccaaggaacccccacctcatctcagggttcgatcaatatggagcactggatttcccaagccattcatggatctacgaccagcacgactagcagctcttccacccagagcggggggtcaggcgccgctcaccgactggcagatgtgatggcccagacccacatcgaaaatcattccgcaccaccggatgtcactacatataccagcgaacatagtatccaggtggagagacctcaaggcagtactggaagtaggaccgctcccaaatatggaaacgccgagctgatggagacaggcgatggggtcccagtttcctcacgggtgagcgcaaaaatccagcagttagtgaacacgctgaagagacctaagcgcccacccttacgcgagttttttgtcgatgactttgaagaactactcgaagtccagcagccagaccctaatcaaccaaagcctgagggagcgcagatgctggcaatgcgtggcgaacagttaggggttgtcactaattggccaccaagcttagaggcagctctgcaacgctggggcaccatctcacccaaggcaccatgtctaacaaccatggatactaatggtaaacctctgtacattcttacctacggaaaactgtggacccggagcatgaaagtcgcatactctattcttcacaagctgggcaccaaacaagagcctatggtccggcctggcgacagggtcgctctggtcttcccaaacaatgaccccgcagccttcatggccgctttttacggttgccttctcgcagaggttgtgccagtgcctattgaggtacccctgacacgaaaggatgctggtagccagcagatcggcttcttgttgggatcttgtggcgtaacggtcgctctgacctccgacgcatgccacaaaggactgcccaaatctcctacgggcgaaataccgcagttcaagggctggcctaaactcctctggttcgtcaccgagagcaaacacttgagcaagccaccaagggactggttcccacatattaaggacgcaaacaatgacacagcatacatcgagtataagacttgcaaggatggctccgtgctcggtgtcaccgttactaggacggctctgctgacccactgccaggccttgacccaggcatgcggttacacggaggcagagaccatagtgaacgttctcgatttcaagaaagatgtcggcctatggcacgggattttaacctcagtgatgaatatgatgcacgtgatcagcatcccatatagcctaatgaaggttaacccactcagctggatccagaaagtttgccagtataaagcgaaggtggcctgtgtcaagtctagggacatgcattgggcccttgtggctcatagggatcagagagatattaatctgtcgtctttaagaatgctaatcgtggccgatggtgccaacccgtggagcatctcatcatgtgatgctttcctgaacgtattccagagtaaaggtctccggcaagaggtcatttgtccctgcgcgtctagtcccgaggcactcactgttgctataaggagacctacggatgactcgaatcagccacctggtcgtggagtgctgagtatgcacggactcacctacggcgttatccgggttgactccgaagagaagctgtctgtgctgacagtgcaagacgtggggctggtgatgcccggagcaattatgtgtagcgtgaagcccgacggcgtgccacagttgtgtaggactgacgaaattggagagctgtgcgtgtgtgcagttgctaccggtacttcctactacggtctgtcaggcatgacaaaaaacacattcgaggtgttccccatgacttcttcaggcgcgcccatcagcgaatacccattcatcaggacagggctgctgggtttcgtgggcccagggggcctggtcttcgtcgttggaaagatggatgggttaatggtagtttccgggaggcgacacaatgccgacgatattgttgccactgcccttgccgtcgagcctatgaaatttgtgtatcgcgggcgcatcgctgtgttctcagtaacagtgcttcacgacgaaagaatcgtgatcgtcgcagagcaacggccggatagtactgaggaggacagtttccagtggatgtcccgtgtcctgcaggccatcgatagcattcatcaggtcggagtctactgcctggcccttgtcccggccaacacgttgccaaaaaccccactaggaggcatccacttaagtgagaccaaacagctgtttttggaggggagccttcacccctgtaatgtgctgatgtgcccccatacctgcgtgactaacctaccgaagccaaggcagaagcagcctgaaataggtcccgccagtgttatggtgggtaatctcgtgtctggtaaaaggatagcacaggcctctggtagggacttgggacagattgaggacaatgaccaggcaagaaagttcctgtttttgtcagaggtgctgcagtggagagcccaaacgacccctgaccatattctgtacaccctgctgaactgccgcggcgcaatcgctaatagcctgacgtgcgtgcagctccacaagagagccgagaaaatcgccgtaatgctgatggagagaggacacctgcaagatggggaccacgtcgcactggtatatcctccagggatcgacttgattgccgccttctatggatgcctttacgctgggtgcgtcccaatcacagtaaggcccccacatcctcagaacattgccactactctgccgacagtgaagatgattgtcgaagtgtcccgcagcgcctgcttgatgacaacccagctcatttgtaagctgcttcggagccgcgaggcagccgccgccgtggacgtgagaacctggccactgatcctggacaccgatgacctcccaaaaaagagacccgcccagatctgtaagccatgtaaccctgacaccctagcttacctggacttcagcgtgtccactaccggtatgctcgcaggtgtgaaaatgtctcacgccgccacatccgctttttgtaggagcatcaaactgcaatgcgaactatacccatcacgcgaggtcgcaatttgcctagacccatactgtggtctgggattcgtgctgtggtgcctctgtagtgtatactccggccatcaatccatcctgatccccccttcagaactggaaacgaacccagctttgtggctcctggcagtgagtcaatataaggttcgggacactttttgctcatacagcgtgatggaactgtgcaccaagggccttggttcccagaccgagagtttaaaggctcggggactcgatctctctcgagtgcggacctgcgtggtggtggctgaggagaggccacgtatcgctctgacacagagcttctccaaacttttcaaggacctcggcctccaccccagggctgtgagtacatcattcgggtgccgcgtgaatttggcaatctgcctccaggggaccagcggcccggatcctacaaccgtgtacgtcgacatgcgcgctttaagacacgatcgggtccgactggtagaaagaggaagcccgcactctttgccactgatggagagcggaaagatcctaccgggggtacgcatcattatcgcaaaccccgagacgaagggacccctgggcgatagccatctcggcgagatctgggttcattcggcacataatgcttcaggctattttactatttatggtgatgagagccttcaaagcgatcattttaatagcaggctgtcgtttggcgacactcaaacaatttgggcacggactggctatcttggattcctgcggcgcaccgagcttaccgatgcgaatggcgagcggcatgatgccctgtacgttgttggtgcattggacgaggccatggagctgaggggtatgagatatcatccaatcgatatcgaaacgtccgtgattagagcacacaagagcgtcactgaatgtgcagtgttcacttggactaacctgctggtcgtggtggtggaactggacgggagcgagcaagaagctctggacttagtgccccttgttactaatgtggtactagaagaacactatctgatcgtcggcgttgtggtggtcgtcgatataggagtgataccaattaactcccggggtgaaaaacagagaatgcatttgcgtgacggtttcttggctgaccaacttgaccccatttatgtggcgtataacatgtag

SEQ ID NO: 185457 - DNA, 1971 bp, Artificial Sequence
  Description of Artificial Sequence: Synthetic coding sequence
atggccgtgcccatgcccagcaagcggcggagcctggtggtgcagactagtatggatgcctacacaccacctgacacatcaagtggctccgaggacgaaggtagcgtgcagggggacagtcagggtacaccgacgtcaagccaagggtccatcaatatggagcactggatctctcaagcaatccatggctccactaccagtacaactagtagctcctccacacagagcggaggctcaggcgcggctcatagactggctgatgtcatggctcagactcacattgaaaatcatagcgcccctcccgatgtcaccacctacacctcagaacacagtatacaggtggagcggccccaggggagcaccggctcacggactgcaccgaaatatgggaatgcggagctgatggaaacaggggatggggtccctgtctcttctagagtgtctgccaagatccagcagctcgtgaataccctaaaaagacctaagcgtccgcctctgcgcgagtttttcgtcgatgactttgaggaattactcgaggtgcagcagcctgaccctaatcagcccaaaccagaaggagcccaaatgctggctatgcggggtgaacagctgggcgtcgtgactaattggccgcccagcctggaggctgcactgcagcgctggggtactatatctcctaaggcgccctgtctgacgacaatggataccaatgggaagcctttgtacatcctcacctacgggaagctgtggacgaggtctatgaaagtggcatatagcattctgcacaaactgggcactaagcaggaacccatggttaggccaggcgatcgggtcgctctggtgttcccaaataatgatccagcggcctttatggccgctttctacggatgcttgctggccgaggtggtgccagtgccgattgaagttcctcttactcggaaggacgctgggagccagcagattggattccttctcggttcgtgcggcgttacagttgcactgacgagcgatgcctgccacaaaggcttaccgaagtcgcctacaggtgagatcccacagttcaagggctggcccaagctcctgtggtttgttaccgaatcgaagcacctgtcgaagcctccccgggactggttccctcatattaaggacgcgaacaatgatacagcctacattgaatacaaaacctgtaaagatggcagtgtgctgggagttaccgtcacgaggactgcacttctgacacattgtcaggcgctaacccaggcctgcgggtatactgaagccgagactatcgtgaatgttcttgacttcaaaaaagacgtgggcctgtggcacgggatcctgacatcagttatgaacatgatgcacgtgatcagcattccatactccctcatgaaagtgaacccgctgtcatggatccagaaggtgtgtcaatataaggccaaagtcgcttgcgtgaagagtagagacatgcactgggcactggtcgcacacagggatcaaagggatatcaacctgagtagcttacggatgctgatagtagccgacggcgccaatccttggagcatctctagttgcgacgcctttctgaacgtgttccagagcaaagggctgagacaggaggttatctgcccatgcgcttcctccccagaggcgttaactgtggccattagaaggccaactgacgactctaatcagccccctggccgaggcgtattatctatgcacggcttaacctacggcgtgattcgcgtcgattccgaagaaaaactgagtgtgctcacagtacaggacgtcgggttagtgatgccaggtgcgataatgtgtagcgtgaagccggatggcgtcccacagctttgtagaacagatgaaattggcgagctgtgtgtgtgtgccgtggctaccggcactagttactatggtctgagcggaatgactaagaacacatttgagcacacatccaataaggggaagtag

SEQ ID NO: 185458 - DNA, 597 bp, Artificial Sequence
  Description of Artificial Sequence: Synthetic coding sequence
atgagccacgccgccaccagcgccttctgccggagcatcaagctgcagtgcgagctgtatccgagccgagaggtagcaatatgtctggacccttactgcggtctgggatttgtcttgtggtgtttgtgcagtgtttacagcgggcaccaaagcattttaatacctccatcagaactggagacaaacccagctctgtggcttttggcagtcagccaatataaagtcagggatacattttgctcctactcagtgatggagctgtgcaccaaggggctcgggtctcagacagagtcattgaaagcccggggacttgatctgagcagagtgagaacctgtgtcgtcgtggctgaggagagaccccgtattgcgctcactcagtctttcagtaaactgttcaaggacctgggtctgcatcccagagctgtgagcaccagcttcgggtgccgagtaaatctcgccatctgtctacaatgttgggactaccggcacgaaccacccagaccagcccccaaatgtttcaaaatggtctacaaagagggggttaggagcgtaggcgaagataagatcagagagaaacggacgaaaacctggcgttag

SEQ ID NO: 185459 - DNA, 696 bp, Artificial Sequence
  Description of Artificial Sequence: Synthetic coding sequence
tgagagaccatcgtgaacgtgctggacttcaagaaggacgtgggcctctggcatggcatccttacatctgttatgaacatgatgcacgttatatccataccgtactccctgatgaaagtgaaccccctctcttggattcagaaagtctgccagtacaaggcaaaggtcgcatgtgtgaagtctagagatatgcactgggctttggtcgcacacagggaccagagggacataaatctgtctagcctgcgcatgctgatagtggctgacggggctaacccatggtccatttcttcgtgtgacgcttttttgaacgtctttcaaagcaagggactaaggcaggaagttatctgcccatgtgcttccagcccggaggccctaaccgtagccataagaagacctacagatgactctaatcagccccccggccgaggggtgctgagtatgcatgggctcacctatggcgtaatccgggtcgattccgaggaaaagttgtccgtgctgactgtacaagacgtgggactggtcatgcccggagctattatgtgtagtgtaaagcccgatggcgtgcctcagctctgtcgcacagacgaaataggtgagctatgcgtgtgcgccgtagctactggcacctcctactacggcctgagcggcatgaccaagaatacgttcgaacacaccagcaacaagggtaagtag

SEQ ID NO: 185460 - DNA, 564 bp, Artificial Sequence
  Description of Artificial Sequence: Synthetic coding sequence
atggccgaccggagcctggagggcatggccctgcccctggaggtgagagctcggctcgcggagcttgaattggagttgtccgagggagatatcacccaaaaagggtacgagaagaagaggtccaagcttataggagcttacttgcctcagcccccgactgcaaacggggccgcagtggtgagatgtagactgcagcactcagagggagctcccaggcgcacctttcggtcggctcacatcggagtttgcgatgtaagggaagccgccgctagggaacgtgtggcaagcacggctggaaatcggcccctgttctactttaggtttggcgttgaccaggccctgccacaggaaaggcgcgcacctgtcaccccaagttcagcgtcccgttatcataggaggagaagttctggctccagggatgagaggtatcggtcagacgtgcataccgaagctgtacaggccgccttagctaagcataaagaacgtaaaatggcagtgccaatgccgtctaaacggaggtcactggtagtgcagacctctatggacgcttacaccccaccttag

SEQ ID NO: 185461 - DNA, 468 bp, Artificial Sequence
  Description of Artificial Sequence: Synthetic coding sequence
tgagtgtacagcggccaccagagcatcctgatcccccccagcgagctggaaaccaaccctgcgttgtggctactggccgtttctcaatacaaggtccgggatacattttgttcttacagtgttatggagctgtgcactaagggcttgggaagccagacagaatccctgaaagcacgcgggctcgatttgtccagggtgcgcacatgcgtggtggtggcggaggagcgaccgcgcatagcattgactcagagcttctctaagctgtttaaagatcttgggctgcacccgcgggccgtgagtacctcgttcggctgcagggtaaacctcgccatctgcctccagtgttgggattaccggcacgagccccccaggccagccccaaagtgtttcaaaatggtgtataaggaaggggtgaggagcgtgggcgaggataaaatccgtgagaaacgaacgaagacttggcggtag

SEQ ID NO: 185462 - DNA, 1446 bp, Artificial Sequence
  Description of Artificial Sequence: Synthetic coding sequence
atctgggtgagccggagcgcctgcctgatgaccacccagctgatctgcaagctgctgcggtctagagaggctgcagccgcagtagatgtgagaacctggcccctgattctggacactgacgacctaccaaagaagcggccagctcaaatttgcaagccatgcaacccggacactctcgcatacctagatttcagcgtttccaccactggcatgctggcaggggtcaagatgagccacgccgccacaagtgccttttgccggtcaatcaagcttcagtgcgagctgtatccgtcacgcgaagttgccatctgtctggacccctattgcgggctgggattcgtcctgtggtgcttatgtagtgtgtatagcgggcaccagtcaatattaatccctcctagcgaactggagacaaatcccgccttgtggctactcgccgtgtctcagtacaaggtccgggataccttttgctcttacagtgtcatggaactttgcactaaagggctaggaagccagactgagtccctgaaggcccgcggccttgacctgtcacgagtgaggacctgcgtggttgtcgcggaggagaggcctagaatcgctctcactcaaagcttttcgaaactatttaaagacctggggctccacccacgggctgtctctacctcctttggatgtagagtgaacctcgccatctgcctgcaaggcacaagtggccccgatcccacaacagtgtacgtcgatatgagagccctgcgacacgacagggtccgccttgtagaacgcggttccccacactcccttccacttatggagtcaggtaaaatactgccaggggtgaggattattatagctaatcccgagaccaaaggcccgctcggggattctcacctgggcgaaatttgggttcactcagcccacaacgcctccggctactttactatttacggggatgagagcctgcaatccgaccatttcaacagtcgcctttcattcggggatacccagactatttgggcaagaactggctaccttggatttctccgtcggacagaattgacggacgccaacggcgaacgtcatgatgcactgtatgttgttggggctctggatgaagcaatggaactcagaggcatgcggtatcacccaatcgatattgagacaagcgtgatcagggcccacaagtccgtaaccgagtgcgcagtcttcacatggactaatttactagtggtagttgtcgaattggacgggtctgagcaggaggcactggacctggtgcctctcgtgaccaatgtcgtgctggaagaacattatcttatcgttggagtcgttgtcgtggtcgacattggcgttatcccaataaattctcggggagagaaacagcggatgcacctgagagatggcttcctggctgatcagcttgatcctatatacgtggcatacaacatgtag

SEQ ID NO: 185463 - DNA, 1116 bp, Artificial Sequence
  Description of Artificial Sequence: Synthetic coding sequence
atgcacggcctgacctacggcgtgatccgggtggacagcgaggagaagctatctgtcctgacagttcaggacgtgggcctggttatgcccggcgccatcatgtgctcggtgaagcctgatggcgtccctcagctgtgtcgtaccgacgagattggtgagctgtgtgtatgcgccgtggccacaggaacctcctactacgggctgtccggaatgactaagaacacctttgaagttttccccatgacctcgtccggggcacctatatccgagtatcctttcattcggacgggattgctgggttttgtgggaccaggggggctcgtgtttgttgtagggaaaatggacgggctaatggtggtttcaggacgtcgccataatgccgatgacattgtggccactgccctggcagtcgaacccatgaagttcgtctaccgcggcagaattgcagtcttttccgtgacagtcctgcatgatgaacggatcgttattgtggcagagcagcgccccgacagtacagaggaagatagctttcagtggatgtctcgagttctccaggccattgacagtattcaccaagttggggtctattgcctggctctcgtccccgcaaatacacttccaaagacccctctgggcggaattcacttgagcgagacaaaacagctgttcttggagggatctttgcatccctgcaatgtcctcatgtgtccgcacacgtgcgttacaaatcttccaaagcccagacagaagcagccggaaatcggcccggcctccgttatggtggggaacctggtctctggtaaaaggatagcccaggccagtggacgagaccttggccagatcgaggacaacgatcaggcaaggaagtttctgtttctgagtgaagttctccaatggcgtgcccagacgactccagatcacatcctgtacactctccttaattgtagagtaaggcgcggcgcaggcttaccctggttactggcctcaagaggcctagcctggtttctgggggctctgttgctgctgagcttgaacccctttgcctctgtgttgtgggagttcttcctgtgtttcgctatcctgaccgaaaccttcgtccctagagactgtttctag

SEQ ID NO: 185464 - DNA, 1236 bp, Artificial Sequence
  Description of Artificial Sequence: Synthetic coding sequence
atgtggagcggctggtggctgtggcccctggtggccgtgtgcaccgcggatttctttagagatgaagccgaaaggataatgagggacagtcccgtgatcgatggccacaacgatctgccatggcagctgttggacatgttcaacaacaggctgcaggacgaacgtgctaatctaacaactctggcaggaacccacacgaatatcccgaaactgagagccggatttgtgggaggacagttttggtcagtgtatactccctgtgacactcagaataaggacgccgtgcggcggacacttgagcagatggatgtggtgcaccgtatgtgcaggatgtatccggagacttttctatatgtgactagctccgcaggcattcggcaggccttcagggaagggaaggtcgcttcactcataggggtggagggcggacactccattgatagttccctgggcgttctaagagccctgtaccagttggggatgcgctatctgaccctgacccattcttgcaacaccccttgggccgacaactggctcgtagacaccggtgactcggagcctcagtctcagggcttgagcccattcggacaacgcgtggtgaaagaattaaaccgattgggcgtgttgatcgacctggcccatgtcagcgtggccaccatgaaagcgaccttgcagctgagcagggctccagtcatattcagtcactcctctgcatacagcgtttgtgcttcccgccgaaacgtgcctgacgatgtccttcgcctagtgaaacagaccgacagtttggttatggtcaacttctacaacaactatatctcatgtacgaataaggccaacctctctcaagtagcagatcacttggatcacatcaaagaagtggccggggcaagagctgtcggttttgggggcgattttgacggggttcctagagtgcccgaaggtctggaggatgtcagcaaatatcctgacctaatcgctgagctgctccgccgaaactggacagaagcggaggtcaaaggggcgctggccgacaacctgctgcgcgttttcgaggcagtggagcaggcctcaaacctcacacaggcccctgaggaggaaccgatcccattggaccagctcggtggatcctgccggactcattacgggtatagtagcggcgcaagctcgcttcacagacattggggtttactgctcgcgagtcttgcccctctcgtcctatgtttatcattgctctag

SEQ ID NO: 185465 - DNA, 1236 bp, Artificial Sequence
  Description of Artificial Sequence: Synthetic coding sequence
atgtggagcggctggtggctgtggcccctggtggccgtgtgcaccgccgacttttttagggatgaggcagagcggataatgagagactctccggtgatagacggccataacgatctcccatggcagttgctagatatgtttaacaaccggctgcaggacgaacgggccaacctaaccacgctggccgggacccatactaacatacctaagttacgcgctggttttgtcggtggccaattctggagtgtgtacaccccatgcgatacacaaaataaggacgctgtgcgcagaactcttgagcagatggatgtggtccatagaatgtgccgcatgtaccccgagactttcctctacgtgacctccagcgctggtatcagacaggcattccgggagggcaaggtggcctcactgatcggcgttgagggcggtcattccatcgacagcagcctgggcgtcttgcgggctttataccagcttggcatgcggtatctaacacttactcactcttgtaatactccctgggcagataactggcttgtcgacaccggtgactccgaaccacagtcacaggggctgtctccatttggccagagagtggtcaaagagctgaatagattgggtgtgctgattgatctggcccacgtcagtgtagctaccatgaaagcaactctccagctgagccgcgcccccgtgatcttctctcactcatcagcctactcagtgtgcgccagccggagaaacgtcccggatgatgtgcttcgtctggtgaagcaaaccgactcccttgtaatggtgaatttctataacaactacatctcttgcactaataaagccaatctgagccaggtggccgatcacctcgatcacattaaggaggtcgcgggggcacgggcggttggcttcggtggggatttcgatggcgtgccaagagttcccgaagggctcgaagacgtcagcaaatacccggacttgatcgccgagctgctacgaaggaactggacggaggcagaggtcaagggcgccctggccgacaatctgctgcgggtttttgaggctgtggagcaggccagtaatctcacacaagcccctgaagaggagcccatacctttagatcagctcggaggctcgtgcagaacacactatggttacagttctggcgccagttcacttcaccgccactggggtctgttgctagccagtctcgccccactcgtattatgcttgagcttactatag

SEQ ID NO: 185466 - DNA, 1236 bp, Artificial Sequence
  Description of Artificial Sequence: Synthetic coding sequence
atgtggagcggctggtggctgtggcccctggtggccgtgtgcaccgctgacttttttagagatgaggccgaaaggatcatgcgcgatagtccagtaattgacggacataacgatcttccgtggcaattgctcgatatgtttaataatagactccaggatgagcgagctaacctgacaaccttggctggtactcacacaaacattcccaagctcagagctggattcgtcggcgggcagttctggtcagtgtataccccttgcgatacgcagaataaggacgcagttaggagaaccctggagcagatggatgtggtgcaccggatgtgccgcatgtacccagaaacgtttctttacgtcacctctagcgccggcatcagacaggcttttcgggaaggtaaggtggcatctctgatcggagtagagggcgggcactcaattgactcctccttaggggttcttagggccttatatcaactaggcatgcggtacttgacactcactcactcctgtaacaccccctgggcggataactggctcgtagatacaggggactccgagccccagagccagggactctcaccattcgggcagcgcgtggtgaaggaactcaacagactcggcgtgctgatcgacctggcacatgtgtctgtggctacgatgaaggccaccctccaactcagtagggcaccagttatcttctcccattcctctgcatatagcgtttgcgcctcccggcgtaatgtccctgacgacgtactgcgcttggttaaacaaacagatagcctcgtgatggtgaacttttataacaattacatatcctgtacgaacaaggcgaacctttcccaggtagccgatcacttagatcacatcaaggaggttgcgggcgctagggccgtgggcttcgggggagactttgacggggtgcctagagtgcctgaggggctggaggacgtgagcaagtaccctgatttgattgccgaacttctgcgccggaattggactgaagcagaggtgaagggtgccctcgctgataatttactcagggtttttgaagctgtggagcaggcctctaatttaactcaggccccagaagaggagccaatcccgctggatcagctgggagggtcttgcaggacccactacggctatagcagcggggcaagcagccttcaccgtcattgggggctcctgctggccagcctggccccactcgtgctgtgtctctcccttctgtag

SEQ ID NO: 185467 - DNA, 381 bp, Artificial Sequence
  Description of Artificial Sequence: Synthetic coding sequence
atgcagcccagcggcctggagggccccggcaccttcggccggtggccactgttaagtctgctgctgctactgcttctcctccaacctgttacctgtgcctacacaacaccgggccctccaagagcactaactactctaggggcccctcgggcccatacgatgcccggtacttacgcaccctctactactttatcctcaccctctactcagggtctgcaggaacaggctcgagcgctcatgagagacttccccctggtggatgggagcggccagcccatgtgccatgctaggccacgcaccggcatgccatgtgcatcgccctggagcagactcacctcatacgcagcctgcgtcccacccatcctatcctggtccctgtag

SEQ ID NO: 185468 - DNA, 1200 bp, Artificial Sequence
  Description of Artificial Sequence: Synthetic coding sequence
atgcagcccagcggcctggagggccccggcaccttcggccggtggcctttgctgtctctgctcctgcttctccttttgctgcaaccggtaacctgcgcctataccacgccgggcccccccagggccttgttttggtcggcctacgtgccatgccagacccaagatcgagacgcccttcggctcactctagaacagattgacttgattcgtcggatgtgtgctagctatagcgagttggaactagtgacatcagccaaagccctgaacgatacacagaaacttgcatgtttgataggagtcgaaggtggacattcattggataattcactgtctattctacctactttttacatgctgggagttcgatacttgactcttactcacacctgcaacactccctgggctgagagctccgccaaaggagtacatagtttctacaacaatatctccggcctcaccgacttcggcgagaaggtggtcgccgagatgaaccgtctagggatgatggtggatttgtcacacgtgagcgatgccgtggcccggcgagctctcgaggtgtctcaggccccagtgatcttttcccatagtgccgcaagaggcgtctgtaactcagctagaaatgtgcccgatgacatccttcagctcctcaagaagaacggcggtgttgttatggtgtccctgtcaatgggggttatccagtgtaacccatctgctaacgtgtcaacagtggccgaccattttgaccatattaaagccgtcattggatccaagtttatagggataggaggcgattacgatggagcaggaaagttcccacagggactggaagacgtgtcgacatacccggtcctgattgaggaactgctgtctagaggctggtcagaggaggagttacagggagtcctcagagggaatttactgagggtctttcggcaagttgaaaaggtgcaagaggagaacaagtggcaatctcccttggaggataaatttcctgacgaacaacttagctcatcctgccactcagacctaagccggctgaggcagcgccagagtcttactagcggccaggagctcactgaaatccctattcactggacagctaagcttcctgcgaagtggtctgtatcggagtcttccccccatatggcccccgtgttagcggtcgtggcaacattccccgtgctcatcctgtggttgtag

SEQ ID NO: 185469 - DNA, 1461 bp, Artificial Sequence
  Description of Artificial Sequence: Synthetic coding sequence
atgcagcccagcggcctggagggccccggcaccttcggccggtggcctctgttgagtcttttacttttactgcttctactacaacccgtgacttgtgcctatacaactcccggtcccccacgggccctgaccaccctgggagctcctagagcccatactatgcctgggacctatgcgcctagcacgactcttagctcacccagtacccagggtttgcaggagcaggcccgggctctcatgcgggattttccactggtcgatgggcataacgacctcccgctagtcctgagacaagtgtatcagaaaggtctccaagatgtgaatctgagaaatttttcctacggccaaaccagtctagatcggctccgagacgggctggtgggagcacagttctggtcagcttatgtaccatgccaaacacaggatagagatgcactgaggctgaccctcgagcagatcgatctgatacgaagaatgtgtgcgtcgtactcagaactggaactcgtcacatccgctaaggctctgaatgatacccagaagctggcctgtttaatcggggtcgaagggggacattccctcgataactctctgtctattttgccaacgttttatatgcttggtgtgaggtatttgacactaactcacacttgcaataccccttgggctgaatcatcagcaaagggggtccatagcttctacaacaacatcagcggattgaccgacttcggggagaaagtggtggctgagatgaatcgcctagggatgatggtcgatttgtcccatgtcagtgacgcggtggcacgtcgggcgttggaggtaagccaggcaccagtgattttctctcacagtgctgcacgaggcgtatgcaatagtgctcgcaacgttcccgacgacatcctgcaactgctaaagaaaaacggcggcgtcgtcatggtctccctctcgatgggcgtaatacagtgcaaccctagtgcaaatgtatctaccgtggcggatcactttgaccacattaaagcagtcattggcagcaaatttatcggcattggcggggactacgacggagcggggaaattcccccagggcctcgaagacgtctctacctatcccgtgctgattgaagagctcctgagccgaggatggagcgaggaggagctgcagggggttctccgcgggaatctcctgagagtgtttaggcaagtggagaaggttcaagaggaaaataagtggcagagccctctggaagacaaattcccagacgaacagctgagctccagttgccacagcgacctatcacggttacggcaacggcagagccttacaagcgggcaggaattgaccgaaatcccaatccactggacagctaaactgccagccaagtggtctgtgtcagagtcctcccctcatatggcccccgtgctagctgtggtggctactttccccgtcctaatcctttggctgtag

SEQ ID NO: 185470 - DNA, 1461 bp, Artificial Sequence
  Description of Artificial Sequence: Synthetic coding sequence
atgcagcccagcggcctggagggccccggcaccttcggccggtggccactgctgtctctgctccttctcctactgctgctccagccagttacctgtgcatataccaccccagggcctccgagagcactcacaaccctcggggcccctcgtgctcacacaatgcctggcacttatgctcccagcaccacactctcttcaccctccacacaagggttgcaagagcaggctcgggccctcatgcgagattttccactcgtggatggccacaacgacttaccactcgttcttcggcaggtgtatcaaaagggattgcaggatgtgaacttgcggaacttttcatacggccagacatctctggaccgcctgcgcgacggcctcgtgggagcacagttctggagcgcctatgtgccatgccagacccaggatagagacgctttgcggctaactttggaacagattgatctgattcgccggatgtgcgcaagctatagcgaactggagctggtcacctctgctaaggccctgaacgacacacagaaactggcttgtctaattggcgtggaaggtggacatagcctcgacaattctttgtccatccttcccacattctacatgctgggtgtccggtatcttacattgactcatacatgcaacaccccatgggccgagagctcggccaagggagtgcattcattctataataacatcagtgggctgaccgattttggcgaaaaggtggtcgctgaaatgaaccgcctggggatgatggtcgacctgtctcacgtgtctgatgctgtagccaggcgagccctggaagtgagccaagctcctgttatttttagccacagcgcggctaggggcgtgtgcaattccgcacgcaatgtccctgacgacatcctgcagttgttaaagaaaaatggcggagtcgtcatggtgtctcttagcatgggagtgattcaatgtaacccatccgcaaacgtgagcacagtagcagaccatttcgatcatatcaaggcggtaatcgggagtaaattcatcggcatagggggcgactatgatggcgctgggaagttcccgcagggactggaagacgtgtccacctatcctgtgctgattgaggaactgctgagcagaggttggagcgaagaagagctccaaggggtgctgcggggcaatctgctcagagtgtttaggcaggtagagaaagtccaggaggagaacaagtggcagagccctttggaagacaaatttccagacgagcagctgtccagcagttgccattctgatctgtctaggttgcgacagcggcaatcgcttactagtggacaggagctcactgaaataccgatacattggactgccaagctcccagctaaatggagtgtgagcgaaagctccccccatatggcgcctgtactagcagtggtagctacgttcccagttttgattctatggctgtag

SEQ ID NO: 185471 - DNA, 1542 bp, Artificial Sequence
  Description of Artificial Sequence: Synthetic coding sequence
atgatccggacccccctgagcgccagcgcccaccggctgctgctgcccggttcaagaggaaggccacctagaaatatgcagcctaccgggcgagagggaagtcgggccctctctagaaggtacctacgccgactgttgttacttctgctcctgctgctgttacgccagcctgtaacaagggcagaaactacacctggtgctccacgcgctttatctacccttggctcacccagcctcttcaccactcctggggtccccagtgcactgaccaccccaggcttgaccacacccggcacacccaagacactggatctgagggggagagcccaagctctgatgcgtagttttccactagtggacgggcacaacgaccttccccaggtgttgagacagcgatacaaaaatgtcctgcaggacgtgaatctgagaaacttctctcacgggcaaacatcgttggatcggttacgcgacgggcttgtcggcgcccagttctggtctgcctctgtgtcttgccagagtcaggatcagaccgctgtccgactagctctggaacagatagacctgatccaccgcatgtgcgctagttactctgaactagagcttgtcaccagtgctgaaggcctgaattcatctcagaagcttgcatgcctaattggcgtggagggcggtcacagcctggactccagtttatccgtcttgcgctctttttatgtgcttggggtgagatatttaacacttaccttcacatgtagcactccttgggctgaatcatctacgaaattccgacaccacatgtataccaatgtgagcggcctgacctccttcggagaaaaagtagtggaggagctcaataggctggggatgatgatagacctgtcttacgccagtgatacactgattaggagggtgcttgaggtgagccaggccccggtcatatttagtcacagcgcagctcgggcggtttgcgataacctgctgaatgtgcccgatgacatcttgcagctcctgaaaaagaacggcgggatcgtcatggtgaccttgagtatgggggtcctgcaatgtaatctccttgcgaacgtcagcaccgtcgccgatcattttgatcacatacgagccgtgatcggaagcgagtttattgggatcggcggcaactacgatggtacagggagattcccccaagggctggaggatgtgtctacttatccagttctgatcgaggagctcctgtcgcggtcttggagcgaggaggaactccaaggcgtcctgcgcggaaacctgctgagagtattcaggcaagttgagaaggtgcgcgaggaaagcagagcccagtcacccgttgaggctgaattcccctacggacagctgagcactagctgccactcacacttagttcctcagaacgggcaccaggctacccatctcgaagtaacaaaacagcctacaaatagggtgccttggagaagttctaacgcgtccccttatctggtccccggacttgtagccgccgctaccattccgacgttcacccaatggctgtgttag

SEQ ID NO: 185472 - DNA, 2370 bp, Artificial Sequence
  Description of Artificial Sequence: Synthetic coding sequence
atgcggaaggtggagagccggggcgagggcggccgggaggagctggggtcgaacagtcccccgcagagaaattggaaaggaatagctatcgcattactcgtgatcttggtagtttgtagtctcatcaccatgtctgtcatacttttgacacctgacgaactcacaaacagctcagagacacgactttccctcgaagatctgtttaggaaggacttcgtcctacacgatccggaggcacgatggattaatgatacagacgtcgtatacaagtcggagaacggacatgtgatcaaactgaatatcgaaacgaacgctaccaccctgttgctggaaaacactacttttgtgacctttaaagcttcccgacacagtgtgtcaccagatttaaaatatgtgcttctcgcctacgacgtaaaacagatattccactacagctacacagcttcttacgtcatttacaacattcatacccgggaagtgtgggagctgaacccgcctgaagtcgaagattctgttctccaatacgccgcttggggtgtgcaaggtcagcagctgatctacatattcgaaaataatatctactatcagccagatatcaagagctcctcactccggctaacaagttcagggaaagaagaaatcatcttcaacggcatagcagactggctgtatgaggaagagttgctgcattcccacatcgctcactggtggtctcctgacggtgagagacttgcatttctgatgatcaatgattccctggtccccacaatggtgatcccccgattcactggagccctttatccaaaaggtaagcagtatccgtatccaaaagccggacaggtcaaccccacaatcaaactctatgtggttaatctgtatggaccaacccacactctcgagctcatgccaccagactcgtttaagtctagagaatactacataaccatggtcaaatgggtgagcaacaccaaaacagtggtccggtggttaaacagagcacagaacatcagtatactgactgtgtgtgaaacaacaacaggcgcctgttccaaaaagtatgagatgacttcagatacctggctttctcagcagaatgaggagccggtgttcagtcgggatgggagcaaattcttcatgaccgtgcctgtgaaacagggggggcgcggtgagtttcatcatgttgccatgtttctgattcagtccaaatctgaacagattacagtacgccatctcacgtctggcaactgggaagtgataaagatcttggcatatgacgagacgacacaaaaaatatatttcttatcaaccgagagctcaccccgcggacggcagttgtattctgcatcaactgaaggactgctgaatcgtcaatgcatatcatgtaatttcatgaaggaacagtgcacttactttgatgcatccttcagccccatgaaccagcactttctgctattctgtgaggggcctcgtgtgccagtggtctccctccatagtacagataaccccgccaaatacttcattctggagtccaactcaatgctgaaagaggctatcctgaagaagaaaataggcaaacctgaaatcaaaatcttgcacatcgacgattatgagctgcccctacagttgagtctgcctaaggacttcatggacaggaatcaatacgccctcttgcttatcatggacgaagagcccggcggacagcttgtgaccgacaagttccacattgattgggactccgtactgatcgatatggataatgtgatagtcgctaggtttgacggtaggggttctggtttccagggcttgaagatcctgcaggagattcaccgtcggctgggttccgtggaggtgaaagatcaaatcacggctgtcaaatttttgctcaagcttccttacatagatagtaaaaggctgtccatttttggcaaaggttacggcgggtacatcgccagtatgattctgaaatctgatgagaaattatttaagtgtggaagtgttgtggcacctatcacagaccttaaactctatgcatccgcttttagtgaacgttacctgggcatgccaagtaaggaagagagtacataccaggccgccagcgtcctgcacaatgttcacggcctgaaagaagaaaacatactgatcattcacggcaccgcggacaccaaagtacactttcaacatagcgcggaactaatcaagcatctcattaaagctggagttaattataccatgcaggtttatcccgatgagggacacaatgtctctgagaaatcaaaatatcatctgtatagcactatcttaaaattctttagtgattgtctaaaggaggagatttccgtgcttccacaggaacctgaagaagacgagtag

SEQ ID NO: 185473 - DNA, 2403 bp, Artificial Sequence
  Description of Artificial Sequence: Synthetic coding sequence
atgaccgccgccaagcaggagccccagcccacccccggcgcccgggcctctcaggcacagccagctgaccaggaactgggcagcaattctccgccacagcgcaattggaagggaatcgccatcgccctcctggtcattctcgtggtttgcagcttgattaccatgtccgtcattctgttaacacccgatgagttaaccaactcttctgaaacccgcctgagcctcgaggacttgtttaggaaagattttgtcctgcacgacccagaagctagatggatcaacgataccgatgtggtgtacaagagcgaaaacgggcacgtgatcaaactgaatattgaaaccaacgcaaccacgctgctgctcgagaacaccacctttgtgacgttcaaggctagccggcactcggtgtctcctgacttaaagtacgtgctcctggcctatgacgtaaaacaaattttccattactcttacaccgccagctacgtgatatataatatacacactcgggaagtgtgggagcttaaccccccagaagtggaagacagcgtgctccagtacgctgcttggggggtgcagggacagcagctcatctacatcttcgagaacaatatatactatcagcctgacattaagagcagctcattgcgactgacatctagtgggaaagaggagatcatcttcaatgggattgccgattggctgtatgaggaggagctgctgcattcgcatattgctcactggtggagtccagacggggaaagattggcattcttaatgatcaatgacagcttggttcccaccatggtcatccctaggtttacaggtgccttgtaccctaaagggaagcagtacccctatccaaaagcggggcaggttaatcctacaataaagctatacgtggtcaatctttatggaccaacccataccctggaactaatgccccccgactcattcaaatcaagggagtactacattaccatggtaaagtgggtgagcaatactaaaaccgtcgtaagatggctgaaccgggcccagaatatctccattctgacagtgtgcgaaacgaccacaggcgcctgtagtaagaagtacgagatgaccagcgatacatggctctcccagcagaatgaggaacctgtcttttcacgggatggctctaagttcttcatgacagtacccgtgaagcagggcgggagaggcgagttccatcacgtagccatgtttcttatccaatctaagagcgaacagataaccgtgcggcatctgacatcaggaaactgggaggttattaaaattttagcctacgacgagaccacacaaaaaatatactttctttccaccgagagcagcccaagaggccgccagctttactctgcgtccaccgagggactcctgaaccgacagtgtatcagttgtaatttcatgaaggagcagtgtacatatttcgacgctagcttttctcctatgaaccaacactttctgctgttctgtgaaggcccaagggtgcccgtcgtgtccctgcacagtactgataatcccgccaagtattttatcttggagagtaactcgatgttaaaggaggccattcttaagaaaaagatcgggaagcctgaaattaagatactccatattgacgactatgagctgcccttgcagctgtctttacctaaggactttatggatcggaaccagtacgcactgttgctaattatggatgaggagccaggcgggcaacttgtgaccgacaagttccacatcgactgggattcggtgcttatcgatatggataacgtgatcgttgcacgcttcgatgggcgggggagtggatttcagggtctgaagatattacaggagatacaccggaggctaggaagcgtcgaagtgaaggatcagatcacagctgtgaagtttctgctgaaactaccttacattgatagtaagcggctgtctatttttgggaaaggatacggcggctacatagcgtccatgatcctgaagtctgatgaaaagctgtttaaatgcggttctgtggtggcacctatcactgacttgaagctctacgcctctgccttctctgagcggtacctaggcatgccatctaaagaagaatcaacttaccaggcggcctccgtgctccacaacgtacacgggttgaaggaagagaatattttgatcattcatggcaccgccgacactaaagttcacttccagcactctgctgaactcatcaaacacttgattaaggctggggttaactacacaatgcaggtgtacccagatgaaggccataatgtctcagagaagagtaagtaccacctttattcaacgatcctgaaatttttttcggactgcctcaaagaagagattagtgtgctccctcaggaacctgaagaggatgagtag

SEQ ID NO: 185474 - DNA, 2391 bp, Artificial Sequence
  Description of Artificial Sequence: Synthetic coding sequence
atgaaccagaccgccagcgtgagccaccacatcaagtgccagccctccaagacaattaaggaactcggatcaaacagtccaccgcagagaaactggaaaggcatcgccattgcactgctggtgatcttggtggtttgttccttaattaccatgtctgttatcctgctgacgccagatgaactaaccaactccagtgagacacgattgagcttggaggatctcttccggaaagattttgtgctgcacgatcccgaggccaggtggatcaatgacacagatgtggtgtacaagtctgagaatggacatgttattaaactgaacatagagaccaatgctacaacgttgctcctggagaatacaaccttcgtgacattcaaggccagccgccacagtgtgtcccccgatcttaagtatgtgttactcgcttacgatgtgaagcagatcttccactatagctataccgcctcttatgtaatttataacatccatacaagggaggtttgggagctgaacccaccggaagtggaggattccgtgttacaatatgcggcctggggcgtacagggtcagcagctgatatatatcttcgaaaacaatatctattaccaaccagacataaaaagcagttctttgagactaacctcgtccggaaaagaggagattatcttcaatgggatagcagattggctttatgaagaggaacttttgcactctcatatcgcgcactggtggtcccccgatggcgaaaggttagcatttttgatgatcaacgactcgctggtgccgacaatggtgattccgcggttcaccggagcactgtatcccaagggaaaacagtacccttacccaaaagcgggacaggtgaatcctactatcaagctgtacgtggtgaatctctacggccctacacacacccttgagttgatgccaccagattcattcaagtctcgagagtattacattactatggtgaagtgggtatcaaatacgaaaacagtggtgaggtggctgaacagggctcagaacatatcgatccttacagtttgtgagaccactaccggggcctgtagtaaaaagtatgaaatgacaagtgacacttggctctcccagcagaacgaggaacccgtcttctccagggacggctcgaagttcttcatgaccgtgcccgtgaagcagggaggaaggggtgagttccatcatgtagcgatgtttctgatacagagcaaatccgaacagataaccgtgcgtcatctgacatcaggtaactgggaggtaatcaagatcttagcatatgacgagacaactcagaaaatatacttcctgagtacggaaagttctcctagagggcgccagctgtatagtgcttcaaccgaaggattgttgaatcgccagtgtatcagttgcaattttatgaaggaacagtgtacgtacttcgacgcgtcatttagccccatgaatcagcatttcctcttattttgtgagggcccccgcgttcccgtggttagtttgcactcgaccgataatcccgctaagtactttatcttagagagcaactccatgctgaaagaggccattcttaagaaaaagatcggaaagccggaaattaaaattctccatattgatgactacgaattgcctctgcagctttcactgccgaaggacttcatggaccgcaatcagtacgccttactgctcatcatggacgaggagcctggtggccagctggtcaccgataagtttcatatcgactgggattccgtgctgatagatatggacaatgtgattgttgctcgttttgatggacgaggctccggcttccaggggctcaaaatcctacaggagatccatcgccgcctcggtagcgtggaggttaaagatcagatcacggccgtgaaatttctgctgaaactaccttacatagactcgaaaagactaagtatcttcggcaagggatacggcggttatatcgcttccatgatcttaaagtccgacgagaagctgttcaagtgtggcagcgtagtcgctcctatcacggacctgaagctctatgcaagcgctttctctgagcgttacctggggatgccctccaaagaggagagcacgtatcaagccgcaagtgtgctacacaatgtccatggcttgaaggaggaaaatatactaattatccacggcactgccgacactaaggtccattttcaacactcagccgaacttattaaacacctcatcaaagctggggtgaactatacaatgcaagtctatcccgatgagggacataatgtatctgagaagagcaaatatcacctctattccactattctgaagtttttctctgattgtctgaaggaagagatatctgtcctgccccaagagcctgaggaggatgaatag

SEQ ID NO: 185475 - DNA, 294 bp, Artificial Sequence
  Description of Artificial Sequence: Synthetic coding sequence
atgagcgtgatcctgctgacccccgacgagctgaccaacagcagcgaaacaaggctgagcctggaagacctgttccgtaaggacttcgtgctgcacgaccccgaggctagatggatcaacgacacggacgtggtgtacaaatctgagaatggtcacgtcataaaactcaatatcgagactaatgccacaacgttgttgttggagaacaccacctttgtcacctttaaagcctccagacacagcgttagtcctgatctcaaatatgttctccttgcttacgacgttaaacaatag

SEQ ID NO: 185476 - DNA, 1803 bp, Artificial Sequence
  Description of Artificial Sequence: Synthetic coding sequence
ctgagcatcctgatcctgaccagcaacgagctgaccaacagcagcgagaccaggctctctctggaggacctgttcaggaaagactttgtgttgcacgatcccgaagcacggtggatcaacgacacagacgtggtttacaaaagcgaaaacgggcatgtaatcaaacttaatatcgagaccaacgcaactacactgctgctggaaaatactacgtttgttaccttcaaagcttctagacactcagtcagccctgatctgaagtatgttctgctcgcatatgatgtgaaacagatatttcactattcttatactgcatcatacgttatctacaatattcatacgagggaggtctgggaacttaatccacctgaagtggaagactctgtactgcaatacgcagcttggggggtacagggtcagcaacttatttacatctttgaaaacaatatctattatcagcccgacataaaaagctcatctcttcggctgacttctagtgggaaggaagagatcattttcaacggcatcgcagactggctgtacgaggaagaactccttcacagccacattgcccattggtggtctccagacggggaacggctggcgttcctcatgatcaatgacagcctggttccaactatggtcatccctcggtttaccggggccctgtatccgaaaggcaagcagtacccttacccaaaggccggtcaagtgaaccctaccatcaaactctatgttgtgaacttatatgggccgacccatacgctggagttaatgcctccggactcctttaaaagcagagagtactacatcacaatggttaaatgggtgtccaataccaaaaccgtggtgagatggcttaatcgggcacagaacataagcattctgacagtgtgcgaaactactaccggcgcttgcagcaaaaaatacgaaatgacttctgacacctggttgtcccagcagaatgaagaaccagtgtttagcagagacggttcaaaatttttcatgacagtgccggtcaagcagggtggacggggtgaattccaccacgtagcaatgtttttgatacagtctaagagtgagcagattacagtgcgtcatctgacctctgggaactgggaagtgatcaagatattagcttatgatgaaacaacccaaaagatttacttcctgtcaacagagtcatcaccacgcggacggcagctgtactcagcatctacagaagggctattgaaccggcagtgcatctcgtgcaattttatgaaagaacagtgcacatacttcgatgctagcttctcgccaatgaaccagcattttctgctgttttgcgagggtcctagagtgccagtggtatcactgcattctactgataatccagctaagtactttatactagaaagcaactcaatgctgaaagaggctatcctgaaaaaaaaaatcggcaagccagaaatcaagattctgcatattgatgattacgagctgcccctgcaactctcacttcctaaggatttcatggataggaaccagtacgcgctcttgttaattatggacgaagagcccgggggacagctggtcactgacaaattccatattgattgggatagcgtcctcatcgatatggacaacgtcatcgtcgcaaggttcgatggcaggggctctggatttcagggtctaaaaatcctccaggaaatccaccggcggctagggtctgtcgaggtcaaggatcagattacagccgtgaaatttctgctgaaactgccttatatagattctaagcgtctgtcaatttttggcaaatag

SEQ ID NO: 185477 - DNA, 2241 bp, Artificial Sequence
  Description of Artificial Sequence: Synthetic coding sequence
atgagcgtgatcctgctgacccccgacgagctgaccaacagcagcgagactagattatctctagaggatctattcaggaaagattttgtgttacacgatcccgaagccaggtggatcaacgacaccgatgttgtatacaaatccgaaaatgggcacgtgattaagctgaatatcgaaacaaacgctacgaccttattattggagaatacgacttttgtaactttcaaggcatcacgacactctgtgtcaccagacctgaagtatgtgttgctggcctacgatgttaagcaaatttttcattactcatatactgcgagttacgtgatttataatatacacactagggaggtgtgggaactcaatcctcctgaagttgaggactctgtattacagtatgctgcttggggagtccagggccagcagctgatttatatcttcgagaataatatttattatcaacctgatatcaagtcaagctcattgcggctcactagctccggaaaggaggagatcatctttaatggcatcgcagactggctgtacgaagaggaactcctccactcccatatagcccattggtggtcacctgacggagagagattggccttcttaatgatcaacgattctctggttccaaccatggtgattccgaggtttaccggggccttatatcctaagggcaaacagtatccttatcccaaagccggccaggttaatcctacaatcaaactgtatgtcgttaacctgtatggccccacccacaccctcgaactgatgccacctgacagcttcaagtcccgcgagtactatattacaatggtcaagtgggtaagtaacacgaagactgtcgttagatggctaaatcgcgcccagaacattagcatactaaccgtttgcgagactactactggagcatgctccaagaagtatgagatgaccagtgacacttggttgtctcagcaaaatgaggagccagttttctcgcgggacgggagcaaattttttatgacagtgcctgtgaagcagggcggcaggggcgaattccaccatgtggccatgttccttattcagtccaagtcagaacagattaccgtgaggcatctgaccagcgggaactgggaggtaatcaagattctcgcctatgatgaaacaactcaaaaaatttacttcctgtctaccgaatcatcaccacgaggccggcagctgtattccgcctctacagaaggccttcttaatcggcagtgcatttcatgcaattttatgaaagagcagtgcacctatttcgacgcctcttttagcccaatgaatcagcacttcctgctattttgcgaggggcccagagtccccgtggtgagtctccattctacagataaccccgctaagtacttcatactagaatctaattcgatgctcaaagaagctattctgaagaaaaagattggaaagcctgaaataaagattttacacatcgacgactacgaactgcccctgcaactgtctctgcctaaagattttatggatagaaatcagtacgctcttttacttataatggatgaagagccggggggccagctggttaccgacaagttccatattgactgggactctgttctgatcgacatggataacgtgatcgtggctcgattcgatggccggggaagtggattccagggtctgaaaattctgcaggaaatacaccggaggttggggtccgtagaagttaaagaccaaatcaccgcggttaaattcttgttgaaactgccatacatagactcaaagcgcttgtctattttcgggaagggttatggaggttacatcgcctccatgatcttgaaatccgacgaaaagctgttcaagtgcggctccgttgtggccccaattacagatcttaaactatatgcttcagccttttccgagaggtatctgggaatgccaagcaaggaggaaagcacataccaagccgcctcggtgctgcataacgtgcatggcctgaaagaggagaacattttgatcattcacgggactgctgacacaaaggtccacttccagcattccgccgagcttatcaagcacctcataaaggccggcgtgaactacactatgcaggtgtaccccgatgagggtcataacgtctccgaaaaatcaaagtaccatttgtattctacaatactcaagttcttcagtgactgcctgaaggaggaaatttccgtgctgccgcaagaacccgaagaagacgagtag

SEQ ID NO: 185478 - DNA, 954 bp, Artificial Sequence
  Description of Artificial Sequence: Synthetic coding sequence
atggccgacacccagtacatcctgcccaacgacatcggcgtgagcagcttggattgcagggaagctttccggctgctcagcccaacagagcggctctatgcctaccatctgtctcgcgctgcatggtacggtgggttagccgtcctcctccaaacatcgcccgaggcaccctacatttacgccctattatctcgcctcttcagggcccaggacccagaccagttaagacagcatgctttggcagaagggctcacagaagaagagtaccaggccttcttggtgtatgcggcgggggtttattcaaacatgggcaactacaagagcttcggagatacaaagtttgtgcccaaccttccaaaagaaaagctggagagggtgattctggggtcagaggcagcacaacagcatccagaggaggtccgtgggttatggcaaacctgtggggaactcatgttctctctggagcccagactcagacatctcggactgggaaaggaaggaatcactacgtatttctctgggaattgcaccatggaagacgctcgcgtgcgactcgatcgtagcaagatacgttcagtgggcaagcccgccttggaaagatttttaaggagactgcaggtcctaaagagcactggggatgtggccggaggccgtgccctgtacgaagggtacgccaccgttacagacgctcctccagagtgtttcctcacacttagagacacagtcctgctccggaaggaatccagaaaactcatagtccagcccaacaccaggctcgagggctccgacgtgcagctgctggaatacgaagcttccgccgccggtctcattcggtctttcagtgaaagattccccgaagatgggccggagctggaagaaatcctgacacagttagctactgccgacgccagattctggaagggaccgtccgaagctccatctggacaggcttag

SEQ ID NO: 185479 - DNA, 2214 bp, Artificial Sequence
  Description of Artificial Sequence: Synthetic coding sequence
atggccgacacccagtacatcctgcccaacgacatcggcgtgagctctctggactgccgggaggcctttcgtctgcttagtcctacggagagactgtatgcttaccacttgagcagagccgcgtggtatggcggtcttgctgtgttactgcagacgtcccctgaggcaccctatatttatgcccttctgtctcgcctgtttagagcccaagaccccgatcagctgcgccagcacgctctggctgagggacttaccgaggaggagtaccaggccttcttagtttatgctgccggggtctattccaacatggggaattataagtcattcggagacactaaatttgtgcccaacctacccaaggagaaactggaacgggttatcttagggagtgaggcggcccagcaacatcctgaggaggtccgcggattgtggcagacttgtggcgagcttatgttcagcttggagccacggctgaggcacttaggtctgggcaaggaaggtatcactacatacttttccggaaattgtacaatggaagatgcaaaacttgcccaagactttctggatagccagaacctctctgcttacaataccaggctttttaaggaggtggatggcgagggtaaaccttactacgaagtgcgactcgccagtgtgctgggcagcgagccctcgctcgactccgaggttacctcaaaactgaaatcctatgaatttaggggctctccttttcaggtgacgcggggggattacgcccctatactccagaaggttgtcgaacagcttgaaaaggccaaagcctatgccgccaattcccaccagggccagatgctcgcacaatacatcgagtcattcactcagggttcaatagaggcacacaagcgcggatccagattctggatacaggacaaagggcctattgtagagtcatatatcgggttcattgaatcctacagagacccgtttggctcccggggagagtttgagggattcgtcgctgtggtcaataaggctatgtctgctaaattcgaacgtctggtagcatctgccgagcaactgctaaaggagctgccctggcctccgaccttcgaaaaggacaagttcctcaccccagactttacatctttagatgtactcacgttcgccggctccggaatacctgccggtatcaacataccaaactatgatgatctgagacagacagaagggttcaaaaatgtgagcttggggaacgtcctcgccgtggcgtatgcaacccagcgcgagaagttaacattccttgaagaagacgataaagatctgtacatcctttggaagggaccgagttttgacgttcaggtgggcctccacgagctgttaggccacggttcggggaagctcttcgttcaggacgagaagggagcctttaactttgaccaggagactgtgatcaatccagaaaccggtgaacagatccagagttggtatcgctcaggcgagacctgggacagcaaattcagtaccatcgcatcttcatacgaggaatgtagagcagaaagcgttggcctttatttgtgcctacatcctcaggtgttggaaatatttggcttcgaaggagccgatgcagaagatgtcatttacgtgaattggttaaacatggtcagagccgggctgttggctttggaattctacacccccgaagcatttaattggcgccaggcacatatgcaagcacggtttgtgattcttcgagttctgttggaggccggtgagggtctcgtcacaattacccccactacagggtccgatggaagacccgacgcacgggtgagactggaccggtccaagattcgctctgtcggaaaaccagccttggaacgcttcctgcggcggctccaggtactcaaaagcactggggatgttgccggaggcagagcactctacgagggatacgcaacagtgacggatgcccctccagagtgcttccttacacttcgggatacagttctactgaggaaagaaagtcgaaaactgatcgtgcagcccaacacccgacttgaggggagcgatgtacagctgctggaatatgaggcgtccgcagcagggttaatacggtcatttagcgaacggttccctgaggacggaccggaacttgaggaaatattgacccagctggcgaccgccgacgcccgcttctggaaggggccaagtgaggccccgagcggacaggcctag

SEQ ID NO: 185480 - DNA, 2214 bp, Artificial Sequence
  Description of Artificial Sequence: Synthetic coding sequence
atggccgacacccagtacatcctgcccaacgacatcggcgtgagctcactggattgtagggaggcatttagactgctgtctcctacagaaagactgtatgcatatcatctgtcgcgcgccgcctggtacggcggcctcgcagtgctgttacagacaagtcctgaggccccatatatttatgcccttttaagccgcctgtttagagcacaagaccccgaccagctcagacagcacgcccttgctgagggattgaccgaagaagagtatcaggcattcttggtttacgcggcgggggtttattctaatatggggaactataaaagtttcggcgacactaagtttgtacccaacctgcccaaggagaagctagagcgagtgattctcggatcagaagccgcgcagcagcatccggaagaggttcgggggctgtggcaaacgtgcggcgagctcatgttcagcctggagcccaggttacggcacctcgggctcggaaaggagggaataaccacttatttttcagggaactgcactatggaagacgctaaactggcccaggacttcttagattcccaaaacctgtccgcatacaatactaggctgtttaaggaagtagacggggagggtaaaccctattatgaagtgagattggcgtctgtgctgggatccgaaccttccctggactctgaggtgaccagcaagctcaaaagctatgagttccggggtagcccttttcaagtcacacgtggggactacgcccccattctgcaaaaggtagtggaacagctggagaaggcgaaggcctacgcggcgaatagtcatcagggacagatgttagcccagtatatcgagagttttactcaggggtccatcgaggcacataagcgaggaagtcgcttttggatacaggataagggacctatcgttgaaagctacattgggtttatcgaatcttatcgggaccctttcggcagcagaggcgagttcgagggtttcgtcgcagtggttaataaggcgatgagcgctaaatttgaacgtctggtcgccagtgccgagcagctgctaaaggagctgccatggccgcccacctttgagaaggacaagtttttgactccggacttcacttccctggacgtgttgacattcgccggcagtgggatcccagccggtattaatattcccaactacgatgacttacgccaaactgaaggctttaagaatgtgtcgctcggaaacgtgctagctgtcgcgtacgcaacgcagcgcgagaaacttacctttttagaagaggatgataaagatctgtacattctatggaagggaccctcatttgatgtccaggtggggctgcatgaactgttgggccatggatccggaaagctttttgtgcaggatgagaaaggcgcattcaacttcgatcaggagactgtcattaaccccgagacgggagagcagattcagagctggtaccggagtggcgaaacctgggatagtaagttctccacaattgccagttcctacgaggaatgtagggctgagagcgtgggtctatacctctgtctccaccctcaggtcttagaaatcttcggcttcgagggagctgatgcagaggacgtcatctatgtgaattggctcaatatggtgcgggccggactgctcgccttggagttttacacacctgaggcctttaattggagacaggctcacatgcaggcccgtttcgtgatcctgcgtgtgctgctggaagctggcgaaggtctggtgactatcacccccactaccggatcggatggaaggccagacgccagggtacgtctcgataggagcaagatccgttccgtgggaaagccggctcttgaacggtttctgcggcgactgcaggtcctgaaatccaccggcgacgttgccgggggccgagctttatatgagggctatgctacagtaaccgatgccccacccgagtgcttcctcacccttcgagatactgtgcttcttaggaaggaatctcgcaaattaattgtacagcccaatactcgtctggaaggatccgacgttcagttacttgaatacgaagcaagtgcagccggcctcattcggagcttctcagagcggtttccagaagacggccccgagctggaagaaatcctgacacagctagccaccgctgacgctcgcttctggaagggcccgagtgaagcaccttctggccaggcttag

SEQ ID NO: 185481 - DNA, 273 bp, Artificial Sequence
  Description of Artificial Sequence: Synthetic coding sequence
atggccgacacccagtacatcctgcccaacgacatcggcgtgagctcccttgattgccgggaggcatttcgattgctgtctccaacggaacggctgtatgcctaccatctgtccagggccgcctggtatggtggactcgccgtacttttacagaccagcccagaggcaccatacatatatgccttgctgtcgcgcctgttccgtgctcaggaccctgatcaactgcgccaacacgccctggccgaaggcctcactgaggaagaataccagtag

SEQ ID NO: 185482 - DNA, 606 bp, Artificial Sequence
  Description of Artificial Sequence: Synthetic coding sequence
atggccgacacccagtacatcctgcccaacgacatcggcgtgagctcactggactgtcgcgaggccttcaggctgctctctcccacagagaggctatacgcttatcacctctctcgggccgcgtggtacgggggcttggctgtacttctgcagacctcccccgaggccccatatatctacgccctcctgagcagactttttagagctcaggatcctgatcagctgcgccagcatgctctggcggaggggctcaccgaagaggaataccaggcttttctggtctacgctgcgggtgtctatagtaacatggggaattataaatccttcggagataccaagttcgtaccaaacctgcctaaagaaaaacttgaacgcgttattctggggagcgaggccgctcagcagcaccccgaagaggtgagaggcctttggcagacttgcggcgagctgatgttcagcctcgagccccgcctgcgacacctgggactgggcaaagaaggaattactacgtatttcagcggcaattgcaccatggaagacgccaagttggcccaggattttctggattcacaaaatctgtccgcttataacacgcgcctgttttag

SEQ ID NO: 185483 - DNA, 2274 bp, Artificial Sequence
  Description of Artificial Sequence: Synthetic coding sequence
atgggcgagcccgaggccggcagcgagttcgccaacggcgccgccgcagccgccggacccatggccgatactcagtatattctgcctaatgatatcggggtgtcatcgctggattgccgggaagcttttcggctgctcagccctaccgaacggctttatgcttatcatctgtcccgcgccgcatggtacgggggccttgcagttctcctgcagacctctcccgaggccccctatatctatgccttgttaagcagactctttagggctcaggacccagaccagctgcggcagcatgctttggccgagggcctgacagaagaagagtatcaggccttcttagtctacgcggccggagtgtattctaatatggggaactataaatcttttggagacaccaaatttgtcccaaacttgcctaaggaaaaactggaacgcgtaatcctgggttcagaggcagcccaacagcatcctgaggaagtccgaggactgtggcagacctgtggcgaactgatgttcagtctagagcccagactgcgacacttgggcctcgggaaggagggtatcactacttactttagcggtaactgtactatggaggatgcaaagctggcgcaagacttcctggactctcagaatttgagcgcctataacactagactctttaaggaggtggatggagaggggaagccttattacgaggttagacttgccagtgttctgggaagcgagcctagcttagatagcgaggtaacctcaaaactcaagagctatgagttccgagggtcaccgtttcaagtaactaggggcgactatgcgcccatcctgcaaaaagtcgttgaacaattagagaaggccaaggcctacgccgcaaactcacaccaaggacagatgctagcccagtacatcgagtcttttacacagggatctatagaagcccacaaaaggggaagtcggttttggattcaggacaagggccctatcgtggagagctacatcggctttattgagagttacagggatccctttgggtccaggggcgagttcgaggggtttgtggccgtcgtgaataaggctatgagcgcaaagttcgagcgtctggtggctagtgcagagcagctgctcaaagaactcccttggcctccgaccttcgaaaaggataaattcctgactccggacttcacctcacttgacgttctgacatttgcaggttccggaatccccgctggcattaacatacctaattacgacgacctgaggcagactgaaggcttcaaaaatgtttctttaggaaatgtgctggctgtcgcttacgccactcagagagaaaaacttactttcctcgaggaagacgataaggatctgtatattctgtggaagggcccttcctttgatgttcaagtcggcctgcatgaactgctgggccatggttcgggaaaactatttgtgcaggatgaaaaaggcgcatttaatttcgatcaggagaccgttatcaaccccgagaccggcgagcaaatccagtcctggtatcgcagcggcgagacatgggattcgaagttttctactatcgcgtcttcatacgaagaatgtagagccgagtcggttggactttacctttgcctgcacccacaggttcttgaaattttcggttttgaaggagcagacgctgaggatgtcatctacgtaaattggctcaatatggtaagagccggcctgctggctctggagttctacacaccagaagcatttaactggcgacaggctcacatgcaggctaggttcgtgattctgagggtcctgttggaggcaggcgaagggttggtgactattaccccaacgaccggctccgacgggaggcctgacgcacgggtccgcctggatcgcagtaagattcgaagtgtcggcaaaccggcgctggaacgtttcctgcgaagactgcaggtcctgaagtccacaggcgatgttgctggtggcagggctctatatgaaggctacgcaacagtcacagacgccccccccgagtgcttccttacccttcgcgacacggtgctcctgcgaaaagagtcaaggaagctgatcgttcaacctaacacgcgccttgagggcagcgacgtgcagctcctggaatacgaggcgagcgctgctgggttgattagatccttttcggaacggttcccagaggatgggcctgagttggaagaaatcctgacacagcttgcaactgcggacgctcggttctggaagggtcctagcgaggcccctagtggtcaggcttag

SEQ ID NO: 185484 - DNA, 2271 bp, Artificial Sequence
  Description of Artificial Sequence: Synthetic coding sequence
atgggcgagcccgaggccggcagcgagttcgccaacggcgccgccgcggcaggccctatggccgatactcagtatatcttgcctaatgacatcggtgttagctctttggactgtcgggaggcctttaggctcctctcaccaaccgagcggctgtacgcctaccacctttcccgcgcagcatggtatgggggcctggccgtgttgctacaaacctcacctgaagctccatatatttacgctcttctgtcacggttgtttcgcgcccaggaccccgatcagcttcgacaacacgccctggcagaagggctcaccgaagaagagtatcaggcattcctggtctacgcagctggagtctactccaacatggggaattacaaatccttcggcgacaccaaattcgtccccaatctgcccaaagagaaactcgaaagggtcatccttgggtccgaagcagcccagcagcacccagaggaggtgagagggctgtggcagacatgcggggaactaatgttcagccttgaaccccgtctgcgccatctggggctgggtaaggaaggtattactacctatttttccgggaattgtactatggaggacgccaagctcgcacaagatttcctggactcccagaatttgtcagcgtacaatacaaggctgttcaaggaggtcgacggcgaaggcaaaccttactacgaagttcgtctagcttccgtcttggggtccgaaccaagcttggattctgaagtgacctccaagctgaaatcttatgagtttcggggctctccgtttcaagtaactcggggcgattatgccccaattctccagaaggtggtggagcaattagagaaagctaaagcttatgctgcgaactcccaccaaggacagatgctggctcagtatattgaaagctttactcagggctccatcgaggcacataagaggggatctagattttggattcaggataaggggccaattgtggagtcgtacataggattcatcgaaagttatagagaccccttcggcagtaggggggaatttgagggtttcgtcgcggtggtgaataaagcaatgtctgctaaattcgagcgcctggtggcttcggctgagcagctgctgaaggagcttccctggccccccaccttcgagaaggataagtttttaacaccagattttacaagcttagacgtgcttacattcgcagggtccggtatacccgcaggcatcaatataccgaactacgatgacctcagacagacagagggatttaagaatgtgtccctcggcaacgtcctagctgtggcctacgccacgcagagagagaaactaacatttctcgaagaagacgacaaagacctgtatatcctctggaagggaccaagctttgatgtacaggtaggcctgcatgagctactgggacatggtagtggaaaactttttgtgcaagatgaaaaaggcgcgtttaacttcgaccaggaaaccgtcatcaacccggagacaggtgaacaaatccaaagttggtaccgttctggagaaacttgggatagcaagttctccaccatcgcaagttcatatgaagagtgtcgggcggagagtgttggattgtatctgtgcctacatcctcaggttctggaaatatttggcttcgaaggcgccgacgccgaggatgtcatatacgtcaattggctgaatatggtccgtgccggactcttagcattagagttctatacgcccgaagctttcaattggcgccaggcgcatatgcaagcccgtttcgtgattctacgtgttctgctggaggctggcgaaggactggtgacaataaccccaactaccgggagcgacggacgtcccgatgcacgggtgcgccttgacaggagcaaaatcaggtctgtggggaagcctgcattggagcgctttctacggagattgcaagtgctgaagagtactggcgacgtggctggtggcagagccctttacgaaggttacgccaccgtgactgacgccccccctgaatgctttctgacactgcgtgatactgtgttgctgagaaaagaaagccgaaaactgatcgtgcagcccaacactcgcctagaggggtctgacgtgcaactcctagaatacgaggctagcgcagcgggtctgatccggagtttctcagaaagatttcccgaagacgggcccgaactggaggaaatcctcacacaactcgctactgctgacgcaaggttttggaaaggcccttcagaggccccctctggacaagcgtag

SEQ ID NO: 185485 - DNA, 2214 bp, Artificial Sequence
  Description of Artificial Sequence: Synthetic coding sequence
atggccgacacccagtacatcctgcccaacgacatcggcgtgagcagcctggactgccgcgaagcatttcgcttgttgtccccaacagagcgcctgtatgcctaccatctgagtcgagcagcgtggtatggcggtctggcggtgctgctccaaacctcccctgaagctccctatatctatgccttgctcagcagactgttccgcgctcaggacccagatcagcttcgtcaacacgctctggccgaaggcctgaccgaggaagagtatcaggcctttctggtctacgcagccggagtgtatagcaacatggggaattacaaatccttcggcgacacaaaatttgtgcctaatctgccgaaagaaaagcttgagcgggtgatactgggaagtgaagctgcacagcaacacccagaagaagtccggggcttgtggcagacctgcggagaacttatgttctccctggagccaagactgaggcacttgggccttggtaaagaaggtattacaacttatttcagtgggaactgcaccatggaggacgctaagttggctcaagacttcttagattctcaaaatctttcagcctacaacaccaggctcttcaaggaggtcgacggcgaagggaagccgtattacgaggtgagactcgcgtcagtactcgggtccgagccttcgttagactctgaggtaacatcgaaactgaagtcatatgagttcagagggtcaccgtttcaggtgacgcggggagactatgcccccatactgcaaaaagtggtagagcagttagagaaggccaaggcttatgcagccaattcgcatcaggggcaaatgcttgcccagtatatcgagtctttcacccaggggtcaatagaggcacacaaacgaggctcaagattttggatccaggataagggtccaatagtggagtcctatattggatttatcgagtcgtatcgcgatccatttggttctcgaggagagtttgaggggttcgttgctgtagtcaacaaggctatgtctgccaagtttgaaagactagtggcttcagctgaacagctcttaaaggaactgccttggccccctacgttcgagaaagacaaatttttgacaccggactttacatccttagacgtactgacattcgcgggatcggggatccccgctgggattaatatccccaattacgatgatctgagacagactgaaggcttcaaaaatgtgagcctagggaacgttttggccgttgcatacgcaacccagcgagaaaagctcacgtttttggaggaagacgacaaagacttgtacattctgtggaaagggccctccttcgatgtccaggtgggattacatgaactactgggacatggtagcgggaagttgttcgtccaggatgaaaaaggggcttttaatttcgatcaggagactgtgattaaccccgaaactggtgagcagattcagagctggtaccggtccggcgagacctgggacagcaaattttcaacgatagcttcctcttacgaagagtgtagggctgagagcgtcgggctatatctgtgtttgcatccacaggtcctcgagatattcggcttcgaaggggctgatgcagaagatgtgatctatgtgaactggttaaacatggtccgggcagggctactggctctcgaattctacacccccgaagcatttaactggaggcaggctcatatgcaggctcggttcgtcattttgagagtgctgctggaggccggtgagggtttagttaccatcacacctacaaccgggtctgatgggcgaccggacgcaagagttcggctggatcggagcaagattagatccgtgggtaagccagcgctggagagatttctccgaagattacaagtgctgaagtccaccggcgatgtagctgggggtcgggccctgtatgagggctatgccacagtgacagacgcaccccctgagtgcttcttaacgctgcgcgatactgtgttgctgcgcaaagagtcccgtaaactcatcgtccagcctaacacaagactggagggcagtgacgtgcagctccttgagtatgaagcctccgccgcgggcctgatcagaagctttagtgaacgattcccagaagacggccctgagcttgaggagattctgacccagctcgcaacagcggacgcccggttctggaaaggcccatccgaagcaccaagcggacaggcatag

SEQ ID NO: 185486 - DNA, 1908 bp, Artificial Sequence
  Description of Artificial Sequence: Synthetic coding sequence
atgggcaactacaagagcttcggcgacaccaagttcgtgcccaacctgccaaaagagaaattggaacgcgtgatactgggctctgaagccgcccagcagcatcccgaagaggtgcgggggctgtggcagacatgcggcgaactgatgttctctttagagccaaggcttaggcaccttggcttgggcaaggaggggattactacatattttagcggaaattgcaccatggaggatgccaagcttgcacaggacttcctggatagccagaatctatcggcctataatactcggctgtttaaggaagtcgatggggaagggaagccatactatgaagtgcgcctcgcgtcagtgctggggagtgagccctcccttgacagcgaagttacaagcaaactcaagagctacgagttcagaggatcaccctttcaggtcacccggggcgactacgcgcccattctgcagaaggtagtggagcagctcgaaaaggccaaggcatatgccgctaacagtcaccagggacagatgctcgcccagtatattgagtctttcacgcagggaagcatcgaagcacacaaacgaggatcaagattctggattcaggacaagggtcctattgtggaaagctacattggcttcatcgagagttatcgagaccccttcggtagcaggggagagtttgaagggttcgtggcggtggtaaacaaagcaatgtccgcaaaatttgagcgactggtggcttctgctgaacaactgctcaaagaactaccatggccacctacctttgagaaggacaaattcctcactccggatttcactagcctcgacgttttgacgttcgctggctcaggcatcccggcaggaattaacatccccaactatgacgacctaaggcagaccgaggggttcaaaaatgtgtctctaggcaatgtgctggcagtggcctatgctacacagagagaaaaactgacttttttggaggaggacgacaaagacctatacatactatggaagggtccttcattcgacgttcaggtggggttgcatgagcttttaggacacggctctggcaaactatttgtccaggatgaaaagggggctttcaacttcgatcaggaaacagtgattaacccagagaccggtgagcagatccagagctggtaccgcagtggcgagacatgggactccaagttttccacgattgccagctcctatgaggaatgcagagctgaatccgtaggtctttatctctgtctgcaccctcaagtgctggaaatatttgggttcgagggggcggatgcagaggacgttatctacgtgaactggctgaacatggtgagggcggggctattggcactggaattctacacacctgaggccttcaactggcggcaggctcacatgcaggctcgatttgttatactgcgagtgctgctcgaggccggtgaggggctggtgactattacccccacaacagggagtgatggtcgcccagacgcccgcgtgaggttggatagatcaaaaatcaggagtgtcgggaagccggccctggagagattcttacgccggctgcaggttctgaaatccacgggggatgtcgcaggagggagggccctgtacgagggctatgcaaccgtgactgatgctccccctgagtgtttccttacgctgagagacaccgtactgctgaggaaggagtcaagaaaacttatcgttcagccaaataccagacttgagggtagcgatgtccagctattagaatacgaagctagtgccgcaggtctcatacggtccttcagcgaaaggttcccagaagacggccccgagctagaggaaatcttgacacagctggcaacagcagacgcgagattttggaaaggcccatcagaagccccttcaggacaggcctag

SEQ ID NO: 185487 - DNA, 2412 bp, Artificial Sequence
  Description of Artificial Sequence: Synthetic coding sequence
atgaccaccgccaaggagcccagcgccagcggcaagagcgtgcagcaacaagaacaagagctggtgggctcaaatccaccacagcgcaactggaaagggattgccatagccctactggtgattctcgtcatctgcagcctgattgttacttccgtcatcttgctaacgcctgccgaggacaatagcctaagccaaaaaaagaaggtcacggtggaggacttgttttctgaggatttcaaaattcacgatccagaagcaaaatggatctcagatacagaatttatctatcgagaacaaaaagggaccgtgaggctgtggaacgttgagacgaacaccagtactgtactaatcgaaggcaagaaaattgaaagtctccgggctatccgctacgaaatcagccctgacagagagtatgctttgtttagctacaacgtcgagccgatttaccagcactcttacaccggctactatgtcctcagcaagataccgcatggagatccacagagtcttgaccctccagaggtgagtaacgcaaagctgcagtacgctggctggggcccaaaaggacagcagcttatttttatattcgaaaacaacatctattactgtgcccatgtgggaaaacaggccattcgtgtcgttagtactggcaaggaaggagtaatttacaacggcttgagcgactggttatacgaggaggaaattctgaaaacccatatcgcccactggtggtcccccgacgggacccggcttgcttatgctgcaattaacgattctcgcgttcctatcatggagctgcctacctatacgggatcaatctacccaacagtcaagccgtatcactaccctaaggcgggcagcgagaatccctccatttcactgcatgtaattgggctgaacggtccaacccacgatctagagatgatgccccctgatgatcccaggatgcgagagtattacattacaatggtaaagtgggcgacttccacaaaagtggcagtcacgtggcttaaccgggcacaaaatgttagcatactgaccctgtgtgacgccacaactggagtttgtactaagaaacacgaagacgaaagcgaggcgtggcttcacagacaaaacgaagaaccagtcttttccaaggacgggagaaaatttttcttcataagggccatccctcaaggaggcagagggaaattctaccacatcaccgtcagttcatcgcagccaaactctagcaatgacaacatccagagcattacgtcaggcgactgggatgtgacaaagattcttgcatacgacgagaagggcaacaaaatctattttctgtcaaccgaggatctgccccgcaggagacagctgtacagcgccaataccgtgggaaacttcaacagacagtgtctgtcgtgcgatctggtggagaattgtacctattttagcgcgtcgtttagccattcgatggactttttcctgctcaagtgcgagggtccaggagtccccatggtcaccgtgcacaatactacggacaagaaaaaaatgtttgacctggaaaccaacgagcacgtaaaaaaagctataaacgacagacagatgcctaaggtcgaataccgggatattgaaatcgatgattataacctaccaatgcaaatcttaaaaccagccacttttaccgacacaactcactaccccctgctgcttgtggttgatggcacccccgggtcacagtctgtcgctgaaaagttcgaggtatcatgggaaacagtcatggtgtccagccacggcgcggtggtggtaaagtgtgacgggcgtgggagtggatttcagggcacaaaactgcttcacgaagtcagacggcgcctcgggctgctcgaagaaaaagaccaaatggaggctgtcagaactatgttgaaagagcagtatatcgaccgcacacgcgttgcagtgtttggcaaagattacggcggttatttatccacatatattttgccggctaaaggtgagaaccagggacagacttttacttgcgggagcgctctgtcaccaatcaccgattttaagctatatgcctctgccttcagcgagaggtatctgggcctgcacgggctcgataatcgtgcctacgaaatgacaaaagtggcccacagagtttctgctttggaagagcagcagtttctgattattcacccgactgccgacgaaaagatccacttccagcacaccgccgagctgattacccagctcattcggggtaaggctaattactctctccagatatacccagacgaaagtcattacttcaccagctcaagcctgaagcagcacctgtacagatcaatcattaatttttttgtcgagtgcttcagaatccaggataagctgctcaccgttacagccaaagaggatgaggaggaggactag

SEQ ID NO: 185488 - DNA, 2598 bp, Artificial Sequence
  Description of Artificial Sequence: Synthetic coding sequence
atggccagcctgtaccagcggttcaccggcaagatcaacaccagccgaagctttcctgccccccccgaggcaagccatctgctaggtggccaaggacccgaggaagacggaggcgctggggccaaaccactgggccctcgcgcacaggcagccgcaccccgagaaaggggcggcggcggcggcggcgcaggagggcgccctaggtttcaataccaggccaggtcagacggcgatgaagaggatgagttagtgggctcaaaccctccccagaggaattggaagggtatcgccatcgcattgttggtaatcctagtcatctgtagcctaatcgtaacatctgtgatcttgctgacacccgcagaggacaatagtctttctcaaaagaagaaggtcacagtagaagacctgttttctgaagattttaaaattcacgacccagaggcgaagtggatctccgatactgagtttatctaccgagagcagaaaggaacggttagattgtggaatgtggagaccaatacctccacggtactcattgagggtaagaaaatcgaatccctgcgcgctatccggtacgagattagcccagatagagaatatgcactgttttcctacaacgtggagcctatttaccaacattcttacacagggtattacgtgttatcaaaaatccctcatggggatcctcagtccctggacccacctgaagtgagcaacgccaaactccagtacgccgggtggggccccaaaggccagcaactaatcttcatcttcgagaataacatatactactgcgcccacgttggtaaacaggccatccgtgtggtgtccacgggtaaagagggtgtcatttacaacggattgtccgactggctctatgaagaggagattcttaagacacacatcgcccactggtggtctccagacgggacgcgactggcctatgctgccatcaatgatagccgggtgccgattatggagttacctacatatacgggctcaatatatccaactgtgaagccatatcactaccccaaggctggttccgagaacccaagcataagcttgcacgtgatcgggctgaatggcccaacacatgacctcgaaatgatgccccccgatgatccccggatgcgtgagtattacattacaatggtgaagtgggcgacatccaccaaagttgctgtgacctggctgaacagagcccaaaatgtttccattttaacattgtgtgacgccacaaccggcgtgtgcacaaagaaacatgaagacgaatctgaagcctggctccaccgtcagaacgaagaaccggttttttctaaagacggacgaaaattcttcttcattcgagccattccccagggcggaagagggaagttctatcatatcactgtgagtagctcgcagcccaacagttccaatgacaacatccagagcataacttcaggcgactgggacgtgaccaaaatcctggcctacgacgagaaaggcaataaaatctatttcctgtctactgaggacttaccaaggcgccgacaactttattccgctaacacagtcggaaactttaacaggcaatgtctgtcatgcgacttagttgaaaactgcacttacttctcagcctctttctctcattcaatggatttttttctcctgaagtgtgagggccccggtgtccctatggtgaccgtgcacaacaccacagataagaaaaagatgtttgaccttgagacaaatgaacacgttaaaaaggccattaacgatagacagatgcccaaagtggagtatcgagacattgagatcgatgattataatttgccgatgcagatactgaagcccgctactttcactgataccacccactatccactgctgctggttgtggatgggacgccggggagccagagtgtggccgaaaagttcgaggtttcctgggagacggtcatggtttcgtcacacggcgctgtcgtcgtcaagtgcgatggccgcggatcagggttccagggaactaaactcttacatgaggtgcgacgaagactggggctcctggaagagaaagaccaaatggaggccgtgcgcactatgttgaaagagcagtacatcgataggacgcgggtggccgttttcgggaaagattacggcgggtatctcagtacctacatcttacctgccaagggagagaaccaggggcaaaccttcacatgcggctccgcgctttcaccgataactgactttaagctgtacgcaagtgctttctcagaacggtatttagggctacatggcctcgacaaccgcgcctacgagatgaccaaggtagcgcatagggtctctgccttggaagagcaacagttcctgatcatccatcccaccgcggacgagaagatacacttccagcacacggccgagctgatcacccaattgatcagaggaaaggcaaattattccttacagatttaccctgatgaatcccattattttaccagttcaagtttaaagcagcacctgtacaggagtatcatcaatttttttgtggaatgctttcgtatccaggacaaactgcttaccgtgaccgccaaagaagacgaggaggaggattag

SEQ ID NO: 185489 - DNA, 2406 bp, Artificial Sequence
  Description of Artificial Sequence: Synthetic coding sequence
atgaaggagaaggccatgatcaagaccgccaagatgcagggcaacgtgatggagttagtcggcagtaatcccccacagaggaactggaaaggcattgcaatcgccctcctcgtcatcctggtcatctgttcattgattgtgacatccgtaattttactgaccccggctgaagacaacagcttgagtcagaagaagaaagttacggtcgaggatctgtttagcgaggacttcaagatccacgaccctgaagcaaagtggatctccgacacagagttcatctatagagagcagaagggtacggttaggttatggaacgtagaaacaaacacgagtacagtcctgatagagggtaagaagatcgagtccctccgggctattcgatatgagatatctcccgatcgggaatacgcactgttctcctacaacgtcgagcctatttaccagcacagttatacaggctattacgtgctgtcaaagattcctcacggggacccacagtctcttgacccgccagaggtgtccaacgctaagctccaatatgctggctggggccccaagggccagcagctgatcttcattttcgagaacaatatttactactgcgcacatgtcggtaaacaagccattcgagttgtgtccacgggtaaggagggagtgatctacaacggactgagcgactggctctacgaagaagagatacttaaaacccacatcgcacattggtggtctcctgacggaacacgcctggcctatgcagctataaacgattcaagagtgcccataatggaactgccaacatacactggcagcatctacccaactgtaaagccttaccattaccccaaagccgggtctgagaaccccagtattagtttacacgtgattgggctgaacgggcccacacatgatctggagatgatgccaccagacgacccgcgcatgcgggagtactacatcacgatggtaaagtgggcgacatccacaaaagtcgccgtgacatggttaaacagggcacagaatgtgagcatcctgaccctctgtgacgccactactggcgtgtgcaccaagaagcatgaggacgagtctgaggcatggttgcatcgccaaaatgaagaaccagtgttctcaaaggacgggcgaaagtttttttttatccgggcaattcctcagggtggtcgtggaaaattctatcacatcaccgtgtcaagtagtcagcccaattcttctaatgacaatattcagtctatcaccagtggcgattgggacgtgaccaagatcctggcctacgacgagaaaggcaacaagatctacttccttagcacagaggacctgcctcgtagaagacaattgtatagtgcaaacaccgtcggaaacttcaacagacaatgtctttcttgcgacttggttgagaattgcacctactttagcgcctctttctctcactcaatggatttcttcttgctaaagtgcgaagggccgggtgtacctatggtcactgtccacaacactactgataagaagaagatgttcgatctcgaaacaaatgaacacgtcaagaaggcaatcaacgacagacagatgcccaaagttgagtacagagacatcgagatcgacgactacaacctcccgatgcagatccttaaaccagccacatttactgataccacacattatcccttgctcctggtagtggatggcacccccggaagccagagtgtcgccgaaaaatttgaggtttcatgggagacagtcatggtctcctctcatggggccgtcgtggtcaagtgtgatgggcggggcagcggcttccaagggaccaaactgttgcacgaggtcagaaggcgacttggcttactggaagagaaagatcagatggaagcggtgagaacaatgttaaaggaacagtatatcgaccgaacgagagttgcagtgtttgggaaggattatgggggttatttgtccacctacatccttccagccaagggagaaaaccaaggtcagacattcacctgcggatccgccctgagtccaatcaccgacttcaaactgtatgcgtcagcattttcagaacgctacttgggcttacacggcctggacaaccgggcttatgagatgacgaaagtggcccatcgggtctcggctctggaagaacagcagtttctgattatacatcctacagccgatgagaagatccacttccagcacacagctgagctgatcacacaacttattaggggcaaggcaaattactcgctgcagatataccctgacgagtcacactatttcacatcctcttctttgaaacaacatttatatcggtcaatcattaattttttcgtggaatgcttccggatccaggataaattactcacagtgaccgccaaggaggatgaggaggaggactag

SEQ ID NO: 185490 - DNA, 2277 bp, Artificial Sequence
  Description of Artificial Sequence: Synthetic coding sequence
atgaccaccgccaaggagcccagcgccagcggcaagagcgtgcagcagcaggagcaagagctggttgggtctaacccgccgcaacgcaactggaaggggatcgccatcgccttgttggtgatactagtgatatgttcgctgatcgtgaccagtgtcattctgttgactccagcggaggacaacagtctttcccaaaagaagaaggtgaccgtggaggacctcttttcggaggactttaagatccatgaccccgaagccaagtggattagtgatacagaatttatttacagggagcagaagggaactgtgcgattgtggaacgttgagacgaataccagcaccgtcctaattgagggcaagaagattgagtctctccgagccatacggtatgaaatctcaccagacagagaatacgccctgttttcctataatgtggaacctatcttcatctttgaaaataatatttactattgtgctcatgtggggaaacaggcgattcgtgtggtctccaccggcaaggagggggttatctataacgggttgtcagattggctctatgaggaagaaatcttaaaaacgcacatcgcccattggtggagcccagacggcactcggctggcatatgcggccataaatgattctagagttcctatcatggagttgccaacctacaccgggtctatctatccaacagtcaagccttaccactaccctaaagcgggatctgaaaatccatctatttcgttgcatgtgatcggtctgaatgggcccacacacgatctggaaatgatgccaccggatgacccgagaatgcgggaatattacatcaccatggtaaaatgggcaacatccaccaaagttgcggtgacgtggttgaatcgggcccagaatgtcagcatacttaccttgtgtgatgcgacgactggagtgtgcacaaaaaagcatgaagacgagagtgaagcctggctgcacagacagaacgaggaacctgtgttttccaaagacggacgaaaattcttctttatccgagctataccacagggaggtcgtgggaaattctatcacattaccgtgtcctcatcacaaccaaactccagcaatgataatatccaatcgattacctcaggggattgggacgtgacaaagatcctggcctatgacgagaaaggcaataaaatctactttctctccacagaagacctccctaggcggaggcagttgtactccgctaatactgtgggaaatttcaataggcagtgcttgtcatgcgatcttgttgaaaactgcacttatttttctgcgtcattttcgcatagcatggacttcttcttactaaaatgtgagggtcctggggtccccatggtgacagtccataataccaccgataaaaagaaaatgttcgatctggaaacaaatgaacatgttaaaaaggccataaacgacagacagatgcccaaggtcgagtacagggacattgagatcgacgattataatctccccatgcagattttaaagcccgccaccttcaccgataccacacactatccgctgctgctggtagtggacggcacacctggaagtcaatctgtggccgagaagtttgaagtgagttgggaaactgttatggtgtcctcgcacggagctgtggttgtaaagtgtgatggcagagggagtgggttccagggcaccaagttgctgcatgaagtaagacggagacttgggctgctggaggagaaggaccagatggaggccgtacgcaccatgttgaaagaacagtacattgaccggacgcgcgttgcagtctttgggaaggactatggaggctatctttccacttacatcctgcccgccaaaggggaaaatcagggtcagactttcacctgcgggagtgctctgtccccaattaccgacttcaagttatatgcaagtgccttttccgagcgataccttggtcttcacggcctagataatcgggcatacgaaatgaccaaagtcgcccaccgggtgtccgccctggaagagcagcagttcctaataattcatccaacggcggatgagaaaattcatttccagcacaccgcggagctgatcacccaactgattagaggtaaggctaactacagtctgcagatctaccctgacgaatcccattacttcacgtcctcatctctgaagcagcacctgtacagaagtataatcaacttcttcgtcgaatgttttagaatccaggacaaactactcaccgtgaccgccaaagaagacgaggaagaggattag

SEQ ID NO: 185491 - DNA, 2649 bp, Artificial Sequence
  Description of Artificial Sequence: Synthetic coding sequence
atggccgccgccatggagaccgagcagctgggcgtggagatcttcgagacggcagactgtgaggaaaacatcgaaagtcaggaccgtcccaagctcgagcctttttatgttgagcgatatagctggtcccagctgaaaaagctcttggcggacactcgaaaataccacgggtacatgatggccaaggcaccccacgacttcatgtttgtgaagcgcaacgatcccgatggcccacacagcgaccggatttattacctggctatgtcaggcgaaaaccgcgaaaacaccttattttactccgagattcctaagaccattaatcgggccgcagtcctgatgttgtcttggaagccacttcttgacctgtttcaggccacacttgattacggcatgtattccagagaagaagagctattgagggaaaggaagcgtattggtaccgtgggcatcgcttcctatgactatcaccagggttcaggaacctttctcttccaagctggctccggaatttaccacgtcaaagacggtgggccacaagggttcacacagcagccactccgtcccaatctcgtggagacatcatgtcccaacatccgcatggacccaaagctgtgccccgctgaccctgactggatagccttcatccattccaatgacatctggatcagtaacatcgtgacaagagaagaaagacggctgacctacgttcataacgagctagccaatatggaggaggacgccagatccgccggcgttgctacattcgtgttacaagaggagtttgatcgatattctggatattggtggtgtcccaaagctgagactacacccagcggcggcaagatactacgaattctgtacgaggagaacgatgaatcggaagtggaaattatccacgtcacctccccaatgttagagacccggcgggctgattcattccgttacccaaagacggggactgctaacccgaaagtgacctttaaaatgtctgagatcatgattgatgcagaaggtagaatcatagacgtgattgataaggaactaatccagcccttcgaaatactttttgaaggcgtggagtacatcgctcgggccggatggacacccgagggcaagtacgcttggtctattttgctcgatagatctcagaccagacttcagatagtgttgatcagcccagaactcttcattcctgtggaagatgatgtcatggagagacagagactcatcgaatccgtccctgacagcgttactcccctgattatttatgaggaaactacagacatttggatcaatattcacgatatttttcacgtgtttccacagtcacacgaggaggaaatagaattcatcttcgccagcgagtgtaagacgggttttaggcatctgtataagatcaccagcattttgaaagaatcaaaatacaaaagaagctccgggggcctgcctgcccccagtgatttcaagtgtcctattaaggaggagattgcaatcaccagcggagagtgggaagtgctgggtcggcacggcagcaatatccaagtagacgaagtgcgcaggcttgtttacttcgaaggcacgaaagactcaccgctcgagcatcatctatatgttgtgagctatgtgaaccctggtgaagtcactcgtttaactgatcgtgggtattcacactcttgttgcatttctcagcactgcgacttcttcatctcaaagtacagcaatcagaagaaccctcactgtgtcagtctgtacaagctgagctccccagaggacgatcctacgtgcaagaccaaggagttctgggcaactatactggactcagctggaccactgccggattacaccccccccgagatcttctccttcgaaagtactaccggttttaccttatatggaatgctctataagccacacgaccttcagccaggcaaaaaatacccaaccgtgctgttcatttacggcggacctcaggtgcagctggtgaacaataggtttaagggggtgaagtactttcggttgaatacactggcttccttagggtacgtcgtagtcgtaattgacaaccggggctcctgccatcgcggacttaaatttgagggtgcctttaagtataagatggggcaaattgaaattgacgaccaggtagaaggacttcagtatctggctagccggtacgattttatcgatctcgatagagtcggtattcacggttggagttatggcggctatctgtccctgatggccctcatgcaacgttccgatatcttcagagtagcaattgctggagcacctgtgacactctggatcttttacgacaccggctatacagaaaggtacatgggccacccagatcagaatgagcaggggtattatttggggtccgttgctatgcaagctgagaagttcccatccgaacccaaccggctcctcctccttcacggctttttggatgagaacgtgcactttgcccacacatctatcttgctgagcttcctggtgcgtgcagggaaaccatacgacctacagatttatccccaggaacggcattctattcgggtccccgagtcaggcgagcactatgagctgcacctgctacactacttgcaggagaacttggggtctcgcatcgccgctctgaaggtcatttag

SEQ ID NO: 185492 - DNA, 2550 bp, Artificial Sequence
  Description of Artificial Sequence: Synthetic coding sequence
atgtggaagcggagcgagcagatgaagatcaagagcggcaagtgcaatatggcagcagcaatggagacagagcagttaggcgtggagatcttcgagacagccgattgtgaagagaacatcgagagtcaggatcgccccaagcttgaacccttctacgtggaaaggtattcctggagccagctgaagaagctcctagcagatacacggaaatatcacgggtatatgatggccaaggcacctcacgatttcatgtttgtgaagcggaacgatccggacggaccacatagcgacaggatttactatctcgctatgtcgggcgagaatcgagagaacactctattttactccgaaatccctaaaacgatcaatagagccgccgtgttgatgttgtcatggaaacctcttttggacctcttccaggctacgctggactacggcatgtactcaagggaggaagagctcttgagggaacgcaagagaataggaacggtcggaattgcgagctacgactaccatcaggggtctggcacattcctcttccaggctggctctgggatctaccatgtgaaggacggcgggccgcagggattcacacagcagccgctgcggccaaatcttgtcgagacatcttgccctaatatccgcatggatcctaagctctgtccggccgaccctgattggatagccttcattcactctaacgatatttggatttccaatatcgtcactagagaggagcgtagactcacctatgtgcataatgagctggctaacatggaggaggacgcgaggagtgccggggtcgccactttcgtgctgcaggaagaatttgaccgttacagcgggtattggtggtgtccgaaagcagagacaacaccctctggcgggaaaatccttagaatcctttacgaagaaaacgatgagtctgaggtagagatcattcacgtcacatccccgatgctggaaactaggagggccgatagcttccggtacccgaagacagggactgccaacccgaaagtcacctttaaaatgtcagaaataatgatcgacgcggaggggcgcattatcgatgtgatagataaggagcttatacagccatttgaaatactgttcgagggcgtggaatatatcgcccgtgccggctggacacctgaaggcaaatatgcctggtcgatcctgctggatagatctcagacgcggctgcagatcgtattaatcagccctgagctgtttataccagttgaggatgacgtcatggagcgccaacgcctgatcgagtctgtcccagactcagtgacccccttgattatctacgaagaaactaccgacatctggattaatatccacgacatttttcacgtgtttccccagagccacgaggaggagattgagttcatattcgcatcagaatgtaagactggcttccggcacctgtacaaaattacatcaatccttaaggaaagtaaatacaagcgctccagcggaggcctgccggctcctagcgatttcaaatgccctatcaaggaggagatcgcgataacttcaggagaatgggaggtgctgggcaggcacggatccaacattcaggtcgatgaagtccggcgattagtgtacttcgaagggaccaaagacagccccctggagcaccacctatacgtagtttcctatgtcaaccctggggaggtgacacgccttacagataggggctacagccacagttgctgcatctcccagcactgcgattttttcatctccaagtatagtaaccaaaagaatccccactgtgtgagcctgtataagctctcaagtccagaagatgacccgacatgcaaaacgaaagagttttgggcaaccattctggatagcgcaggccctctcccggactacaccccccccgagatcttctcctttgaaagcacaaccggtttcaccctctatggcatgctgtataaacctcacgacttgcagcctggtaagaagtatcctacagttcttttcatttatggcggaccccaaggccagattgagatcgatgaccaggtggaaggacttcaatatttagcatcccgctatgatttcatcgatctggatagggttgggatccacggttggagctatggcggttatttatcactgatggccctaatgcagcgctctgatattttcagggtggcaatagccggagcccccgtgaccttgtggatattctatgacacaggttacacagaaaggtatatgggccacccagaccagaatgaacaggggtattacctgggcagcgtcgctatgcaggccgagaagtttcctagcgaaccaaatcgcctgttattgctgcacgggttcctcgatgaaaacgtgcactttgcccacacgagtatccttctgtctttcctagtacgggcaggaaaaccttacgacctacagatctacccccaggagcggcattctatccgagtccctgaatcaggcgagcactatgagctgcacttgttacactatctgcaagagaacttaggctcacgcatcgcggctctgaaagtgatctag

SEQ ID NO: 185493 - DNA, 2544 bp, Artificial Sequence
  Description of Artificial Sequence: Synthetic coding sequence
atgtggaagcggagcgagcagatgaagatcaagagcggcaagtgcaatatggccgcagctatggagacagagcagctcggcgtggagattttcgagactgccgactgtgaggagaacattgagtcccaggaccgtcccaagctcgagcccttctacgtggaacgttatagttggtcgcagctgaagaaacttttagctgacacccggaagtaccatggatacatgatggctaaggcacctcatgatttcatgtttgttaagaggaatgatccagacggaccgcatagcgataggatctattacctggcaatgtcaggtgagaacagggagaatacgttgttttattcggagattcccaaaacgattaatagggctgctgtactgatgctgagctggaaaccgttgcttgacctgttccaggcaacacttgattacgggatgtacagtcgtgaagaggaactcctcagagaacggaagcgtatcggcacggtagggatcgcctcatatgattatcaccaaggatcaggcactttcttatttcaggctggctccggcatctaccacgtaaaggatggcggcccacaggggttcacacagcagccactccgcccaaatctggtggaaaccagctgcccgaacatacgcatggatcccaagctgtgtccagctgatcccgactggatcgcatttattcacagtaatgatatctggatcagcaacattgttacacgtgaggagcggcgcctgacatatgtgcataacgagctggctaatatggaggaagacgcaagatcagccggagtcgcaactttcgtgctgcaggaggagttcgaccggtactctggttattggtggtgcccaaaagctgaaaccacaccttccggcggcaagatcctgaggatactgtacgaagaaaacgatgagagtgaggtggaaatcatccacgtgacgtccccaatgctggaaaccagacgggccgactcgtttcgttatccaaaaaccggaacagctaacccgaaagtcacgttcaagatgtccgaaattatgatagatgctgaggggagaattattgatgttatcgacaaggaactaatacaacctttcgaaatcctcttcgagggggtggaatacatcgctagagcaggctggacccctgagggcaagtacgcatggtcaatcctgctggaccgcagtcagacacggctgcagattgtgttgatctcacccgaactctttatacctgtggaggacgacgtgatggagcggcagcggctaatcgagagtgtgcccgatagcgtcacaccgctgataatttatgaggagacaacagatatctggattaatatacacgatattttccacgtgtttccccaatcacatgaggaagaaatcgagtttatcttcgctagcgaatgtaagacaggctttcggcatctgtacaagattactagcatacttaaggagtcgaagtataagcgctcttctggaggtctccccgcaccctcagattttaaatgtccaatcaaggaggaaatagccatcaccagtggcgagtgggaggtgctgggacggcacggttctaatatacaggttgacgaggttaggaggctggtgtatttcgagggcacaaaagactccccactggaacatcacttgtacgtggtttcttacgtgaaccctggcgaggtgacacgcctcacagatcggggttactctcattcatgctgtatatcgcagcattgtgatttctttattagtaagtatagtaatcagaagaaccctcactgtgttagtttatacaagctctccagtccagaggacgaccccacttgtaagacaaaagagttctgggctacaatcctggatagtgctggaccactgcccgactacaccccccccgagatcttctcatttgaatccactactggatttaccctgtatggcatgttatacaaacctcacgacctacagcctggaaaaaaataccccaccgtgttgttcatatatggaggacctcaagtacagctagttaacaaccgctttaaaggtgtcaagtatttccggttgaacaccctcgcatccctcgggtatgttgtggtcgtcatcgacaaccgaggatcttgccaccgcgggctcaaatttgagggcgcttttaagtacaagatggttgcgatcgcaggcgctccagttaccttgtggatcttttacgacactgggtatacggagaggtatatgggccacccagaccaaaacgagcagggttactacctaggttctgtggcgatgcaggccgagaagtttccatccgaacctaaccggctgctgcttctgcacggctttctagatgagaatgtgcatttcgcccacacatcgatcctgctgtcctttctggtgcgggccgggaagccttatgatcttcagatttacccgcaggagagacattcaattcgggtacctgagagtggagagcattacgaactgcatcttcttcactatctccaggagaacctcgggagccgtatagcagccctcaaagtgatctag

SEQ ID NO: 185494 - DNA, 2178 bp, Artificial Sequence
  Description of Artificial Sequence: Synthetic coding sequence
atgtggaagcggagcgagcagatgaagatcaagagcggcaagtgcaatatggcggcagccatggaaacagagcagctgggagtggagatcttcgaaaccgccgactgtgaagaaaatatcgaaagtcaggaccgacccaagctggagccattctatgtggaaagatacagctggtctcagttgaagaaactgctcgctgatacgcggaagtaccacggatacatgatggctaaggccccgcacgattttatgttcgttaagaggaatgatcctgatggcccgcactccgatagaatctattacctggccatgtcaggtgaaaatagagagaacactctgttctacagcgagattcctaaaaccattaatcgggccgctgtcctaatgctgtcatggaagcccctgctggatttgtttcaggctaccctggactatggtatgtatagccgagaggaggagcttttgagagaacggaagcgcataggcaccgtgggcattgctagctacgactaccatcaggggtccggcacgtttctgtttcaagccggcagcggcatctatcatgtgaaagacggtggcccccagggattcactcagcagccattgagacctaatttagtggaaacgagttgtccaaatatccgcatggaccccaagctttgtcctgcggatccggattggattgcatttatacacagcaacgacatctggatttctaacattgtaacacgggaggagcggcggctgacgtatgttcataatgagctggccaacatggaagaagacgcgcgaagtgccggagtcgccaccttcgttctccaggaggaattcgaccgctactccgggtactggtggtgtccaaaggccgagaccactccatctggagggaaaatactccgtatcctctacgaggagaacgacgaatccgaggtcgagattatccatgtgacctcacctatgctggaaactcgtagggctgattctttcagatacccaaaaacaggaaccgcaaacccaaaggtgacctttaagatgtcagagataatgatcgatgccgaaggacgaatccaggtggacgaagtgaggaggctggtgtacttcgaaggaaccaaagactctcctctggagcaccacctgtatgtggtgtcttacgtcaatcccggtgaggtgacccggctcaccgatagaggctacagccacagttgctgtatcagccagcattgcgattttttcatctcaaagtactctaaccagaagaacccccactgcgtcagcttgtataagctgagttcaccagaggatgatcccacatgcaagacaaaggaattttgggcaacaatattggattctgcaggtccattgccagattacactccacctgagatttttagcttcgaatccacaacaggcttcaccctgtatggaatgctctataagccacacgatctacaaccaggaaaaaaatatccaactgttctatttatttatggaggcccccaggtgcaactcgttaataaccgctttaaaggggtgaagtattttcgactcaataccctggcttctctaggctacgtcgtcgtcgtgatcgataacagggggagctgccatcgtgggctaaagttcgagggagcattcaagtacaagatgggtcagattgagatcgatgatcaggtggaaggattacagtatctcgcatccaggtacgattttattgacctcgatcgcgtagggatccacggatggagctacggcggctacttatcccttatggccctgatgcagaggtcagacatattccgtgtcgcaatagctggtgcccctgttacactctggattttttacgataccgggtataccgaaaggtacatgggtcatcctgaccaaaatgagcagggttactatttgggcagcgtggcaatgcaggccgaaaagtttccttcggagccaaaccgactactcctgctgcatggattcttggacgagaacgttcacttcgcccatacaagtatcctgctgtcctttctggttcgggcgggaaaaccatacgatcttcaaatctaccctcaagaacgccattccattcgcgtccccgaaagtggagagcactacgaactgcatctactgcattacctgcaggaaaacctgggctcccgcattgccgctctgaaggtcatttag

SEQ ID NO: 185495 - DNA, 2697 bp, Artificial Sequence
  Description of Artificial Sequence: Synthetic coding sequence
atgtggaagcggagcgagcagatgaagatcaagagcggcaagtgcaacatggcggctgcaatggagaccgaacagcttggggttgagatatttgagacggctgattgcgaagaaaacattgagtcacaggaccgccccaagctcgaacctttttatgtagagagatactcttggagccagctcaagaaacttttggccgacactagaaagtaccatggctatatgatggcaaaggcaccgcacgatttcatgttcgttaagcgcaacgacccagacggaccccactcagacagaatatactacttagcaatgtctggtgaaaaccgcgagaacaccctgttctattcagagatccctaagaccattaacagagctgcagtgctgatgctttcctggaaacccctgcttgatttatttcaggctacccttgattatggtatgtatagtagggaggaggaactattaagagagcggaagcgcataggaaccgttggaatcgcatcgtatgattatcatcagggctcaggaacgtttcttttccaggctggctctgggatctaccacgttaaagatggaggcccgcagggctttacccagcagccactccggcctaatctggtagagacatcctgtccaaacatccggatggatcccaagctgtgcccagccgatccggactggatcgcattcatacacagcaacgatatctggatatctaatatcgtgacgcgagaggaaaggcggctcacctatgtgcacaacgaactggcaaacatggaggaggacgctcggtcagctggggtggccacgtttgtgctacaggaggaattcgatagatactctggatattggtggtgtcccaaggctgagacaaccccctctggcggcaagatactcaggatcttatacgaggagaacgatgagtctgaagtggagatcatccatgtgaccagtcctatgctggagactaggagagcagattcttttcggtatcctaagacgggtacagccaaccctaaagtcacttttaaaatgtccgagattatgatcgacgctgaggggcgcataattgatgtaattgacaaggaattaattcagccattcgaaatcctcttcgagggagtcgaatatatcgctagagccggatggacacccgagggaaaatacgcatggtcgatcctgctggatcgatctcagacgcgactgcaaatcgtgctgatcagtcccgagctgttcatacctgtggaggatgacgtgatggagcgtcagcgcttaattgagagtgtgccggattccgtgacgcccctcatcatctatgaagaaaccacagatatctggataaatatccatgacatcttccacgtgttcccacagagccatgaagaggagatcgaattcatatttgcctcagaatgcaagacgggattccgacacttgtacaagataacatcgattcttaaggagtccaaatataagcgtagtagtggcggcttaccagccccctctgacttcaagtgccctataaaagaggaaattgcaattacgtccggggagtgggaggtactcggccgccatgggtccaatattcaggtggacgaggtgaggaggctagtgtatttcgaagggaccaaagacagccctctggagcatcacctgtacgttgtctcctacgttaatcctggcgaagtgacaagacttaccgatcgcggctactctcactcatgctgcatatctcagcattgcgattttttcataagcaagtattctaatcagaagaaccctcattgtgttagtctttataaactctcatccccagaggacgatcccacttgtaaaacgaaggaattttgggctacgatactggacagcgccggtccactcccggactacacgccccccgaaatattttcattcgagagcaccaccggttttacactctacgggatgttatacaagcctcacgacttacaaccagggaagaagtacccaacagtgttatttatctatggcggcccccaggtgcagctggtaaacaaccggttcaagggcgtgaagtacttcagactgaacacgctcgcctcactcggttacgtggtggttgtcatagataatcgggggtcttgccaccggggtcttaaattcgagggtgcttttaagtacaaaatggggcagatcgagatcgacgatcaggtggaaggactgcagtatcttgctagccgctacgattttatcgacctggatcgcgtgggaatacacggctggagttacgggggttatcttagcctgatggccctgatgcaacggtcagatatcttccgagtcgctattgcaggggcccccgtgacgctgtggatattttatgatactggctacactgagcgatacatgggtcaccctgatcaaaatgagcagggatactacctcgggagcgtggctatgcaagccgagaaattccccagcgagccaaacaggttgctgttgctccatggcttcttagatgagaatgtgcactttgcccatacatccatccttttgagttttctggtgcgtgccggcaaaccatacgatctccagatttacccacaggagcggcactccatccgggtgcctgagagcggggagcattatgaactgcacctcctgcattacctgcaggaaaacctgggatcccggattgctgctctgaaagtgatttag

SEQ ID NO: 185496 - DNA, 2349 bp, Artificial Sequence
  Description of Artificial Sequence: Synthetic coding sequence
atggccgccgccatggagaccgagcagctgggcgtggagatcttcgaaacggcggattgcgaggagaacatcgaaagccaagatcgccctaagctcgagccattttatgtcgagcgctattcctggagccagcttaaaaaactgctggctgacacacgcaaataccatgggtatatgatggctaaggctcctcacgactttatgtttgtgaaacggaacgatcctgacggaccgcactcggacagaatctattacctagcgatgagcggagaaaatcgggagaacacgctcttttacagcgaaattccaaagactatcaatcgtgcagccgttctcatgcttagttggaagccactcctcgatctgtttcaagcgacactagactatggtatgtattcaagagaggaggagctcctgcgggagcggaagagaataggaaccgtggggattgcctcctatgactatcatcaagggagtgggacttttttgttccaagctggcagcgggatatatcacgtcaaggatggcgggccacaaggcttcacccagcaacccctgcgccccaacttggtcgaaactagctgtccgaatattaggatggaccccaaattgtgtcccgccgatcccgattggatcgcattcatccactcaaatgacatttggatctcaaacattgtgacccgcgaggaacgtaggctgacctacgttcataacgagctggccaatatggaggaggacgctcgatctgccggcgtggcaactttcgtgctgcaggaagagttcgatagatacagcggctattggtggtgccccaaggcggagaccaccccctccggtggtaagatcctgcggattctctacgaagagaacgatgaatcggaggtggaaatcattcatgtcacctcccctatgcttgagaccagacgcgcggactcctttcgctatcccaaaaccggcactgccaatccgaaggtgacttttaaaatgagcgaaatcatgatcgacgcggaaggaagaattattgacgtcattgataaggaactgattcagccattcgagattttattcgagggtgtagagtacatcgcccgggcaggatggactcctgaaggcaaatatgcctggtctatactgctcgacaggtctcagacacggctgcagatagtcttaatttctccagaattattcattccagtggaggatgacgttatggaaaggcagcgcttgatcgaatctgtgcccgacagcgttacgcctctaattatttatgaggagactaccgacatctggataaacatccacgacatctttcatgtgtttcctcagagtcatgaggaggagatcgagtttatattcgctagcgaatgtaagaccggtttcaggcacctctataaaatcacaagcatactcaaagagtccaagtacaaacgctcttccggagggctgccggcaccctctgactttaaatgccctataaaggaagagattgcaatcacgtcaggtgaatgggaggtgctgggacgccacggaagcaatattcaagtggatgaagtccgtcgcctcgtgtattttgagggcactaaagacagccccctcgaacatcacctctacgtcgtctcctatgtcaacccaggagaggtcacacgcctcacggaccgaggttactcacacagctgttgtatatctcagcattgtgacttctttatttctaagtattcgaatcagaagaacccgcattgcgtctcactctacaagctctctagtccagaggatgaccccacttgtaagaccaaagaattttgggcaacaatcttggattcagctgggccgctgcccgattatacacccccagaaattttctcttttgagtccaccaccggcttcactctctacggtatgctgtacaagccccacgacctccagcccggcaagaaatatcctacagtgctatttatttacggaggacctcaggtggctatcgctggcgcccctgttaccttgtggattttctacgacactgggtacactgaacgctacatgggccatcccgatcaaaacgaacagggatactaccttggaagcgtggctatgcaggccgagaaatttccatctgagcctaaccgtctgctactgctccatggcttcctggacgaaaacgttcattttgcccatacttcaattctcttgagcttcttggtgcgggctggcaagccttacgatttgcagatttatccgcaagagagacacagcattagggttcccgagtctggcgaacattacgaattacacctcctccattacctgcaggagaatctggggtctaggatcgccgccttgaaagtcatatag

SEQ ID NO: 185497 - DNA, 2697 bp, Artificial Sequence
  Description of Artificial Sequence: Synthetic coding sequence
atgtggaagcggagcgagcagatgaagatcaagagcggcaagtgcaatatggcagcagcgatggagaccgagcagctaggggtagagatatttgagaccgctgactgtgaggaaaatattgaatcccaagacagaccgaaactcgagccgttctacgtcgagcggtactcctggagccagctgaaaaagttactcgcagatacacgaaagtatcacggttatatgatggctaaggcgcctcatgatttcatgtttgtgaaacgcaatgatccagatggacctcacagtgataggatttactacctggctatgtcgggcgaaaatcgagagaacacactcttttattctgagatacccaagaccataaatcgggctgctgtgctaatgttatcctggaagcctctccttgatctgttccaagccacactcgactatgggatgtacagtagggaagaggagctgctgcgggagaggaaacggatcggcactgtgggaattgcttcctatgactatcatcagggcagcggcaccttcctttttcaggctggatccggcatttaccacgtgaaagacggcggcccacaaggctttacacagcaacctctgagaccaaacctcgtggagacgtcttgtcctaatatccgcatggatcccaaattgtgcccggccgatccagactggatagcatttatacatagcaacgacatttggatctctaacattgtgacgagagaggaaagaagactgacctatgtacataatgagttggcaaacatggaggaggacgctagaagcgccggggtcgcaacattcgtgttacaagaagagttcgatcggtacagcggatattggtggtgtcctaaggccgaaacaacaccatcgggaggcaagattttgcggattttgtatgaggagaatgacgaatccgaggtggaaattatccacgttacatctcccatgttggaaactagaagagcagactctttccggtatcctaagaccggtactgcaaacccaaaagtcacgttcaaaatgagcgagatcatgatagacgcggaggggaggattatagatgttatcgataaggagctgattcaaccatttgagatcctgttcgaaggggtcgagtacatcgcgagggcagggtggacacccgaaggaaaatatgcttggtctattttgctggaccgcagtcaaacgcgcctgcagattgtcctgatcagtccagaactgtttatacctgtagaggacgatgtgatggagagacagagacttatcgaatccgttcctgactcagttacaccattgattatttacgaggagactaccgacatttggattaacattcacgacatatttcatgtgttccctcagtctcacgaggaagagattgaattcattttcgcttctgaatgcaagacgggtttccggcacttgtataagatcaccagtattcttaaagaaagtaaatataagcggagttcaggaggtctaccagccccctctgacttcaaatgtccgatcaaagaggagatcgctataacttctggcgagtgggaggtgctaggacgccatgggagcaacattcaggtggatgaggtcagaaggctggtttatttcgagggtaccaaggacagtcccctggaacaccacttgtatgtggtgtcgtacgttaacccgggtgaggtaacgcgcctgacagacagagggtactcccactcgtgctgtattagtcagcactgtgacttctttattagcaagtatagcaaccagaagaacccccactgtgtttctttgtacaagctgagctcccccgaggacgaccccacttgcaagaccaaggaattctgggcaaccattctagattctgctgggcccctgcccgattatacaccaccagaaattttctcatttgaatctacaaccggttttaccttgtatggaatgctctacaagccccacgacctccagcccggtaaaaagtatcccacagttttgtttatctacgggggtcctcaggtgcagctggtaaataaccgatttaagggggtgaagtattttagactgaatactttagcgtctctgggctacgttgtcgttgtgatcgacaatcggggctcttgtcaccggggcctgaagtttgagggggctttcaagtacaagatgggacagattgaaatcgatgatcaggttgaggggctccagtatttggcatccagatatgactttattgatctggacagggtggggattcatggctggtcctatggcggttacctatctttgatggcccttatgcagaggagcgatatctttagggtagctatcgcgggcgcaccagttacgctttggattttctatgatacaggatacaccgagagatatatgggacaccccgatcaaaatgagcaaggctactatcttgggagcgtggccatgcaggcggagaagttccctagcgagcctaacagattgctccttttgcatggcttccttgatgaaaacgtccattttgctcacacatcgattctgctcagtttcctcgttcgggccggaaagccctacgacctgcaaatctatccacaggagagacactccataagggtccctgagagtggggaacattacgagctgcatctacttcactacctgcaagaaaaccttgggtcacggatagccgcactgaaggtcatttag

SEQ ID NO: 185498 - DNA, 3669 bp, Artificial Sequence
  Description of Artificial Sequence: Synthetic coding sequence
atgagcgaggccccccggttcttcgtgggccccgaggacaccgagattaatccaggcaactacaggcacttttttcaccacgccgacgaagacgatgaggaagaggacgacagcccaccagaacgacagatcgtcgtcggtatatgtagcatggcaaaaaagtccaaatctaaacctatgaaggagattctcgaacggatttccctcttcaaatatatcactgtggtggtgtttgaggaggaggttatccttaacgagcccgtggagaactggcctctctgcgactgtttaatttccttccactccaagggattccctctggataaagcagtggcatatgccaagctgaggaaccctttcgtgatcaatgacctcaatatgcaatacttgatccaggatagaagggaggtgtacagcatccttcaggcggaaggcatcctgctgccccgttacgccatcttgaacagggatcctaacaaccccaaggagtgtaatctcatcgagggcgaggaccatgtggaggtcaatggagaagtgttccagaagcccttcgtagagaagcccgtgtcggcagaggatcataatgtatacatctattaccccacaagtgcagggggaggctcccagcggctgttccggaagatcggctcgcggtccagcgtgtattcgccagagagcaacgtgaggaaaaccggttcttacatttacgaagaattcatgcctactgacggaactgatgttaaagtttacactgtgggacccgactacgctcacgctgaggcccgcaagtctccggcacttgacggaaaggtggaacgggacagcgaggggaaagaagtcaggtacccagtgatcctcaacgcccgagaaaagctcattgcgtggaaagtgtgcctggctttcaaacagaccgtatgcggattcgacttactgcgagccaacggacaaagttacgtgtgtgacgtcaacggcttcagtttcgtaaaaaatagcatgaaatactacgatgactgcgctaagatattaggtaatattgttatgagggaattggcgcctcaatttcatatcccatggtctatacccctggaggctgaagacatacccatcgtgcccacaacctcaggtactatgatggaattgaggtgtgtgattgctgtaatcaggcacggggatcgtaccccaaagcaaaaaatgaagatggaggtaaggcatcagaagttctttgatctgtttgagaaatgcgatgggtacaagtcaggcaaactgaagttaaagaagcctaaacagctccaggaagtcctagacattgctcgacagctcctcatggagctcggccagaataacgatagtgagatcgaggagaacaaacctaagcttgagcagcttaagaccgtgctcgagatgtatggtcattttagcggcattaataggaaagtgcagttgacatacctcccccatggatgccctaaaacctccagcgaggaggaagatagtcgccgtgaggagccttctctccttttagtattaaaatgggggggcgagctgacacccgcagggcgcgttcaagccgaggagttaggcagagctttcaggtgcatgtatccaggtggtcagggcgactacgccgggttcccagggtgtgggctgcttaggttacactccacttacaggcatgaccttaaaatttacgcctccgacgaggggcgtgtgcagatgactgcagcggcctttgccaaaggcttgcttgcactggagggagagttgacaccaatacttgtacagatggtgaaatccgcaaacatgaacggattacttgactccgacagcgacagcctgtcatcatgtcagcaacgagtgaaagccagactgcacgaaatactccagaaggatagggacttcacagcggaggattacgaaaaactaacaccctctggatcgatttccctgatcaaaagcatgcatctgattaagaatccagtcaagacatgtgacaaggtgtattccctcatacaaagcctgacctcccagatccggcacagaatggaagatcccaaaagctctgacattcagctttaccacagcgaaaccctcgagcttatgctgaggcgctggtccaagctagagaaagacttcaagactaagaacggccggtatgatatatccaaaatccccgacatttatgattgtatcaagtatgatgtacagcataacggcagcctgaaattggagaacacaatggagttgtacaggctcagcaaagcacttgcggatatagtgattccccaggagtatggtattactaaagctgaaaagctagagattgccaagggctactgtaccccgttagtgcggaagatccggagtgacctccagagaacccaggacgatgacaccgtgaataagctgcaccctgtgtattccaggggcgtcctttcacccgagcgccacgtccggacacggttatattttacctcagagtcccacgtgcactctctcctgagcatcctcagatacggagccctttgcaatgagtccaaggacgaacagtggaaaagggctatggactacttaaatgtggtgaacgagctgaactatatgacacaaatcgtgatcatgttatatgaggacccaaataaggatttgagcagcgaagaacgcttccacgtggagttgcatttctcccccggagccaagggctgcgaagaagataagaacctgcccagtggctacggttaccgcccggcttccagggagaacgagggacgccggcccttcaaaatcgataatgatgatgagcctcatacgtcaaagcgcgatgaggtggatagagccgtcatcctgttcaagcccatggtgtcagagccaatccatatccatcgcaagtctcccctgccacggtcccggaaaactgccaccaatgacgaagaaagtcctctcagcgtgagctctcctgaaggaactggcacatggctgcactacaccagcggggtggggacaggccggaggcgccgtcgatccggagaacagataacgtcttcccccgtcagcccgaagtcactcgcattcacatcgagtatttttggcagctggcagcaggttgtttccgaaaacgcaaactaccttcgcacaccaagaaccctggtcgaacagaagcagaaccctacagtgggatcccattgtgctggacttttcagcacctccgtcctgggtggctctagttcagcaccaaacctgcaggattatgcgagaactcatcggaagaagcttactagcagcggttgtatagacggatttgagctgtattctatggtgccttcaatctgccccttggaaactctgcacaacgccctgagtttaaagcaggtcgacgagtttttagcttccatcgccagtccatcgtcagacgtgcctcgaaaaacagccgaaatcagcagtacagcccttcgatcgtcacccattatgcggaagaaagtaagcctgaacacctatacccccgcgaagatcctaccaacaccaccggctacacttaagtccaccaaggcctcctcaaaacccgccacatccggccctagtagcgccgtggtccctaacacctcctctcgcaagaagaacattacaagcaagaccgagacacatgagcataagaagaacacaggcaaaaagaaatag

SEQ ID NO: 185499 - DNA, 3732 bp, Artificial Sequence
  Description of Artificial Sequence: Synthetic coding sequence
atgagcgaggccccccggttcttcgtgggccccgaggacaccgagataaatcctggaaactacaggcatttttttcaccacgcggacgaggatgacgaagaggaggatgactcaccgcctgagcggcagatagtcgtcggaatctgcagcatggcaaaaaagtctaaatctaagccaatgaaagaaatactggaacgaatctccctcttcaaatatataacagttgttgtgttcgaagaagaggtgatcctgaatgaacctgtcgaaaattggcccctctgcgactgcttgataagctttcattcaaagggttttccccttgacaaagccgtagcttatgccaaactgcgcaacccctttgtgataaatgatctgaacatgcagtatctgatccaagatagacgagaagtctacagcatcttgcaggccgaaggaatactgttgccacgttacgctattcttaacagagatcctaacaatcctaaggagtgtaatttgattgagggagaagaccacgtcgaagtgaacggcgaagtctttcagaagccttttgttgaaaaacccgtgtccgcagaggatcataatgtgtacatatactatcctacctccgccggtggtggttcgcagcggctgttcaggaaaatcggatctcggtcaagtgtgtattcccctgagtccaacgtgaggaagactggctcatacatctacgaagaattcatgccaaccgatggaacagacgtgaaagtctacaccgtgggcccagactatgcccacgccgaagcacgtaaatcccctgctttggacggcaaggtagagcgtgacagtgaaggcaaagaggttcgctaccccgttattctgaatgccagggaaaagcttattgcctggaaagtgtgcctcgccttcaaacagaccgtctgcggatttgatctgttgcgggcgaatgggcagtcttacgtttgcgacgtcaacggctttagtttcgtgaaaaattctatgaaatattacgatgattgtgcaaagattctgggcaacatagtaatgcgcgaattagcgccacagtttcacatcccctggtcaatacctttggaagccgaggatattccaattgtcccaacgacctccggcaccatgatggaattgcggtgtgtgatagccgtcatcagacatggcgaccgcacccccaagcagaagatgaagatggaggtccgtcatcagaagttcttcgacttgtttgaaaagtgcgacggatacaaatccggtaagttgaagctgaaaaagccaaagcaactacaggaagtactggatatcgcgcgacagttgttgatggagctgggccagaataatgactcagaaatagaagagaataagcctaaactggagcagctcaagaccgtgttggaaatgtatgggcacttcagcggaattaaccggaaagtgcagctgacctatctcccccacggctgtccaaagacatcttccgaggaggaggactcccggagggaagaaccctccctgttgctcgtacttaagtggggcggagagctcaccccagccgggcgggtgcaagccgaagaactgggccgggcgttcaggtgtatgtacccggggggtcaaggcgactatgcgggcttcccggggtgcgggctactgcggttacattccacgtatagacacgacctcaagatctacgcatctgacgagggaagagtccagatgacagctgccgccttcgccaagggcctgctcgctctggaaggcgagctcactccgatactggtgcagatggtcaaatcagccaacatgaacgggttgcttgattccgatagcgactccttgagctcatgccagcagagggtaaaggcacgattacacgagatcttacaaaaggaccgggactttacggccgaggactacgaaaagctgaccccaagtggctccatcagtctgatcaaaagcatgcatctcatcaagaacccagttaagacgtgtgacaaggtttattcgttaatacagtccctgacttctcaaatccgtcatcgtatggaggacccgaagagtagcgatatacagctgtatcacagcgaaaccctggagttgatgctgagacgatggtcaaagctggagaaagacttcaagaccaaaaatggaaggtacgatatttctaagatcccagatatttacgactgcataaaatatgacgtccagcataatggctccctgaaactagagaacaccatggaactgtatcgactctccaaggctctggccgatatagtgatacctcaggagtacggcattacaaaggctgaaaagcttgagattgctaagggttactgtacccctctggtgcgcaagatccgatctgacctgcagagaacgcaggacgatgataccgtcaataagctgcacccagtgtatagccgtggggttctctctccggaacggcatgtgagaacgcggctctatttcacctcagaatcccatgtacattcactgctgagtattctgcggtacggtgccctttgcaacgagtcaaaagacgagcaatggaagcgggcaatggattatctaaatgtcgtgaacgagctcaactatatgacccaaatcgtcatcatgctgtatgaggacccaaacaaagatctgagctccgaggagaggttccatgtggagttgcacttttctcctggagccaagggatgcgaggaagataaaaatctgccaagcggctacggctatcgccccgcctctagagagaacgagggacggcgcccttttaagattgacaacgatgacgagccacatacatccaagcgggacgaagtggaccgtgctgtcatcctgtttaagccgatggtgtctgaacctatacacatccatcgcaagtccccattgcctagatctcggaagaccgcaactaatgatgaggagtctccactatccgtgagtagccctgaaggcactgggacgtggcttcactacacaagcggggtcggcacagggaggcgtcgaagacggtccggagaacagataacaagtagccccgtgtcccctaaatctttagccttcacttcgtccatcttcggtagctggcaacaagtggtctcagaaaacgccaactatctccggactcctcggacattggttgaacagaagcagaatcctaccgtgggatctcactgtgcgggactcttttctacctcggtcctaggcggtagctcctcagccccaaacttgcaagactacgccaggacccacagaaaaaagcttacgtccagtggatgtattgatgacgctacacgggggtctgcggtcaagcggttcagtatcagtttcgctcggcaccctactaacggttttgagctctattcaatggtcccctctatctgtccgctggagacattgcataatgcattgtctcttaagcaggttgatgagttcctcgccagcattgcgtcacctagctcggacgtgccacgcaaaacagccgagataagtagtaccgccctcaggtcctcccctataatgcgcaagaaagtcagcctgaatacttatacccccgctaagatccttccaactccccctgccactttgaagtccactaaggctagctctaaaccagcaactagtggcccctcttctgccgtggtgcctaacacctcctctaggaagaaaaacatcactagtaagactgagacacacgaacacaagaaaaacacgggcaaaaaaaaatag

SEQ ID NO: 185500 - DNA, 3669 bp, Artificial Sequence
  Description of Artificial Sequence: Synthetic coding sequence
atgagcgaggccccccggttcttcgtgggccccgaggacaccgagatcaaccctggcaactaccggcattttttccaccatgcagatgaggacgacgaagaggaggatgattcgccacccgagaggcagattgtggtggggatctgtagtatggccaagaaatcaaagtccaagccgatgaaggaaatattagaaaggataagcctttttaaatacattacagtggtcgtgttcgaagaagaggtgatcctgaacgagccggttgaaaactggcccctgtgtgattgtttgattagctttcactctaaaggtttccccctggataaagccgtcgcttacgccaaactaaggaacccctttgtgattaatgatctaaatatgcaatatttaatacaggaccggagagaggtgtatagcatcctgcaggcagaaggaatactgctccctaggtacgccatcttgaatagagatccaaacaaccctaaggagtgcaatctcatagaaggggaggaccacgtcgaagtgaacggagaggtattccagaagccctttgtcgagaaaccagtcagcgccgaggatcacaacgtgtatatctattatccaacttcagcgggaggcggcagccagcggctatttcgcaagattgggtcacgcagtagcgtgtattcccctgagtccaatgtccgaaagacaggatcgtatatttacgaggaattcatgcctactgatggcacggatgtgaaagtgtacactgtcggcccagattacgctcacgcggaggcaagaaagtccccggctctcgatggaaaagtcgaaagagacagtgagggcaaggaggtgcgctaccctgtgattctgaatgctagggagaagttgattgcttggaaagtttgtttggcttttaaacaaactgtgtgcggcttcgatctgctgagagctaatgggcagtcttacgtgtgtgacgttaacggtttttccttcgttaagaactccatgaagtattatgatgactgcgccaagatccttggcaatatcgtaatgagggagctggcccctcaatttcacatcccgtggtccattccgctcgaggccgaagatattcccatcgttcccaccaccagcgggacgatgatggagctgaggtgcgtcatcgctgtgatccggcatggagataggaccccaaaacaaaaaatgaagatggaagttaggcatcagaagttttttgatctttttgaaaagtgcgatggttataaaagtgggaagctgaaattgaaaaagcctaagcagttgcaagaggtgctggacatcgccaggcagctactcatggaactgggtcagaataacgattctgagattgaagagaacaaacctaaacttgaacaacttaaaacagtcctggagatgtacggtcacttctctggcatcaatcggaaggtacaactgacgtaccttccacatggctgtcccaaaacctctagcgaggaggaggacagtaggagagaagagccgtcactcctcctagttctcaaatggggtggcgagttaacgcctgccggccgcgtgcaggcagaggagctcggccgggccttccggtgcatgtatcccggcggccagggcgattacgctgggttccccggctgcggacttctcagattgcatagcacctatagacatgaccttaaaatttacgctagtgatgagggaagggtccaaatgaccgctgctgccttcgcaaaaggccttctcgcacttgaaggagaattgacacctatccttgtgcagatggtcaagagcgccaacatgaatggcctgctggacagcgacagcgacagtcttagctcctgccagcagagggtgaaggcccggctgcacgagattcttcagaaagatagggactttacagctgaggactacgagaagctaactccatcaggaagcatctctttaatcaagtccatgcacttgattaagaaccctgttaagacttgtgacaaagtgtacagcttaatccagagcctgacgagtcagatacgccaccgaatggaggatccaaaatctagtgatattcagctgtaccacagtgagacactagagctgatgctgagacggtggagtaaattggaaaaagacttcaagaccaaaaatggcaggtatgacatttccaaaatccccgacatctatgattgcatcaagtatgacgtacagcacaacggatctctcaaactcgagaacacaatggagttgtaccgcctctcaaaggcactcgcagatatagtgatcccccaggagtacggcattaccaaggctgagaagttagagatcgccaaaggatattgcacccctctggtgcgcaaaatacgctctgacttacagcgcactcaggacgatgacacggtgaataagctgcaccctgtctattcacgaggagtgctgagtcctgaacgacacgtgaggacacggctgtacttcacaagcgaaagccacgtgcactctctcctctctatcctccgctatggagccctctgtaatgagtccaaagacgaacagtggaaacgggcaatggattacctgaacgtagtaaatgagttgaactatatgactcagattgttattatgctctacgaagaccccaacaaggacttgagttcagaggaacggttccatgtggagctccatttctccccgggcgccaagggttgcgaggaagacaaaaacctccccagtggatatggatatcgccctgcaagcagagagaatgagggaagacgcccttttaagattgataatgacgatgaaccccacacgagcaaaagggacgaggtggaccgcgcagtaatcctgtttaagcccatggtgagtgagcccatacacattcatcgtaagtctcctttgcctcggtcacgaaagactgcgaccaacgatgaagaaagcccactctctgtcagttctcctgaagggactggaacctggctacattatacatcgggagtcgggaccggccgaaggcgcaggagatccggcgaacagattacctcaagtcccgtcagccccaaatccctggctttcacaagttccatctttgggtcttggcaacaggttgttagcgagaacgcgaattatctgagaaccccacggaccttagtggagcaaaagcagaatcccactgtaggtagccactgtgccggcctattttctacctcagtgcttggaggctcttcaagtgcccctaatctgcaggactatgctcggacacacagaaagaaacttacttccagtggatgtatagatggcttcgaactgtattctatggtaccttctatctgccctctggagacgctccacaacgcgctgtctctcaagcaggtcgacgaattccttgcaagcattgccagccctagctccgatgtgccacgtaaaaccgcggagatctctagtactgccttaaggagctcccctataatgcgtaaaaaagtctctctgaacacttacactccggccaagatcctgccaacaccccctgcaactttaaagagtacaaaggcctcaagcaaacctgccactagtgggccatcgtccgccgtcgttccaaacacaagtagccggaagaagaatatcactagcaaaacggagacacatgaacataaaaaaaatacgggcaagaagaaatag

SEQ ID NO: 185501 - DNA, 3837 bp, Artificial Sequence
  Description of Artificial Sequence: Synthetic coding sequence
atgagcgaggccccccggttcttcgtgggccccgaggacaccgagataaatccaggcaactatcgccacttttttcaccatgctgacgaggacgatgaagaagaggatgattcaccacccgaaagacagatcgtggttgggatttgcagcatggccaagaagtcgaagtccaagccaatgaaagaaatactcgaaaggatctccttgttcaaatacatcacagttgtcgtgtttgaagaagaggtaatcctcaacgaaccagtggaaaactggcctctgtgcgattgtcttatatctttccactccaagggtttcccactcgataaagccgtggcttacgcaaagctgagaaatccattcgtaattaatgatctgaacatgcagtatcttattcaagataggagggaggtgtactccattttgcaggccgaggggatactcttgcccagatacgctattctgaaccgcgatcccaacaacccaaaagagtgtaatctgatcgagggcgaggaccacgttgaggtcaatggggaagtgttccagaagcccttcgtcgaaaagcccgtatctgccgaagaccataacgtgtatatctactatcccacctcagctggcggaggttctcagcgcctgttccggaaaataggaagtcgctcttccgtgtactcgcctgaaagtaacgttagaaagaccggatcatacatttacgaggaattcatgcccaccgacgggacagatgtaaaagtctacacagtgggacccgattatgcgcatgctgaggcccgtaaatctcctgccctagacgggaaggtggagcgggactccgagggcaaagaagtcagatacccagtcatcctgaacgctagagagaagctcatagcctggaaggtatgcctggcgtttaaacagacggtttgcggctttgacctcctgcgagccaacgggcagtcctatgtgtgcgatgttaatggctttagtttcgtcaagaatagcatgaaatactacgacgactgtgctaagatcttaggcaatatcgtgatgagagagttggctcctcagtttcacattccctggtctattcctcttgaggcagaagacatcccaattgttcccactaccagtggcacgatgatggagctgaggtgtgtcatcgcagtcatccgacatggcgaccgcaccccaaaacaaaagatgaaaatggaggtgaggcatcagaaattctttgatttgttcgagaaatgcgatggttacaagtctgggaagttgaagctgaagaaacccaaacagctgcaggaagtcctcgatattgctcggcagctgctgatggagctgggacagaacaacgactccgagatcgaggagaacaagcctaagctcgaacagttgaagaccgtactagaaatgtatggacacttcagtggcatcaataggaaagtccagctgacatacctcccgcatggctgccccaaaacatcctctgaagaggaggattcaagacgcgaagagccctcccttctcctcgtgctgaaatggggcggcgaacttacccccgctggtagagtccaggcggaggaattgggccgcgcattcagatgcatgtaccctggtggccagggtgactatgccggatttccaggctgtggactgctgcggctacactccacttaccggcacgatctcaaaatctatgccagtgacgaaggaagggtgcagatgacagctgcagcctttgcgaagggtctcctcgcgctggagggcgagttgacgccaatcttggtgcagatggtgaaatcggctaacatgaatggtttactggactccgactccgactctctgtccagttgtcaacagcgggtcaaggctaggctgcacgagatcttacagaaggatcgggatttcacagcagaggattatgagaaattgaccccctctggctctattagcctgattaagagcatgcacctaattaagaacccggtgaagacctgcgacaaggtctattctctgatccaaagcctgacgagccagatccggcacagaatggaggaccctaagagctcagatatccaactgtatcattccgaaacccttgaactgatgctacggcgttggtccaagctcgaaaaggacttcaaaactaaaaatggccgatatgatatcagtaagatccccgacatctacgattgtattaaatatgacgtgcaacacaacggaagcctgaaacttgagaacacgatggaattatatagactttcgaaagcgcttgctgacatcgtaatccctcaagaatatgggatcacaaaggccgaaaaattagagatcgcaaaaggttactgcactcctctggtgaggaagatacgctcagatctgcagaggacgcaggatgatgataccgtcaacaaactgcaccctgtgtacagtagaggcgtactttccccagagaggcatgttcggaccagactttacttcacctcggaaagtcacgtgcactcgctcctgtcaattctcaggtacggtgcattgtgtaacgaccacgactctcagaatgaagatggaggcatggttaaagagatggaaagcaaggacgagcagtggaaacgagctatggattatctcaacgtagtcaatgaactgaactatatgacacaaatcgttatcatgctgtacgaggatcctaacaaggacctgtcttccgaagagagattccacgtagagcttcatttctccccaggggccaaggggtgcgaagaagacaaaaatctccccagtgggtacggctataggcctgccagccgggaaaacgagggtcgtcggccctttaagatcgacaatgacgatgaacctcatacttctaagcgcgacgaggtggaccgcgctgtaatcctcttcaaaccaatggtgagcgagccaattcacattcacaggaagagccccctgccaagaagtagaaaaactgccacaaacgatgaggaatcacctctgtcagtttcttcgccggagggaactggcacatggttgcattatacatccggcgtcggaacagggcgccgacgtaggcgaagcggggaacagatcacatcatcccctgtgagccctaagtctctcgcgtttacatcaagtattttcggcagctggcagcaggtagtttcggaaaacgcaaattatctgagaaccccccggaccctggtcgagcagaagcagaatccaaccgtgggttcacattgcgcggggctgttttcaacttcagtcctgggcggatcctcctccgcccctaatctgcaggattatgcgcggacacatcgaaaaaagttaaccagctccggttgtattgatgatgccactcgggggtcggctgtgaaaaggttttccattagttttgctcgtcaccctacaaatgaacacttacacctctacaggtgctggtccgtgtcatccgttgaatttttgggctcctccggctttgagctctattcaatggttcccagcatctgtcctctagagacattacacaatgccctctccctcaagcaggtggatgagttcttggcctcaatcgccagcccaagttctgatgtgccacggaaaacagccgagatcagttctaccgctttacgctcatcacccatcatgaggaagaaggtcagcctgaacacctatacaccggcgaagatcctgccaacccctcccgctactctcaagagtaccaaggcatccagcaagcccgcgaccagcggaccttcttcagcagtggtcccaaacacctctagtagaaaaaaaaatattacctctaagacagagacccatgaacacaaaaagaacacaggtaagaagaagtag

SEQ ID NO: 185502 - DNA, 177 bp, Artificial Sequence
  Description of Artificial Sequence: Synthetic coding sequence
atgagcgaggccccccggttcttcgtgggccccgaggacaccgagatcaatcccggtaactataggcattttttccaccatgccgatgaggacgatgaggaagaagacgacagcccccctgaacgtcaaattgttgtcggaatttgcagcatggctaagaagtccaagtccaagtag

SEQ ID NO: 185503 - DNA, 2877 bp, Artificial Sequence
  Description of Artificial Sequence: Synthetic coding sequence
atgctgaagagcaagaccttcctgaagaagacccgggccggcggcgtaatgaagattgtgcgggaacattacctccgggacgatattgggtgcggggcccccgggtgtgccgcatgcggaggcgcccatgaaggtccagccctggagccacagccgcaggacccggcctcctcggtctgtccccagccgcattacctccttcctgacactaatgtgctgctgcaccagattgacgtcttagaggatcctgcgatccgcaacgtgatagtcttgcagaccgtactgcaagaagtgcggaacaggagcgctcctgtctataaacggatacgtgatgtcacaaataaccaggaaaagcacttttatacatttactaatgagcaccatcgcgagacctacgtcgaacaggagcaaggcgagaatgctaatgatcgaaacgaccgcgccatccgcgtggcggctaagtggtataacgaacacttaaaaaaaatgtcggcggacaaccagctccaggtcatattcatcacgaacgaccggaggaataaagagaaagctatagaggaaggtattcctgcatttacatgcgaagagtacgtgaaatcactgacggctaatccggaactcattgacagactggcatgcctctctgaggaaggaaatgagatagagtctggcaagatcattttctccgaacatttgccgctctccaagctacagcagggtatcaaatccgggacttacttacagggaacgtttcgagctagccgggagaattaccttgaggctacagtttggatacatggggacaacgaggaaaacaaagagatcattcttcagggcctgaagcacttaaatagagccgttcatgaggatattgtggccgtggaactacttcctaaaagccagtgggtggcaccaagttcagttgtgctgcacgacgaaggtcaaaatgaggaagacgtggagaaagaggaggaaaccgagaggatgctgaagaccgccgtgtcagagaaaatgttaaaacctactgggagggtggtaggtattattaagaggaattggcgaccctattgcggaatgttgtcaaagtctgacatcaaagagagcagaagacacctgtttacaccagcagacaaacgaattccccggatcaggattgaaactcggcaagcatcgaccctcgaagggcggcgtatcattgttgctattgacggctggccgagaaactcacgctaccctaatgggcatttcgtgaggaacctgggtgatgtgggggaaaaagagactgagactgaggttttgcttctggagcacgacgtcccccaccagccatttagccaagctgtcctgtcgttcttgcccaaaatgccttggagtattaccgagaaagatatgaaaaatagggaggatctgagacacctttgtatctgcagtgtagacccaccaggatgtaccgacatagacgacgcccttcactgccgggagctcgagaatggcaatctagaggttggcgtacacatcgctgacgtgtctcactttatccgcccggggaacgcgcttgatcaagaaagtgcccgccgggggaccacggtgtatttgtgcgagaaacgcattgatatggtccccgaactcttgtcttcaaatctgtgctcgctgaagtgcgatgtcgatagactggcctttagctgcatctgggagatgaatcacaatgccgagatccttaaaaccaagtttaccaagtccgtgataaatagtaaggctagcctcacatatgccgaagcccagctacgaatcgattcagctaacatgaatgatgacataacgacctccttacgcggactgaacaagttggcgaagattctgaagaaaaggcggatcgagaaaggggcactcacactgagctctcctgaagtccgcttccacatggattccgagacgcatgaccctattgatctccaaactaaagagctaagggagacaaattctatggtggaggagttcatgctgctggccaacatcagcgtggctaagaaaatccacgaagagtttagcgagcatgctcttctgcggaagcatccagctccccccccaagtaactacgagattcttgtgaaagcagctcgctcacgaaatctggagattaaaaccgacactgctaaatccctcgccgagagcctcgatcaggccgagtcccccacgttcccctacctgaacaccctgcttcgtatacttgccacacgctgcatgatgcaggccgtttatttttgttccggtatggataacgatttccatcattacggccttgcctcacccatctacacacatttcacctcgcctattcggagatacgctgacgtgatcgttcaccgcctattagccgttgccattggggccgattgcacttatcctgaactcacggacaagcacaagcttgcagatatttgcaaaaatctaaatttcaggcataagatggcccagtacgcccaacgggcctccgtcgcgttccatacccagttattctttaagtctaaaggaatagtgagcgaggaggcctacatcctgtttgtgcggaagaacgccatcgtcgttctgatccccaagtacgggctggaaggcaccgtgttctttgaagagaaggataaacctaacccacagctgatttacgacgacgagatacccagcttaaaaatagaggacaccgttttccatgtgtttgataaggttaaagtgaaaatcatgctcgactcatcaaatttgcagcatcagaagatcagaatgagcctggtcgaacctcagatccctggaattagcatacccacagacacttccaacatggatctgaacgggccgaaaaagaaaaagatgaaactgggtaaatag

SEQ ID NO: 185504 - DNA, 2391 bp, Artificial Sequence
  Description of Artificial Sequence: Synthetic coding sequence
atgagcgccgacaaccagctgcaggtgatcttcatcaccaacgaccggcgcaataaagaaaaggcgattgaggagggaattccagcctttacctgtgaagaatacgtaaagtctctgacagccaacccagaactgatcgatcggttggcatgcctaagtgaagagggcaatgagatagagagcgggaagatcatcttttccgagcacctccccctgtcaaagctgcaacagggcatcaagagcggaacgtacttgcaaggcacttttcgggcgagccgggagaattacctggaggctacagtttggattcacggcgacaatgaggaaaacaaggagattatcctgcagggcctgaagcatttgaacagagcagttcacgaggacatcgtcgcagtggaactgctgcctaaaagccagtgggtggctccatcaagcgtcgtgctccatgacgaggggcagaacgaagaagatgtggagaaagaggaggagactgagcggatgctcaagacagctgtttctgaaaagatgttaaaacctacaggcagggtagtggggatcattaagcgaaactggcggccttattgcggaatgctgtccaagtctgacataaaagaatccagaaggcatctattcactcctgcagacaaacgcattccacgcatcaggatcgagacacggcaggcaagtacattggagggccggaggatcatcgtcgccatcgacgggtggccccgcaacagccggtatccaaatggccatttcgtacgcaacctgggggacgtgggggaaaaggaaacggagaccgaggtgctccttctcgagcacgatgtgcctcaccagccattctcccaggctgtcttgagcttcttgccaaagatgccatggtctatcacagagaaggacatgaagaacagagaagacttaaggcacctgtgtatctgctccgtagatcctcctggctgtaccgacattgatgatgctctgcactgtcgggagctcgagaacggcaacctcgaagtgggcgtgcatatcgctgatgtttctcatttcatccgacccggcaacgcgttggaccaggagagcgcccggagaggcactacagtgtatctgtgtgagaagcgaatcgacatggtgccagagcttctgagctcaaacctgtgctctttaaaatgtgacgttgaccggctcgcctttagctgcatatgggaaatgaatcacaatgctgagatattgaaaactaagttcactaaatcagttattaattccaaggctagtctcacctatgcagaagcacagcttagaattgacagcgccaatatgaacgatgatatcacgacatccctgagaggcttgaacaagctggccaagattctcaagaaacgccgcatcgagaaaggggctctgacactgtcatcaccggaagtgagatttcacatggacagtgaaacacacgacccaatcgacctgcagacaaaggagctgcgggaaaccaactctatggtcgaagagtttatgttgctggctaatatttcggttgccaaaaagattcatgaggaattctctgagcacgcattactgagaaaacaccccgccccccctccttccaactatgagattctggttaaggctgccaggtctcgaaacttggagataaagacagacacggcaaagtccctggccgaatccttggaccaagccgaatctccaacgtttccttatctgaacacactgcttaggatcttggcaacccggtgcatgatgcaagccgtgtacttttgtagcggaatggataacgattttcaccactacggcctagctagtccaatttatacccattttacctctcccatacggaggtatgctgatgttattgtgcaccgcctgctggcagtggccataggggctgactgcacatatccggagctaaccgacaagcataaacttgccgatatctgtaagaatcttaatttcagacacaaaatggcacagtacgctcagagggcgtccgtggcatttcacacacagttattcttcaaaagtaagggtatcgtgtcagaagaagcctatattctgtttgtgcggaagaacgcgatcgtggttttaattccaaagtacggtctcgaagggacagtgtttttcgaggagaaagacaagccgaacccccaattaatctatgacgacgagattccctctctaaaaatcgaggataccgtgtttcacgtttttgacaaagtcaaggtcaaaatcatgctggacagcagtaacctgcagcaccagaagatccgcatgagtttggtggaaccgcagattcctggaattagtataccaactgatacgtctaatatggatctcaatggccctaaaaaaaagaagatgaagctgggcaagtag

SEQ ID NO: 185505 - DNA, 2787 bp, Artificial Sequence
  Description of Artificial Sequence: Synthetic coding sequence
atgctgaagagcaagaccttcctgaagaagacccgggccggcggcgtgatgaaaattgtccgcgagcattacctgcgggatgacataggttgtggcgcccccggctgcgcagcttgcgggggagctcacgagggccctgcgctcgagcctcagccccaggacccagcgagcagtgtttgcccacagcctcactatttgctgcctgatacaaacgttctgctgcaccagatcgtttcagcctggaggcccggaacatgggcttccgtggcttcttcgctacggttgcccggcagcttggagacatacgtcgaacaggaacagggggagaacgcaaacgaccgcaacgacagggctattagagtggccgctaaatggtacaacgagcacctgaaaaaaatgtcagccgataaccaactgcaggttatctttatcacaaacgatcggcggaataaggagaaagctattgaagaggggattcctgccttcacatgtgaggagtacgtaaaatccctcacagcgaatccggagctgatagatcgtttggcttgtctgtctgaggaagggaatgagatcgagtccggaaagatcatattcagtgagcacctgcccctgtctaaactgcagcagggaatcaagagtggtacatatttacaagggacattccgagcctctcgcgagaactacctggaagccactgtgtggatacacggcgataacgaggagaacaaggagataattctgcagggcctaaagcacttaaatcgcgccgtccatgaggatattgtggctgtcgaattgctcccaaaatcacaatgggtggccccaagctccgtcgtgttgcatgacgagggacaaaacgaggaggatgtggaaaaggaggaggagactgagagaatgcttaaaacagccgtctctgagaagatgctgaaacccacaggtcgggtggtgggcataattaaaagaaattggaggccatattgcggtatgctttctaagtcagatataaaggagagccgtcggcatctgttcacgcccgctgataagcgaattccccgtattcgcatcgaaacaagacaggccagcacacttgagggtagacgcatcattgtggccatagatggctggcccaggaatagccgctatccaaacggacacttcgttagaaatctgggtgacgtgggagagaaagagacagagacagaggtgttgctactagagcatgacgtgccacaccagccattttcccaggccgttcttagcttcttgccgaagatgccatggtcaattaccgagaaagacatgaaaaaccgcgaagacctgaggcatttgtgcatctgttctgtcgatcccccgggctgcaccgatatcgatgatgccctccattgtagagagcttgagaacggtaacctggaagtgggggttcacattgccgacgtatcccatttcatccggccaggcaatgctctcgaccaggaatccgcgagacggggaaccaccgtgtatctgtgtgagaaaaggatcgacatggttcccgagctgctttcatccaacttgtgttccctaaagtgcgatgtcgaccggctggcattttcctgtatttgggagatgaatcacaacgccgagatcctgaaaaccaagtttacaaagagcgtcattaatagcaaggcatccctgacctacgctgaagcgcagctgcggattgactctgcaaacatgaacgacgatataaccacttcactgagaggactaaataaactggccaaaattttgaagaagagaagaatagagaagggcgctcttacgctgtcatcacctgaggtgagatttcatatggatagcgagacccacgaccctatcgacctccaaactaaggagttgagagaaaccaactctatggttgaagaatttatgttactggctaatatctcggttgctaagaagatacacgaggaattctcggagcacgctctgctgcgaaagcaccctgcccctccaccatctaattacgaaatcttagtgaaggcagcaagaagcagaaacctggagattaagaccgacacagccaagagtttggccgagtccctggatcaggcagagtctccaacgtttccctatctgaatactcttctccggattttagccacacgctgtatgatgcaggcggtttatttctgcagtggcatggataacgatttccaccattacggtctggcctcccctatttacacacacttcacctccccgatacgacggtatgcagatgtgattgtacacaggctgcttgctgttgccattggtgcagactgtacatatcctgaactgaccgataagcacaaattggcggacatatgcaagaacctgaactttagacacaagatggcccagtatgctcaacgagcctccgtggcattccatacccagttgttctttaagtcaaaggggattgttagcgaggaagcatatatcctgttcgtgaggaaaaacgccatagtggtactgatcccaaaatatgggctggaagggactgtcttcttcgaggaaaaggacaagccaaacccacagctgatttacgatgacgaaattccctctttaaagatcgaggacactgtgtttcacgtctttgacaaggttaaggtgaaaatcatgttggactcttctaatctccagcatcagaagattcggatgagtctggtggagccccagatccccgggatcagtatcccgacggatacgtcaaacatggatctcaacgggcctaagaaaaagaagatgaagctgggtaaatag

SEQ ID NO: 185506 - DNA, 2916 bp, Artificial Sequence
  Description of Artificial Sequence: Synthetic coding sequence
atgcagaccgcctgccaggccgtgcagcaccagcggggccggcggcagtataataagctccgcaatctcctcaaggacgcaagacacgattgcatcctgtttgccaacgagttccagcaatgctgctacctacctagagaaagaggggagtccatggagaaatggcagacccgcagtatctataacgcagccgtttggtactatcaccactgtcaggatcggatgccaatcgtcatggtcactgaagacgaggaggccattcagcagtacggctcagagaccgaaggagtgttcgtgattaccttcaagaattatcttgataatttttggcccgatctgaaagcagcgcacgaattgtgcgattcaatccttcagagcaggagagaaagagaaaacgagtctcaggagtctcacggcaaggagtatccagaacatttaccattggaggttctggaggctgggatcaaaagtggccgatacattcagggcatcctgaacgtgaataaacaccgagcacaaatagaggccttcgtgcgattgcagggcgcctcaagtaaagatagcgatctggtgtctgacatcctgatccacggcatgaaggcccgcaaccggtctatccatggcgatgtagtcgtggtcgagttgttacctaagaacgagtggaaggggaggaccgtggctctgtgtgagaacgattgtgatgataaggcgtcaggcgagtctccttccgagcccatgccaactggccgcgtggtagggattctgcagaaaaactggagggactacgtggtaactttccctagcaaagaagaggttcagtctcaaggaaaaaacgctcaaaaaatcctcgtgaccccctgggactaccgcatccccaaaatacggatatctacccagcaagctgaaacccttcaggattttagggtggttgtgcggatcgactcatgggagagcacatccgtgtaccccaatggacactttgtaagggtcctgggcagaatcggagacctggagggagagatcgctaccatcttagttgaaaatagcatcagtgtcatccccttttcagaggcccagatgtgtgagatgcctgttaatacccctgaatcaccatggaaggtctctccagaggaggagcagaaacgaaaggacctgaggaagagtcatctagtgttcagtatcgatcccaaagggtgtgaagacgtggatgataccttgagtgtcagaactctgaataacggaaatctcgagctgggcgtccacatcgctgacgtgacgcatttcgtggctccaaactcttatatcgacatagaggcacgcacacgcgccaccacctattacctcgctgatagacggtacgatatgcttccatccgtgctgagcgctgacttatgttccctcctgggtggtgtggaccgctatgctgtgagcatcatgtgggaattggataaagccagctacgagatcaagaaggtttggtacggaagaactataatacgcagcgcgtacaagctgttctacgaagccgctcaagagcttctggatggcaatctctccgtcgtggatgacattcccgagttcaaagacttggacgaaaaaagccgacaggctaaactggaggaactggtatgggcgatcgggaaactcaccgacatagcccgccatgttagagccaaaagagacggttgcggtgctttggagctagaaggcgtggaagtgtgtgtgcaactcgacgataaaaagaatattcacgacttgataccaaagcagcctcttgaagttcatgagacagtggcagaatgtatgatccttgccaatcactgggtggcaaaaaagatctgggagagctttccacaccaggctcttctacggcagcaccccccaccacaccaggagttctttagcgaattgagagaatgcgcaaaagccaagggtttttttatcgatacgagatctaacaaaactttggctgacagcctggataacgctaatgatccacacgacccgattgtcaatcgcttattgcgctccatggcgacccaggccatgtctaatgccctttactttagcacaggatcgtgtgccgaagaggagttccaccactacgggctcgctttagataagtatacgcattttacaagccctattagacgctactccgacatcgtcgtacatagactcctgatggccgccatctccaaagataagaaaatggaaattaaaggcaacctcttctctaacaaggatttagaggagctgtgccggcatatcaacaatcggaatcaggctgcacagcattctcaaaagcagtccacagagttgtttcagtgtatgtacttcaaagacaaggatccagctacagaagagaggtgtatcagcgacggggtgatctactcgataagaaccaacggggtgctgctattcatcccaagatttgggattaagggcgctgcctatctcaagaacaaggacgggctcgtgatctcatgcgggccagatagctgctctgagtggaaacccggcagtctacagcgatttcagaacaaaattacttccacaacgacggacggcgagtccgtgacatttcacctgttcgaccacgtgacagtgcgaatttccatccaagcttcacggtgccacagtgatacaattcggctagagataatctctaataaaccctataagatcccaaatacagaactcattcaccaaagctcccccctcctaaaaagtgagttagtcaaggaagtcactaaaagcgtagaagaggctcagctagctcaggaggtcaaggtgaacataattcaggaagagtatcaggaatatcggcaaacgaaggggcgatccctgtacacactgctcgaagagatccgggaccttgctcttctggatgtctcgaataactacggaatttag

SEQ ID NO: 185507 - DNA, 3165 bp, Artificial Sequence
  Description of Artificial Sequence: Synthetic coding sequence
atgctgcagaagcgggagaaggtgctgctgctgcggaccttccaggggcggacactcaggatagttcgggagcattacctgagaccatgcgtgccatgccacagtcctctgtgtccgcaaccagccgcctgttcccacgacggaaaattgctctcttcagatgtaacccattacgttataccagactggaaggtcgtccaggactacctggagattcttgaatttccagagctgaagggcatcatcttcatgcagacagcttgtcaggcagtacaacatcaacgggggcgtcgtcaatacaacaaactgcgaaacctgttgaaggacgcgcgtcatgactgtatcctcttcgccaacgagttccagcagtgttgttaccttccgcgggagagaggggagagtatggagaagtggcagacccggtcaatttacaacgccgctgtttggtactaccatcattgtcaggaccgcatgcccattgtaatggtaacagaagacgaggaggctatacaacagtacggatccgaaactgagggcgtttttgtgatcaccttcaaaaactacctggataacttctggcctgatttaaaggctgctcatgaactgtgcgattctattcttcaaagccgaagagagagggaaaatgaaagccaggaatcccacgggaaggaataccccgaacacctcccactcgaagtgctcgaggctgggatcaagtctggtcgctatatccagggcatactcaacgtcaacaaacatcgcgcccaaatcgaagcctttgttagattacagggagcctcatctaaggattctgacctggtctcggatattctcatccatggaatgaaggccagaaataggtccattcacggcgacgttgtagtggtagaattgctgcccaagaatgaatggaaaggacgaacagtggctctctgcgagaatgactgcgacgataaggcttccggcgagtccccttctgagccaatgccaaccgggcgcgttgtcgggatacttcaaaaaaattggcgagactatgtcgtcacctttccaagcaaagaggaagtgcagtcacaaggcaagaacgcccagaagattctggtgacaccttgggattacagaatacctaaaatcaggatttccacacagcaagctgaaaccctgcaagacttccgggtcgtggtgcgcatcgacagctgggaaagtacctccgtttatccaaacggccacttcgtccgggtgctgggcagaatcggtgatctggaaggcgagatcgccacaatactggttgagaattctatatcggtgataccatttagtgaagcccagatgtgtgagatgccagtgaatacaccagagagcccatggaaagtgagcccagaagaagaacagaagcgaaaagacctcaggaaatcgcacctcgtgttttccatcgatccaaaagggtgcgaagatgtggatgatacattatccgtgcgtacactaaacaacggaaacctcgaattgggcgttcacattgctgacgtaacccactttgtggccccgaattcttatatagacatcgaagctaggactagggccactacatattatctagctgacaggaggtacgatatgcttccaagcgtcctgagcgctgacctgtgtagcctcctgggtggcgtcgatcgctacgcagttagcatcatgtgggaacttgataaggccagttacgaaatcaaaaaggtgtggtacggcagaacaatcattagatctgcctacaagttgttctatgaggccgctcaggagctgctcgacggcaatctttccgtcgttgatgatataccggagttcaaggacctcgacgagaagtcgaggcaggccaagctggaagagctcgtttgggcaatcgggaagcttaccgatattgcaagacacgtgcgcgcaaaacgcgacggatgtggggccctcgaactcgagggggtcgaggtttgcgtgcagcttgacgacaagaaaaatatccatgatttaatccccaagcagccgttggaggtgcacgaaacggtggcagaatgcatgatcctggcaaatcattgggtagccaaaaaaatctgggaatcttttccccatcaggccttactacggcagcaccccccaccccaccaggagttcttttcagaattgcgagaatgcgccaaggccaaaggtttctttattgacactagaagcaataagacattagcagatagcctggataatgctaacgatccccacgatccaatcgttaaccgactgttacggtccatggcgacgcaggctatgtccaacgccctctatttcagcaccggcagttgcgcagaagaggagttccaccactatggacttgctcttgataagtacacccacttcacatccccaattcggaggtatagcgatatagtggtacacagacttttaatggccgctatctctaaagacaagaaaatggagatcaagggcaacctcttctcaaacaaggatttggaagagttatgcagacatattaacaaccgcaaccaggcagcccagcatagccagaaacagtcaaccgagctcttccaatgtatgtacttcaaggacaaggaccctgccacagaggaacgatgcatatccgacggcgttatttattctatacgcaccaacggggtgctcctctttatcccacgctttgggattaaaggagccgcgtacctgaagaataaggatggattggtcatctcttgcggaccagactcatgttctgagtggaagcctgggagcctgcaacgtttccagaacaaaattaccagtactaccacagacggagaatctgtgaccttccacctctttgatcacgttactgtaaggatttccatccaggcctcccgatgtcattctgatacaatccgcctggaaatcattagtaataaaccgtacaagatacccaacacagaactgatacaccaatcatctcctttactcaagtcagagctggttaaagaggtcacgaagtctgtcgaggaagctcagctggcacaggaggtaaaagttaacattattcaagaagagtaccaggaatatcgacagaccaaaggcagaagtctgtataccctgctggaggagatacgagatctggcactgcttgatgtctcaaataactatggtatttag

SEQ ID NO: 185508 - DNA, 762 bp, Artificial Sequence
  Description of Artificial Sequence: Synthetic coding sequence
atggagaagtggcagacccggagcatctacaacgccgccgtgtggtattatcatcactgtcaggatcgcatgcctatcgtcatggtcactgaggacgaagaagcaatccagcagtacgggagcgaaaccgagggagtgttcgtcattaccttcaagaactacctcgacaacttctggccagacttgaaggcagcccatgaactgtgcgattcgattctccagtctcgcagagagagagaaaatgaatcacaggaaagccatgggaaggaatatcctgagcatctgccactggaggttctggaggcgggcataaaatcagggcgttatattcaggggatccttaacgtgaataagcacagggcccagatcgaggcttttgtgaggttgcagggtgccagttccaaggatagcgatctggtatccgatatactcattcatggcatgaaagcgcgaaatagatcgatccacggcgatgttgtggtggtggagcttctcccaaaaaatgaatggaaaggcaggacagtggctttgtgtgagaatgattgcgacgacaaggcaagtggagagagcccaagcgagcctatgcctactggactgcagggaggcagagcgcaccggtttcttggagtcaacatttgcgttagcaagtggacgttctgtgcatgttttcgaaagaacaggagatcagggagagggaattgcaaccatcctggtggcaagcagtacttttcgtatagcttcttacggtccagcgacgtgtag

SEQ ID NO: 185509 - DNA, 453 bp, Artificial Sequence
  Description of Artificial Sequence: Synthetic coding sequence
atggagaagtggcagacccggagcatctacaacgccgccgtgtggtactaccaccattgccaggataggatgcctatcgtgatggtgaccgaggacgaagaagctatccaacagtacgggagcgagacagaaggtgtatttgtcatcacctttaaaaactacctggataatttttggcccgacttaaaagccgcccatgagttgtgtgatagtatcctgcagtcgcggcgtgaacgggaaaatgagagccaggagtctcacggaaaggagtaccctgagcacttgcctctcgaagtgttggaggctggcattaagtctggtcggtatatacagggaatcttgaacgtaaataaacacagagctcaaatcgaagcctttgtccgtctccagggagcaagctccaaggattccgatctggtcagcgatatactaatccacggaatgaaggcctag

SEQ ID NO: 185510 - DNA, 174 bp, Artificial Sequence
  Description of Artificial Sequence: Synthetic coding sequence
atgcagaccgcctgccaggccgtgcagcaccagcggggccggcggcagtataataagctgcgaaacttactgaaggatgcacgtcatgactgtatcttgtttgccaatgagtttcagcagtgttgttatcttcccagagaacgcggagagagtatggagaaatggcaaacatag

SEQ ID NO: 185511 - DNA, 294 bp, Artificial Sequence
  Description of Artificial Sequence: Synthetic coding sequence
atgcagaccgcctgccaggccgtgcagcaccagcggggccggcggcagtacaataagcttagaaatctcctgaaagatgcgcggcatgattgtatcctgtttgccaacgagttccagcaatgctgctatctcccccgagagcgcggggaaagcatggagaaatggcagaccaggtcgatttacaatgccgctgtgtggtactaccatcattgtcaggacaggatgcctatcgtcatggtgacagaggacgaagaagccatccaacagtacggttccgaaactgagggcgtgtag

SEQ ID NO: 185512 - DNA, 312 bp, Artificial Sequence
  Description of Artificial Sequence: Synthetic coding sequence
atgcagaccgcctgccaggccgtgcagcaccagcggggccggcggcaatacaacaagctgcgaaacctgttaaaagatgctcgtcatgactgtatcctgtttgcaaacgagtttcagcagtgctgctacctgccacgagaaaggggagaatcgatggagaagtggcagacacggtccatatacaacgctgccgtgtggtattatcatcattgtcaagaccggatgcctatcgtcatggtgacagaagacgaggaagccatccagcagtacgggtctgaaactgagggtgtgtttgtcatcacgtttaaatag

SEQ ID NO: 185513 - DNA, 1812 bp, Artificial Sequence
  Description of Artificial Sequence: Synthetic coding sequence
atgagccaccccgactaccggatgaacctgcggcccctgggcaccccaagaggcgtgtcagcagttgcagggccccatgacattggcgccagtccaggggataagaaatccaagaatcggagtacgcgggggaagaagaagtccatcttcgagacatatatgtcgaaagaggatgtatccgaaggcttgaaaagaggcaccctgatccagggtgtgctacggatcaatccaaagaaattccacgaagcttttatcccatcacccgatggagatcgcgatattttcatcgacggcgtcgtggctcgcaatcgagccctgaatggagatctagtggtggttaaactgctcccggaagaacattggaaggttgtcaagccagagtccaacgacaaggaaactgaggctgcgtatgaatccgatatccccgaagaactctgtgggcatcacctgccccagcagagcctaaaatcctacaatgacagcccagatgtgatcgttgaggcacaatttgacgggtcagactccgaagacggacatggcatcacacagaatgttttggttgatggcgtgaagaagctcagcgtgtgtgtctctgaaaagggaagagaggacggcgacgctccagttactaaggatgagaccacttgcatatcacaggacactcgcgcactcagcgaaaaatctctccaacggtccgccaaggttgtgtatatcctggaaaaaaaacactcgagggctgccacggggttcttgaagttgcttgccgataaaaatagcgagctgtttaggaaatacgccctcttctcaccttccgatcatcgcgtcccgagaatctatgtgcctctgaaggattgtcctcaagacttcgtggctaggccaaaggactatgcgaataccctgtttatttgccgtatcgtagactggaaggaggattgcaacttcgccctcggccagcttgcgaagtctctgggacaagccggagaaatcgagcctgagacggagggcattctgactgagtacggcgtggatttctcagatttcagctccgaggttctcgagtgcttaccacaggggctgccttggaccattccgcccgaagagttctcgaagaggagggaccttagaaaagactgtatatttactatcgatccttctactgcgagagatctggatgatgcactgtcatgtaaaccattagcagatggaaatttcaaagttggagtgcacatcgcagacgtgtcctattttgtcccagaaggcagcgacttagacaaggttgcagctgagagggcgacgtcagtctacctggtacaaaaagtcgtgcctatgttgcccaggcttctctgcgaagagctgtgctctctgaatccgatgtctgataagctgacattctctgttatctggacattaactccagaaggcaagattctagatgagtggtttgggagaaccattatacgatcgtgcacaaaattaagctatgaacacgcacagagtatgatcgagagccccacggaaaaaatcccggctaaggaactcccgccaatttcccctgagcacagtagtgaggaggttcaccaacagaatgctgacaaggatggtgccgcacacttgcaggctagtcacagccccagcgctgaggatgcagaggcccaaccttccacagaagagcgcctcccggaaacacgcggcatttgcgaccgtgaccccgacacccgactgttttttctccagcagcagagtcgggtactggaggcaaagccccagaacacaattcgagtggaggaacagactacacagctgcaaatttag

SEQ ID NO: 185514 - DNA, 2658 bp, Artificial Sequence
  Description of Artificial Sequence: Synthetic coding sequence
atgagccaccccgactaccggatgaacctgcggcccctgggcaccccacgtggcgtttccgcagtggctggcccccacgacatcggagcttctccaggagacaagaagtccaagaataggtccacccggggaaagaaaaagtcaatctttgagacctatatgagcaaggaggatgtttctgaggggctgaaacggggcacactaattcagggagtgctgcgtattaatcctaaaaagtttcatgaggccttcattccttctcccgacggcgacagggacattttcatcgatggagttgtagccaggaatcgggcactgaatggcgacctcgttgtggtgaaattgttgccagaggagcactggaaagtagttaaacccgaatccaacgataaagaaacagaggcggcttatgagtcagatatccccgaggagctgtgtgggcatcacctgcctcaacagtctctcaagagttacaatgactcccccgatgtcattgtagaggcacagtttgatggaagcgattctgaggacgggcacgggataacccagaatgtgctcgtggatggtgttaagaagttgtcagtatgtgtatctgaaaaagggagagaggacggcgatgcccctgttacaaaggatgagacgacttgtattagtcaggacacccgagcactgtcagaaaaatcgcttcagcgcagtgctaaagtggtgtacatcttagagaagaaacattcaagggccgctacagggttccttaagctacttgcagataaaaatagcgaacttttccgaaaatatgcactgttctcacccagcgaccacagggttccaagaatatacgtgccccttaaggactgcccccaggactttgtggctagacccaaagactatgcaaacactctttttatctgccgaattgtggattggaaagaggactgtaacttcgctctaggacagctggctaaatcccttgggcaggcaggagaaatcgagcctgagaccgaaggaatcctcacagaatacggcgtagacttttccgacttctcatctgaagtgctggagtgtctcccgcagggcctgccttggaccatcccgccagaagagtttagcaaacggagggatttgaggaaggattgcatctttactattgacccgagtacagctcgggatctggatgacgccctgtcttgtaagccactcgcagacgggaacttcaaagttggcgtgcacattgcggatgtctcctattttgtgcccgaggggagcgatctcgataaggtggcagccgagagagccacaagcgtctatctggtgcagaaggtggtgcccatgcttccaagactcctctgcgaagagctgtgcagtctgaaccccatgtctgacaaacttactttttccgtgatttggactctgactcctgagggaaagattcttgacgagtggtttggacggacgatcatccgttcctgtactaaattatcctacgagcacgcacagtccatgatcgagtctcctactgaaaagatcccggctaaagagctcccccctatatccccagagcatagctcagaagaagttcaccaggctgttctgaatctccacgggatcgcaaagcaactgcggcagcagcggtttgtagatggcgctttacgcctcgaccagctcaaattggcgttcaccctagatcacgagaccgggctgcctcaagggtgccacatttacgagtaccgcgagtccaataagttagtagaggagtttatgttgctggcaaacatggctgttgcacacaagattcatagggctttccccgagcaagctctgctgcgaagacatccaccaccccagacaaggatgctatcagatctagtggagttttgtgatcagatgggattgcccgtggattttagctctgccggtgccctgaataagagcctgactcagacctttggggatgacaagtacagcctagcgaggaaggaggtactcacaaatatgtgctcccgcccaatgcagatggctctatacttttgttcgggtttactgcaggaccccgcccagtttcgccattacgctcttaatgtaccactgtacacgcacttcacctcaccaatcagacgcttcgcggacgttctcgtgcacaggctgctcgccgcagcgctggggtaccgggagcgtctagacatggcacccgacacattgcaaaaacaggcggaccactgtaacgaccggcgcatggctagcaaacgcgtgcaggagttaagtacctccttgttcttcgccgtgctggttaaggagtccgggcccctggagtccgaggccatggtgatgggcatcctcaagcaggcctttgacgtgctggttctgcggtacggggttcaaaagaggatctactgtaatgctttagctctgcgatcccatcactttcaaaaagtcgggaaaaagcccgagttgacactggtttgggagcctgaggacatggagcaagagcccgcacagcaggtgatcactattttctcacttgtcgaggtggtgctgcaggctgaatctacagctctcaaatacagtgcgatcctgaagcggccggggacccagggccatttaggacccgaaaaggaagaggaagagtctgatggcgaaccagaggacagctcgactagctag

SEQ ID NO: 185515 - DNA, 1071 bp, Artificial Sequence
  Description of Artificial Sequence: Synthetic coding sequence
atgagccaccccgactaccggatgaacctgcggcccctgggcaccccaaggggtgtttccgcggtcgccggacctcacgacatcggggcctccccgggagataaaaaaagtaagaacagaagtactcgcggaaaaaaaaagagtatcttcgaaacatacatgtccaaagaagatgtgtcagaggggcttaaaaggggcacactgattcagggggtcctcagaatcaacccaaagaagtttcacgaggccttcatcccatcgccagatggcgatagggatatcttcattgatggagtagtcgccagaaacagagccctgaacggcgatttggttgtcgtcaagcttctaccagaagaacattggaaggtcgtgaaaccagagagcaacgataaagaaacggaagcagcgtatgaatctgacattccagaggaactgtgcggccatcacttacctcaacaaagcctgaagtcttacaacgactctcccgacgtcatcgtggaagctcaatttgatggatcagactctgaggacggccatgggatcactcagaacgttctggttgatggagttaagaagctgagcgtgtgtgtctccgagaaggataacgagattgaagcacagaggagctcttgggcttatccagtgagtcacaggaagagcgaagagcgcatggtgatgcacaggctgcagaagatgcggccacccgctttccacaagactcaggaactgtatcggaggaatccttgtaaggaccagcaaaggtggttcacctcttggaggaaaaatatactagagcagcagcctgcaagctcaaacagctggctgatccgtaccgctaactgcctcgggaacacaccttgtttcttgccacagacaaccgaatgcttagagttcatgtgtttgtctaggaccgtgccacgtacgctttggcatggattaaagatcatgcctactcattgctccagcgctgcgctgtggaccggaagaaggacagcgatcttaccttggggctcttggctgcgggttttaggtcggctcgttaagcttagcttaaaacagaaggagtattag

SEQ ID NO: 185516 - DNA, 2658 bp, Artificial Sequence
  Description of Artificial Sequence: Synthetic coding sequence
atgagccaccccgactaccggatgaacctgcggcccctgggcaccccaaggggcgtttcagccgtggctggcccccacgacattggagcctcaccaggtgacaaaaaaagtaagaaccgctctacgagaggaaaaaaaaagagcatcttcgagacttacatgtcgaaggaggatgtctccgaaggactcaagcgcggaacactcattcagggggtattaagaatcaaccctaagaagttccacgaagctttcattccttctccggacggtgacagagatattttcattgatggcgttgtcgccaggaacagagctctgaacggcgacttagtcgtggttaagctgcttccagaggaacattggaaggtcgtcaaacctgagtctaacgacaaggagacagaagctgcctacgagagcgacatccctgaggaattgtgtggccaccacttacctcagcaatctctcaagtcatataacgatagcccagacgtaatcgtagaagcccagttcgatggaagtgacagcgaggatgggcacggaatcacacagaatgtcctggtcgacggcgttaaaaagctgtcagtatgcgtgtccgaaaagggccgagaggatggcgacgcccctgtgaccaaagacgaaactacctgcatatcacaggacacccgagccctgtccgagaagtccctacaacggagcgctaaggtggtgtatatcctggagaagaaacacagtagggccgcaacaggctttttgaagctgcttgcagacaagaatagtgagctttttagaaagtacgctcttttcagccctagcgaccatagggtgccccggatttacgttcccctgaaggattgccctcaggatttcgtagcacggcctaaggattacgcaaacaccttgtttatttgcagaattgtggactggaaggaagattgtaacttcgctctgggacaactggccaaaagccttggacaggcaggcgaaatcgagcctgaaaccgagggaattctcaccgaatatggggtggacttcagcgacttttcaagtgaagtgctagagtgtctccctcagggattgccctggacaatccctccagaggaattttccaagaggagagacctccgcaaagattgtatttttactatcgatccatctaccgctagagacctggatgacgcgctgtcatgcaagccactggccgacggaaacttcaaagttggggttcacatcgccgatgtatcctattttgtccctgagggcagtgaccttgacaaagttgctgctgagagagcgacttctgtgtatctggtgcagaaagtggtgccaatgttgccccggttactgtgcgaggaactgtgtagtttgaacccaatgagcgacaagttaacattcagcgtcatttggacacttactcccgagggcaaaattctggacgaatggtttgggcggacaatcatccgatcttgtacaaagctgtcttatgaacatgcccaatctatgattgaaagccctactgaaaagatcccagctaaggagcttcccccaatttcccctgagcattcttccgaggaagtgcatcaggcagtgctgaatcttcacggcatcgctaaacagcttagacagcaacgcttcgtggatggagctctccgactggatcagctgaagctggccttcactctggatcatgaaactggactgccacagggctgccacatctacgaatatcgagagagtaacaagttggtcgaggagtttatgctgctagctaacatggccgtggcccataaaatacaccgcgcgttccctgagcaggctctgctgcggaggcatccacccccacaaacaagaatgctctcggatctcgtggagttctgcgaccaaatggggcttccggttgacttctcttctgctggggctttaaacaagtccctgacccagacgtttggggacgacaagtactcacttgcccggaaggaggtgctgactaatatgtgctctaggccgatgcagatggcattatatttttgcagcggcctgttacaggacccagcccaatttcgacactatgccctgaacgttcctctctatacgcatttcacaagcccgatccgccggttcgccgacgtgctagtgcataggttgctcgcagcggctcttggatatagggaaagacttgatatggcgcccgataccctccagaagcaggctgaccactgtaacgatcgccggatggcctctaaaagggttcaggagctctctacatctctattcttcgctgtacttgttaaagagagcgggcctctggaatctgaagccatggtaatgggaattttaaagcaggcctttgatgtgctcgtgctaagatacggtgttcagaagaggatctattgcaacgctctcgccctacgctcccatcactttcagaaggtgggcaaaaagccagagctgactctggtgtgggaacctgaagacatggagcaagagccagcacagcaggtgattaccatttttagtttagtggaggtggttttgcaagccgaaagcacagcactgaaatatagtgccatcctcaagcggcctggtacccagggtcacctgggtcccgagaaggaggaggaagaaagcgatggggaaccagaggacagcagtacttcctag

SEQ ID NO: 185517 - DNA, 750 bp, Artificial Sequence
  Description of Artificial Sequence: Synthetic coding sequence
atgagccaccccgactaccggatgaacctgcggcccctgggcaccccccgtggagtgagcgctgtagcgggaccccacgatataggcgcttcccctggtgacaagaaatccaagaacagatctactcgcggtaaaaagaagtctattttcgagacatatatgagcaaagaggacgtcagcgaagggctcaagcggggcacactcatccagggggtattgagaattaaccccaagaaatttcacgaagcctttattcctagtccagacggcgacagagacatattcattgatggtgttgtcgcccgtaatagagctctgaacggcgatctggttgtcgtgaagctgttgccagaagaacactggaaagtcgtgaagcccgagtccaacgataaggaaaccgaggcggcttacgagtccgacattcctgaggagctctgcgggcaccatctccctcaacagtccctcaagtcttataacgatagcccggacgtgattgtcgaggctcagtttgatgggagcgattccgaagatggccatggaatcacccagaatgtgctagtggacggcgttaaaaagctgtccgtctgtgttagcgagaaggggcgggaggacggagatgcacctgtgactaaagacgagacgacatgcatatcccaagatacccgcgctctgagcgaaaagagcctacagaggtcagccaaggtgatcgcttataggttttctccaagagtgcagatggccttcacatag

SEQ ID NO: 185518 - DNA, 2028 bp, Artificial Sequence
  Description of Artificial Sequence: Synthetic coding sequence
atgagccaccccgactaccggatgaacctgcggcccctgggcaccccaaggggggtgtctgctgtggctggcccacacgacatcggcgcctcccctggggataagaagtccaagaacagatcaacacgcggtaagaagaagtccatcttcgagacttatatgtccaaagaggatgtgtcagagggactcaagagaggaaccctgatccaaggagtgcttcgtattaacccgaaaaagttccacgaagcctttattcctagccccgacggagatcgggacatcttcatcgacggcgtcgtcgcccgcaatcgcgcattgaatggcgatctggtggtggtaaaattgctcccagaagagcactggaaggtcgtcaagccagaaagcaatgataaggaaacagaagctgcttatgagtcagacattccagaggagctctgcggtcaccacttgccacaacagtccctgaagtcgtacaatgactcgcccgatgttattgttgaagcccagtttgatgggtccgatagtgaagatggtcacgggatcacccagaatgtactggtcgacggagtcaagaagctctccgtgtgtgtgtctgagaaggggagggaagacggggacgctcctgtgaccaaggacgagacgacatgcatatcgcaggatacccgggctctgagcgaaaaaagcctgcagcgaagcgctaaggtcgtgtacatactggaaaagaagcactctcgagccgccaccgggtttctcaagctgctggctgacaagaactccgagctgttccggaaatatgcactcttttcaccatccgatcatcgggtcccacgcatctacgtgcccttaaaagactgtccccaggacttcgtggctcgccccaaagattacgctaacaccctgttcatctgcaggattgtggattggaaggaggattgcaatttcgcactcgggcagctagctaagtcactgggtcaggctggagagatagagcctgagaccgaggggatcctgacagaatacggcgtggacttttcggatttcagttcagaggtgctggagtgtcttccacagggccttccctggactatcccgcccgaagaattcagcaaacggcgcgaccttcgtaaggattgcattttcacaattgatccctctacagcaagggatttggacgatgccctcagctgcaagcccctagccgacgggaattttaaggttggagtccacatcgcggatgtgtcctacttcgtccctgaggggtcagacttggacaaggtggcagcggagcgggctacctccgtttatctcgtgcagaaggtggtcccaatgttgcctagactgctttgtgaagaactctgctcactcaatcctatgtccgataaacttacatttagcgtgatatggaccctgactcccgagggaaaaatccttgatgagtggttcgggagaaccattatccgctcctgcacgaaactttcatacgaacacgcccagtccatgattgagtccccaaccgagaagatcccagccaaggagctgcctcctatttcacccgagcattcttccgaagaagtccaccaagccgtcctgaatctacatgggattgccaaacagttgcgccagcaacgcttcgtggatggcgccctgcggctggatcagttaaaactggcattcacgcttgatcatgagaccggacttccacagggctgtcacatttacgaatatcgggagagtaataaactggtggaagagtttatgttattagctaatatggccgtcgcccacaaaatccaccgtgcctttcccgagcaagccctactaagacgacacccgcccccacagacacgcatgctgtccgaccttgttgagttctgcgaccagatggggctgcccgtggacttctccagtgccggagccctaaacaagtcacttactcagacgtttggtgatgacaagtatagcctggctagaaaggaggttctgaccaatatgtgtagtagactccccgttccaccacattggctgtag

SEQ ID NO: 185519 - DNA, 435 bp, Artificial Sequence
  Description of Artificial Sequence: Synthetic coding sequence
atgagccaccccgactaccggatgaacctgcggcccctgggcacccctagaggggtgagtgccgtggccgggccacatgacataggagcaagcccaggggacaaaaaatctaagaaccgatctaccaggggcaagaagaagtccatttttgaaacatacatgtctaaggaagacgttagtgagggcctgaaaaggggcacgttgattcaaggcgtcctacgaattaacccaaagaaatttcatgaagcatttatcccatcccctgacggggaccgggacatcttcatcgatggcgtggtggctcgaaacagggctctgaatggcgacctggtggttgtcaaactgctaccagaagaacactggaaggtcgttaagcctgagtcaaacgataaggagactgaagcggcctacgagagtgatattcccgaggaatag

SEQ ID NO: 185520 - DNA, 1860 bp, Artificial Sequence
  Description of Artificial Sequence: Synthetic coding sequence
atgagccaccccgactaccggatgaacctgcggcccctgggcaccccccgcggcgtgagtgccgtggcaggcccacacgacatcggagcctcacctggggacaagaagagcaagaacagatctacacgcggaaaaaagaaaagcatcttcgagacctatatgtctaaggaagacgtgagtgaaggactgaaacgcggaacgcttatccagggagtgctgagaatcaatcccaaaaagtttcatgaggcttttatcccctcaccggatggcgacagagacatttttatcgatggagtcgtggcacgaaatcgagccctgaatggcgatctcgtcgtcgtaaagttactccctgaggaacactggaaagtagtcaagccagaaagtaatgataaggagacagaggctgcgtatgagagtgacattcctgaggaactatgtggacaccacctaccccagcagtctctgaagagctataacgactccccagacgtcattgtggaggcccaatttgatggatcagacagcgaagacggtcatggcataacccaaaatgtactcgtggacggagtgaagaaactgagcgtgtgcgtctccgagaagggacgagaggatggcgacgctcctgtcacaaaggatgaaacaacctgtatttcacaggatactcgtgccctctccgagaaatctttgcagaggtccgcgaaggtggtgtatattcttgagaaaaagcatagccgcgcagccacaggtttcctgaagctgctggcagacaagaacagcgaactgttcaggaagtatgccctgttcagcccctccgatcatagagtgccccggatatacgtccctttgaaagattgccctcaggacttcgtcgcacgccccaaggactacgccaatacactgttcatttgtaggatcgtggattggaaggaggattgcaactttgcgctcgggcagcttgctaaatctctggggcaggccggggaaatcgagcccgagacagaaggtattctcaccgagtatggtgtagacttctccgacttttcatcagaggtgctagaatgtctccctcagggactgccctggacgattcccccggaggagttcagcaagcgccgggacctgagaaaggattgcatttttacaatagatccaagtactgcaagagatcttgatgacgctttgtcctgtaaacccctggctgatgggaactttaaggtcggggtgcacattgccgacgtgtcctatttcgtccccgagggctcggacctggacaaggtggccgctgagcgagccacctccgtttacctagtgcagaaagtggttccgatgctgccccgattgctgtgtgaggagctttgcagcctgaacccaatgtccgataaattgaccttttcagtgatctggactctgacaccagagggcaaaattctagatgaatggttcgggagaaccataattcgtagttgtactaaactgtcatacgagcatgcccagagcatgatagagtctcccacggaaaagataccagctaaggagctgccccctatttcacccgagcattctagtgaggaagtgcatcaagccgtgcttaacctccacgggatcgccaaacaactgagacaacagagattcgtggacggagctctgcgcctcgaccaactcaagttggcgtttactctggaccacgagaccgggctgccccagggctgtcatatctacgagtaccgggaatcaaacaagccgtgttgcgccgggacacctaggcccaaacagggttgttcagtcacgtggtggaactccgcaaccagatgggggtgcccatggacaagcgcccctcaggaaccaagcatgaaggcctag

SEQ ID NO: 185521 - DNA, 615 bp, Artificial Sequence
  Description of Artificial Sequence: Synthetic coding sequence
atgagcaccgagaccgagctgcaggtggccgtgaagaccagcgccaagaaagactctcgaaagaaagggcaggatcggtccgaagcgacccttatcaagagatttaaaggcgaaggcgtgagatataaagctaagttaatcggcattgacgaagtgagcgccgctcgaggggacaaattgtgccaggactctatgatgaaattgaagggagttgtcgccggggcccgctccaagggtgagcacaaacaaaagattttcctgacaattagcttcggaggcatcaaaattttcgatgagaaaaccggtgccctgcaacaccaccacgcggtccacgagattagttacatcgcaaaggacattaccgatcaccgggccttcggatacgtgtgtggtaaagaggggaaccacagattcgtcgcaatcaaaactgcacaggccgcggagccagttatcctcgaccttagagacctttttcaacttatttacgagttgaaacagagagaggaacttgaaaaaaaagcacagaaagataaacagtgtgagcaggctgtgtaccaggtgcccacgtcacagaagaaggagggagtctatgacgtgccaaagagccagccatag

SEQ ID NO: 185522 - DNA, 642 bp, Artificial Sequence
  Description of Artificial Sequence: Synthetic coding sequence
atgagcaccgagaccgagctgcaggtggccgtgaagaccagcgccaaaaaggactccaggaaaaaggggcaggacagaagtgaggcaacccttatcaaaaggttcaagggcgaaggcgtgcggtacaaagccaaattgatcgggatcgatgaggtcagtgctgcaagaggggacaaactgtgccaggattcaatgatgaagctcaagggcgtggtggccggtgcaaggtctaaaggagagcataagcaaaagattttcctgacgatctcgttcggcggtattaagatctttgacgagaagacaggcgcactgcagcaccatcacgccgtgcacgagatctcctacattgcaaaagacatcaccgatcaccgggccttcggctatgtgtgcgggaaggaagggaaccaccggttcgtggcaataaagaccgctcaggcagcggagccagtaatcctggatttaagagatctctttcagttgatttatgagctgaaacagcgggaggagctggagaaaaaggcccagaaggacaagcagtgtgagcaagccgtctaccaaaccatcctcgaggaggacgtggaagaccctgtgtatcaggttattagtgaaacaagcagaggtttccggtttaaaagcgattag

SEQ ID NO: 185523 - DNA, 1767 bp, Artificial Sequence
  Description of Artificial Sequence: Synthetic coding sequence
atgagcaccgagaccgagctgcaggtggccgtgaagaccagcgccaagaaagattctcgcaagaaagggcaggataggtcagaggcaacactcatcaagagattcaaaggagaaggagtccggtacaaagctaagctgattggcatcgatgaggtttctgccgcccgcggagataagttgtgccaggatagcatgatgaaactgaagggtgtcgttgcaggtgcccgctcaaagggagaacataagcagaagatctttttgaccatcagctttggcgggataaaaatctttgatgaaaagaccggagccttgcaacaccaccatgctgtccacgagattagctacatcgccaaagacatcacagatcatagagcctttggatacgtttgtggcaaggaggggaaccacagatttgttgcaatcaagacagctcaagccgccgagcccgtgatcctggatctccgcgacctgtttcagctaatctacgagttgaagcagagggaagaattggaaaagaaggcgcaaaaagacaagcagtgcgaacaggctgtgtatcagacaattcttgaggaagatgtggaagacccggtgtaccagtacatcgtctttgaggcaggccatgagccaattcgcgatcctgaaacagaggagaatatttatcaagttcctactagtcagaagaaggagggagtttacgatgttcccaagtcgcagccagtctcaaacggatactctttcgaagactttgaagaacggttcgccgccgctactccgaacaggaatttgccaacagactttgacgaaatttttgaagctaccaaggctgtcacccagcttgaactgtttggtgatatgagcacccctcctgatatcacatctccacctacccccgccacaccaggggatgccttcatcccctccagtagccagaccctccccgccagcgcagacgtgtttagctctgttccttttgggaccgcagctgtaccgagcggctacgtagcgatgggcgctgtgcttccctcattctggggacagcagccgctggtacagcaacagatggttatgggagcccaaccccctgtggctcaagtgatgcccggcgcacagcccatcgcttggggccagcctggtctgtttcccgccacccagcagccctggccaactgtcgcaggccagttccccccagctgcctttatgccgacacagacagtcatgcctcttcctgccgccatgttccaagggcctctgactccactagccacggttcccggcacctcagacagtactcggtcgtcccctcaaacagacaaaccgcggcaaaaaatggggaaggagacttttaaggacttccagatggctcagccccccccagttccttctagaaaacccgaccagccaagcctaacttgtacatctgaagccttctcctcatattttaataaagttggtgtggctcaggatactgacgattgcgacgatttcgatatctcacagttgaatctgacacccgtgacatctacaactccatctaccaatagtcctccgacccccgccccccggcagtcgtctccttccaagtcctctgcttcccacgcatccgatcctactaccgatgacatttttgaggagggctttgagtccccttccaaaagcgaagaacaggaggctccggacggtagccaggcctcttccaatagcgatcctttcggggaacccagcggcgagcctagcggagacaatattagcccccaggccgggagttag

SEQ ID NO: 185524 - DNA, 720 bp, Artificial Sequence
  Description of Artificial Sequence: Synthetic coding sequence
atgagcaccgagaccgagctgcaggtggccgtgaagaccagcgccaaaaaggactcacgcaaaaaaggccaggataggtctgaggcaacactgatcaagagattcaagggcgaaggagtaagatacaaagcaaaactgatcggaattgacgaagtgagcgccgcgcgtggagataagctgtgccaagattctatgatgaaactaaagggcgtggtcgccggtgcgagatctaagggggaacacaaacagaaaatattcctgacaattagctttggtggtattaagatattcgacgagaagaccggtgtgcctacctcacagaagaaagagggagtttatgacgtgccaaagagccagcctgtttccaacgggtattcgttcgaagactttgaggaacggtttgccgccgctaccccaaaccgaaacttgcctactgactttgatgaaattttcgaagcgacaaaagccgtgacccagctggagctgttcggggacatgtctacacctccagatattacctcacccccaacaccagcaaccccaggagacgcctttattccatccagctcccagaccctgccggcatccgcagatgtcttcagttcagtcccctttggcaccgcagcggttccttccggatacgtcgccatgggtgctgttctgccttcgttctggggtcagcagcctcttgtccagcagcaaatggtgatgggcgcttag

SEQ ID NO: 185525 - DNA, 1668 bp, Artificial Sequence
  Description of Artificial Sequence: Synthetic coding sequence
atgagcaccgagaccgagctgcaggtggccgtgaagaccagcgccaagaaggactccaggaaaaaaggacaggatcgctcggaagccaccctcatcaagcgtttcaagggcgagggggtgcgctacaaagctaaactgatcgggatcgacgaagtctctgcagctcggggggataaattgtgtcaagactcgatgatgaagctgaaaggcgtggtggccggagcacggagtaaaggagaacacaagcagaaaatattcctcacaataagctttggagggattaaaatcttcgacgagaagacgggcgccctacagcaccaccatgccgttcacgagatcagctatatcgccaaagacatcacagaccacagggcatttggatacgtttgcggaaaggaggggaatcatagattcgttgccattaagactgctcaggccgctgaaccagttatcctggatctgcgcgacctgtttcagctcatctatgaacttaagcagcgtgaggagcttgagaagaaggcacagaaggataaacaatgtgaacaagccgtttatcagactatacttgaggaggacgtggaggaccccgtctaccaatacatcgttttcgaggccgggcatgagcctatccgtgatccagaaactgaggagaacatttaccaggttcccacaagccagaagaaagagggagtctacgacgtccccaagagtcaacctgtgagcgctgttacccaactggagttgttcggcgacatgtccacaccacccgacattacctctccccccactccagccactcccggcgacgcctttatcccatcttcttcccaaaccctcccagcctccgcagatgtcttttctagtgttccattcggcacagccgctgtcccgtcaggatacgttgctatgggcgccgtcttgccaagtttttgggggcagcagcctctggtgcagcagcagatggtgatgggagcccagcctcctgtggctcaggtcatgcccggggctcagccaatcgcctggggtcagcctggtctatttcccgcaacccagcaaccgtggcctactgtggctggccagttcccccctgcggcatttatgcctacacagaccgtgatgcccctccctgctgcgatgttccaggggcctctcactcctctggccacagtacctggtacctctgactctaccagaagttctccacagacagacaagcctcggcagaaaatgggcaaggagacgtttaaggacttccagatggcccagccacccccagtgcccagcagaaagccggaccagccctctcttacttgcacctccgaagcgttttccagttacttcaataaggtaggagtagcccaggacacggacgattgcgacgattttgacatcagtcaattaaatctcacccccgtcacatccacaaccccatccaccaattctccccctactccagcgccccgtcagagctcccctagtaagagctcagccagccatgcctcggaccctacaacagacgatatcttcgaggaaggctttgaaagcccgtccaagagtgaagagcaggaggctcctgatggttctcaggcatcttctaactccgacccgtttggagagccctctggtgagccatcaggtgacaacatcagtccccaggccgggagctag

SEQ ID NO: 185526 - DNA, 1668 bp, Artificial Sequence
  Description of Artificial Sequence: Synthetic coding sequence
atgagcaccgagaccgagctgcaggtggccgtgaagaccagcgccaaaaaggactccagaaaaaaaggccaggatcggtctgaagccaccctcatcaagagatttaagggagagggtgtcagatataaggcgaagcttatcgggattgatgaggtttccgccgcaaggggggacaaattgtgtcaggacagcatgatgaaactgaaaggcgtagtcgcaggcgcacgctcaaaaggcgagcacaagcaaaaaattttcctgacaataagtttcggcggtataaagatcttcgatgagaagaccggagccctgcagcatcatcatgctgtgcatgaaatatcttatatcgccaaggacatcacggaccatagggctttcggctatgtgtgcgggaaggagggcaaccataggttcgtcgcaattaagactgctcaggccgccgaacctgtaattctggacctcagggatctattccagctgatatacgaactgaaacagcgagaggaattagaaaagaaagcacaaaaggataagcagtgtgaacaggcagtgtatcagaccatactcgaagaagacgtagaggacccagtgtatcaatatatcgttttcgaggccggccacgagcctattcgagaccccgagaccgaggagaatatctaccaggtgccgacatcccagaagaaggagggggtttacgatgtacctaagagtcagcccgtgtcagctgttacacaactcgaactgttcggggacatgtctacccctcccgatatcaccagcccacctacaccagccacgccaggggatgccttcatcccttcttcttctcagacgctccccgcctcagcggacgtgtttagctcggtaccattcggcacggccgctgttccttcaggatatgtggctatgggggcagtgctgccctcattttggggccagcagcctctggtgcagcagcagatggtgatgggcgcccagcctcctgtggctcaggtgatgcccggtgcacaaccgatagcctggggacagcccgggctgtttcctgcaacccaacagccgtggccaactgtcgcaggtcagttcccccctgcggccttcatgccaacgcagacagtgatgccactgccagctgcgatgtttcaggggcctctcactcccttggctacggtgccgggtactagcgatagcactagatcttccccacagaccgataagcccagacagaaaatgggaaaggaaacatttaaagactttcagatggctcagccaccgcctgtccccagccgtaaacccgatcagccaagcttgacgtgtacctccgaggctttctcctcatactttaataaggtcggtgtcgcccaggataccgacgattgtgacgacttcgatatttcccagctgaatctaacaccagtgactagcaccactcccagtactaacagccccccaacccctgccccgcgccaatcctccccgtccaagagttccgcctcacacgcttcagaccccaccacagacgacatcttcgaggagggctttgagtccccctccaaaagtgaggagcaggaagctccagatggtagccaggctagtagcaatagtgacccattcggtgagccttctggcgagcctagcggggataatatcagcccgcaagctggatcctag

SEQ ID NO: 185527 - DNA, 1668 bp, Artificial Sequence
  Description of Artificial Sequence: Synthetic coding sequence
atgagcaccgagaccgagctgcaggtggccgtgaagaccagcgccaaaaaagattctaggaagaaggggcaggaccggagcgaagcaaccctgattaaacgcttcaagggagagggggtacgctacaaggccaaacttattggaatcgacgaagtgagcgccgcccgaggcgataaattgtgtcaggacagcatgatgaaattaaagggtgtcgttgccggcgccaggagcaagggagagcacaaacagaagatcttcttgactatttcatttgggggaatcaaaatatttgatgaaaaaacaggagccctacagcatcatcacgctgtgcatgaaatttcatatatcgccaaggacataactgatcatagggccttcgggtatgtttgcggaaaggaggggaatcaccggttcgttgcaatcaaaactgcccaagctgctgaacctgttattcttgacttgagagatctatttcagctgatctatgaacttaagcagcgtgaggagttggaaaaaaaggcacagaaggacaaacagtgtgaacaggcagtgtaccagactattttggaggaagatgtggaagaccctgtgtatcaatacatagtgttcgaagcagggcacgaacccatcagggacccagaaaccgaagaaaacatctaccaggtgcccacaagtcagaagaaagagggcgtctatgatgtgcctaagtctcagccggtgtctgccgttacacagctagaactgttcggggacatgagcacacctcccgacatcacttcgcctcccacacccgccaccccaggggatgccttcatcccatcatcctctcaaacgctcccagcgagtgcagatgtgtttagctccgtcccattcggaactgccgccgttccaagcggctacgtggccatgggtgcagtcctgccttccttctggggacaacagccactggtgcagcaacagatggtcatgggcgcacagccacctgttgctcaggtcatgccaggcgcgcaacctatcgcgtggggccagcctgggctcttcccagccacgcaacaaccttggcctaccgtggcaggtcagtttccacccgccgcttttatgcctacccaaactgtgatgcctctgccagccgccatgttccagggaccgctgaccccactggccactgttcctggtacttcagacagtacgcggtcttctccacagaccgataaaccgcggcagaaaatggggaaggagacttttaaagatttccagatggctcaaccaccacccgtgccctcccggaagcccgatcaacccagcttgacatgcacatccgaagctttcagctcgtactttaacaaagttggcgttgcccaggacacagatgactgtgacgactttgacattagccagttaaacctgacgcccgtcactagcaccacgcccagtaccaacagcccccctactcccgcgccaagacagtcatcaccaagtaagtctagcgccagtcatgccagcgatcctaccaccgatgacatttttgaggaaggatttgagagcccctccaagtctgaggagcaggaagctccagacggatcacaggccagctccaatagtgatccttttggggaaccctcaggagagccaagcggggacaacatatctccccaggctggcagctag

SEQ ID NO: 185528 - DNA, 1614 bp, Artificial Sequence
  Description of Artificial Sequence: Synthetic coding sequence
atgagcaccgagaccgagctgcaggtggccgtgaagaccagcgccaaaaaggattctcggaagaaaggacaggatcgcagcgaggcgacactcataaagagattcaagggagagggggtcagatataaagccaaactcatcgggattgacgaggtttctgctgcccggggcgacaaactctgtcaggattccatgatgaaactcaagggtgtagtggctggggcaagaagtaagggcgagcacaaacagaaaatctttttgacgatctccttcggcggaattaaaatattcgatgagaaaacaggagccctgcagcatcaccatgccgtgcatgagatttcatatatagcgaaagatatcacagaccatcgcgctttcgggtacgtatgcggtaaggaggggaaccacagattcgtcgccatcaagactgctcaggctgccgaaccggtcatcctggacctaagagatctgtttcagctgatatacgagctgaaacagcgcgaggagttagaaaagaaggcgcagaaagacaaacaatgtgaacaagccgtgtatcaagtcccaacatcgcagaagaaggagggagtctacgatgtgccaaaatctcagcctgtctcaaacggatattcatttgaggactttgaagagcgcttcgcggccgcaacccctgccgtgacgcagctcgagttattcggtgacatgagcacgccgcctgatatcacatcccccccaacacccgccacccccggagacgccttcattccttctagcagtcagaccctgcctgcctccgccgacgtcttctcctcggtgcccttcggcaccgcagccgttccatctggatatgttgcgatgggggcagtgctgccctccttctggggacagcagcctcttgtccagcagcagatggtgatgggtgcccagccgcccgtggcccaggtaatgcccggggcccagcccatagcatggggtcagcccggactgtttcccgcaacccagcagccatggcccaccgtggctgggcagttcccccccgccgctttcatgccgacacagacggtcatgcctttgccagctgctatgttccagggaccactgacaccgctagccactgtgcccggcacgtcagacagtactcgtagcagtccccagacagataagccaaggcaaaagatgggcaaggaaactttcaaagattttcagatggctcagcctccccccgtgcccagtaggaaacccgaccagccgtcacttacttgtacgagtgaagcctttagttcttactttaataaggtcggagtggctcaagacacagacgactgcgacgactttgatatttcccaactgaatttaaccccagtcacatccaccacaccttccacgaattcacccccaacgcctgccccacggcagagcagcccttccaagtccagtgcctcccatgcttccgatcccacgactgatgacattttcgaagaaggctttgaaagcccttcaaaaagcgaggagcaagaggctccagacgggtcccaagcatcttcaaactcagatcctttcggcgagccttccggagaacccagcggcgacaacatctctccacaggccggcagttag

SEQ ID NO: 185529 - DNA, 1662 bp, Artificial Sequence
  Description of Artificial Sequence: Synthetic coding sequence
atgagcaccgagaccgagctgcaggtggccgtgaagaccagcgccaagaaagatagcagaaagaagggccaggatcgatccgaagcaacactcattaaacggttcaagggcgagggtgttcgctacaaagcgaaactcattggcatcgatgaagtctcggcagcccggggtgataagctctgtcaagactccatgatgaaactgaaaggtgtggtggcaggggccaggagcaaaggcgagcacaagcaaaagatctttctcaccatcagttttggcggaattaagatctttgacgagaagacgggcgcgcttcaacatcaccatgccgtccacgaaatctcatatatagctaaggatatcacagatcacagagctttcggatacgtctgcggtaaagaagggaatcaccggtttgtcgcgatcaagactgcccaggcggccgaaccggttatccttgatttgagagacctcttccagctgatatatgagctgaaacagcgcgaggagctggaaaagaaagcccaaaaggataagcagtgtgaacaggccgtgtaccaggtccctacctcccagaagaaggagggagtatatgatgtgcctaaatctcagcctgtatccaacgggtacagtttcgaggattttgaagagcgctttgctgccgccactccgaaccggaatttgcccacagacttcgacgaaatcttcgaggcgacaaaggctgtgacacagcttgaactgttcggagatatgagcacaccccctgacatcacatccccacccacacccgcaacccctggtgacgctttcatcccctccagcagccagacccttccggcctcagccgatgtgttttcatctgtgcctttcggaaccgcggccgtaccctctgggtacgttgctatgggagccgtactaccaagcttctggggacaacagcccttggtccagcagcagatggttatgggagcccagccccctgtggcccaggttatgccgggtgctcaacccatcgcttggggacagccaggtttatttcccgccacacagcaaccgtggccgacagtagccggccagtttcctcccgcagcctttatgccaacgcagactgtaatgcccttacccgctgctatgttccagggcccgctgacaccacttgccacggtacccggcacttcagatagcactcgcagctcccctcagaccgacaaacctcgtcagaagatgggcaaggagacttttaaggatttccaaatggcacagccgccgcctgtgccttcccgaaaacctgaccagccatcgctcacatgcacatccgaagccttttcgtcctactttaacaaagttggcgttgcccaggacactgatgattgcgacgactttgacatctcgcaactaaatctcacacctgtgaccagtaccacaccaagtactaattctcctcccacacctgcgccaaggcagagttctccctctaaatcctcagcatctcatgcatccgaccccacaactgatgatatctttgaagagggcttcgagtccccttcaaagagcgaagagcaagaagctccggacggtagccaggctagctctaatagcgacccttttggcgaaccttccggcgaacccagcggcgataatatctctcctcaggcggggagctag

SEQ ID NO: 185530 - DNA, 1410 bp, Artificial Sequence
  Description of Artificial Sequence: Synthetic coding sequence
atgagcaccgagaccgagctgcaggtggccgtgaagaccagcgccaaaaaagattcaagaaaaaagggacaggacagaagcgaggctacactgatcaagagatttaaaggggaaggagtgcggtacaaggccaagctgataggaatcgacgaagtctccgcagctcgcggagacaagctttgccaagacagtatgatgaaactcaaaggcgtggtcgccggagcccggtccaagggcgaacacaagcagaagattttcttaaccatcagtttcggcggcattaagatctttgatgagaaaacaggcgtacccactagtcagaaaaaggaaggggtttatgacgttccaaaatcacagcctgtgtccaatggatacagttttgaggactttgaggagcgtttcgctgccgctacgcctaaccggaatctacctacagactttgacgagattttcgaggctaccaaggccgttacccagctggagctgttcggggacatgtctacaccacccgatattacttccccacctacgccggccactccgggcgacgcattcattccctctagttcccagaccctgcctgcaagtgcagatgtcttctcatctgtcccctttggaactgctgccgtccccagcggctacgtggccatgggggccgtgctccccagcttctggggtcagcagccactagtgcaacagcaaatggtgatgggcgcacagcctcccgtggcacaggtgatgccaggagctcagccgatcgcttggggccagcctggattgttcccggccacccaacagccatggcctaccgttgctgggcagttccctcccgctgctttcatgccaacgcagactgtcatgcccttgccagccgccatgtttcagggtcctctgacccccctggctactgtgccaggaacttcagacagcacgaggtcttcccctcagacagacaagcctaggcagaaaatgggcaaggagacattcaaagactttcaaatggctcaaccccctccagtgccttcaagaaagccagatcagcccagtttgacatgtacatccgaagcctttagctcatacttcaataaggtcggggtcgcacaggacactgatgattgtgatgacttcgacatatcccaacttaaccttacccctgtgacttctacaacaccctctactaacagcccccctacaccggcccctcgacagagctcgccctctaaatcgtctgcttcacatgcatccgacccaacaaccgatgacatcttcgaagaaggattcgaatccccttcaaaatccgaggaacaggaggctcccgatggatctcaagcttcttcaaattccgacccgttcggcgagccgagcggcgagccaagtggagataacatctctccacaagctgggtcctag

SEQ ID NO: 185531 - DNA, 2313 bp, Artificial Sequence
  Description of Artificial Sequence: Synthetic coding sequence
atgagcaacgaggtggagaccagcgccaccaacggccagcccgaccagcaggccgcccctaaagctccatccaaaaaagaaaaaaaaaaggggcctgaaaagacagacgaatacctcttagcaaggtttaaaggagatggcgtgaagtacaaggccaagctcattggaatagacgatgtccccgatgccagaggagacaaaatgtcacaggactctatgatgaagctcaagggcatggctgccgctgggaggtctcaggggcagcacaagcagaggatctgggtgaacatcagtctctctggtataaagatcatcgacgaaaagactggggtgatagagcacgagcaccccgtgaacaaaatctccttcattgcgcgagatgttactgataacagggctttcgggtacgtctgcggcggcgagggacagcaccaattctttgcaatcaagactggccagcaggctgagcctcttgttgttgacttaaaagatctatttcaggtaatttacaacgtcaaaaaaaaagaagaggaaaagaagaaaattgaagaggctagcaaggcagtggagaacggctcagaagcactgatgatattagatgaccagacaaataagctaaagagcggggtcgaccagatggacctctttggagatatgtctaccccccccgacctgaactctcccacagaaagtaaagacattctcctggtagatctgaactcggagatcgacacgaatcagaatagtcttcgagaaaacccattcctgacaaacggcatcacgagttgctcacttcctaggccgacccctcaagcttcttttctgccagaaaatgctttcagtgccaacttgaatttctttcccactcccaacccagatccgttccgagacgatcctttcacccagcctgatcaatccacacctagcagctttgatagtttaaaatcaccagatcaaaagaaggaaaatagtagttcctcttctacgcctctctccaacgggcctcttaacggcgatgtggactattttgggcagcagttcgaccaaatctctaaccgaacgggaaagcaggaagcccaggccgggccctggccattttcctcctctcaaacacagcctgcagtgagaacacaaaatggagttagcgaacgggaacaaaacgggtttagtgtgaagtctagtcccaaccccttcgtgggctcaccacctaagggcctcagcatccaaaatggggtcaaacaggatcttgagtcaagcgtccagagcagtccccatgacagcatagcgatcatccccccgcctcaatccaccaagccaggtcggggacggcgcacagccaagagctcagcaaatgacctgcttgcctcagatattttcgcaccacccgttagtgaaccctcaggccaggcctctcctactggtcagcccactgctctacagccgaaccccctcgacttattcaagacgtccgcaccggcccctgtggggccacttgttggcctgggtggagtgactgtgaccctgcctcaggcaggaccatggaatacagcatctctcgtgtttaatcagtccccaagtatggcccccggcgccatgatgggcggccaaccttctggatttagtcaacccgtgattttcggtactagccctgccgtctccggctggaaccagccctccccattcgcagcatccacaccaccacccgtccctgtcgtgtgggggccttcggcttcagtggccccaaacgcatggtcaacgaccagtccactggggaatccatttcagtctaacatttttccggccccagccgtcagtacccagccccccagcatgcactcttcacttctggtgacacctccgcagcctcccccccgagccgggccacccaaggacatttcctccgacgcctttaccgcattagatcccttgggcgacaaggagataaaagacgtaaaggaaatgtttaaagacttccagctgagacagcctccagctgtgccagccagaaaaggcgaacagacatcttctggcaccctgagtgctttcgctagttacttcaatagtaaggtcggtattccacaggagaatgcggatcatgatgacttcgatgcaaaccaattacttaacaagattaatgagccgcctaagccagccccaaggcaggtgagccttccagtgactaagagcacagataatgcgttcgagaaccccttttttaaggattcatttggatcctcccaggcctctgtcgcatcctctcaacctgtgagctctgaaatgtacagagacccctttggaaacccctttgcgtag

SEQ ID NO: 185532 - DNA, 1659 bp, Artificial Sequence
  Description of Artificial Sequence: Synthetic coding sequence
atgagcaacgaggtggagaccagcgccaccaacggccagcccgaccagcaggctgcccccaaagcgcctagtaagaaagagaaaaaaaagggccccgagaagactgacgagtatctgttggcaagattcaagggagatggagtcaaatataaggccaagctgattggcattgatgatgtgcccgatgcacggggcgacaaaatgtcacaggattctatgatgaagctcaagggaatggccgccgcagggaggagccaggggcagcacaagcagcgcatctgggtcaacattagcctgtccggaatcaagattatcgatgagaagacaggagtaattgagcacgagcaccccgtcaataagatttcctttatcgcaagagatgtcaccgacaatagagccttcggttatgtatgtggcggtgaaggccaacatcagttctttgctattaagacgggtcaacaggctgagccactcgtggtcgacctgaaggatttgttccaagttatttataatgtgaaaaagaaggaagaggaaaagaagaaaatagaggaggcgagtaaggctgttgagaatggctccgaagccctgatgatactcgatgaccagactaacaaactgaagtcaggcgtcgaccaaatggacctttttggggatatgtccactcctcccgatcttaattcgcccacctctagcgcaaacgacctgctggcttccgacatctttgccccccccgtctccgagcccagcggccaggcatcccccacagggcagcctactgctctgcaaccaaatccgctggatctatttaaaacttccgctccagctccagtcggcccattggtgggtctaggaggtgttaccgtgaccctccctcaggcggggccatggaacactgcgtcattggtttttaaccaaagcccctcaatggcgcctggagccatgatgggggggcaaccttcagggtttagtcagccggttatcttcgggacctctccggcagtgtccgggtggaatcaaccaagccctttcgctgccagtacccctccccccgtgcccgttgtgtggggtccgtctgcgtctgtcgcaccgaacgcctggtccaccacatctcctctcggaaatccctttcagtccaacatttttccagcacccgccgtgtccacccagccaccttcaatgcattcttcacttctggtgactcccccccaaccgcctccccgagctggcccccctaaggatatcagtagtgatgccttcaccgccctggatccattgggggacaaggaaatcaaggacgttaaagaaatgtttaaggactttcagctccgacagccgcctgcggtacctgcccgaaagggagaacagacatcatctgggactctctccgctttcgccagctatttcaatagcaaagtcggcattccacaggagaacgctgatcatgatgactttgacgccaaccagttgctcaataagatcaatgagccaccaaagcccgcccctcgccaggtgtctctgccggtgacaaagagtactgataatgcttttgaaaacccctttttcaaggacagtttcggctccagtcaggcctcggtagcgagttcccagcctgtgagcagtgagatgtaccgtgatccttttggcaatccgtttgcatag

SEQ ID NO: 185533 - DNA, 204 bp, Artificial Sequence
  Description of Artificial Sequence: Synthetic coding sequence
atgagcaacgaggtggagaccagcgccaccaacggccagcccgaccagcaagctgccccgaaagccccctccaaaaaagagaagaagaaggggccggagaaaaccgacgaatacttattggctagatttaaaggtgacggcgtgaagtacaaggctaaactgatagggattgacgatgtgcccgacgctagaggtgacaaatag

SEQ ID NO: 185534 - DNA, 231 bp, Artificial Sequence
  Description of Artificial Sequence: Synthetic coding sequence
atgagcaacgaggtggagaccagcgccaccaacggccagcccgaccaacaggccgcaccaaaggccccatctaaaaaggagaagaagaaagggcccgagaagaccgacgagtatctcctggcgaggttcaaaggggacggggtgaaatacaaggcaaagctgattggaatagacgacgtgcccgatgccaggggggataaaatgtctcaggattcgatgatgaaactgtag

SEQ ID NO: 185535 - DNA, 120 bp, Artificial Sequence
  Description of Artificial Sequence: Synthetic coding sequence
atgagcaacgaggtggagaccagcgccaccaacggccagcccgaccagcaggcagccccgaaggcccctagtaaaaaggaaaagaaaaaaggacccgaaaagaccgacgagtacttgtag

SEQ ID NO: 185536 - DNA, 2250 bp, Artificial Sequence
  Description of Artificial Sequence: Synthetic coding sequence
atgagcaacgaggtggagaccagcgccaccaacggccagcccgaccagcaggcagcccctaaggctcccagtaagaaggagaaaaaaaaaggtccagaaaagactgacgagtatttgctggccaggtttaagggcgacggggtaaagtacaaggccaagctgattggtatcgacgacgtgcccgatgccaggggtgacaagatgtctcaggattcaatgatgaagctgaaaggaatggcagccgcagggaggtctcagggccaacacaaacagcggatctgggttaatatcagtctctccggtatcaagatcattgacgagaagaccggcgttattgaacacgaacaccccgtaaacaagatcagctttattgcacgagatgttaccgataatcgagcctttgggtatgtttgcggaggggaagggcagcatcagttctttgccatcaagacggggcagcaggcagaacctctggtggtcgatctcaaggatctcttccaggtaatctataacgtcaagaagaaagaagaagaaaagaagaaaatcgaggaggcgagcaaggcggtggagaatgggtccgaggcattaatgatacttgacgatcagactaacaagcttaagtcggagtccaaagacattctgctggtcgacctgaattcagagatcgacacgaaccagaactcactacgcgagaaccctttcctgaccaacggcatcacgtcctgctctctaccccgccctacgccccaagcgagcttcctccccgaaaatgccttttcagccaatctgaacttttttccaactcccaatcccgaccctttccgggatgatccattcacccagcctgatcagagtacgccctcatccttcgatagcctgaaatctcctgatcagaagaaagagaattcaagttcgagtagcacacctctctccaatggaccgcttaatggggatgtggactattttggccagcaatttgatcagatttcaaaccgcacaggcaagcaggaggcccaggccggaccatggccattttctagcagtcagacacagcctgccgtgaggacgcagaatggtgtctccgaacgggagcagaacggtttttccgttaaatcctctcccaatccattcgtgggaagccctccaaagggactgtctatccagaacggagttaagcaggatctagaatcatctgtacaatcctcaccgcacgacagcattgcaatcatccccccaccccagagcacaaaaccgggacgcggcagaaggacagccaagagcagcgccaatgatcttctggcctctgacatctttgcacctccagtctcagagccttcaggccaggcgtcccctacaggccagcctacagctctgcagcccaaccctttagatttgttcaaaacctccgcccccgctcctgtgggtccattagtcggattgggtggtgtgacagttacactcccacaggcaggaccttggaatacggcctcattagtgtttaaccagtctcctagcatggccccaggcgccatgatgggtggccagcctagtggattctctcagcctgtaattttcggaacttctccggccgtgtctggatggaaccagcccagcccttttgccgcaagtacaccaccaccagtcccagtggtctggggtccatccgcctcggtcgcacctaacgcgtggagcaccaccagtcccctgggcaacccgttccaaagtaatatcttccccgcacctgccgtgtctacacaacctccctccatgcatagtagtctactggttactcctcctcagccaccaccgcgggcaggacctcccaaggacatcagcagcgacgcatttacggctctggatccgcttggcgataaagagataaaagacgttaaggagatgttcaaggacttccaacttcggcagccccccgccgtccctgccaggaagggggagcaaacctcttcaggaaccttgtccgcttttgcatcttatttcaattcgaaagtgggtatcccacaagaaaatgccgaccacgacgattttgacgcgaaccagctgttaaataaaataaacgagcctcccaagcctgcgccaagacaggtgagcctgcccgtgaccaaaagcactgacaatgccttcgagaaccccttcttcaaggatagctttggatcctcccaggcgagcgtagcgtcttcccagcctgtgagttctgagatgtacagggaccctttcggaaacccgttcgcctag

SEQ ID NO: 185537 - DNA, 2568 bp, Artificial Sequence
  Description of Artificial Sequence: Synthetic coding sequence
atgatcctgatcccccggatgctgctggtgctgttcctgctgctgccgatcctttcaagtgcgaaggcccaggtgaaccccgcaatttgccgctaccccctcggtatgagtggaggccaaatccctgatgaagatattacagctagtagccagtggtctgaatctaccgcggccaagtatggacgcttggactctgaggaaggagacggggcttggtgtcccgagatccctgtcgagcccgacgatttaaaagagtttttgcagatcgacttgcatacactacacttcatcaccctggtcggaacccaaggtcgacacgctggtgggcacgggatagagttcgcccccatgtataaaatcaattactcaagggatggaacccggtggatttcttggagaaatcgtcacgggaagcaggtgctggatggcaactccaacccatatgacattttcctcaaagatctggagccaccaatagtggctcggttcgttaggttcattcctgtgacggatcattcaatgaacgtctgtatgcgcgtggaactgtacggatgtgtctggctggacggacttgtctcctataatgcaccggccggacagcaatttgtgctccccggaggaagcattatctacctcaatgacagcgtttatgacggcgccgtcggttattccatgacagagggactgggacagcttacggacggcgtcagtggccttgacgattttacccagacacatgagtaccatgtgtggcccggttatgattacgttggctggcggaatgagtccgccactaatggctatatagagattatgtttgagtttgacaggatcaggaacttcaccacaatgaaagttcattgcaacaacatgtttgccaaaggcgtaaagatatttaaagaagttcagtgttacttccgttccgaagcatccgagtgggaaccaaatgccattagttttccgctagtgttggatgatgtgaacccttccgctaggttcgtgacggtccctcttcatcatagaatggctagcgcaattaaatgtcaataccacttcgcagacacctggatgatgttctccgagattacatttcagtcggacgcggcgatgtataataattccgaggccttaccaacctctccgatggcgcctactacatatgatcctatgctgaaggtggacgacagcaatacgcggatcctaattggctgcctggtagccataatttttatcctactagcaattatagttatcatactctggcgccagttctggcagaagatgctggagaaagccagccggcggatgcttgacgacgaaatgactgtaagcttgtccttacccagcgattcatccatgttcaataacaaccgctcctccagtccctctgagcaggggtctaattccacatacgaccgtatctttccccttcgacctgactatcaggagccttcacggctgatccgcaagcttcccgagttcgctccaggtgaagaagagagtgggtgcagtggcgttgtaaagccggttcagcctagtggcccggagggcgtaccacattacgccgaagcagatattgtgaatcttcagggagtaaccggtggcaatacgtattctgttccagccgtcacaatggacctcctttcagggaaggatgtcgcagtagaggaatttccccggaaacttctgacattcaaggagaagcttggagagggccaatttggtgaagtacacctgtgcgaggttgaaggcatggagaaattcaaggacaaggatttcgccctggacgtgtcagccaatcagcccgttctggtggccgtcaaaatgctgagggccgatgcaaacaagaatgcccggaatgacttcctcaaggaaataaagataatgtctcgccttaaggacccgaatataatccacctcctggccgtctgcattacggacgaccccctgtgcatgattactgaatatatggagaacggcgatttaaatcagtttctttcacggcacgagccacccaacagttcctcttcagatgtcagaactgtaagttacacaaatctaaaattcatggcaacccagatcgcatcaggcatgaaatacctcagctcgcttaattttgttcaccgcgatttggcgactcgcaactgcttagtggggaagaactacaccatcaagatcgctgacttcggcatgagccgcaatctgtatagtggcgattactatcgaatccagggccgcgcggtcctgcccatcagatggatgagctgggagtctattttgctgggaaaatttaccacagcgtccgatgtatgggccttcggtgtgacgttgtgggagacctttaccttttgtcaggagcagccatactcgcagcttagtgatgagcaggtaatcgagaatacgggagaatttttcagagaccaagggaggcagacctatttgccgcagccagcaatctgtccagactctgtctacaaattgatgcttagttgctggaggagggataccaagaataggccttcctttcaggagatccatttactgctgttacagcagggggatgaatag

SEQ ID NO: 185538 - DNA, 2568 bp, Artificial Sequence
  Description of Artificial Sequence: Synthetic coding sequence
atgatcctgatcccccggatgctgctggtgctgttcctgctgctgcccatcctctcttccgccaaggcgcaggtgaatcccgctatttgccggtatccgctgggtatgagcgggggccaaatacccgatgaagacattaccgcctcctctcagtggagtgagagtacagctgctaagtacggccggttggattccgaagagggagatggggcatggtgcccagaaattcctgtagagccagatgacctgaaagagtttctgcagattgacttgcacactctacacttcataacccttgtggggacccaggggcgacacgccggaggacacggcattgaatttgcaccaatgtacaagatcaactacagcagggatggtacccgttggattagctggagaaatagacacgggaaacaggtgctcgacgggaacagcaatccttacgatatcttcctgaaggatctagagccccctatcgttgccaggttcgtaaggtttatccccgtcactgaccacagcatgaatgtgtgcatgcgagtagaactatacgggtgcgtgtggcttgacggcctggtgtcatacaacgcacccgccggccagcagtttgtccttcccgggggcagtataatctacctcaatgactctgtgtacgacggggccgtgggttactcgatgacggaggggttgggtcagctgactgacggcgtgtccgggcttgatgacttcacccagactcatgagtaccatgtatggcctggctacgattacgttgggtggcgcaatgagtctgcgaccaacggctacatcgaaattatgtttgagttcgatcggatccgaaacttcacaacaatgaaagtgcactgcaacaatatgttcgccaaaggggtcaagatctttaaggaagttcagtgttactttcgctccgaggccagcgagtgggagccgaatgctatatcctttcctctggttctcgacgatgttaacccaagcgcacggtttgtcacggtgcccctccatcatcgcatggccagtgcgattaagtgtcagtaccactttgctgacacttggatgatgttttccgaaattacatttcagtctgacgctgccatgtacaacaattcggaagcccttcccacaagcccgatggcccccacaacttacgaccctatgctaaaggtcgacgattctaatacccgcattctgattggctgtctggttgccatcatctttattctgctagctatcattgtgattattctgtggaggcagttttggcagaagatgctggagaaagcctcacgtcggatgcttgatgacgaaatgacagtgtccctgtctttacctagtgactcctctatgttcaataataatcggagcagcagcccatcggagcaaggctcgaactctacctacgaccggatatttcccctccgacctgattaccaggagccatctagactcattcgcaaactgccagagttcgcccctggagaggaagaatccggctgcagcggtgtcgtgaaaccggtccaaccttccggtcctgagggggtcccccactatgccgaggccgacattgtcaatctgcagggcgttaccggggggaatacttactctgtgccagcagtcaccatggacctgttgtccggaaaggacgtggctgtggaagaattcccacgaaagctgctgacattcaaggagaagcttggcgaagggcagttcggcgaagtgcatctttgcgaagtggaagggatggaaaaatttaaagacaaagacttcgcgctggacgtttcagcaaaccagcctgttctggttgctgtgaagatgctacgcgcagatgcaaataaaaacgccagaaacgattttctaaaagagattaaaataatgagtagattgaaggatcccaacattattcatctcttagccgtttgcatcactgatgaccccttgtgtatgatcacagaatatatggaaaatggggacctcaatcagtttctgagtaggcatgagccacccaactctagttcatctgacgtgcgtactgtgtcatataccaatctgaagtttatggccactcaaatcgcatctggtatgaaatacctgagttctcttaattttgtccaccgggatcttgccacaagaaattgtctcgtgggcaagaactacacaataaaaattgcagacttcggaatgtctcgcaatctgtactcgggcgattactatcgcatccagggccgcgctgtcttgcctatcaggtggatgtcttgggagtccatactcctcggcaaattcactactgctagtgacgtgtgggcttttggcgtaaccctgtgggagactttcacgttctgtcaagaacaaccatattctcagctatcagacgagcaagtaattgagaatactggtgaattcttccgggatcagggccggcaaacgtacctgccccaaccagcaatttgtcctgactccgtgtataagttgatgctctcatgctggagacgcgacaccaagaatcgtccatcttttcaagagatccatctcctgttgttgcaacaaggtgatgagtag

SEQ ID NO: 185539 - DNA, 447 bp, Artificial Sequence
  Description of Artificial Sequence: Synthetic coding sequence
atgatcctgatcccccggatgctgctggtgctgttcctgctgctgcctatcctgtctagcgcaaaagctcaggtgaacccagccatctgtaggtacccactgggcatgtctggaggacagatcccagacgaggacatcaccgcctctagtcagtggagtgaatctaccgcagctaagtacgggcgactcgactccgaggagggggacggggcttggtgtcccgagatcccggttgaacccgacgatctgaaagaatttttacaaatcgatttgcacactttgcatttcattaccctcgtagggactcaggggcgacacgcaggggggcacggaatcgaatttgcgcccatgtataagatcaactatagcagggatgggactcgttggatttcctggcgaaaccgccatggtaagcaggtcctcgatggtaattctaatccgtattag

SEQ ID NO: 185540 - DNA, 516 bp, Artificial Sequence
  Description of Artificial Sequence: Synthetic coding sequence
tgaatcttcatcctgctggccatcatcgtgatcatcctgtggcggcagttctggcaaaagatgctggagaaagcctctcgcagaatgttagatgacgaaatgaccgtatcactttctctgccatcagatagcagcatgttcaacaataaccgttccagctcacccagcgaacagggttctaacagtacctacgaccggatttttccattacggccggactaccaggaacctagccgtctgattagaaagttgccagagtttgcacccggtgaagaggagtcagggtgctcaggtgtggttaaaccagtgcaaccttctggcccagaaggggtgccacactacgcagaggctgatatcgtgaatcttcaaggggtgacgggaggaaatacttacagcgttcccgcagtgaccatggatctcttatcagggaaggacgtcgccgtggaggaattcccccgcaagcttctgaccttcaaagagaaacttggggaaggtcagtttggagaggtctcttag

SEQ ID NO: 185541 - DNA, 393 bp, Artificial Sequence
  Description of Artificial Sequence: Synthetic coding sequence
atgatcctgatcccccggatgctgctggtgctgttcctgctgctgcccatcctgagctctgccaaagctcaagtaaatcctgctatatgtcgctatcctctcggaatgagtggaggccagatcccagacgaggatattactgccagctcgcagtggtcagagagcactgccgcaaagtatggtagacttgattcagaggaaggagacggtgcctggtgcccagaaatccccgttgagcctgacgatctgaaagagtttcttcagatcgacctacacaccctacactttattactctggtgggtacccagggaaggcatgccggaggccacgggatcgaatttgcccctatgtataaaattaactacagccgggatggaacgcggtggatttag

SEQ ID NO: 185542 - DNA, 501 bp, Artificial Sequence
  Description of Artificial Sequence: Synthetic coding sequence
ctgaaggtggacgacagcaacacccggatcctgatcggctgcctggtcgccattatcttcattcttctggctatcatcgtcattatcctctggagacagttttggcagaaaatgcttgagaaagcatcacgccggatgctagatgacgaaatgacggtgagcctttcactcccaagcgactcaagcatgttcaacaataatcgcagttcatccccctcagaacagggatctaattctacgtacgaccggatcttccccctgcgcccagactatcaggaaccatcccgcctcatcaggaaactccccgagtttgcccctggcgaagaggaatcaggcgaggacgatgtcgtgggaagagttagcagagaaaaaccccagcaggcaagcgggagatatgatactcctgctccctcatccctccatctgtttctcgtgagcgctaatctactcagaagtccccatagcctatccaggttcgggcttccattattgttggcttag

SEQ ID NO: 185543 - DNA, 447 bp, Artificial Sequence
  Description of Artificial Sequence: Synthetic coding sequence
atgatcctgatcccccggatgctgctggtgctgttcctgctgctgccaatcctgtcttcagccaaagctcaggtcaatcccgccatttgcagataccccctgggtatgtcagggggacaaattcccgatgaggacatcacggcgagtagtcaatggtctgaatccaccgctgctaagtacggacgactcgactccgaagagggcgacggtgcttggtgtcccgagatccccgtggagcccgacgatctgaaagaatttttacaaatcgatctccatactctgcacttcatcaccttagtgggcacccagggccgtcacgccggcgggcatggcattgagtttgctccaatgtacaaaattaattactcccgagatggaaccaggtggatctcatggcggaacagacatggaaagcaagtgctggatggtaattctaatccatattag

SEQ ID NO: 185544 - DNA, 2403 bp, Artificial Sequence
  Description of Artificial Sequence: Synthetic coding sequence
atgaactacatcttcggcaacaacaccctgctgtacagccggggctcaagaggaggtaacacttcttcttcccatggctcagcgggccccaagcagaaacactgggctaagaagggatcttccgatgaactgcaggcggagcccgagcccagtaggtggcagcagatagtggcgttttttactcgtcggcattccttcattgattgcattagtgtcgccacctcttccacccaggctaatccaccccccgttctggtcaacactgattccctggaaacccccacctatgtgaacggcaccgatgcggactacgaatatgaggaaataacccttgagcgaggaaatagcgggctgggcttctctatcgctggcggtacggacaaccctcatatcggcgatgacagctcaattttcattaccaaaattatcaccgggggagctgctgcccaagacggtagactgagagtaaatgattgcatcctgagggtaaacgaggtggacgttagagacgttacgcactccaaagccgttgaagcactgaaggaggctggaagtattgtcaggctttatgtcaaaagacggaagccagtgtctgagaagattatggaaataaagttgattaagggccctaaaggacttggcttcagtatagctggcggcgtgggcaaccagcacatccccggagataattccatttacgtgactaagattatcgagggcggcgctgctcacaaggacggcaagctgcaaatcggcgataagctcttggctgttaacaatgtgtgcctggaggaggtgacccatgaagaggctgtgacagctttgaaaaatacttccgattttgtgtacctgaaagtggccaagccaacgagtatgtatatgaatgatgggtatgccccccctgacattacaaattcttccagtcagccagtagacaaccacgtgagcccttcatcctttctgggtcagacaccggcatcaccggctaggtacagccccgtgtccaaagcagttctgggcgacgacgaaatcacacgagagccacgcaaagtggttttgcatagagggtctaccggtctggggttcaacattgtgggaggcgaggatggggaaggaatattcatctctttcattctggctgggggacccgccgatttgagtggcgaactcaggaaaggagatcgcataattagcgttaattctgtcgacttgcgtgccgcctcccacgagcaggccgccgcagccctaaagaatgccggccaagcagtgactatcgttgcccagtacagacccgaggaatactccaggtttgaggccaaaattcacgacctgcgggagcaaatgatgaactcatcgatctctagtgggtcagggagtttgaggactagccagaaaagaagcctctatgtacgggctctgttcgactacgacaagacgaaagatagcggtcttccatctcagggcttgaattttaagtttggagacattcttcatgtgatcaacgccagtgatgacgagtggtggcaagcgagacaggtgacccctgacggggagtcagacgaagttggggtgattcctagcaagcggcgcgtggagaagaaagagcgggccagactgaaaaccgtcaaattcaatagtaaaaccagggacaaaggggagatacctgacgacatgggatcgaaaggtcttaagcacgtgacatccaacgctagtgattccgagtcaagctatctgatcctgatcacagacgaatatggctgctccaaaggtggccaggaggaatatgtcctgtcctacgaacccgtcaaccagcaagaggtcaattatacacgtccagtgataatactgggccccatgaaagataggataaatgacgacctcatatccgaattcccggacaaattcggttcctgcgtccctcacactacaaggcctaagcgcgactatgaggtagacggacgcgattatcacttcgtgacatctagggaacagatggagaaggatatacaagagcacaagttcattgaagctgggcaatacaacaaccacctgtacgggacatcagtacagtccgtgcgggaggtagctgagaaaggaaagcactgtatccttgacgtgagtggcaacgccatcaaaagactgcagatcgcgcaactttaccccatatcaatttttataaaacccaaatcaatggaaaatattatggagatgaacaagagattgaccgaggaacaggcaagaaaaacattcgagcgtgctatgaaactggagcaggaattcaccgagcattttaccgcgatagtccagggagacacactcgaggacatctataaccaggttaagcagattatcgaggaacagtcgggtagctatatatgggtacccgcaaaagagaaactatag

SEQ ID NO: 185545 - DNA, 2367 bp, Artificial Sequence
  Description of Artificial Sequence: Synthetic coding sequence
atgaactacatcttcggcaacaacaccctgctgtacagccggggcagccgaggcggcaacacatcgagcagccatgggtccgctggtccgaagcagaagcattgggctaagaaaggcagtagtgatgagctgcaagctgagccagaaccatcaaggtggcaacagattgttgctttctttacacgacgccatagttttattgattgtatctcagtcgctacatcaagcacccaggcgaacccaccacccgtgcttgtgaatactgatagtttggaaactcccacatatgtgaatgggaccgacgccgactacgagtacgaagagatcaccctcgaaagaggcaactccgggctgggcttcagcatcgccggtgggaccgacaacccccacattggggacgacagttccatttttatcaccaagatcatcaccggtggagctgccgcacaggacggcagattacgagtaaacgactgcatactcagagtcaacgaagtagatgttagagacgtgacacatagtaaagcggtcgaggcactgaaggaggctgggtcaattgtacgtttgtatgtgaaacggaggaagcctgttagtgagaagatcatggagatcaaattgataaagggccctaaaggactcggcttcagtatcgcggggggagttggtaatcagcatatacccggcgacaactctatttacgtgaccaagatcattgaggggggcgcagctcacaaggatgggaaacttcagataggggacaagcttctagccgtgaacaacgtgtgcctggaagaagttacacacgaagaggccgtcaccgctctgaaaaacacttccgactttgtgtacctgaaagtggccaagcccaccagtatgtacatgaatgatgggtacgcaccaccggatatcacgaatagttcatcccaacccgttgacaatcacgtatctccttcaagtttcttgggacagacccctgcttcaccagcacgatattcccctgtgagtaaggcggtgctgggagacgatgagatcacccgggagccaagaaaggtggtcttgcaccggggatccaccgggctgggattcaacatcgtaggaggcgaagatggcgaaggcatcttcattagctttattctagcaggcgggcccgccgatctctcaggtgagctcaggaagggtgatcggatcataagcgtgaactcagtcgatctgcgggcagctagccatgaacaggctgccgcggccctaaaaaacgcgggccaggccgtcactattgttgcccaatacaggccagaggaatactcccgcttcgaggctaagatccatgatctgcgcgagcagatgatgaattcttctatatcctctggttctgggagtctgaggacgtcccaaaaacggagtttgtatgttcgggctctcttcgattatgacaaaaccaaggacagtggcctcccatcccagggcctgaacttcaaatttggcgacatattgcacgtgataaatgcaagtgacgacgaatggtggcaggctcggcaagttacccccgatggcgaatccgacgaagtaggtgtgataccatccaaaagacgcgtggagaagaaagagagggcacgattgaagaccgttaagtttaactccaagacccgggacaagggtgagatcccagacgacatgggttccaaggggcttaaacatgttacgagcaacgcgagtgattctgaaagctcttaccggggccaggaagagtatgtgctctcatacgagcccgtgaatcagcaagaagtgaattatactagacctgtgatcatccttggccctatgaaggatcggatcaatgatgacctgatttcagagttcccggacaaatttggatcttgcgtgccccacaccacgagaccgaaacgggattacgaagtagatggccgggactatcactttgtgaccagtagggagcagatggagaaagatattcaggaacataagtttattgaggcaggtcaatacaataaccacttgtatggcacaagtgtccaaagcgtccgcgaggtcgccgaaaaaggaaaacactgcatcctggacgtttctggtaatgctattaagcgcctccagatagcccaactctatccaatttcaatctttatcaaacccaagtcgatggagaatataatggaaatgaataagagactgaccgaagagcaggcccggaaaaccttcgaaagggccatgaaattggagcaagagttcacggaacatttcacagccatcgttcagggagacaccttggaagacatttataatcaggttaagcagattatcgaggaacagtctggatcatacatctgggtgccggctaaggagaagctgtag

SEQ ID NO: 185546 - DNA, 1539 bp, Artificial Sequence
  Description of Artificial Sequence: Synthetic coding sequence
atggagcgggcccggaagttcagcggcagcggcctggccatgggcctcggatctgcgagcgccagcgcttggagacgggccagccaaaggtgggcctggccgttgcgcagcctaagaccaggcggcgacgccagggagccacggaaaatcatcctgcacaagggatcaactggcttagggttcaatatagtgggtggcgaagatggggagggcatcttcgtttcgttcatactggccggcggtccagctgacctctcaggagagctcagacgcggggacagaatcctgtctgttaacggggtcaacctccggaatgctacgcacgagcaggccgccgcagcactgaagcgggcaggccaatccgtaactatcgtcgcacagtatcgcccagaggaatactcccgtttcgaaagcaaaattcacgaccttagggagcagatgatgaattcttcaatgagcagtgggtccggaagccttaggacttcggagaagagatccttatacgtgcgtgccttatttgactatgatcgaacgcgcgactcctgtctcccttcccagggcctgtccttcagttacggggacattctccacgtcattaatgcctctgacgacgagtggtggcaggcgcgactcgtgactccccatggcgaatccgaacagataggggtgatcccttccaaaaagcgggtagaaaaaaaggagagggcacgtctgaagaccgttaaatttcatgcgaggaccggaatgattgagtccaatagatccatcaagactaagaggaagaaatctttcagactcagcaggaagtttcctttttacaaatccaaagagaacatggcgcaggaaagttccattcaggagcagggggtaactagtaacacttcagattcagaaagctcttcaaagggtcaggaggatgctatcttgtcttatgagccagtgacaagacaggagatccactatgcccgtcccgtgatcatactgggccctatgaaggatcgggtgaacgatgaccttatatccgagtttcctcataaattcgggagttgtgttcctcacacaacaaggccacggcgtgataacgaagtggacggacaggactaccatttcgttgtaagccgcgagcagatggaaaaagacattcaggacaacaaatttattgaagccggccagttcaatgataatctctacggtacatccatacagagcgtcagagcggtggccgaaaggggcaagcactgtatcctggatgtgagtggcaacgctatcaaacggctgcagcaggcccagctttaccccatcgccatttttattaagcccaagtcaatagaagccctgatggaaatgaatcgccgccagacttatgagcaggcaaataaaatttatgacaaagcaatgaaactggaacaagaatttggggagtacttcacagctatcgtccaaggggattcactggaagaaatttataacaagattaagcaaataatagaagatcagtccgggcattatatttgggtgccgtccccagagaagctctag

SEQ ID NO: 185547 - DNA, 3021 bp, Artificial Sequence
  Description of Artificial Sequence: Synthetic coding sequence
gaggaggaggccggcgacctggtgcagcccggcatcagcttccccggccctgcagaggaggacctagacccccagtatagttggagccctactcagcacttcaatgaggagagatatagcccagcacctaggtccatgaaaggcttgagtggaagtagaacgcaaccgcctttatgcagcggccacacatgtggcttggccccacctgaggactgcgaacacctacatcatggcccagacgcccgccctccctatctcctcagtccagctgattcatgccctggcggcaggcatcggtgcagcccgaggtccagtgtgcactccgagtgcgttatgatgccagtggtactgggcgaccacgtgagctcttccaccttcccacgcatgcactatagctcgcattatgataccagagacgattgtgccgtggcccatgcaggggcaaaaatcaacagaatccctgcaaacctgctggatcaatttgaaaagcaattacctctgcaccgcgatgggtttcacactttacagtatcagagaacaagcgccgcagccgagcagcgttcagagtcacctgggagaatccggcatctcgtgcactctgtgcagaaattgttcactaaatcccacagcctggaagggagttccaagagcaatgctaacgggaccaaagccgacggccgggctgacgaccaccaccacgcccaccatgccaagcatagcaaacgctccaagagtaaagaaaggaagcccgagggtaagccccgacccggcatgtctagctggtggtcgagcgacgacaatctggactctgactccacctatcgaacaccttcagtgcttaacagacaccatttaggtccagttgcgcactgctaccccgatgctctccaaagccccttcggagacctctctctgaagacaagtaaatctaataacgacgtgaaatgttccgcatgcgagggtttggccctgaccccagacgccaagtacttaaagagatcttcctggtccacccttaccgtttcccaggcaaaggaggcttaccgcaagtcatccctcaacttggacaagccccttctacatcaggatgctaagccagcccttcgtccctgtcattacctccaagtgccacaggacgagtgggggggctatcccaccggaggaaaagatgaagaaattccatgtagaagaatgcggtcgggctcatacattaaggccatgggagacgaggagagcggcgaaagtgacagcagtccaaaaacatcaccaaaaagcgctatcttgccagaacctctgctgaaaagcatcggacagcggcctctgggagagcaccagacccagacctatctgcaggccgcttccgacgtgcctgttggccatagtcttgacccggccgccaactacaatagccccaagttccggtccaggaatcagtcttatatgagagctgtttcaaccctctcacaagctagctgcgttagtcaggtctcagaggcagagatcaacgggcagttcgaatcggtgtgtgaatcagtgttcagtgaggtggagtcacaggctatggatgcgttggatctgcccggttgcttccgcacacgatctcactcttacctcagagctatacaggccggctatagccaagacgatgagtgtatccctatgatgacgcctagcgatatcactagcaccatccggagtacagctgccgtctcttacaccaactacaagaagactcctcctcctgtgcctcctcgtaccacctccaagccgctgatctcggtcacagcacaaagtagcacagagtcaactcaagacgcctatcaggattctcgcgctcagagaatgtcgccttggcctcaagatagccgcggtctgtacaattcaacagactccctcgatagcaacaaggcgatgaatcttgctctggaaaccgccgccgcgcaacgccacctgccagagagccagtccagctctgtccggaccagcgataaggctatcctggtctcaaaggcagaggaattgcttaaaagccgttgttccagcatcggtattcaagtcgaaactgccaccgactcagacacagagagcagaggactcagggagtatcattccgtgggcgtgcaggtggaggacgaaaaacgtcatggtaggtttaaaaggagtaatagcgtgaccgccgcagtacaggccgacctggagcttgagggatttcccggccatatcacaacagaagataagggcttacagtttggttcctcatttcagcggcattcggagccttccactccaactcaatacagcgcggtaaggactgtacgtacacagggtctgttctcttaccgagaagattatagaactcaagttgacacctctaccctgcctccccctgatccctggttggagcccgccatcgataccgtggaaactggtcgcatgtcaccttgcaggcgggacggaagctggtttttgaagcttctccatgcagaaacaaagcggatggagggatggtgtaaagaaatggaaagagaggcagaggagaatgatttatcagaggaaatcctggggaaaatcaggagcgccgtaggttccgcccaactcctgatgtcacagaaatttcaacaattttattggctgtgtcaacagaacatggaccccagtgccatgcctcgccccacatctcaggatctggcaggttattgggacatgctgcagctttctattgaagacgtgagcatgaagtttgatgagctccagagactgcgtctgaacgactggaaaatgatggaatccccagaacgcaaggaagaacgaaaggtccctcccccaatccctaagaagcctccaaagggtaaattcccgatcacacgcgagaaatccctcgacctacctgataggcagcggcaggaggcccgcagaagactcatggccgccaagagggctgctagttttaggcaaaatagcgcctccgagcgcgctgactcaatcgaaatatacattcctgaagcgcagaccagactctag

SEQ ID NO: 185548 - DNA, 2928 bp, Artificial Sequence
  Description of Artificial Sequence: Synthetic coding sequence
atgaagggcctgagcggcagccggacccagccccccctgtgcagcggccacacctgtggactggccccaccagaggactgtgagcacctgcaccatggaccggacgctagacccccctatctcctgagccccgcagacagttgtcccggcggccgccatcgttgttccccaagaagtagcgtacactctgagtgtgttatgatgcccgtcgtgcttggggatcacgtttcttcatctacttttcctagaatgcattatagctcccactacgacaccagagatgactgcgctgtagctcacgccggagccaagatcaacaggatccccgctaacctactggatcagttcgagaaacagctgcctctccatcgcgacggtttccacaccttgcagtatcagcgtacctccgccgccgctgaacaaaggtccgagtctcctgggcgcattagacacttggtgcattcagtccagaagctgtttactaagtctcacagcctcgagggcagctccaaaagtaatgcgaacggcaccaaggccgatggacgcgctgacgaccaccaccacgcccatcatgctaagcattccaagcgcagcaagtccaaggagagaaaacctgagggcaaaccgagacccgggatgtcgagctggtggagctccgacgacaacctggatagcgattcgacttatagaacccccagcgtgctgaacaggcaccacttgggccccgtagcacactgctacccggatgccctgcagtcccccttcggggacctgtcactgaagacttctaagtctaataatgatgtgaaatgctcagcatgtgaaggactggccttgaccccagacgccaagtacttgaaacgcagttcatggagcaccctcaccgtgtcgcaggcaaaagaggcctacagaaagtccagtttgaacttagataagccactgctccaccaggacgcaaagccagctctgaggccttgccactacctgcaggtcccgcaggacgagtggggtggataccccacaggcgggaaagatgaggaaatcccgtgcaggaggatgcgatctggctcttatatcaaggcaatgggtgatgaggaatcaggtgagtccgattcttcacccaaaacatcacccaaatccgcgattctcccagagccactccttaagtccattgggcagcggcctttaggagagcatcagacccagacataccttcaggccgccagcgacgtgccagtagggcatagtcttgatcctgcggccaactacaattcacccaaattccgatcaagaaatcagtcatatatgagagccgtgtctacccttagccaggccagttgtgtctcccaagtgtctgaagccgagatcaacggtcaattcgagagcgtctgtgagagcgtgtttagcgaagtcgagagccaggcaatggacgccctggaccttcccgggtgctttcgtactcgatcacacagctaccttagggctatccaggccggctattcccaggatgacgagtgtataccaatgatgacacccagcgatataacaagcacaataaggagtacagccgccgtctcctataccaactataagaagacccctccccctgtgccacccagaactacttctaagccgttaatcagcgtaacagctcagtcatctactgagtcaacacaggatgcgtatcaggattctcgggcccagcgcatgagcccttggcctcaggattccagggggctatataattctaccgactccctggacagtaacaaagctatgaacctggcactggaaacagcagccgcacagagacatttaccagaaagtcagtctagctccgtaaggacctcggataaagcgattctggtgagcaaagccgaggagcttctgaagtctcgctgcagcagcataggcattcaggacagcgagttcccagagcaccaaccataccctcgcagcgatgtggagacggccactgattcagacaccgaaagtaggggcctacgcgaataccattccgtcggggtccaggttgaagatgagaaaagacacggccgatttaagcgcagcaactctgtgacggctgcagtgcaggccgatcttgagttggagggatttcccgggcatatcaccacagaggacaagggattacagttcggaagtagcttccagcgccactctgagccgagtacacccactcagtacagtgcagtgcggaccgttagaacccagggcctttttagttatcgggaggattacagaacccaagtcgacacatccactctgccaccaccagacccttggcttgaaccagcaatcgacactgttgaaactggccgtatgagtccttgccggagggacgggagttggtttcttaaactgcttcatgctgaaaccaaaaggatggaaggttggtgcaaggagatggaacgagaagcggaagaaaacgacttatccgaagaaattctgggcaagattcgctcggccgtgggatccgcgcagctgctgatgagtcagaaatttcaacagttctactggctttgtcagcagaatatggaccccagcgccatgccacgaccaacctcccaggatctggcgggctactgggatatgctgcaattatctattgaggatgtgagcatgaagttcgacgagctacagcggctgcgcttgaatgactggaaaatgatggaatctccagaacggaaggaggagagaaaggtgcctccaccaatacccaagaagccccccaagggaaagttccctatcactcgagagaagtcgttggatctccccgaccggcagagacaggaggctaggcggcgcctgatggcagctaagcgagcagcgtcgttccgccagaacagcgcgagtgagagagccgactccatcgagatttacatccccgaggcccaaactcgcctgtag

SEQ ID NO: 185549 - DNA, 2937 bp, Artificial Sequence
  Description of Artificial Sequence: Synthetic coding sequence
tgacccacccagcacttcaacgaggagcggtacagccccgccccccggagcatgaaaggactctccgggtcccgtactcaacctcctctgtgctccggccacacatgcggcttggcacctccggaggactgcgagcatttacatcatggaccagacgcaaggccaccgtatctgctgagccctgctgactcatgccctgggggacggcaccgatgcagccctaggagtagcgtgcattcagagtgcgtgatgatgccagtggtgttaggagaccatgtgagctcctcgaccttcccacgtatgcactactcatctcactacgacacccgtgacgattgcgccgttgcccatgcgggcgcaaaaataaacagaataccagccaacctgttagatcagtttgagaaacagctgccgcttcatcgggatggtttccatacactacaatatcagcggactagtgccgccgctgagcagcgtagcgagagccccggacgcatccgccacttggtccatagcgttcagaagctcttcacaaaaagtcattctttggaaggaagctcaaagtctaatgcaaacgggaccaaggccgacggcagggctgatgaccatcatcacgcccatcacgcgaagcattcaaaaagaagcaagagcaaagagcgaaagcccgaaggaaagccaagacctggtatgagttcttggtggtcgagcgatgacaacctggactcagacagtacatatagaactcctagcgtcttgaatcgccaccacctggggcccgtggctcactgttacccagatgctctccagtctccgtttggagacctttcgctgaaaacaagcaaaagtaacaatgatgtaaagtgttctgcctgtgaaggcctcgcattgacaccagatgccaaatacttgaaaaggagctcatggtctacactgactgtcagccaggctaaagaggcctaccggaagagctcacttaatcttgacaagccacttctgcaccaggacgccaagcctgccctgcgaccctgtcattatctgcaggtgccccaggatgaatggggcggctatccaactggggggaaagatgaagaaatcccttgccggagaatgagaagcgggagttacatcaaagctatgggagacgaagagagcggtgagagcgattcgtctcctaaaaccagtcccaagtccgctattttgcccgaacctctcttgaaaagtatcgggcagagaccactgggggaacatcagactcagacatacctacaagctgccagtgatgtccctgtgggccatagccttgatccagcagcaaattacaactcacccaagttccgcagtcgcaaccagagctacatgcgtgccgttagtaccctgagtcaggcctcctgtgtctctcaggtttccgaggccgagatcaatggacagttcgagtccgtctgcgaaagcgtgttctctgaggttgagtcacaggctatggacgcactggacctgccaggatgtttcaggactcggagccacagttacctgcgagcaatccaggcggggtactcccaggacgacgaatgtatccccatgatgactccaagcgacatcacaagtactatccgttctaccgctgccgtgtcgtacactaactataagaagacccccccgcccgtacctccccgtaccaccagcaaaccacttatttccgtgaccgcacagtcttccacagaatctacccaggacgcatatcaggactctcgcgcacaacgtatgtctccttggccacaggatagccgcggtctgtataactctacagattctttggattcaaacaaagctatgaatcttgccttggagacggccgcggctcaacggcacctgccggaaagtcagtccagtagcgtgaggacctcagataaggccatcttggtgtcaaaggcagaagaactgctgaagagccgctgttcctccataggtattcaggtggaaactgcaactgactcggacaccgagtcacgaggactgcgcgagtaccattccgtgggggtgcaggtcgaagacgaaaagagacatggtcgtttcaaacgaagtaattcagtgaccgccgccgtgcaggctgacctggagctcgagggatttccagggcatattacaactgaggataagggtctccaatttggtagttcattccagaggcattccgagccttctacacctacccagtattccgctgtgaggacagtcaggactcagggccttttcagttacagggaagactacagaacgcaggttgacacttcaacccttccccctccagacccgtggctggagcccgccattgatacagtggagaccgggcggatgagcccttgcaggagagatggaagttggttcctgaagctgctgcacgcggagaccaaaaggatggagggctggtgcaaggagatggaacgagaagccgaggagaacgacctgtccgaggagattctcgggaaaattagaagcgccgtcgggtccgcccagctcctgatgtcacaaaagtttcaacagttctactggctgtgtcagcagaatatggatccatccgccatgccaaggcccacctcgcaggatctcgcagggtactgggacatgctgcagttatcaatcgaggacgtgagcatgaagttcgacgagctgcagagattgaggctgaatgactggaagatgatggagtcacccgaaagaaaagaagagagaaaagtaccacctccgatcccaaagaagccacccaagggtaagttcccaattactagagagaagagtttggaccttcctgaccggcagagacaagaagctagaagacgtctgatggcggccaagagggcagccagtttcaggcaaaactcagcctctgagagagccgatagcattgagatctatattcccgaagcacagacacggctgtag

SEQ ID NO: 185550 - DNA, 2562 bp, Artificial Sequence
  Description of Artificial Sequence: Synthetic coding sequence
atgcccgtgcggaagcaggacacccagcgggccctgcacctgctggaggaatataggagtaaactgtctcaaacagaggaccggcagctgagatctagcattgagagggtcatcaatatatttcagtccaacctgttccaggctctcatcgacattcaggaattttacgaagtgacacttctagataatccaaagtgtatcgatcgcagcaaaccttcggagcctatacagccggtgaacacctgggaaatctccagcctgccctcttcgactgttacttccgagaccctccctagctccctctcaccttctgtggagaagtacagataccaggatgaggataccccacctcaggaacacataagccctcagattaccaacgaggtcatcggaccagaactggttcatgtatcggaaaaaaacctttctgagatagaaaacgtgcatgggtttgtgtcccatagccatatctctcccatcaaagtgaacgggacagacgcagattatgaatacgaggagatcacactggagagagggaacagtgggctgggcttctctattgccggagggacagacaatccacacataggcgacgactcatcaatttttatcaccaaaataataaccggcggggctgcggcccaggacgggcgcctgcgagtcaacgattgcatcctccgagtgaacgaagtggacgtgcgcgacgtcacccattcaaaggcagtggaagccctgaaggaggccggcagcatcgtgcgtctgtacgtcaaacgccgcaaacccgtaagcgagaaaatcatggagattaagctcattaaagggccaaaggggctcgggttttctatcgctgggggcgtgggcaaccagcacattccaggggacaacagcatttacgtgacaaagattattgaaggcggtgccgcacataaggacggcaagctgcagatcggggacaagttgctcgccgtcaataatgtgtgtctcgaagaagtgacccacgaggaggccgtgacagctctcaagaacacctccgatttcgtgtacctgaaagtcgccaagcctacatctatgtacatgaacgacggctacgctcccccggatatcactaatagctcttctcagccagtagataatcacgtctcaccttccagctttctgggacaaactcccgcatcccctgctcgctacagcccggtgagcaaagccgtgctgggggacgacgaaattacccgggaaccacgtaaagtggtgctgcatagagggtcaacgggcctcggcttcaacatcgtggggggcgaggatggcgaggggatcttcatcagctttatcttggctgggggcccagcagacctatccggtgagctcagaaaaggggacagaatcattagcgtgaattcggtggacctaagagcggctagccacgagcaagccgcagccgcactgaaaaatgcagggcaagctgtcaccatcgttgcccaatatagaccagaagagtactcacggttcgaggctaaaattcacgacctgcgggaacaaatgatgaattcttctatttctagcggttccggctctttgaggacctcacagaagcgatcgctgtacgtcagggcccttttcgattatgataagactaaggactcgggcctgccctctcagggtctaaattttaaattcggagacatcctgcacgtgattaacgcttcggacgacgagtggtggcaagctagacaggtgactcccgatggtgaatcagatgaggtgggcgtaataccctctaaacggcgggtggagaagaaggaaagagcccgcctgaaaaccgtcaaatttaactccaagactagggataagggggaaatacctgatgacatgggtagtaaagggctgaaacacgtgacctctaatgcgtctgattcagagtccagctacagagggcaggaagagtacgtgctatcatacgagcctgtcaaccagcaggaagtcaattacactcgcccagtgatcatcctgggacctatgaaggatcgtattaacgacgatttaatctcggagttcccagacaaatttggttcctgtgtgccccataccactcggcccaagagagattatgaggtggatggacgtgactaccacttcgtgacgtctagggagcagatggagaaggacattcaggaacacaagttcatcgaagcagggcagtacaacaaccacctttacgggaccagcgtccagtctgttagagaggtagctgaaaagggcaagcactgcattttggacgtcagcggtaacgctatcaagcggttgcagatcgcccaactatatccaatctccatcttcatcaagcctaagtccatggaaaacatcatggagatgaataaacgacttacagaagagcaggcccgtaagacgtttgagagagccatgaagttggaacaggaatttactgagcattttactgcaatcgttcagggcgacactcttgaggacatctacaaccaggtgaagcagatcattgaagagcagtctggaagttacatttgggtaccagctaaagagaagctgtag

SEQ ID NO: 185551 - DNA, 2781 bp, Artificial Sequence
  Description of Artificial Sequence: Synthetic coding sequence
atgcccgtgcggaagcaggacacccagcgggccctgcacctgctggaggagtacagatcaaaactttctcaaactgaggaccgccaactccgctccagtatcgaacgagtgattaatatttttcaatctaacctatttcaagcactgatcgacatccaggagttctacgaggtgacattgctggacaaccccaagtgcatagaccgttcaaagccgagtgaaccgatccagcctgttaatacttgggaaatctcatcacttcctagttccactgtcacctccgagaccctgccatcatccctgtcaccatcggtggaaaagtaccgctatcaggatgaggacacacctccgcaagaacatatctctccccagatcactaatgaagtcatcggacctgaactggttcatgtcagcgaaaagaacttgagcgaaatagagaacgtgcatggctttgtctcccactcacacatcagtcccatcaagccaacagaggcagtgctcccctccccacccaccgtcccagtgattcctgttctgcccgtgcccgctgaaaataccgtgattctccctacaattccacaggcaaatccacctcctgtgttggtcaacaccgactctctggaaacccccacttacgtaaatggaactgatgcagattatgagtatgaggagatcactctggagcgtgggaacagtggactgggattctcaatcgccgggggaacggataatccccatatcggcgacgactccagtatcttcattaccaagattataaccggtggcgccgcagctcaagacggacgcttgcgggtcaatgactgcatcctgagagttaacgaagttgatgtgagagatgttacccactcaaaagccgtcgaggcccttaaggaggctgggagtatcgttcgtctttacgtgaaacggcgcaaacccgtcagtgagaaaattatggagatcaaactgatcaaggggcctaaggggctggggttctcaattgcaggtggggtcggaaaccagcatattcctggcgataactccatctacgttaccaaaattattgaaggtggggcagcccataaggacggcaagcttcaaattggtgacaaactcctcgctgtgaataacgtttgtttggaagaggtgacgcatgaggaggccgtgacagctctaaaaaacacttccgacttcgtgtacctgaaggtagccaagcctacttctatgtatatgaatgatggatatgccccacccgacattacaaactcttcttcccaacctgtcgataatcacgtctctcctagtagtttcttgggccagacccccgcttcaccggccaggtatagtcccgtgagtaaggcagttctcggagacgacgaaataaccagagagccacgcaaagtcgtgttgcatcgtggctcaaccggactgggcttcaatatcgtgggtggggaagacggcgagggcatatttattagcttcatactggccgggggcccagcggatctgtctggcgaactgcgaaaaggcgacagaattatttctgtgaattctgtggacctccgggccgcatcacatgagcaagcggccgcagcgttgaagaatgctggacaggccgtgaccatcgtggcccagtacaggccagaagagtattcccgtttcgaagcaaaaatccacgatttgcgcgagcaaatgatgaacagtagcattagcagcggcagtggctctctccgcacatctcagaaacgaagcctgtacgtgagggcgctgtttgactatgacaaaaccaaagactctgggcttccctctcagggactcaactttaagttcggggacattctgcatgttataaacgcctccgatgatgagtggtggcaggcaagacaagtgacacccgacggcgaatcagacgaagtcggtgtcatcccgtccaaacggagggtagagaagaaagaacgtgcccgattgaaaacagtcaagttcaacagtaaaactagagacaaggggcagagctttaacgacaaaagaaagaagaacttgtttagtcgaaaattccccttctataagaataaagaccagagtgagcaggaaactagtgatgccgaccaacacgtgacatccaacgcttcagactccgagagctcctaccgtgggcaggaagagtatgtcctgtcatacgaacctgtgaatcagcaggaggttaactatacaagacctgtcataattttgggacccatgaaagaccggatcaatgacgacctcatatccgagttccctgataaatttgggagctgcgttccacacaccaccagacctaagagagattacgaagtggacggtagggactatcacttcgtaacaagcagggagcagatggagaaggacatccaggagcacaaattcatagaagctggacagtataacaaccacctgtacggcacatctgttcaatccgttcgggaggtggccgagaaggggaagcactgtatcttggatgtctcaggcaatgccattaagagactccagatagcacagctctaccccatcagtatttttatcaagccaaaatccatggagaacatcatggagatgaacaagcggctgactgaagagcaagcacggaaaaccttcgagcgcgccatgaagttggagcaggaatttaccgaacactttaccgccattgtgcagggtgataccctcgaagacatctataatcaggttaagcaaatcattgaagagcaatcaggttcctacatttgggtccctgccaaagaaaaactgtag

SEQ ID NO: 185552 - DNA, 2682 bp, Artificial Sequence
  Description of Artificial Sequence: Synthetic coding sequence
atgcccgtgcggaagcaggacacccagcgggccctgcacctgctggaagagtatagaagtaagctgtcacaaaccgaagacaggcagctgcggagtagtatcgaaagagtcattaatatttttcagagtaatctgtttcaggctctcattgacatccaggagttctatgaggttacgctactggataatcccaaatgtatcgacaggtcaaagccctccgaacctatccagcccgtcaacacttgggaaatcagttctttgcctagtagcactgtcacctccgagacactgcccagcagcctaagccctagcgtggaaaaataccggtaccaagacgaggatacacctccacaggagcatatcagccctcaaatcactaacgaagtcattgggcctgaattggtgcacgtgagcgagaaaaatcttagcgaaattgagaatgtccacggcttcgtaagtcatagccatatctcccccatcaaggctaaccctccgcctgtactcgttaatacagactcactggagactcctacctatgtgaatgggacagatgcagactacgaatatgaggaaataacgttagagcggggaaattctggcctcggcttctctattgccggaggcaccgacaatccacacatcggggatgactctagtatcttcattacaaaaataatcaccggtggagccgccgctcaggacggcagacttcgagtcaatgactgtattcttagggtgaatgaagttgacgttcgggacgtaacgcactccaaggctgtcgaggcgttaaaagaggcgggctctatcgtccggctttacgtcaagaggcgcaagcccgtttccgagaagataatggagattaagttgatcaagggaccaaagggacttgggttcagtatcgccggaggcgtgggcaaccagcatattccaggcgataacagcatttacgttacaaaaataattgagggcggcgctgctcacaaggatggtaagctccagattggcgacaagctgttagcggtcaataatgtgtgtctcgaggaggtgacacatgaggaggccgtgaccgcactgaagaacacgtcagatttcgtctacttgaaggtcgcaaagcctactagtatgtatatgaacgacggctacgccccaccagacattacaaactcctcaagccaacccgttgacaaccatgtgagtcctagcagcttcctgggccagactcccgctagccctgcccgctattccccggtgtctaaggccgttctcggcgacgatgaaataacgagggagcctcgtaaagtggttctacaccgcggatctaccggtttggggttcaatatagtaggcggagaggacggggaagggatcttcatctcttttattttggccggcgggcctgcagacctttccggtgaactcaggaagggggacagaatcataagcgttaattcagttgacttgcgggcggcctcccatgaacaggctgccgcagccctgaaaaatgcaggccaagccgtgaccatcgtcgcccagtatcggccagaagaatatagccgatttgaggcgaaaatccacgacctgagagagcagatgatgaactcaagcatatcatcaggctccggcagtcttaggacctctcaaaagcgaagtctgtacgtacgggctttgttcgattatgacaagaccaaggattccgggctgccgtcacagggcctgaacttcaaattcggtgacatactgcacgtgattaacgcctctgacgacgaatggtggcaggcccgacaggtcactccagatggggagtccgatgaggtaggagtgattcctagcaaacgtcgggtggagaaaaaggaaagggcaagattgaagaccgtgaaattcaattctaaaacaagagataagggtcagagcttcaatgataagagaaaaaagaacctgttttcaaggaaatttcctttttataaaaacaaagaccaaagcgaacaagaaacgtccgacgccgatcagcatgtgacctcgaacgccagtgattccgaaagtagctaccgtgggcaagaggaatacgtgctgtcctatgaacccgtgaatcagcaggaagtgaattacacccgccctgtcatcatcctgggccctatgaaagacaggatcaacgatgatttgatttctgaattccccgataaatttggtagttgtgtgccccatacaacgcgacccaagcgggattacgaagtcgacggccgcgattaccactttgtcacatcgagggagcagatggagaaggatattcaggagcacaagtttatcgaggccggccagtataataaccacttgtacggtacaagcgttcaatccgttcgagaagtggcggaaaaggggaagcactgtatcctggatgtaagtgggaatgcaataaagcgcttacagattgcgcagctctaccccatcagcattttcataaagcccaaatctatggaaaatattatggagatgaataaaaggctcacagaggagcaggccagaaagaccttcgaacgggctatgaaactggagcaggagtttactgagcacttcactgctatcgtgcaaggagataccttagaagacatctataatcaggtaaagcagatcatcgaagagcagtccggcagctacatctgggtccccgctaaagagaaactgtag

SEQ ID NO: 185553 - DNA, 2754 bp, Artificial Sequence
  Description of Artificial Sequence: Synthetic coding sequence
atgcccgtgcggaagcaggacacccagcgggccctgcacctgctggaagagtaccgctccaagctgagccaaacggaagatagacagctccgatcctctatcgaacgcgtaatcaatatctttcagagtaacttgtttcaagcactcattgatatccaggagttctatgaggtcactctgctggataatcccaagtgcatcgataggtctaagccctccgagccgatacaacctgtgaacacatgggagatctccagcctcccctcttctaccgtgacctcagaaacacttccttcatctcttagcccttcagtcgaaaagtaccgataccaggacgaggacacaccaccccaggaacatataagcccacagattacgaatgaggtgatcggtccagaactggttcacgtgtctgagaagaacctgtccgagatagagaatgtccatgggtttgtgtcccattcccacattagtccaataaagccgaccgaggcagtcctcccctctccacctacggtccccgttataccagtcttgcccgtgcccgccgaaaatactgtcatcctcccaaccatcccccaggcaaaccccccgcccgtgctggtcaacaccgattccttggagacacctacttacgtgaatggaaccgatgccgactatgaatatgaggagatcacactggagagggggaacagcgggctcggctttagcatcgctggcggaacggacaacccccacattggagatgattctagtattttcataacaaagattataactggcggcgccgcggcccaggacggcagactgcgcgtaaatgattgcatcctgcgggtaaacgaagtggacgtacgcgacgtcacacacagcaaggcggtggaggctcttaaggaggctggaagcattgtgcggttgtatgtgaaaagacgaaaaccggtgagcgagaagatcatggagatcaagcttataaaaggaccgaaaggcctcggtttttcaatcgcggggggcgtggggaatcagcacatacctggagacaatagcatctatgtcacaaaaataatagagggaggagctgcccataaggacggcaagctgcagattggagacaagctcctggcagtgaacaatgtgtgcctcgaggaggttacacatgaggaagccgtgacggccttaaagaacacatccgactttgtatacctcaaagtagctaagcctacttctatgtacatgaatgatgggtatgcaccaccagatataacgaatagctcctcccagcccgtggataaccatgtgtctccatccagctttcttggccagacgcccgcaagccccgcccgatacagccccgtctctaaggcagtgctcggggacgacgaaattacccgtgagccgaggaaagtggtgctccatagaggtagcacaggtctgggatttaatatcgtgggaggggaggacggagagggcatattcattagttttattctagccggaggtcccgcagacctgtctggagaactgcggaagggggatcggatcattagcgtgaactctgtggacctgagggcggcttctcatgaacaggcagcagctgccttgaagaacgccggccaagccgtaacaatcgtggctcagtatcgccctgaggaatactcaaggttcgaagctaagatacatgatctgagagagcagatgatgaatagttcaatatcaagcgggagtggttccttgagaacatctcagaaaaggagcttatatgtgagagcccttttcgactacgataagacaaaggacagcggacttccttctcagggattgaactttaagtttggtgacattttacatgtaataaacgcatcggacgatgagtggtggcaggccagacaagtaacccctgacggcgagagcgacgaggtgggagtcattccttctaaacgtagggtagagaaaaaggaaagagcaagactgaaaaccgtgaagtttaactccaagacacgggataaaggcgagataccagatgatatgggttccaaaggcctgaaacacgtgacaagtaatgcgagcgactcagagagcagttatctcatcctaatcacagacgagtacggttgttccaaaggtagaggacaggaggagtatgtgttatcatatgagcccgtgaaccagcaagaggtgaattacacgagaccagttatcattctcggccctatgaaagaccgcattaatgacgatctgatctctgagttccccgacaagtttggcagctgcgtgccccacaccacacgacccaagagagactatgaggtggacgggcgcgattatcatttcgtgacttctagagaacaaatggaaaaggacattcaggagcataagtttatcgaagctggccagtacaataaccatctctatggaacgtcagtgcagtcagttcgtgaagttgcggaaaagggtaaacattgtattctggacgtttctggtaatgcgatcaagcgactgcagatagcgcagctctaccctatatccatttttatcaagcctaagtctatggagaacataatggagatgaacaagaggctgactgaagagcaggcacgtaagaccttcgagagagccatgaaactcgaacaggagttcaccgagcacttcaccgcaatagtgcaaggagatacactcgaggatatttataaccaggtgaaacagattatcgaagagcaatctggttcatatatatgggtcccagccaaggagaagctgtag

SEQ ID NO: 185554 - DNA, 2676 bp, Artificial Sequence
  Description of Artificial Sequence: Synthetic coding sequence
atgcccgtgcggaagcaggacacccagcgggccctgcacctgctggaggagtatcggtccaaactgtcacaaactgaagataggcagttgagatcctcaatcgaacgcgttatcaacatattccagtccaatctctttcaggccctgatcgacattcaagagttttatgaggtcaccttgttggataaccccaagtgtatcgatcgctccaaaccctctgagcccatccaacctgtcaatacatgggagatctcgagccttccgagctcaaccgtgacgtccgagactttgccgtcctctttatccccctccgtggaaaagtatcggtatcaggacgaggatactccaccacaggagcacatctcaccacagataaccaacgaggtcatcggccccgaactggttcatgtatctgaaaagaatctgtccgaaattgaaaatgtccacggattcgttagtcattctcacatttcaccaatcaaacccaccgaggcagtgttgccttcaccgcctacggtccccgtcattcccgttctaccagtgccggctgagaacacagtgatactccccaccattccgcaggccaacccccctcccgttctggtgaacaccgattctctcgagacgcctacatacgtaaatggcaccgatgctgattatgaatatgaagagatcactctcgaacgaggaaattccggcctgggattctcaatcgccggcggcactgacaatcctcacataggcgacgacagcagcatttttatcaccaaaatcatcaccggtggggccgccgcccaagacgggaggctgcgtgtcaatgactgcattttacgtgtgaatgaagtggacgtgcgtgacgtcacccattctaaggccgtggaggcactaaaagaagccggatccattgttcggctgtatgtgaaacgtcggaagccggtgtcagaaaaaattatggaaatcaagctgatcaaaggaccaaagggactggggtttagtattgccggcggtgtgggtaatcagcatataccaggtgacaacagcatatacgttaccaagatcatcgagggcggggcagcgcataaagatggaaagctgcagattggagataaactgctagccgtgaacaatgtgtgtctggaggaggttactcacgaagaggctgtgactgcgcttaaaaacacctcagattttgtgtatcttaaagttgccaagcccacaagcatgtacatgaacgacggttacgctccccctgatattacaaactcctcctcccagcccgtggataatcacgtttctccatccagtttcctgggccagactcccgcaagtcccgctcggtacagcccggtttccaaggccgtgctcggcgacgatgagatcactagagagcctcgcaaagtagtcctgcatcggggctcgaccggcttaggctttaacatcgtcggcggggaagacggggagggcattttcattagtttcattttggccgggggtcctgcagacctgagcggagaactccggaaaggcgatagaattatcagtgtgaactcggtagatctgcgggcagcatcccatgaacaagctgcagctgcactgaaaaatgctggacaggccgtgacaatagtagcccagtataggcccgaggagtattcgaggttcgaggctaaaatccatgatcttcgcgagcagatgatgaactctagtatttccagtggctcaggatctcttcgtacgtcacagaaacgaagtctgtacgtccgcgctctattcgactacgacaaaactaaggatagcgggttgcctagccagggacttaatttcaagttcggcgacatcttgcacgtgataaatgccagtgatgacgagtggtggcaggccaggcaggttacgcctgatggagagagcgacgaggttggcgtgattccatcaaagcgccgagtcgaaaaaaaggaacgcgcaagactgaaaactgtgaaatttaactccaagactcgtgataagggcgagattccagacgatatgggttcaaagggactgattggcggccaggaagaatatgtgctttcctatgaaccagtgaaccagcaggaggtgaattatacaagacctgtgatcatcctcgggcccatgaaggaccgcattaacgatgatctgataagcgagtttcctgacaaattcgggagttgcgtcccgcacaccacccggcctaagcgggattacgaggtcgatggccgggactaccattttgtgacttctcgtgagcagatggagaaagatatccaggagcataagtttattgaggccggacagtacaataatcatctttacggaacgtctgtccagagtgtgcgcgaggttgcggaaaaaggcaagcattgcattcttgatgtgtcagggaatgccatcaagagacttcagatcgctcaactgtacccaatttccattttcatcaagccaaaaagcatggagaacataatggaaatgaacaaaagactgaccgaggagcaggctcggaagacattcgaacgggcaatgaagctggaacaggagttcactgaacactttacagccattgtgcagggggacactctggaagatatctacaatcaggtgaagcaaatcatagaggagcaatctggcagctatatttgggttcccgccaaggaaaaactgtag

SEQ ID NO: 185555 - DNA, 627 bp, Artificial Sequence
  Description of Artificial Sequence: Synthetic coding sequence
atgcccgtgcggaagcaggacacccagcgggccctgcacctgctggaagagtatagaagcaagctctcccagactgaagatagacaactgagatcaagcattgagcgggtcatcaacatttttcagagcaatttatttcaggcccttattgatatacaggagttttatgaggtgacactcctcgacaatcccaagtgcatagacaggagtaagcccagcgagcctatacaaccagtaaatacatgggagatctcttcgttgcccagcagcacggtgactagcgagactttaccttcttcactgtccccctctgttgagaaatacaggtatcaggatgaggacacacctccccaggagcatatttctccccagataacaaacgaggtgataggccccgaactggtgcatgtttcagaaaagaacctctcagagatagagaatgtgcacgggttcgtcagccactcacatattagtccaatcaaacctacagaggctgtgctcccaagtccacctacagtccctgtcatccccgtgctgcccgtgcccgctgagaacacggtcattttgcctaccatcccacaggctaatccgcctcctgtgctagtcaacacagattctctggaatag

SEQ ID NO: 185556 - DNA, 2616 bp, Artificial Sequence
  Description of Artificial Sequence: Synthetic coding sequence
atgcccgtgcggaagcaggacacccagcgggccctgcacctgctggaggagtacaggtctaagctgtcccagactgaggataggcaactgcggagtagcatagaaagagttatcaatatctttcagtccaatttgttccaagcccttatcgatatccaggaattttacgaagtaaccctcctcgataacccaaaatgcattgatcggtcaaagcccagcgaacctatccaacctgtgaacacatgggagatatcatctctcccttcctctactgtcacctccgagacactgccgtcaagcctgtcaccatctgtagagaagtataggtatcaggatgaagacacccctccgcaggagcatatctctccccagatcaccaacgaggtcattggaccggagcttgtacacgtatccgaaaaaaatttatccgagatcgagaatgtgcacgggttcgtctctcactctcatattagccctattaaagccaatccccctcctgtgctcgtcaacacagactcgctcgagactccaacatatgtgaatggcactgatgccgattacgagtacgaggagattacgctggaacgcggtaattctggcctgggcttttccatcgccggaggaacggacaatccgcatatcggcgatgatagctccattttcatcactaaaattattacaggtggggctgcagcccaagacggtaggctgagggtgaacgattgtatcttaagggtgaacgaagtggacgtgcgcgacgttacccactccaaagcggtggaggctctaaaggaagccggatcaatcgtgaggttgtatgttaaacgtcgcaagccggtcagcgagaagattatggaaatcaaattgattaaaggccctaagggacttgggttctccatcgccggcggggttggcaaccagcatattccaggtgataactctatctacgtgaccaaaattatcgaaggcggggctgcgcacaaggatggaaaacttcagatcggcgacaaacttcttgctgtgaacaatgtttgtctggaggaagtgactcacgaggaggccgtaacagccctcaaaaatacgtccgacttcgtctacctgaaggtcgccaagcctacgagcatgtacatgaatgatggatatgcccccccagacatcacaaacagcagctctcagccagtcgataatcatgtttcgccctcgtcattcctgggccagacgcccgccagccccgctagatactcacctgtgtccaaggccgtactgggggacgatgaaattacacgcgaacctcgtaaggtggtgctgcatcgaggctccactggactgggtttcaacatcgtgggaggcgaagacggcgaggggatctttatttccttcattctggccgggggaccagccgacttgagtggagaactgaggaagggggaccgcatcatatctgttaattcagtcgatttacgtgctgctagtcacgaacaggcagctgccgccttaaagaacgccggacaggcagtgaccatagtagctcagtaccgacctgaggagtacagtcggttcgaggctaaaattcacgacctgagggaacagatgatgaactcgagcatcagtagcggctctgggtcactgcgtacgtcacagaagcggagcctatacgttagagcgctgtttgattatgataagacaaaggattccgggctgccgagtcaaggacttaattttaaatttggagatatccttcatgtcatcaacgcttctgacgatgagtggtggcaggcccggcaggtaacaccggacggagagagcgacgaggtcggtgtcatcccctcgaaaaggcgagtcgagaagaaagagcgcgctcggctgaagacagtcaaatttaactccaagacccgggacaaaggcgagattcccgacgacatggggagcaagggcctgaaacacgtcacgtccaacgcgtcagacagtgaatcctcttaccgcggccaggaagaatatgtcctatcctacgagcccgtcaatcaacaggaagtcaattatactcgcccagtgattattttaggacctatgaaggatagaatcaacgatgacctgatatccgaatttcccgacaaattcggaagttgcgttccacacaccacgcgtcctaagcgagattatgaagttgacggacgcgattatcatttcgtgacctctcgggagcagatggaaaaagatatacaggagcataaatttattgaagcaggtcagtacaacaaccacctgtacggcacaagcgtgcagtcggtcagggaggtggcagagaaggggaaacactgtattctcgatgtatccggaaatgcaattaagcgccttcagatcgctcagctgtaccccatttcaatatttatcaagccgaaatctatggagaacatcatggagatgaataagcggcttactgaggagcaagctcgcaagactttcgagcgggctatgaagcttgaacaagagtttactgaacactttactgccatagtgcaaggagacacactggaggatatttacaaccaggtgaagcagataatagaggagcagtctggaagttatatttgggtgccggctaaagaaaaactgtag

SEQ ID NO: 185557 - DNA, 321 bp, Artificial Sequence
  Description of Artificial Sequence: Synthetic coding sequence
atgcccgtgcggaagcaggacacccagcgggccctgcacctgctggaggaatatcgttccaagctgtctcagacagaagaccgacagctgcgctcttcgattgaacgagtgatcaacatattccagagtaatttgtttcaggcccttatcgatatccaggagttctatgaggtgactctcctcgataatccaaagtgtattgacagaagcaagccttctgagcctatccagcccgtgaacacttgggagattagcagtctgccctctagcaccgtaacatcagaaacactgccttcatctctgtcaccaagcgtggagtag

SEQ ID NO: 185558 - DNA, 1113 bp, Artificial Sequence
  Description of Artificial Sequence: Synthetic coding sequence
atgcccgtgcggaagcaggacacccagcgggccctgcacctgctggaagagtaccggagcaaactaagccagacagaggaccggcagttgcgcagttccatcgagcgtgtaatcaatattttccagtcaaacttattccaggccctgatcgatatccaggaattctacgaggtgactttgctggacaaccctaagtgcatagacagaagcaaaccttctgagccaatccagccagtcaacacctgggaaatatcatcgttaccctcctctacggtcacttccgaaacgttacccagcagcctgagcccctccgtggaaaagtacagatatcaagacgaggacacgcccccgcaggaacacatctctcctcaaattactaacgaggttataggcccggagctggtgcacgtctccgaaaaaaatctgtcagagatcgagaacgtccacggctttgtcagccattctcacatcagcccaattaaagtgaacggtacggatgctgattacgagtatgaggagattacactcgaacgaggaaactcgggcctggggttcagcattgcgggtggtaccgacaatccgcacataggagatgattcttcaatcttcattacaaagattattactggtggcgcagcagcccaagatggccggctcagggtcaacgattgtatactgagggtgaacgaagtagacgtccgcgatgtcacacacagtaaagctgtcgaggccctgaaagaggctggttctatcgttcgcctgtacgtcaagagacgaaagcccgttagcgagaagatcatggaaatcaaactcatcaagggccctaaggggctgggattttccatagcagggggagttggaaaccagcatataccaggtgataacagtatttatgtgactaagatcatagagggcggagcagcccacaaggatggaaagctgcagattggcgacaaactgctggccgtaaacaacgtttgcttggaagaggtgacacacgaagaagccgtcaccgcgttaaagaacacctccgactttgtgtacctcaaagtagccaagccaacaagcatgtacatgaacgacggctatgctcctccagacatcaccaactag

SEQ ID NO: 185559 - DNA, 2715 bp, Artificial Sequence
  Description of Artificial Sequence: Synthetic coding sequence
atgcccgtgcggaagcaggacacccagcgggccctgcacctgctggaagagtaccgcagtaagcttagccagaccgaggaccgccaactgcgctccagtatcgagagggtcattaatatcttccagagtaatctgtttcaggcactgatcgatattcaggagttctatgaagtgaccctcctcgataatcctaaatgtatcgacagatctaagccaagcgagccgatccaacctgtgaatacttgggaaatctcctcgttgccctcctctaccgttacatccgaaaccctcccttcatcactgagtccatcagtggaaaagtatagataccaagacgaagataccccaccccaagagcacatctccccacagatcacaaacgaggtgatcggccctgagcttgtccacgtttccgagaagaacctcagtgagatagagaacgtgcatggttttgtgagccactcccacatcagtccaatcaagcccacggaggccgtacttccgagtccaccaactgtccctgtcatccccgtattaccggtccctgcagaaaacacggtgatcctgcctacaattcctcaagctaatccaccccccgtcttagtcaacaccgacagcctggagaccccaacctacgtaaacggaacggacgcagattacgaatacgaagagattaccttagagcgtggaaactccggcctggggtttagtatcgctgggggcacagacaacccccacatcggcgatgactcctccatctttattaccaagattatcaccggtggtgcagccgcgcaggacggtcgcctcagagtgaatgattgtattctaagagtgaacgaagttgacgtcagggacgtgacacattcaaaagccgtggaggcactcaaggaagccggcagcattgttcgcttatatgtcaagagaagaaagcctgtcagtgagaagattatggagatcaagctcataaaaggcccaaagggactggggttcagtatcgccgggggagtcgggaaccagcatatcccgggggacaacagcatatatgtgaccaagatcattgaggggggcgctgcgcataaggacggcaaactgcagatcggagataagcttcttgctgttaacaatgtgtgcctggaagaggtgactcatgaggaagcagtaacagcattgaaaaacacgtctgatttcgtctatctgaaggtagcaaaacccactagcatgtatatgaatgatgggtatgccccaccagacataaccaactcgtccagccagcccgtcgataaccatgtttccccatcgtctttcctgggccagacacccgcctcaccggctagatatagtccagtgagtaaggcggtactaggagatgatgagattacgagggagcctagaaaggtggtccttcaccggggttctacaggtttaggattcaacattgtcggtggggaggatggagaagggattttcatctcctttatcctcgcgggggggcccgccgatctctctggtgaactgcggaagggagatagaatcatctccgttaatagcgtcgacctgcgggctgcctcacacgaacaggctgctgccgctctcaagaatgctggacaggcagtgacgatagtggcccagtatcgccctgaggaatattcacgttttgaggctaagatccacgatctgcgcgagcagatgatgaactcctctattagctctggatccggtagcctgaggactagtcagaagcggagtctatacgtcagggccctgttcgactatgacaagaccaaggattctggcctgccaagccagggcctcaactttaaattcggagatatcttacacgtaatcaatgcatcagatgacgaatggtggcaggctcggcaggttacccctgacggggagagtgacgaggtgggtgtgattccttcgaagcggcgggtcgagaaaaaagagcgagccaggctgaagacagttaagttcaactctaaaactagggacaaaggcgagatccctgacgacatgggcagtaaaggcctgaaacatgtcacttctaacgcaagcgactccgagtcgagttatagaggacaggaggagtacgtgctaagttatgaacctgtgaaccagcaggaagttaactacacccgaccagtgattatccttggccccatgaaggacagaatcaacgacgacttgatttcagagttccccgacaagtttggctcttgcgtccctcacacaacccggcccaaacgggactacgaggttgacgggagggattaccactttgttacaagtcgcgagcagatggagaaggatatccaggaacataagttcatcgaggcagggcaatacaacaaccatctctacggtacttcagtccagagcgtgagagaagtggcggagaaaggaaagcactgcatcctagatgtgagtggaaacgctattaaacggcttcagatcgctcagctgtatcccatttctattttcattaagccgaagagcatggaaaatattatggagatgaataagcggctgaccgaggaacaggctcggaaaaccttcgagagagccatgaagctggagcaggagtttaccgagcactttaccgcgatagtgcaaggcgatacactagaggacatctacaaccaggttaagcagatcattgaagagcagtcagggtcttatatctgggtccccgcaaaggagaagttatag

SEQ ID NO: 185560 - DNA, 465 bp, Artificial Sequence
  Description of Artificial Sequence: Synthetic coding sequence
atgcccgtgcggaagcaggacacccagcgggccctgcacctgctggaggaatacagatctaaactgtcccaaactgaggacagacaactcaggtcttcaatcgagcgcgtcatcaatatttttcagagcaatctcttccaagcccttatcgacattcaagaattctacgaggtcactctgctggataacccaaagtgcattgaccggtccaagccttcagagcccattcagcctgtgaacacatgggaaatcagtagtctccctagcagcacagtgacatccgagaccttaccctcgagcctatccccatccgttgagaagtatcgctaccaagacgaggatacccccccgcaagagcacatctccccccagatcaccaacgaagtgatcggcccagagctcgtccatgttagcgaaaaaaatctttccgaaattgagaatgtccacggattcgtgtctcactag

SEQ ID NO: 185561 - DNA, 2562 bp, Artificial Sequence
  Description of Artificial Sequence: Synthetic coding sequence
atgcccgtgcggaagcaggacacccagcgggccctgcacctgctggaagaataccgctccaagcttagccagacagaggacaggcagctacgatcatctatcgagcgcgtgataaacatctttcagagcaacctgttccaggccctgatcgacattcaggagttttacgaggttactcttctcgataatccgaagtgtatcgaccgttcaaagccatctgaacccatccagcccgtaaatacatgggagatctcgagcctgccttctagcacggttacatctgagaccctcccgtcaagcctgtccccaagcgtcgagaagtacaggtaccaggacgaagataccccgcctcaagaacatatcagtcctcaaatcacgaacgaagtaatcggccctgagctcgtacatgtaagcgaaaaaaaccttagcgagatagaaaacgtacacgggttcgtgtcccacagccacatctctcctatcaaagtgaacggcacagatgcggattacgagtatgaggagatcacgctggagaggggaaacagtggtctgggattcagtatagccggcggtacagacaatcctcacatcggcgatgatagctccatttttattactaagatcattactgggggagcagccgcccaagacggtagactccgggtgaatgattgcatcctgcgagtgaatgaagtggacgtgcgcgacgtgacccattcaaaggcagttgaggcgctgaaagaggccggttctattgtgcggctgtatgttaaacggcgcaagccggtgtccgagaagattatggagatcaagttaattaaaggccctaaaggtttgggattttccatcgcgggcggcgtcggcaaccaacacatccctggggataatagcatttatgtgactaagataatcgagggtggagccgcccacaaagacggcaaactgcagatcggcgataaacttcttgcagtgaacaatgtttgtctggaggaagtcacgcacgaggaggctgtgaccgccctgaaaaatacgagtgactttgtgtacctgaaggttgccaagccaacctccatgtacatgaacgacggctatgcacctcccgacatcaccaatagttcctcccaaccagtcgataaccacgtgagcccatcctctttcctcgggcagactcctgcgtctcccgcccgctattcaccagtgagcaaggcagttctgggagacgatgaaatcacgagggagcctcggaaggtggtcctgcaccgcgggagtacgggccttggcttcaatattgtaggcggggaggacggtgagggcatttttatcagtttcatcctggctggaggtcccgccgatctctctggagagctgagaaagggggatcgcatcatcagcgtgaactctgtggacttgcgtgctgcttctcacgagcaggcagcagcagctctgaagaacgccggacaggccgtcaccattgtggcccaataccgacccgaagaatactccaggttcgaggcaaaaatccatgacctgcgcgagcagatgatgaacagctcaatctctagtggctcgggaagcttaaggactagtcaaaagaggtctctctacgtgagggctctatttgactatgataagactaaggacagtggactgcctagccaaggactgaattttaagttcggggatatactccacgtgatcaatgcatctgatgatgagtggtggcaggcaagacaggtgacaccggacggcgaaagcgacgaggtaggagtgatcccttcaaaaagacgtgtagaaaagaaggaacgagctcgcctgaagaccgtgaagttcaattcgaagacccgtgacaaaggggagataccagacgacatgggctccaaagggctcaagcacgtaacaagcaatgcatctgattctgaaagttcctaccgaggacaggaggagtatgtgctttcctacgagccggtaaatcaacaggaagtgaactatactagaccagtaattatactgggtccaatgaaggatagaatcaacgatgatctaatttccgaattcccggacaagttcgggagctgcgtgccccataccacccgacctaagcgcgactacgaggtggatgggcgggattatcattttgtgacaagccgagaacaaatggaaaaggatatccaggagcacaaattcatcgaggccgggcagtataataaccacctgtatggcacatccgttcagtctgtgagggaagtggccgagaaaggcaaacactgtattcttgatgtatcaggcaatgcaattaagcggctccaaattgcgcagttgtaccccatctccatctttatcaagcctaaatccatggagaatataatggagatgaacaagcggctgactgaggaacaggcaagaaaaaccttcgaacgggccatgaagctcgagcaggagttcaccgagcactttactgcaatagtgcagggagatactttagaggatatatacaaccaggtgaagcagattattgaagagcaatccggcagttacatatgggtcccagccaaggaaaagctgtag

SEQ ID NO: 185562 - DNA, 111 bp, Artificial Sequence
  Description of Artificial Sequence: Synthetic coding sequence
atgcccgtgcggaagcaggacacccagcgggccctgcacctgctggaggaataccgatcaaaactgtctcagactgaagatcgccagctgagatcttccatcgaacggtag

SEQ ID NO: 185563 - DNA, 372 bp, Artificial Sequence
  Description of Artificial Sequence: Synthetic coding sequence
atgcccgtgcggaagcaggacacccagcgggccctgcacctgctggaagagtacaggtctaaactttcccagacagaagatcgacaactacgctctagtattgaacgcgtaatcaatatctttcagagcaacttatttcaggctctcattgacatccaggagttctatgaggtgactttgctcgacaacccaaaatgtatcgaccggagcaagcctagtgagccgatccagcctgttaatacttgggagatatcctctctgccatcgtcaaccgtgacatcagagaccttgcccagttcattgagccctagtgtggagaagtatcggtatcaggacgaggatactccaccgcaggagcacatttctccttag

SEQ ID NO: 185564 - DNA, 2715 bp, Artificial Sequence
  Description of Artificial Sequence: Synthetic coding sequence
atgcccgtgcggaagcaggacacccagcgggccctgcacctgctggaggaatacaggtctaaattatcacaaacagaggacagacagctccggtcatcaattgaacgcgtcatcaatattttccagagcaaccttttccaagccctgatcgatattcaagaattctatgaagttaccttgctggataatccaaagtgcatcgatcgctccaaacccagcgaacccatccaaccagttaacacctgggaaatatctagtttgccatccagcaccgttactagcgaaaccctgccttcctctctgagccctagtgtcgagaaatacagataccaagatgaggacacacccccacaggagcacatatctccacaaatcaccaacgaggtgatcggacccgaactcgtgcatgtaagtgaaaaaaacctaagcgagatcgagaatgtacacgggtttgtttcccatagccatattagcccaatcaagccaacagaggcggtcctgccttctccccccacagtgccagtcattccagtactgcctgtgcccgcagagaacaccgtaattctgccgacaattccccaggcaaaccctcctcccgttctcgtgaatactgattcgctggagactcctacatacgtcaacggaaccgacgctgattacgagtacgaggaaataaccctagagcgcggaaattccggtctgggattctccatcgccggagggacagataacccccatattggtgatgatagctctatttttataaccaagattattaccggcggcgcagccgctcaggacggcagattacgcgtgaatgactgtattctccgagtcaatgaagtcgatgtgcgcgatgtaacgcactcaaaggccgtcgaagctctcaaagaagccggatctatagtccgcctttatgtgaagaggagaaagccggtttcggagaagatcatggaaattaagttaattaagggtccgaagggcctggggttcagcatcgccgggggtgttgggaaccagcatatacctggtgacaacagcatatatgttacaaaaatcattgagggcggcgctgcccacaaggacggtaaattgcagattggagacaagcttctggcagtaaacaacgtgtgcctcgaggaggttacgcacgaggaagctgtaacagccctgaagaacacaagcgatttcgtttatctaaaagtggctaagcctacaagtatgtacatgaatgatggatacgctcctcccgacatcacaaattcctctagtcaaccggtcgataaccacgtgtcgcctagttcattcctgggacagaccccagcatcacccgctcggtatagcccagtaagcaaggccgttctcggagacgacgagattactagagaacctagaaaggtcgtccttcaccggggaagcacaggcttgggattcaacatcgtgggcggagaagacggagagggcattttcataagctttatccttgcaggtgggccagccgatctgagcggagaactgcgcaaaggtgacagaattatctccgtcaactcggtcgacctgagagccgccagccacgagcaggcagccgccgcacttaagaacgcaggccaagccgtgaccattgtcgctcagtaccgacccgaggagtacagcagatttgaggccaagatccacgatctccgagagcaaatgatgaattcaagtatttcatccggatctgggagtctccgaacatcccaaaagcgctcactgtacgttcgagcccttttcgattacgataaaacaaaggattccggcctcccctctcagggtttaaacttcaaatttggggacatactgcacgttattaatgcttctgacgacgagtggtggcaggccaggcaggtcaccccagacggcgagagtgatgaggtgggggtgatcccatcgaagcggagggtggagaagaaagagcgggcacgccttaagaccgtgaagtttaatagtaaaactcgcgataaaggcgagatccccgacgacatgggctccaagggcctaaaacatgtaacttctaacgctagtgattctgaatccagttaccgcggacaggaggagtatgtgttatcttacgaacctgtaaatcagcaggaagtgaattacactcggccggtcattattctcggcccaatgaaggataggatcaatgatgatctcattagtgagtttccggacaagtttgggtcgtgcgtaccacacaccacccgacctaagagggattacgaagtggacggacgggattatcacttcgtgacttcgagggaacagatggagaaggacattcaggagcacaagttcatcgaggcggggcagtacaacaaccacctgtatgggaccagcgtgcaaagcgttcgggaggtcgcggagaaaggaaagcactgtattcttgatgtaagtggtaatgctataaaaaggctgcaaatagcccaactgtatcctatctctatttttatcaagcctaaatctatggagaatattatggaaatgaacaagcggctaactgaggagcaagcccgtaaaactttcgagcgggcgatgaaattggagcaagaatttaccgagcactttacagcaattgtgcaaggcgatacgctggaggatatatataaccaggtgaaacagattattgaagagcagagtggatcctacatatgggtgcctgcaaaggaaaagctctag

SEQ ID NO: 185565 - DNA, 2682 bp, Artificial Sequence
  Description of Artificial Sequence: Synthetic coding sequence
atgcccgtgcggaagcaggacacccagcgggccctgcacctgctggaagagtatcgaagcaaactgagtcagacggaagatcggcagttgagatcatctatcgagcgcgtgatcaacatatttcagagcaacctttttcaggcacttatcgacattcaggagttctacgaagtaacactccttgacaacccaaaatgcatcgatagatctaaaccatctgagccgatccagccagttaacacctgggaaatatcttcactgccatccagcaccgtgacatccgaaacactgccatcatcattaagcccctcagtcgaaaagtacagataccaggacgaagacacccctccccaggaacacatttctcctcagattaccaatgaagtcatcggaccggaactggtccacgtgtccgaaaagaacctgagtgaaatcgaaaatgtgcacggattcgtctcacactcccatatttcacctatcaaagccaatcctccccccgtactggttaacacggattcactggagacccctacatatgtcaacggcactgatgccgactacgaatacgaggagatcactcttgagcgaggaaatagtggtttgggctttagtattgccggcgggacagacaatccccacatcggagacgactcttccatatttatcacaaaaatcatcactggcggagccgcggctcaagatgggcgcttgcgtgtgaacgattgtatacttcgagtgaacgaagtggacgtaagggacgtgacacatagtaaagctgtggaggccctgaaagaagccggctctattgttagactgtatgtgaagagacggaaacctgtgagcgagaagatcatggagatcaagctcatcaaaggccctaaaggcctcgggtttagcatagctggcggcgttggaaatcagcacattcccggagacaatagcatctacgttacgaaaataatcgagggcggtgccgctcataaggatgggaagctccagataggcgacaagctgctcgctgtcaataacgtgtgcttggaggaagtgactcacgaggaagcagtgacagccctcaagaacacatccgattttgtctacctgaaggtggccaagcctacatccatgtacatgaatgacggctacgcaccaccggacatcactaatagctctagccagcccgtggacaaccatgtgtccccctcctcgttccttggacagaccccagcctcacctgcccgctactcacccgtgagcaaggccgtcctcggcgacgatgagatcaccagagaaccacggaaagttgttctccatcgcggaagtacggggctgggattcaatatcgtgggtggcgaagatggggaggggatttttataagctttatcctagccggagggccagccgacctcagtggggagctgaggaagggcgacagaatcattagcgttaactctgtagatcttagggccgcgtctcatgaacaagcagcagccgctcttaagaacgctggtcaggcagtcactatcgtggcacagtataggccagaagaatactctagatttgaggctaagattcacgatctgagagagcagatgatgaattcctccatttcctcaggaagtggctccctgcgcacctctcagaagaggtcgctttacgtacgggcactatttgattacgataagacaaaggactcaggccttccctcacagggactcaactttaagtttggggatattctgcatgtgatcaacgccagcgacgatgaatggtggcaggcacggcaggttacgccggatggggagagtgacgaggtgggcgtgatacctagtaaacggcgggtggagaagaaagagcgcgctagattaaagacagtaaaatttaactctaaaacccgggataaaggccagtcattcaacgataaacgaaagaagaacctgttctcccgtaagttccccttctataagaataaagaccagtcagagcaggaaaccagcgacgccgatcaacacgtgacaagtaatgccagcgattcggagtctagttaccgcggtcaagaagagtatgtcctatcttatgagccagtcaatcagcaggaggtgaattatacccggccggtgatcatattggggcctatgaaagatcgaataaatgacgacctgatctcagaattcccagataagttcggcagctgtgtcccacacaccactcgacctaaaagagattacgaagtcgatggcagagactaccattttgtcacaagccgcgaacagatggaaaaagatattcaagaacacaagtttatcgaagccggccagtacaacaatcatttgtatggaacctccgtacagtctgtgagagaggtcgccgagaagggcaagcattgcatcttagacgtgagtgggaatgcaataaagaggctccagatcgctcaattatatcctattagcattttcatcaaacccaagagcatggagaatattatggaaatgaataagaggctgactgaggagcaggcgcgcaagacgttcgagcgggctatgaaactggagcaggagtttacagagcatttcaccgcaatcgtgcagggagataccctggaagacatctacaaccaggttaaacagatcattgaggagcagtctggcagctacatatgggtgcccgccaaggaaaagttgtag

SEQ ID NO: 185566 - DNA, 2730 bp, Artificial Sequence
  Description of Artificial Sequence: Synthetic coding sequence
atgaacgcctacctgaccaagcagcacagctgcagccggggcagcgacgggatggacgccgtaagatccgctcctacactcattcgagacgcccattgcgcctgcggttggcagcgcaactgtcagggactgggctattcctcacaaaccatgccttcctctgggcccggcgggccagcctcaaaccgtaccgggggatcctcttttaataggaccctgtgggacagtgtccgcaaatctccccacaagacaagcaccaagggcaaggggacgtgcggggagcactgtacttgcccacacggctggttttccccagcacaagcatcaccagctcccatcattgttaatacagacaccctcgatacaataccctacgttaatggaactgaaatcgagtacgagttcgaggaaattaccttggagcgcggaaactcgggcctgggcttctcgatcgctggcgggactgataacccccacataggagatgatcccgggattttcattactaagatcatccctgggggcgcggctgctgaggacggccgcttgagagtgaatgactgcatcctccgcgtgaacgaggttgatgtgagcgaagtatcacattctaaagccgtggaggccctgaaagaagcagggtcgatcgtgcgactctacgtccgcagaagaagacccattcttgaaacagtcgtagaaatcaagctgttcaagggtcctaagggacttggattcagcattgccggcggcgttggtaatcaacatatccccggggataacagcatctacgtgacgaaaattatcgatggaggggcggcacagaaggacggccgcctacaggtgggggaccggctgctgatggtaaacaactatagcctggaagaggtgacacacgaggaagctgttgccatactgaagaacacctccgaagtggtgtatctcaaagttggaaagccaactaccatctatatgactgatccttacgggccacctgacatcacacacagttattctcccccgatggaaaatcacctcttgtccgggaataacggcaccctggagtataagaccagcctcccaccaatctcccccgggagatactcacctatccctaagcatatgttggtggatgatgattatactaggccacctgagcctgtgtacagcacagtaaataagctgtgtgacaaacctgcatcacccaggcactatagtcccgtcgagtgtgacaaatctttcctgttgagcgctccttactctcactaccacctggggcttttgccagactcggaaatgacatctcacagtcaacacagcacggccacacggcagccaagcatgaccctgcagagggctgtgtcactggagggggagcctaggaaggttgtccttcacaagggctcgaccggcttaggttttaatatcgtcgggggagaagatggcgagggcatcttcgtgagtttcattctcgctggaggacctgcggacctatctggagagctgcaacgaggagatcagatcctctcagtgaatggcatcgatctccgcggtgcctcccatgagcaagcggctgcagccctcaaaggggcggggcagacggtgaccatcattgcccagtatcagccggaagattacgcacggttcgaggccaagatccacgacctcagagagcaaatgatgaatcattcaatgagctccggtagcgggtctctgcgcactaaccaaaagcgcagcctgtatgtgagagcaatgttcgattatgacaagagcaaagattctggcctcccatcccagggcctgagcttcaaatatggtgatattctacacgttattaatgcttcagacgacgaatggtggcaagctagaagagtgatgctcgaaggtgactcagaagaaatgggggtgattccctcgaagaggagagtagaaaggaaagagcgggcaagactgaagactgtcaagtttaacgcaaaacctggggtgattgacagcaaggggtcctttaacgataagcgaaagaagtcattcatattctcgcgcaaattcccattctataagaataaggagcagtcagaacaggagacctctgaccctgaacgtggacaagaggatcttatacttagctacgagcctgttactcgccaggagatcaactatacccgacccgtgataatcctggggcccatgaaggatcgaataaacgatgaccttatctcggaattccccgataagttcggatcgtgtgtgccacacaccacaaggcctaagagggactacgaagtcgacggtagagactaccactttgtgatatctcgtgaacagatggagaaagatatccaggaacataagttcatcgaagccgggcagtacaatgataatctctacggcacctcggtacagtcagttcgattcgtcgcggagagaggcaaacattgcatactagatgtaagtggcaatgcaattaaacgactgcaagtcgcgcagctttatcccattgccatctttattaagccacgctctttggagcctctgatggagatgaacaagaggctgactgaggagcaagccaaaaaaacttacgaccgcgccataaagctggaacaagaattcggagaatacttcactgctatagttcagggggatactcttgaggacatctacaaccagtgcaagctggttatcgaggagcagtcagggcctttcatttggataccaagcaaggagaagctgtag

SEQ ID NO: 185567 - DNA, 2376 bp, Artificial Sequence
  Description of Artificial Sequence: Synthetic coding sequence
atgcagcacgccttcatccccgccagccccgcccccatcatcgtgaataccgacaccctggataccattccctatgttaatggaactgaaatcgagtacgaattcgaagagataacactggaacggggtaatagcggcctgggtttctctatagctggaggcaccgacaatcctcacattggagacgatcccggcattttcataaccaaaattatccctggcggcgccgctgcagaggatgggagactcagggtaaacgattgtatcctccgcgtgaacgaagtggatgtgagtgaggtgagccatagcaaggcagtggaggcactcaaggaggccggttcaatcgttcggctctacgtgagaagacggagaccaatcttggagacagtggtggagattaagcttttcaagggccccaagggccttggcttctctattgccggcggcgtaggcaatcagcacattcccggagacaatagcatctatgtgaccaaaattatagacggaggggcggcacagaaagatggcagacttcaggtgggagaccgtctacttatggttaacaattattcactggaggaagtcacacacgaggaggcggtggctattctcaagaatacaagcgaggttgtgtacttgaaggtcgggaagcccacgactatctatatgacagacccctatggacctcccgacataacacacagctatagtcccccaatggagaaccacctgctctctggaaacaatgggacgctggagtacaagacctccttacctcccattagccccggacgttacagccctatcccgaagcatatgttggttgacgacgactatacacggccacctgagcctgtgtactccacagtcaataagctctgcgataaacctgcatcgcctcggcactacagtcccgtggagtgtgataagtcttttttgctgagcgcaccttacagccattaccacctgggcttgctccctgactcggaaatgacatcgcactctcagcacagtaccgcgaccaggcaaccaagcatgacgctacagagggcagtcagccttgaaggagagccgagaaaggttgtgttacacaagggctctactggcctcggtttcaatatcgtggggggcgaagacggcgagggaattttcgtgtcattcattctggcaggcgggccagccgatttgagtggagaactgcaacggggagaccagattctttctgtgaatggaattgatcttagaggcgcctcccatgagcaagcagccgcagcactcaagggcgccggacagacagtcactatcatagcccagtaccagcctgaggattatgccagatttgaagcaaagatccacgatcttcgtgaacagatgatgaatcattcaatgagttcaggaagcgggtcactcagaactaatcaaaagcggtcactttatgtgcgagctatgttcgattatgacaagtcgaaggacagcggccttccctcgcaggggctcagttttaagtatggggatatccttcacgtaattaacgcctcagacgacgaatggtggcaggctagaagagtgatgctggaaggtgatagcgaggaaatgggggtgatcccatccaagcgccgggtggagaggaaagaaagagcaagactgaaaacggtcaaatttaacgccaagccaggagtcatcgactccaagggagacatccccggccttggggacgacggctacgggaccaagacccttcgagggcaggaggatctcatcctttcctatgagcctgttacccgccaggagatcaactacacaaggcccgtcatcatacttggaccaatgaaagataggatcaatgatgatcttatcagtgagttccctgataagtttggctcttgcgtgcctcacacaaccaggcctaagcgtgactacgaggtcgatggccgggactatcattttgtaatcagtagggaacagatggagaaagacatacaggaacataagtttatcgaggctggccagtataatgacaacctgtatggaacatcagtgcagagcgttaggtttgtggccgagcggggcaagcattgtatcctggatgtgtcaggcaacgcaattaaaagactacaggtggcgcagctgtacccaatcgccatctttatcaagcctcggtccctggagccgctgatggagatgaataaacggcttaccgaagagcaggccaagaaaacttatgaccgcgctattaaactggagcaagagttcggtgaatacttcacggctatagtgcagggggatactttggaagacatctacaaccagtgtaaactcgtgatcgaggaacagagcggcccctttatctggatccctagcaaggagaagctctag

SEQ ID NO: 185568 - DNA, 2928 bp, Artificial Sequence
  Description of Artificial Sequence: Synthetic coding sequence
atgggcatcttcaagagcagcctgttccaggccctgctggacatccaggagttctacgaagttaccctgctgaacagtcagaagtcgtgtgagcagaagatcgaggaggccaatcaggtgctgcagaaatgggagaagacctctttgttagcaccctgtcacgacagactccaaaaatctagtgaactgactgactgtagtggaagcaaggaaaatgcttcctgtattgagcaaaacaaggagaaccagtccttcgagaacgagacagatgaaacgactacgcaaaaccagggtcgatgcccggcgcagaactgcagcgttgaggctccggcatggatgcctgtacatcattgtaccaaataccgctatcaagatgaagacgcgccgcatgaccattcgttgccccgcctgacacacgaggtgaggggacctgagttggttcacgtgagcgagaaaaacctgtcccagattgagaacgtccacggatacgttcttcagagccacatctcccccctcaaagcttctccagcacctataatcgtgaacacggacaccctggacaccataccttacgtgaacggtactgagatagaatatgaatttgaagagattaccttggaaaggggtaattcgggcctcggcttttcaatagctggaggaaccgataatccacatatcggggacgatccaggtatcttcattacaaaaattattcccggcggagcggcggccgaggacggccggctgagagtcaatgactgtatcctgcgcgtgaatgaagtggatgtgtctgaagtaagtcatagtaaagcagttgaagctctcaaggaggcaggtagtattgttcgcctatacgtacgcagacgccggcccatcctggaaacggtggttgagattaaattgttcaaggggccgaagggcctggggttctccatcgctgggggagtaggcaaccagcacattcctggagataactccatctacgtcactaaaatcatcgatggcggtgcagcccagaaggacggacgacttcaggtgggtgaccgactactcatggtcaataactacagtttggaagaagtgacccatgaggaggccgtggctatcttgaagaacacctcggaggttgtctacttgaaggtgggcaagcctaccacaatctacatgactgacccatacggccccccagacatcactcactcctattcaccccccatggaaaatcatctgttgtcgggcaacaacgggacactcgaatacaagacttcactgcctcccattagtcctggacggtattcccccatcccaaagcatatgcttgtggacgacgattatactagacccccagagcctgtttattcaaccgtgaataaattatgtgataaaccggcctccccacgccactacagccctgtggaatgcgataagtcattcttactatctgcaccctactcccattatcaccttgggctgctgccagactctgaaatgacctctcacagccagcactccaccgcaacacgacagccgtctatgaccctgcagcgagccgtgtccctggagggcgagccacggaaagtggtgcttcataaagggtcaacaggcctcggtttcaacatcgtcggcggcgaggacggggaggggatattcgtcagcttcatactggcaggtggtccggctgatttaagtggagagttgcagcgcggtgatcagattctgtcggtgaatggcatcgacttgaggggcgcttctcatgagcaggcagccgctgcccttaagggagccggacaaacagtgaccatcatagcgcagtaccagcccgaagattatgctaggttcgaggcaaagatccacgacttacgggagcagatgatgaaccactccatgtcctcaggcagcggcagtcttagaacaaatcagaagaggagcttgtacgtgagagccatgttcgattatgataaaagtaaggatagcggcctgcccagccaaggcctctctttcaaatacggggacatactacacgtgattaatgcttctgatgacgagtggtggcaggctagaagagtgatgcttgaaggcgactccgaggagatgggggtgatacccagtaaacggagagtcgagcggaaggaaagagctcggctgaaaactgttaaattcaatgctaagcctggcgtgatagattcaaaagggtcatttaacgataaacggaagaagtcctttattttctctagaaaatttcctttttacaagaacaaggagcagtcagagcaggaaacctccgatcccgaacgcggccaggaagatctgattttgtcatatgagccggtgacaagacaggagatcaattacacccgtccagtaattatccttgggcctatgaaggaccggatcaatgacgatcttatcagcgaattccctgataaattcggcagctgtgtgcctcacaccacacggcccaaacgagactatgaggtcgatgggagagactatcactttgtaatttctagggagcagatggagaaagatatccaggagcataagttcatcgaggcgggacagtacaacgataatctatacggcacttcagtccaatcagtccgcttcgtcgccgagcggggaaaacattgcatactggatgtcagcgggaacgccatcaagcggctacaagtggcccaattgtatcccattgctatattcattaagccgcggtccctggagcctttaatggagatgaacaaacgcctcaccgaggagcaggccaaaaaaacctacgaccgagctatcaagttagaacaagagtttggcgagtatttcacagccatcgtgcagggggatacgcttgaggatatatacaatcaatgcaagctggtaatcgaggagcaatccgggccttttatttggatcccaagtaaagagaagctctag

SEQ ID NO: 185569 - DNA, 1005 bp, Artificial Sequence
  Description of Artificial Sequence: Synthetic coding sequence
atgatgaaccacagcatgagcagcggcagcggcagcctgcggaccaaccagaagaggtcattgtatgtgagagctatgtttgattacgataagtcgaaggattccggtctgcccagccaggggctgagtttcaaatacggtgacatattacatgtcatcaacgcctcggacgatgagtggtggcaggcaagaagggtaatgcttgaaggagattctgaggaaatgggcgtcattccaagcaagagacgggtggaacggaaggaacgggcgcgacttaaaaccgtgaaattcaatgcgaagcctggcgtcatcgacagtaagggagacattcctggactcggggatgatgggtacggcacgaagactctccgtggccaggaggacctgatcctaagctacgagcccgtgactcggcaggaaattaattacacccggcccgtaataatcttaggtcccatgaaggacaggatcaacgacgacttaatatctgagtttccagataagttcggcagttgtgtgccacataccacacgaccaaaaagggattacgaggtcgatggacgagactaccatttcgtgatctcaagggaacagatggaaaaggatatccaggagcacaagtttatcgaggctggtcaatacaacgataacttgtacggaaccagtgtccagtctgtgcggttcgtggcagaaagagggaagcactgcatcctggatgtctctggtaatgctatcaaaaggctgcaggtagcccaactttacccgatcgccatttttataaaacccagatccctggaacctctaatggaaatgaataagaggctgaccgaggaacaggcgaaaaaaacctacgatagagcaattaaactcgagcaggagtttggcgaatattttacagcgatcgttcagggtgacactctggaagacatttacaatcagtgtaagttggtaatcgaagaacagtctggcccattcatatggatcccttcaaaagaaaaattgtag

SEQ ID NO: 185570 - DNA, 2613 bp, Artificial Sequence
  Description of Artificial Sequence: Synthetic coding sequence
atgttcttcgcctgctactgcgccctgcggaccaacgtgaagaagtatagataccaggatgaagatgcaccccacgaccactcactgccgcgcctgactcatgaggtgagaggccctgaactggtgcacgttagcgagaagaatctgagtcagattgaaaatgttcacggatacgtgctgcagtcccacattagccctcttaaagcctctcctgcacctatcatcgttaataccgataccctggacaccataccctatgttaacggaacagaaattgaatacgaatttgaggaaatcactctggagcggggcaactccggcctaggctttagcattgccggcggtacagacaaccctcacatcggtgacgaccccggtattttcatcacaaagatcatccctggcggcgccgcggccgaggacgggaggctaagggtgaatgattgcattctgcgggtgaatgaagtagacgtttcagaagtttctcatagtaaagcagtcgaagctctgaaagaggctgggagcattgtcaggctgtatgtgcgccgtaggcgcccaatactcgagacagtcgtggaaatcaaactattcaagggtcctaagggacttggcttttccattgccggaggtgtgggaaatcagcatatacccggagacaattccatatacgtgaccaagattatagatggcggcgccgcccagaaagacggccgccttcaggtgggtgaccgcctgctcatggtgaataattattctcttgaggaggtaacccatgaggaggccgttgctatcctgaagaatacaagcgaggttgtatatttaaaagtgggaaagccaacaacaatatacatgacagacccatacggcccacctgacataacacattcatacagtcctccgatggagaatcatctgctaagcgggaataatgggactctagagtataaaacttcacttccaccaatttccccggggaggtattctccaatcccaaaacacatgcttgtggacgacgactataccaggccccccgagcctgtctattcaacagtgaataaactgtgtgacaaacctgccagcccccggcactactctcctgtcgagtgtgacaagtcatttcttctgtctgccccctatagtcactatcatttgggactgctgcccgattccgaaatgaccagtcactcacagcattccaccgctactagacagccatccatgaccctgcaaagagcggtgtccctggagggcgaacctaggaaagtggtactccataaaggatccaccggtctgggatttaacatcgtcgggggagaagacggtgagggtatcttcgttagctttatactggctggaggccctgctgacctcagcggggaacttcagagaggagaccagatcctgtctgtgaatggcatagatctcagaggggcctctcacgagcaagcagccgcggcactcaagggggccggccaaacagttaccataatcgctcagtatcaacccgaggactacgctcggttcgaagcaaaaatacacgacttgcgcgagcaaatgatgaatcactcaatgtccagcggttcaggctccctgaggacaaatcagaagcggtctctgtatgttcgcgccatgtttgattatgacaagtccaaagactcaggattgccgagtcagggtctttcctttaagtatggagatattctgcacgtgattaacgcatcagatgatgaatggtggcaagccagacgagtgatgttggagggcgactccgaagaaatgggggtgatcccatctaagcgtcgggtggagcgcaaggaacgggcaaggctcaaaactgtgaaatttaatgctaaacccggagtgatcgactcgaaaggctcatttaacgacaagagaaagaagtccttcatttttagtcggaaattcccgttctataagaataaagagcagagcgagcaggaaacatccgatccagagcgaggccaggaagatctcatcttgtcgtacgagcccgtgactagacaggaaataaactatacacggccagtcatcatcttaggcccaatgaaagaccggatcaacgacgacttaatctctgagtttccggataagttcgggagctgcgttccacacacgacccggcccaagagagactacgaggttgatggtcgggattatcacttcgtgatttctcgggagcagatggaaaaagacatccaagagcataagttcattgaggccggccaatacaacgataacctgtatgggacctcagtgcagagtgtgcggttcgtcgccgaacgtggcaaacattgcatcttggatgtctctgggaatgcaatcaaaaggctccaagttgcacagttgtacccaatagcaattttcattaagcctcgctccctagaaccgttgatggaaatgaacaagagactgacagaagaacaagctaaaaaaacctatgatcgggcaattaagctcgagcaagagttcggcgaatactttaccgctatcgtgcaaggtgacaccttggaagatatatataatcagtgtaagctcgtaatcgaggagcaatcgggcccctttatttggattcccagtaaggagaagctttag

SEQ ID NO: 185571 - DNA, 1047 bp, Artificial Sequence
  Description of Artificial Sequence: Synthetic coding sequence
atgatgaaccacagcatgagcagcggcagcggcagcctgcggaccaaccagaaacgcagcctgtacgtccgtgctatgtttgactatgacaagtctaaagattccggtctgcccagccaaggtttgtcctttaagtatggtgatattctacatgtaattaacgcctctgatgacgagtggtggcaagctagaagagtgatgttagagggcgactccgaagaaatgggcgtcattccctctaaacgacgcgtggaacgcaaggaacgagcccgcctcaaaacggtgaaattcaacgctaaaccgggcgtaatagattctaaaggtgatatcccagggctcggggacgatggctacgggaccaagactttgaaacacgtctcgagcaatgcgtcggatagcgaatcctcttatagaggccaggaggatctgattttgtcttacgaaccagtgaccagacaggagatcaattatacccggcccgtgatcatcctggggccaatgaaggaccggatcaacgacgatttaatcagtgagttccctgacaagtttggaagttgcgtgccccacacaacaagacctaaacgcgattatgaggtggatggccgcgactatcatttcgtgatttccagggagcagatggagaaagacatccaggaacataagttcatagaggcgggacagtacaatgacaatctctatggcacctctgtccagtctgtacgatttgtcgctgaacgaggcaagcattgtatcctggatgtcagcgggaacgctataaagcgcctgcaagtggcccagctctatcccattgccatctttatcaagccgcgaagcctagaaccacttatggagatgaataaaaggctcaccgaagagcaggctaagaagacgtacgatagggcaattaagctcgagcaagagtttggggagtacttcactgccattgtacaaggggatacactggaagacatttacaaccagtgcaagctggttatcgaggagcagagcggaccgtttatatggatcccgagcaaagaaaagctatag

SEQ ID NO: 185572 - DNA, 2250 bp, Artificial Sequence
  Description of Artificial Sequence: Synthetic coding sequence
atgcagcggcccagcgtgagccgggccgagaactaccagctgctgtgggatactattgccagcttgaagcagtgtgagcaggcgatgcagcacgcctttattcctgtgaacggcacagaaatcgaatatgagttcgaggagataacgttagaaaggggaaattcaggcctgggtttctccatcgctggaggaacggataatcctcatattggggatgaccccggaatctttatcactaaaattatccctggtggggccgcagccgaggacggacgcctgcgcgtcaacgattgcatacttcgagtcaatgaggtggatgtctctgaagtaagccactccaaagccgtcgaagctctgaaagaggctgggtccatcgtcaggctgtatgttcggagacgtaggcccatcctggagacggtcgttgaaatcaagcttttcaaagggccaaagggtttaggcttctccattgctggcggggtgggaaaccaacatattcccggagacaactcaatttatgtcaccaagatcatagacggcggcgcggctcagaaagacgggcgcttgcaagtcggagaccgtctcctgatggtaaataattatagcttagaggaagtgacacatgaggaagcagtggccattctgaaaaacacctctgaagtggtttatttaaaggtcggaaagcccactactatttatatgactgacccatatggtccccctgacatcactcattcttattctccccctatggagaaccacctgctgtcggggaacaatggtacgttggagtataagacgtcgctgcctcctattagcccaggaaggtactctccaatccccaaacatatgctggtggacgatgactacacaagccactcacagcactctactgcaacccgtcaacctagtatgactctgcaacgcgcagtgagtctggagggggaacctcgcaaagtcgttctccataaaggtagcactggcctgggttttaacattgtgggcggcgaggatggcgaagggatttttgtgtcgtttatcctcgcagggggccctgctgacctgtcgggtgagctacaacgcggggatcaaatcctctcggtaaacggcatagatctccggggcgcgtcacatgaacaggctgcagctgcccttaagggtgctggacagacagtaaccataatcgcgcaatatcagccagaggactatgcccggttcgaagctaaaattcacgacctgcgggaacagatgatgaaccactcaatgtcttccggaagcggatcactgagaactaatcagaaaaggtccttgtacgtaagggccatgtttgactacgataagtcaaaggacagcggtcttccaagtcaaggcctctcattcaaatacggtgacatcttacacgtcatcaacgcctcagacgatgaatggtggcaggcacgacgcgtgatgctggagggcgattctgaggagatgggtgtgatcccctccaagaggagagtggaacggaaagaacgggctcgcctgaaaacggtaaaatttaacgccaagccaggagtgattgacagcaagggtgatatcccaggcctgggtgacgatggctacggtactaagacgctccgcggccaggaagacctcatcctcagctacgagcccgtaacaagacaggaaatcaactacactcgacctgtcattatcctgggacctatgaaagacagaatcaatgatgacctaattagcgagttccctgataagttcggcagttgcgtgcctcatacaacccggccgaagcgagattatgaggtggatggccgggactatcacttcgttatctcgagagaacaaatggagaaggatattcaagaacataaattcattgaagccggccaatataacgataatctttatggcacatccgtacagagtgtccgcttcgtggccgagcgtggaaagcactgcatcttagacgtctcaggtaacgcaatcaagcgccttcaagtggcccagctgtaccctattgctatctttataaagcctaggagtctcgaacccctcatggagatgaacaaaaggcttacagaggagcaggctaagaagacatatgatagagctattaagttggagcaggagttcggcgaatacttcaccgccattgttcagggcgatacactcgaagacatttacaatcaatgtaagcttgtgatcgaggagcagtcagggccgtttatttggatccccagtaaggaaaaactatag

SEQ ID NO: 185573 - DNA, 1005 bp, Artificial Sequence
  Description of Artificial Sequence: Synthetic coding sequence
atgatgaaccacagcatgagcagcggcagcggcagcctgcggaccaaccagaagagatcactctatgtcagagccatgttcgattacgacaaatccaaagactcggggcttccctcgcaaggactcagttttaagtacggcgacatcttgcatgtgatcaatgccagcgatgacgagtggtggcaggctagaagagtaatgctagaaggggacagcgaggaaatgggggtgattccttccaagcgaagagttgaaagaaaagagcgagcacgcctaaagaccgtcaaattcaacgccaagcctggagttattgacagcaaaggtgatatccccggcctgggagacgacggctatggtaccaaaactttaaggggacaggaggacctcatcttatcctatgagccagtaactaggcaggagatcaactacactaggcccgttatcattctcggtccaatgaaagacaggattaatgacgatctcatatccgaatttcctgataagttcgggagttgcgtacctcatactacccggcctaaacgggattacgaggtggacgggagggactatcattttgtcatttcgcgcgagcagatggagaaagatatccaggagcacaaatttatcgaggcagggcagtataatgacaacttatacggcaccagtgtccaatccgtgaggtttgtagcagagcgagggaaacattgtattctggacgtgtctgggaatgctatcaaaagattgcaggtggcccagctttaccccatcgcaatttttattaagcctcgcagcctcgaacctctgatggaaatgaataagcgtctgacagaagagcaggcaaaaaagacatacgatagagccattaagttggagcaggaatttggcgaatattttacagctatcgtgcagggcgacacgctggaggacatttacaatcagtgcaaattagtaatagaggaacagtcgggcccttttatctggatcccaagcaaagaaaaactttag

SEQ ID NO: 185574 - DNA, 2601 bp, Artificial Sequence
  Description of Artificial Sequence: Synthetic coding sequence
atgttcttcgcctgctactgcgccctgcggaccaacgtgaagaagtaccgataccaggacgaggacgccccccacgaccatagtctgcccagactgacgcacgaggttcgaggaccagaactggtccatgtgagtgagaagaatctgtcccagatcgaaaatgttcatgggtacgttcttcagtctcacatctcccccctgaaagcctcacctgcccctataattgtcaataccgatactttggatacgatcccttacgtaaatgggactgagatagagtacgaattcgaggagatcacgttggaacgggggaacagcggactcggcttcagcatcgccggggggactgacaatccccatataggagatgatccaggaatcttcattacaaagatcatccccggaggagctgcggccgaggacgggcgccttcgcgttaacgattgcatcctgagagtgaacgaagtggatgtcagcgaggttagccactctaaagcagttgaggccctcaaggaagccgggtccatcgtgcggctctatgttcgtcgaagacgccccatcctcgaaacagtagtggaaatcaagctctttaaaggccctaagggtttaggcttttccattgccggaggcgtgggcaatcagcacattcctggggacaattcgatctacgtgacgaagattattgatggaggggctgcgcaaaaggatggaagattgcaggtgggagatcgattgctgatggtaaacaactacagcctggaggaggttactcatgaagaagcagtggctatcctcaagaacacctccgaggtggtttacctcaaggtcggcaagcccaccactatctacatgactgatccctacgggccaccagatatcacacactcttattccccacccatggagaatcatctgctctccggtaataatggcactttggagtacaaaactagcctccccccgatcagccccggcagatatagcccaatacctaaacatatgctggtagatgacgattacactcgcccccccgaacccgtatattcaacggtcaacaaactgtgtgataagcccgcctccccccggcattatagcccggtagaatgtgacaaaagtttcctgctctctgctccctacagtcattatcatctggggttgcttccagactcagaaatgacaagccatagtcagcacagcaccgcaacccgccagcccagcatgaccttgcagcgcgctgtatctttggaaggtgaaccccggaaggttgtgctgcacaaaggatcaaccggtcttgggttcaacatcgtcggaggtgaagatggggaaggaatttttgtttcttttatcttagcggggggccccgctgacctgagtggtgagctgcagcgaggtgaccagattcttagtgtaaacgggattgacctgaggggcgccagtcacgagcaagccgccgccgctctgaaaggtgccggccagacagtcaccatcatcgcgcagtaccagcccgaagactatgcacggtttgaagccaaaattcacgatttgagagagcagatgatgaaccactctatgagctccggctcaggaagtctaaggacaaatcaaaaacgcagcctgtacgttcgagcgatgttcgactacgacaaatcgaaggactcgggcttgcctagccaaggactgtcttttaagtacggcgacattctgcacgtgatcaacgctagcgatgacgaatggtggcaggcgaggcgggtgatgttggaaggtgactccgaagaaatgggcgtgattccatctaagagaagggtcgagcggaaagaaagagctcggcttaagactgtgaaattcaacgctaaacccggtgttatcgattcaaagggcgacataccaggattgggagatgacgggtatggtactaagactttgaagcatgtgtcaagcaacgcttctgattctgaatcaagctatagaggacaggaagatctgattctgtcttacgagcccgttacaagacaggaaattaattacaccaggcctgtcatcattttaggtccaatgaaggaccggattaatgacgacctgatcagtgaatttcccgacaagttcggatcttgcgtgcctcacaccaccagacctaaacgggattacgaggtcgacggtagagattatcactttgtcatctctcgtgaacagatggagaaggatatccaggagcacaagtttattgaagccgggcagtacaatgacaacctctacgggactagtgttcagtctgtaagattcgtggccgagcgaggtaaacactgcatccttgatgtgagtggaaacgccatcaagcggcttcaggtggcacagctgtaccccatcgccatctttattaaacctagatcactcgagccccttatggagatgaacaagcgattgacggaagagcaggcaaagaaaacgtacgaccgtgctatcaaactggaacaggagttcggcgagtattttacagcaatcgtgcagggggacacacttgaagatatctacaatcagtgtaagctggtgatagaagagcaatccggcccgttcatctggatcccatcaaaagagaagctttag

SEQ ID NO: 185575 - DNA, 285 bp, Artificial Sequence
  Description of Artificial Sequence: Synthetic coding sequence
atgatgaaccacagcatgagcagcggcagcggcagcctgcggaccaatcagaagaggtctctgtacgtccgggcaatgttcgactacgataaatctaaggattccgggctgccctcccagggactgtccttcaagtacggcgacatcctgcacgtgattaatgcctccgacgatgagtggtggcaggcccgccgagtgatgctggagggcgactcagaagaaatgggcgtaatcccctcgaagcgaagagttgagaggaaggagagggcacggctgaaaacctag

SEQ ID NO: 185576 - DNA, 2559 bp, Artificial Sequence
  Description of Artificial Sequence: Synthetic coding sequence
atgttcttcgcctgctactgcgccctgcggaccaacgtgaagaagtaccgctaccaggatgaagatgcgccccatgaccactctctgccacgcttaactcatgaggtgaggggccctgagcttgtacacgtttccgaaaagaacctgagccagatcgaaaatgtgcatggatacgtcttgcagtcacacatttcacccctgaaagcttctccagccccgatcatcgttaacacggacaccctggacaccattccctatgtgaatggcactgaaattgaatacgagtttgaagagatcacccttgagcgcggaaattctggtcttggtttttccattgctgggggaacggataatccccatatcggcgatgaccccgggatatttatcacaaagattattccaggtggagctgccgctgaggatggacgcctgagagtcaacgattgtatcctgcgggtcaacgaggttgacgttagtgaggtgtctcattcgaaggccgtagaagctttgaaggaagcgggttcaattgtcagactctatgtaaggcgccggagaccaatacttgagaccgtagtggagatcaagctgttcaaaggccccaaaggtctgggtttttcgattgccggcggagttggcaatcagcatatacctggagataactctatttacgtcactaagattatagacgggggagccgcccagaaagacggccgcctccaggttggcgatcggctcttgatggtgaacaactatagtctcgaagaagtgacacacgaggaagccgtagccatcctcaaaaatacatcagaggtcgtttatctgaaggtgggcaaaccaacaactatctacatgactgatccttatggcccaccagacatcacgcactcctactcgccacctatggagaaccacctgttgtccggaaataatggtaccctagagtacaagactagtctcccaccgatctccccagggagatatagccccatccccaagcatatgctggtcgacgatgattacacccgcccaccagagccggtttacagcaccgtgaataaactctgcgacaagcccgcatccccacgacattactcccctgtggagtgcgacaagagtttcctgctctccgctccatactcgcattatcatttaggtctcctgccggattcggaaatgacgtctcactcacagcattccacagccacacgacagcctagcatgaccctgcagcgggccgtaagtcttgagggtgagccaagaaaggtggttttacataaaggctcaacgggactcggctttaacatcgtcggcggcgaagatggggagggaatatttgtctcctttatcttagctggagggcctgcggatctgtctggtgagctgcagcgtggggaccagatactgtctgtgaatggaattgatctccgcggggcttcccatgaacaggcggccgcagcgctcaaaggcgcagggcagacggttacaatcatcgcccaataccaacctgaggattatgcccggttcgaagcaaagatacatgatctgcgcgagcagatgatgaatcacagcatgagcagtggatctggaagtctgaggacgaatcaaaagcgctctctgtatgtgcgagccatgttcgattatgacaagtccaaggattcagggttaccttcccaaggccttagctttaagtacggagacatcctccacgttataaacgcctccgacgatgagtggtggcaagctcgcagggtcatgctggagggggatagcgaggagatgggagtcattccttccaaacgcagggtagagcggaaggaacgggcccggctgaaaacagtcaagtttaatgccaaaccaggagtcatcgatagtaaaggggatattccaggattgggcgatgacggctacggaacgaagaccttacgcggacaggaggatttgatcctgtcctacgagcccgttacccgtcaggagatcaattacacacggcctgtgataattttgggacccatgaaagaccgcatcaacgacgatttgataagtgagttccccgataagttcggcagctgcgtgccgcatacgacacgccccaagcgcgattatgaggttgacggacgcgattaccattttgtgattagcagggagcagatggaaaaagacattcaagagcacaagtttatagaggccgggcagtacaacgacaacttgtatggcacatcagtccagtctgttaggtttgtggctgagcgaggaaaacactgcatccttgatgtgtctggtaatgcgattaaaaggttgcaagtggctcagttgtaccccatcgcaatttttattaagccacggagcctggagccactgatggaaatgaacaagcgtttaactgaggaacaggcaaaaaaaacatatgacagagcaattaaactggagcaagagttcggggaatattttactgccattgtgcagggcgatacgctcgaagatatctataatcagtgtaaactggtcatagaagagcagtctgggcctttcatttggatcccgtctaaagagaaactgtag

SEQ ID NO: 185577 - DNA, 1863 bp, Artificial Sequence
  Description of Artificial Sequence: Synthetic coding sequence
atggtgaacaactacagcctggaggaggtgacccacgaggaggccgtcgccatcctcaagaacacatcagaagtagtttacctcaaagtgggaaaacccacgactatttacatgacagatccctatggtccccccgatatcactcactcctattcacctccaatggaaaatcatctcttgtccgggaacaacgggactttggagtacaagacctccttgccccccatcagccccggacgatatagccccattcccaagcatatgttagtggatgatgactatacccggcctccggaacccgtgtattccaccgtcaacaagctatgcgacaagcccgccagtcccagacattactctcctgtggaatgcgataaatcattcctgctaagcgctccctactcccattaccatttgggactgctgcccgactccgagatgacctcccattctcaacacagcacagccacaaggcagccctctatgaccctccagagggctgtgtctctcgagggggaacccaggaaagtggtcttgcacaaaggtagcaccgggctggggtttaacattgtgggaggcgaggacggcgagggaattttcgtgtcctttatactggcaggtggccctgctgatttatctggcgagctgcaaaggggggaccagattcttagcgtcaatggaatcgatctacgcggtgcttcgcacgagcaagccgctgcggctctaaagggagcgggtcagacagtaactataattgcacaatatcaaccggaggactatgccagattcgaggccaagatccacgacctgcgggagcagatgatgaaccattctatgagttctggctctggctctttacgcacaaaccaaaagaggagcctgtacgtgcgggcaatgtttgattacgataagagcaaggactccggactcccaagccagggcctctcctttaagtatggggatattctgcacgtgatcaatgccagcgacgatgagtggtggcaggctaggcgcgtgatgctagaaggtgacagtgaggagatgggcgtgattccaagtaagcggagagtggagaggaaggaacgggctcgcttgaaaacagtgaagtttaatgccaaacccggcgtcatcgactctaagggcgacatccctggtcttggcgatgatggctacgggaccaagacactgaaacatgtttcttctaacgctagtgattctgaaagttcttaccggggccaggaggatctgatattgagctacgagcccgtaactagacaggagattaattatactcgccccgtgatcattctgggccccatgaaagatcgtatcaacgacgacctaattagcgaattccctgacaagttcggctcttgcgtgccacacacaactaggcctaagcgagactatgaggtagacggaagagactaccacttcgtcatctcacgggaacaaatggagaaagatattcaggaacataaattcatcgaggccggtcagtacaacgataacctgtacggcacttcagtacagtctgtgagattcgtggccgagagaggcaaacattgcatcctcgatgtttcaggaaacgctatcaagcggctccaggttgcccaactctacccgatcgccattttcatcaagccgcggagcctcgaacccttgatggagatgaacaaacgtctgactgaggaacaagcgaaaaagacctacgaccgagccattaagctagagcaggagttcggcgaatacttcactgctattgtgcagggcgacacgctagaggatatctataaccaatgcaagctggtgatcgaagagcagtccgggcccttcatttggattccttctaaagaaaagctctag

SEQ ID NO: 185578 - DNA, 2928 bp, Artificial Sequence
  Description of Artificial Sequence: Synthetic coding sequence
atgggcatcttcaagagcagcctgttccaggccctgctggacatccaggagttctatgaggtgaccctactgaatagtcagaagagttgcgagcaaaaaattgaggaagctaatcaggtcctgcagaagtgggaaaagacatctctcctggctccgtgtcacgaccgcttacagaagagcagcgagctgaccgattgcagtggaagtaaggaaaacgcctcctgcatcgagcagaacaaggagaatcagtcgttcgagaatgaaacagatgagacaactactcagaaccaaggtcggtgccctgctcagaactgttccgttgaagcacctgcgtggatgcccgtgcaccactgcactaagtatagataccaggacgaagacgcaccccacgaccatagtcttccaaggctgactcacgaggtaaggggccctgagctcgtgcacgtgtccgaaaagaacctctcgcaaattgaaaatgtacatgggtacgttctccagtcacacatttctcctctgaaagcaagccccgcacctatcatagtcaataccgacacactcgatacaataccctatgtaaatgggaccgaaattgagtacgagtttgaggagattactctagagcgaggcaactccggtctcgggtttagtatcgcaggcggtacagacaatccccacattggcgatgatcccggaatcttcatcactaagatcattccagggggagcagcagcagaggacggccgtctgcgcgtcaatgactgtatcctcagggtaaacgaggtcgacgtctcagaagtgtctcacagcaaggctgtcgaggccctgaaggaagccggctcaattgtgcggctgtatgtgcgacgacgccgccctattctcgagacagtcgtagagattaagctctttaaggggcctaaaggacttggctttagcattgccggtggcgtcgggaaccagcatatcccaggggataactcaatttacgtaaccaagatcatagatgggggggctgcccagaaagacggcaggctgcaggtgggggatcgtctgctcatggtgaataactactccttggaagaggtcactcatgaagaggcggtcgcaatccttaaaaacactagcgaggtggtgtaccttaaagtggggaagcccacgaccatttacatgacggacccatacggccccccagacatcactcattcttattcacctccaatggaaaaccacctgctaagcggcaacaatggtacactggaatataaaacatccttaccaccaattagccctggcagatatagccctattccaaaacatatgctggtagacgatgactatacgaggccccccgaaccagtttactcaaccgtgaataaattatgtgacaagcctgcatctcccagacactatagtcctgtagaatgcgacaagagtttcctgctctccgctccttacagccactatcatcttggattgctgccagatagcgagatgaccagccactcccaacatagcacagctacgaggcagccgtccatgacgttacagcgagcagttagtctagagggtgaaccaagaaaggtagtgctccataaggggagcaccggtctagggttcaacattgtggggggagaagacggagaaggcattttcgtaagctttatactggcgggtggcccagctgatctatccggggagctgcagaggggcgaccagatcttgagcgtcaacggaatcgatctgcggggcgcttctcacgagcaggcagccgccgcacttaagggggccggccagactgtgaccattatcgcgcaatatcagcccgaagattatgctcgttttgaggctaagatccatgacctcagagaacagatgatgaaccactccatgtcttctgggagtggctcattgcggacgaaccaaaaacgcagcttatatgttagggccatgttcgattacgataagtccaaggatagcggtctcccaagccagggcctgtcttttaagtacggagatattttacacgtgatcaacgctagtgatgatgagtggtggcaggctcgcagggtgatgcttgaaggggattctgaggagatgggcgtgattccttcgaagaggagggtcgaacgcaaggaacgcgcacggctgaagaccgtgaagtttaacgcaaagcccggcgtaatcgatagtaagggcagctttaatgataaacgcaaaaaaagtttcattttcagtcgaaaattccccttttacaaaaacaaggaacaatctgagcaggaaactagtgatcctgagaggggccaagaggacctaatcttgagctatgagccagttactagacaagaaataaactatacacggcctgttatcattttaggacccatgaaagaccgtatcaacgacgatctgatctccgagttccctgacaagttcggtagctgtgttccgcacacaacacgcccaaagcgcgactacgaggtggacggacgggactaccacttcgtgatctcccgcgaacagatggaaaaggatattcaagaacacaagtttattgaggccgggcagtacaatgataatctatacggaacaagtgtgcaatcagtaaggttcgttgccgagcgagggaagcattgcattttagatgtctctgggaacgcaatcaaacggctccaggtggcgcagctgtatcccatcgccatttttataaagccacgaagcctggagccgttgatggagatgaataagaggctcactgaggagcaggctaagaagacctatgaccgggcaatcaagttggaacaggagttcggcgagtacttcacagccatcgtgcaaggcgacaccctggaggacatctataaccagtgtaagctagtgatcgaggaacaatctggtccattcatatggataccaagtaaggaaaaactgtag

SEQ ID NO: 185579 - DNA, 2928 bp, Artificial Sequence
  Description of Artificial Sequence: Synthetic coding sequence
ttcggcttcatcgtgagcgtgcacttccagagctacctgaacatccaggagttttacgaagtcacactgctgaacagccagaaatcctgtgaacagaagatcgaagaagcgaaccaggttctgcaaaagtgggagaaaacatccttactggccccatgccacgatcgcctccaaaagtcatccgagctgactgattgctccggttccaaagagaatgctagttgcatagaacagaacaaagaaaaccagagctttgaaaatgagaccgatgagacgacgacccagaaccaggggcgctgcccggcacaaaactgttctgtcgaagctcctgcctggatgcctgtgcatcattgcaccaagtatcgctaccaggacgaagatgcgccgcatgaccactcattgccacggttaactcacgaggtcagagggccggaactggttcacgtaagcgaaaagaatctatcacaaatcgagaacgtgcatgggtatgtgctccagagccatatatccccattgaaggctagccccgcacctatcatcgttaacacagacacacttgatactattccttatgtaaatggcacagagattgagtacgagttcgaagagatcactctcgaaaggggcaactcaggtttaggctttagcatagcaggaggaactgataatcctcacatcggggacgatcctgggatattcattacaaaaatcattccaggcggcgctgcagccgaagacggtaggcttcgggtcaacgattgcatactgcgagttaatgaggtggacgttagcgaagtgtcccacagcaaagccgtcgaagctctcaaggaagctggtagcattgtcaggttatacgtccggaggcggcgtccgatcctggagaccgtggttgagatcaagctgtttaagggcccaaaaggattaggatttagcatcgccggtggtgtgggcaaccagcacattcccggggacaactccatttacgttaccaagattattgacggaggagctgctcagaaggatggaaggctccaggtgggcgaccggctgctgatggttaataactatagcctcgaggaagtgacccacgaggaggctgtggccatcttaaagaataccagtgaggtggtgtatctaaaggtcggaaaacctaccactatctacatgacagacccatacgggcctccagatatcactcactcgtactctccccctatggaaaatcaccttttgagtggcaacaatggtacgcttgaatacaagacatctctgcccccgatatctcccggtcgctactcccctataccaaaacacatgctggttgacgatgactataccagaccaccagagccagtatattccaccgtgaacaagctgtgtgataagcctgcttcaccccgtcactactcccctgtggaatgcgacaaatcctttctgttgagtgcaccctacagccattaccatctcggtttgctgccagattccgagatgacatctcattctcaacacagcaccgctacccgtcaaccttctatgacactgcagagggctgtttctctcgaaggcgagccgagaaaggtggttttacacaaggggagcaccggactgggtttcaacatcgtaggcggcgaagatggggaaggaatcttcgtgtcgttcatcctggcgggaggacccgccgacctcagcggagagttgcagcggggggatcagattctttcagtgaatggaatagatctccgtggtgccagccacgaacaggccgcagctgctctaaagggcgcagggcagaccgtgaccatcatcgctcagtaccagccagaggactatgctagatttgaagcaaagattcacgacctgcgggagcagatgatgaatcattccatgtcaagcgggtctggaagtctccgcaccaatcagaagcggtcgctgtacgttcgggccatgtttgattacgacaaaagcaaagattccggcttaccatcacaggggcttagtttcaaatatggggatattctgcacgtcattaacgcctctgatgatgaatggtggcaggctaggcgtgttatgttggaaggagattccgaggagatgggtgtcataccatccaagcgccgtgtggaacggaaggagagggctaggttgaaaacagtgaagtttaacgccaagcccggcgtcattgacagcaaaggcagctttaacgataagagaaagaaaagctttatcttttcaaggaagtttcctttttataagaataaagagcagtctgaacaagagaccagtgatcctgaacgtggccaggaagaccttatattgtcgtatgaacccgtgacgcgtcaggaaattaattatactcggccagtgattattctcggacctatgaaggaccggatcaatgatgatttaatcagtgaatttcccgacaaatttggcagctgcgttccccatacaactcggccaaagcgtgactatgaagtggacgggcgagactaccacttcgtcattagccgagagcaaatggaaaaggatatccaggagcacaagttcattgaagccggccagtataatgacaacctgtacgggactagcgtgcagtctgttcggttcgtggccgagcgcggcaaacattgtattctcgacgtctccgggaacgccattaaaagactacaagtggctcagctgtacccaatcgcaattttcatcaagccacggtccctcgagcccttgatggagatgaacaaacgcctgacggaggagcaggccaagaagacatacgatcgcgccatcaaactcgagcaggagttcggtgagtactttacagctatcgtccagggggacactttggaggatatttacaatcagtgtaaactggttattgaggagcaaagcgggcctttcatctggatccccagtaaagagaagctgtag

SEQ ID NO: 185580 - DNA, 2550 bp, Artificial Sequence
  Description of Artificial Sequence: Synthetic coding sequence
atgcacaagcaccagcactgctgcaagtgccccgagtgctacgaggtcacgaggctggcagccctgagacgtctggagccgcctggatatggcgattggcaggtgcctgacccttacgggcctggaggcggcaatggcgcttccgccggctatggtggctactccagtcaaaccctcccgagccaggcaggcgccacacccaccccccggaccaaggctaaactcatccccaccggtcgcgacgtcggcccggtccctccaaagccagtgcccggcaaaagcacgcctaaactcaacggaagtggaccgtcctggtggcctgaatgcacgtgcacaaatagggattggtacgaacaggctagaccagctccgttgctggtcaaccctgagactctaaaacattcacttagcgtgaatggttcggacggcatgtttaagtatgaagagatcgttctcgaacggggaaacagcggacttggattctcgatcgctggtggcatagacaatccacatgttcctgacgatcccggaattttcataacaaaaattatccctggcggtgctgccgcgatggatggaagacttggagtcaacgactgtgttctgcgtgttaacgaggttgacgtgtccgaagtcgtccactcccgcgcggtagaggcgcttaaggaggccggtcctgttgtaaggttggtggtgagacgaaggcagcccccgcctgagaccatcatggaggtcaacctcttgaaaggcccaaagggccttggcttctcaatagctggcggtatagggaaccagcacatccctggggacaacagtatttacatcacaaagataatagaagggggagcggcccagaaggacggccgactgcagataggcgaccggctgctagcagttaataacaccaacctccaagacgtgagacatgaggaggcagtcgcatccttaaagaatacttccgatatggtttatctaaaggttgccaagcccggctcgttgcatcttaatgacatgtatgcaccaccggattatgcgtctacgttcaccgcattggccgacaatcacatctcccacaactctagcttaggctacctcggcgctgtggagtcaaaagtcagctatccagcaccgcctcaggtgcctcctacccgatacagcccaattccacgccacatgttagcagaggaggacttcaccagagagccccggaaaatcattctacacaaaggtagtaccggcctaggcttcaatatcgtaggcggtgaagatggtgagggtatcttcgtctctttcattttggccggcggccccgccgacctgagcggcgagctgcgtcgcggtgaccgtattctgtccgttaatggtgtgaatttgcggaacgccacccatgaacaggccgctgccgctttgaaaagagcaggacagtctgtcacaatcgtggctcagtaccgccccgaggaatactcaaggttcgagtcgaagattcacgacctgcgcgagcaaatgatgaactccagcatgagttccgggtccggctcacttagaacaagcgaaaagcggagtttatacgttcgtgcacttttcgattacgacaggacccgcgattcttgtctgccgtctcaggggctgtcattttcctatggggacatactccatgtgataaatgcctctgatgatgaatggtggcaggcccgactggtgaccccacatggtgaaagtgagcagattggcgtgattcctagcaagaagcgagtagagaagaaagagagagcgcgcttaaagactgtcaaatttcacgccagaaccggaatgatcgagtccaatcgggacttccccggcctctccgacgactactacggtgcaaagaaccttaagggagtgacttctaacacctctgatagcgagtctagttctaagggtcaggaagacgcaatcctctcctacgaacccgtaactagacaggagatccactacgccagaccagtcatcatcctcggacctatgaaagatagggtcaacgatgatttgatcagtgagttcccacacaagtttgggtcttgcgtccctcacacaacacggccaaggagggataacgaagtggatgggcaggattatcattttgttgtatccagagagcagatggagaaggacattcaagacaataaatttattgaggcagggcaatttaacgataacctatacggcacatcaatccagtctgtacgagcggtcgccgagcggggaaaacactgcattctggacgtgtctgggaatgctattaaaaggcttcagcaggctcagctgtaccccattgctatctttataaagcctaagtccattgaagcccttatggagatgaatcgtcgccaaacctacgagcaagctaacaaaatttatgataaagcaatgaaactagaacaagagttcggggagtacttcactgccatagtgcagggagattccctggaagaaatttataacaaaattaagcagatcatagaggaccagtccggccactatatatgggtaccatcccctgagaagttatag

SEQ ID NO: 185581 - DNA, 2454 bp, Artificial Sequence
  Description of Artificial Sequence: Synthetic coding sequence
atgcacaagcaccagcactgctgcaagtgccccgagtgctacgaggtgacgagactggctgcactcaggcggctggagccacccggttacggggattggcaggtgcctgatccctatggaccaggcggtggtaatggcgcgtctgctggttacggaggttactcatcacagaccctcccatcacaagctggagcaacccccacgccgaggacaaaggccaagctgatacccactggccgggatgtcggccccgtccctccaaagccagtccccggaaagtctacccctaaactgaacgggagcggacccagctggtggcccgaatgcacgtgtacaaatagggactggtacgaacaagtgaacggatctgacggcatgttcaagtatgaagagattgtgctcgaaagaggcaactctgggctcggatttagtatcgcaggaggtatcgacaacccgcacgtgccagatgatcccggtatcttcataacaaagataattccaggcggggctgcagcaatggatggacggctcggcgtgaatgactgcgtactgcgagtgaacgaagtcgacgtgagtgaagtggtgcactctcgcgccgtggaagccctgaaagaagccgggcccgtggtgagactcgtcgttcgacgaaggcaaccgcctccggagaccatcatggaggttaatcttctcaaaggtccaaaaggattaggtttctctatagctggtggcatcggcaatcaacatattccgggtgataattctatctatatcactaaaatcatcgagggaggcgctgctcagaaagacggtaggctgcaaataggtgatcgcttactcgccgtgaataatacaaatctgcaggacgtgcgtcacgaagaagcagtggcgagcctgaaaaacacctccgacatggtttacttgaaggtggccaaacctgggtctttgcacttaaacgatatgtacgcccccccagactatgcttcaacattcactgcccttgccgacaatcatataagccacaattccagtcttggatacctgggggcagtcgaatcaaaggtgagttaccctgccccgccacaggtgccacccacacggtatagcccaatccctcggcatatgcttgccgaggaggatttcacaagagagcctcgcaagataattttacacaaaggctccaccggactgggcttcaacatcgtaggtggagaagacggagaaggcatttttgtgagtttcatactagctgggggtcctgccgacctgtccggtgagctccgaagaggagatcgaattctctctgtgaatggtgtgaatttgcgaaacgcgacccacgagcaggccgccgccgcactgaaacgagctggccaatccgtgacgattgtagcccaatatcgtcccgaagaatactccagatttgagtcaaaaattcatgatcttagagagcaaatgatgaatagctccatgtcatcgggctcagggtccctccgcacatccgagaagagatccctctacgtgagggcactgtttgactacgataggactagggattcctgtctgccctcccaggggctgagctttagttatggggacatcctgcatgtcatcaacgccagtgatgatgagtggtggcaggcccggctggtaaccccacatggtgaatctgaacagattggcgtgattccatccaagaagagggtagagaagaaggagcgagctaggctgaagacagtgaaattccacgccaggactggcatgatagagtccaaccgagactttcccgggttatccgacgattattatggagccaaaaacctgaaaggacaggaggatgccattctgtcctatgaacctgtgactcggcaggaaatccattacgctaggcctgtaatcatcttgggccccatgaaggacagagtgaacgatgacctgatctcagagttcccacacaagtttggctcttgtgtgccccataccacaaggccccggagagacaacgaagtggacgggcaggactaccattttgtggtcagcagagagcagatggagaaagatatccaagataataagtttatcgaggcgggccagtttaatgataatttgtacgggacatctattcagagcgtcagagcagtcgcagagcgaggtaaacattgcattctggacgtgagcggcaatgcgatcaaacgattgcagcaggcacagttgtacccaattgccatctttatcaagccgaagtccatcgaggctctgatggaaatgaacagaagacagacttatgagcaggcgaataaaatttatgacaaggccatgaaactggagcaggagttcggggaatatttcacagcaattgtgcagggggatagtctcgaggaaatttataataagattaaacagattatagaagaccagtcaggccactatatatgggttccatcccctgagaagttgtag

SEQ ID NO: 185582 - DNA, 1101 bp, Artificial Sequence
  Description of Artificial Sequence: Synthetic coding sequence
atgatgaacagcagcatgagcagcggcagcggcagcctgcggacctcggagaagagatccctgtatgtgagggccttgtttgattacgataggacaagggattcctgtctgcccagccagggactatccttcagctatggagacatcttacatgtgatcaacgcttctgacgacgagtggtggcaggcccggttggtgacccctcacggcgagagcgaacagatcggggtgatcccatctaagaaaagagtggaaaagaaggagcgcgcccggctgaagactgtgaagtttcacgcgagaaccggaatgattgagagtaaccgcagcatcaagaccaagagaaagaaatcttttaggctatctagaaagtttccattttataaatcaaaggaaaacatggcgcaggaatcttctatccaggaacagggtgtgacatcaaataccagcgattccgaatcgagttcaaaaggccaggaagatgctattctgtcttacgagcccgtgacaagacaggagatccactacgcaagaccggtgattattctgggcccgatgaaagacagggtcaacgatgatctgatctctgaattccctcataagtttgggagctgtgtaccacacacaacaaggcctaggagagacaacgaagtggatggacaggattatcactttgtagtcagccgtgagcagatggaaaaagacattcaagacaacaaattcatcgaagccggtcagtttaacgataacctgtacggtacatccatccaatctgtcagagccgtggcggagaggggaaaacattgtattctggatgtttccgggaacgccattaaaaggctgcagcaggcccagttgtatcccatcgcaatcttcattaaacccaaatctatcgaggcactaatggaaatgaatagacgacaaacatacgagcaggctaataaaatctatgataaggcaatgaaactggaacaggaattcggcgaatactttactgccatcgttcagggcgattcgctggaggaaatttacaacaaaattaagcagatcatcgaggaccagagcggccactacatctgggtcccatctcctgaaaaactttag

SEQ ID NO: 185583 - DNA, 2304 bp, Artificial Sequence
  Description of Artificial Sequence: Synthetic coding sequence
atgagccagcggccccgggccccccggagcgccctgtggctgctggcacctccactcctcagatgggcgcccccactgctgacggtccttcactccgacctctttcaagctctgctcgacattttggactactacgaagcgagccttagtgagagccagaaataccgctaccaggatgaggacacccccccactggaacatagtccggcacatctgccaaatcaggcaaactccccccccgttatcgtgaatacagacactctcgaagcgcctggctatgagctccaagtaaatgggaccgagggggaaatggaatatgaggagatcacattggaacgtggcaatagcggccttggctttagcatcgctggggggacagataaccctcacattggagacgacccaagtattttcatcactaagattattcccggaggcgctgcggctcaggatggaaggttgagagtgaatgatagcatcctgttcgtgaacgaagtcgatgtccgcgaggttacacactctgcagctgtggaggcactgaaggaggccgggtccattgtccggttgtatgttatgaggcggaagcctccggccgaaaaagttatggagattaagctcattaaggggccaaagggcttggggtttagtatcgccggtggcgtgggtaatcagcacattcctggcgacaatagtatctacgtgaccaaaatcatcgaaggaggggccgcccataaagacgggcgcttgcagatcggggacaagatactagctgtgaatagtgtgggcctagaggatgtaatgcatgaagatgccgtggccgccttgaaaaatacctatgatgtggtctatcttaaggtggcaaaaccatctaatgcgtatctgagcgatagctacgcccccccagatatcactacaagttattctcagcatctggataatgagataagccacagttcttacttaggtacagactacccaactgccatgactcctacaagccctcgaaggtatagccccgtagctaaggaccttctgggggaggaggatataccacgcgaacctcggagaattgtcatacataggggctctaccggcctcgggttcaacatcgtggggggtgaggatggggagggcatatttatcagttttatcctggcaggggggcctgctgatctgtcaggagaactacggaagggagatcagatcttgagtgttaacggagtggaccttaggaacgcctctcacgagcaagcagctatcgcactgaaaaatgccggtcagactgttacaatcatcgcacagtataaaccagaggaatatagtagattcgaggctaaaatccacgacttgagagaacagctcatgaacagttcactcggctcaggtacagcctccctgaggtcgaacccaaagcgaggattttatattcgtgcactgttcgactatgacaagacaaaggactgcgggttcttgtctcaggccttgagctttcgtttcggcgatgtgcttcacgtgatcgacgcatcggacgaggagtggtggcaggcacggcgggtccactccgattcagagactgacgacattgggtttatcccaagcaagagaagagtcgaaaggcgcgagtggtctaggctgaaggccaaagactgggggtcctctagcggcagccaaggtagggaagattctgtgctgagctatgagaccgtgacccagatggaagtgcattacgctcgccctataatcattcttggcccgacaaaggatcgcgcaaatgatgaccttctctcggaatttccagataagttcgggtcctgtgtgccccataccaccagacctaagcgggaatatgagatagacggcagggattatcatttcgtcagtagcagagagaagatggagaaagatatccaggctcacaagttcatcgaagctggccagtacaatagccatctgtatggcacaagcgtgcagtcagtccgtgaggtggccgagcagggaaagcattgcatcttggacgtgagtgcaaatgcagtccgcaggctccaggctgcacacctgcatcctattgctattttcatcagaccacggtcccttgaaaatgtgcttgagatcaataagcgcattaccgaagagcaggcccgcaaagccttcgatcgggctaccaaattggaacaggaatttacagaatgttttagcgccatagtggaaggggactcctttgaggaaatttaccacaaggtgaaacgcgtcatagaagatctgtctggaccttatatttgggtgcctgctagggaacggctgtag

SEQ ID NO: 185584 - DNA, 2166 bp, Artificial Sequence
  Description of Artificial Sequence: Synthetic coding sequence
atggactgcctgtgcatcgtgaccaccaagaagtaccggtaccaggacgaggacacaccacctctggagcacagccccgcccaccttcccaaccaagcgaacagccccccggtcattgtgaacacagatactctcgaggcccctgggtatgtgaatggcactgagggggagatggaatacgaggagataacacttgaaaggggtaactctggacttggcttttccattgccggtgggactgacaatccccacatcggggacgatccatccatctttatcactaaaattattccaggcggcgccgccgcccaggatggacggctgagagtcaatgactctattctgttcgtgaatgaagtggatgttagggaggtgactcactctgctgccgttgaagctctaaaggaagcgggctctattgtgcgcctgtacgttatgagaaggaagcctcccgcggaaaaagtgatggagatcaagctgattaagggacctaaggggctcggttttagtatcgccgggggggtggggaatcagcacatcccaggagacaacagtatctacgtgacaaaaattatagagggcggcgccgctcacaaagacgggcggttacaaattggtgataaaattttagcagttaactctgtggggcttgaggatgtcatgcacgaagatgccgtagccgccttgaaaaatacctatgacgtggtctacttgaaggtggccaagccttccaacgcatacctgagtgacagttacgctcctcctgacatcaccacatcatattctcaacacctggacaacgagatatcccattcctcttacctgggcaccgattaccctaccgcaatgaccccaacctctccgcggcgctatagtccagtcgcgaaggaccttctcggcgaggaggacattccccgtgagcctcgacggattgtaatccaccgcggttccactggcttgggtttcaacatagttggcggggaggacggcgaagggatctttatctctttcattcttgccggaggccctgccgatctaagtggggaactgcggaagggagatcagatcctgagtgtaaatggagtggatctccggaatgcctctcacgagcaggctgctatagccctcaagaacgccggacagacagtcacaattatcgcacaatataaacccgaggaatactcccgcttcgaagccaaaatccatgatctgagagagcaactgatgaattcctcgctgggctctggtacagcaagcctgcggagtaaccctaaacgcgggttttacattcgagcactcttcgactatgacaaaaccaaggattgcggctttctgagccaggcactgtcattccggttcggagacgtcctccacgtaatagatgcgagtgacgaggagtggtggcaggctcggcgggtgcactccgatagtgagaccgatgacatcggattcattcccagtaagcgcagggtcgaaaggcgagaatggtctagactgaaggctaaggactggggtagtagttcaggaagccaggggcgggaggactccgtcctgagctacgagaccgttactcagatggaggtccattatgctcgtcctatcatcattctaggacctacgaaagaccgtgccaatgacgacttattatcagagttccccgataaatttggctcctgtgtcccacatacaactcgccctaaaagggaatacgagatagatggccgggactatcactttgtgtcttccagggagaagatggagaaggacatccaagcacacaagttcattgaagcggggcagtacaattcccacttatacgggacaagcgtgcaatctgttcgagaggttgccgaacagggcaaacactgtattctcgacgtctccgctaatgcggtgaggcgcctccaggctgctcatctgcaccctatagcaatctttatcaggccacgctccctggagaatgtgctggagataaataagagaatcaccgaagagcaggcccggaaggccttcgacagagccaccaaattggaacaggagtttaccgagtgcttttcggctatcgtagagggcgattcgttcgaggaaatctaccataaggtcaagagagtgatagaagacctgagcggcccatacatttgggtcccggcccgagagcgcctgtag

SEQ ID NO: 185585 - DNA, 1995 bp, Artificial Sequence
  Description of Artificial Sequence: Synthetic coding sequence
atggagtacgaggagatcaccctggagcggggcaacagcggcctgggtttctctattgccggcggtacggataaccctcacatcggcgacgatccatctatatttattaccaagattataccaggcggagcagccgcccaggatggtaggctgagagtaaacgactctatcctcttcgtaaatgaggtggatgtgcgagaggtaacacatagcgcagccgtggaggcactcaaagaggccgggtcaatagtgcgcctgtatgtgatgagacggaaaccccccgcagagaaggttatggagattaaattaatcaaggggcctaagggacttggcttctcaatcgctggcggagtcggcaaccagcacatacccggagataattccatatacgtcactaaaattatcgagggaggcgcggcacataaggatgggagattacaaatcggcgataagatcctggccgttaatagcgttggtctagaggacgtcatgcatgaagatgctgtagccgctcttaagaatacttacgacgtcgtatatttgaaggtggccaaaccaagcaatgcgtacttaagcgacagttatgctccacctgatattaccactagttactcacagcatctggacaacgagataagtcatagcagttatttgggcaccgattatcctacagcaatgactccaacctccccccgtagatacagccctgtggccaaagatttactgggtgaggaggacattcccagagaaccgcgccggatcgtaattcacagaggaagcaccggacttggctttaacatcgtcgggggggaagatggcgaaggaatctttatttctttcatcctcgccggaggacctgcggacctctccggggaactgcgtaaaggggatcagattctatctgttaacggagtggaccttcggaatgcctctcatgaacaggcggccatagcgctgaagaacgccgggcagacagtcaccatcattgcccagtataagccggaggaatatagtcggttcgaggctaaaatacacgacctgcgtgaacaactgatgaattcctccctggggtccggaactgcctcattacgaagcaatcccaaacgcggcttctacataagagccctctttgactatgataagaccaaagactgcggattcctgagccaagctcttagctttcgattcggagatgttctccatgtcatcgacgcctcagatgaggaatggtggcaagcccgaagggtacactccgattcggaaaccgacgacatcggtttcatcccaagcaagagaagggtggaaagacgcgagtggtctcggctcaaagccaaagactggggatctagctcagggtcgcagggcagggaggacagcgtattgtcctatgaaacagttactcagatggaggtgcattatgccaggccaattatcatacttggcccaacgaaggacagagcaaacgacgatctgctgtcggagttcccagacaagttcggatcatgtgtgccacatacgacacgtccaaagcgggagtatgagattgacggaagggattatcatttcgtgtcctctagggagaagatggaaaaggacatccaggcgcacaagttcattgaggccggtcagtacaattcacacctctacggaacttcagtgcagtccgtacgggaggttgctgaacaaggcaagcattgtattcttgatgtatctgccaatgccgtccggcgtctgcaggctgctcacctgcatccaatcgcaatctttataagaccccgaagcttagagaacgttctggagatcaacaagcgaatcacagaagagcaggcgcgcaaagccttcgatcgtgccaccaagctggagcaggaattcacagagtgttttagcgccatagttgaaggcgattcctttgaagaaatctatcacaaagtgaagcgggtgatcgaggatctgtctggaccgtatatatgggtcccagcaagagaacggctgtag

SEQ ID NO: 185586 - DNA, 2175 bp, Artificial Sequence
  Description of Artificial Sequence: Synthetic coding sequence
atggactgcctgtgcatcgtgaccaccaagaagtaccggtaccaggacgaagacacgccaccattggagcacagcccagcgcaccttcctaatcaggctaatagcccccccgtgattgtaaatacagatacactagaggcccccgggtacgtgctccaggtgaacgggaccgagggtgagatggagtacgaggaaataacccttgagaggggcaactctggacttggattttcaattgctggcggtaccgataatcctcacatcggagatgatccttctatctttatcacgaaaattattccaggaggagcagccgcgcaggatggcaggctccgcgtgaacgactccattctcttcgttaacgaggttgacgtccgggaggtcactcactccgcagccgtcgaggctctcaaagaagctggcagtatcgttcggctgtatgtcatgaggcgtaagccaccagctgaaaaggtgatggagattaagttgataaagggtcccaaaggactcgggtttagcatcgcaggcggagtgggtaatcagcatatacctggggacaactctatatatgtgaccaaaatcatagagggcggggccgcccataaggacggtaggcttcaaattggagacaagatcctcgccgttaactccgtgggtctggaagacgtgatgcatgaagacgccgtcgccgcactcaagaatacttatgatgtagtgtatttgaaggtcgcaaagcctagcaacgcctatctgtctgactcttacgctccccctgacatcactactagctattcccagcatctcgacaatgagatttctcacagtagctacttagggacagactaccccacagcaatgacaccaacttccccccgtcgttattcccctgtcgctaaggatttattgggggaagaggatattcccagagagccaaggcgaatagtgatccatcgcggaagcacgggactgggttttaatatcgtggggggcgaggacggcgaaggtatttttatttcctttatactggctggtggaccagctgaccttagtggcgaactgaggaaaggggatcagatcctgtcagtgaacggtgtagacctacgcaacgcctcccacgaacaggcggcgatcgcacttaagaacgctggccagaccgttacgataatcgcacagtataagccagaggagtactcccggtttgaagcaaaaatccatgacttaagggagcagctgatgaactcctctctcggtagcggcaccgcgtctctgcgctcaaatccgaaaaggggcttctatattcgggcccttttcgattacgataagaccaaggactgcgggttcctctctcaggcactcagctttcgcttcggcgatgtgctgcatgttatcgatgcttcagacgaggaatggtggcaggcccggagagtgcatagcgatagcgaaacagacgacatagggttcatccctagtaaacggagggttgagcggcgtgagtggagcagattgaaagctaaggactggggatcctcaagtggttcccagggccgggaggactctgtactgtcttatgagacagttacccagatggaagtacactatgcgcggccaattatcatcctcggccccaccaaggatcgggcaaacgacgaccttctctccgagtttccagacaaattcggctcttgcgttccacatactactcgtcccaaacgggaatacgaaatagatggccgggactaccatttcgtgtcttccagagaaaaaatggagaaagatatccaggctcacaagttcattgaagctggacagtacaactctcatttgtacgggacttctgtccagtcagtcagggaggtggccgaacagggaaagcactgtatccttgatgtatccgccaatgccgtgcgacgcctgcaggccgctcacctgcatccaatcgccatattcatcagaccccgtagtctcgagaacgtgcttgagattaacaagcggattacagaagaacaggctcgcaaggccttcgaccgtgctacgaaactggagcaggagtttacagaatgcttcagtgccatcgtcgaaggagattccttcgaagagatataccacaaagtcaaacgagtcattgaggacctaagcggtccgtacatctgggtgcctgcccgcgaaaggctgtag

SEQ ID NO: 185587 - DNA, 2304 bp, Artificial Sequence
  Description of Artificial Sequence: Synthetic coding sequence
atgagccagcggccccgggccccccggagcgccctgtggctgctggccccacctttactccggtgggcacccccattgctaaccgtgcttcactccgatctgttccaagccttgctggatatcctggactactacgaggcttcgctgagcgaaagccagaaataccgttaccaggacgaagatacccccccgctggagcatagcccagcccacctgccgaaccaagctaatagcccaccggtgattgtgaacactgacaccttggaagcgcccggatacgtgttgcaggtgaacgggactgagggagaaatggaatacgaggagatcactctcgagcgcggcaattcgggactcggtttctcaatcgccggtgggaccgataacccacatattggtgatgacccatctatctttattacaaaaatcatcccaggaggcgcagctgcacaggatgggcgcctgagggtgaatgactccatcctgttcgtaaatgaagtggacgtgcgcgaggtaacacactccgctgccgtggaggctctcaaggaagctggatccatcgtcagactgtatgtgatgcggcgtaagcccccggccgaaaaggttatggagattaagttgatcaagggccccaaggggctcgggttcagtatagctgggggagtgggaaatcagcatattcccggcgacaactctatatacgtgaccaagattattgaaggcggcgccgcacataaggatggcaggctccagattggcgacaagattctggcagtgaactctgtcggtttggaggacgtcatgcacgaggatgcagtggctgccttgaaaaacacctacgacgtcgtctatttaaaagtggctaaacccagtaatgcctacctgtctgatagctatgcccctcctgacataaccacatcttattctcagcacctagacaacgagatctcacattccagttacctgggaacagactaccctactgcgatgacccctacgagtcctcggcgttactcacctgtcgctaaagacctcctgggagaggaggatatccctagagagccgcggcgcatcgtgattcatagagggagtactggtctgggattcaatatagttggtggggaggacggggagggcattttcatttcattcattctggctgggggccccgccgacttgagtggcgaattacggaaaggtgaccagattttgagcgtaaacggagtggatctgcgaaacgcttcacatgaacaggccgcaattgctctgaagaacgcaggtcaaactgtgacgattatagcacaatataagccggaggagtattcccgctttgaggccaagattcacgatctgcgggagcagcttatgaattcatccctcggctccggaacggcaagcctcaggagcaaccccaagcgcggattctatatacgggctctgtttgactacgacaaaacaaaggactgtgggttccttagccaagcactcagttttcggtttggtgacgtgctgcacgttatcgatgcatcagacgaagagtggtggcaggcaaggcgggtgcacagcgatagcgagacggacgacatcggcttcatcccgtctaagcggcgcgttgagagacgcgagtggtctaggctcaaggctaaggattggggatcatccagtgggagtcagggacgcgaggattctgtgctctcttacgagacagtgacccagatggaggtgcattacgcgaggccaatcattattctgggtcccaccaaagatagggctaacgatgatctgctgagcgagttcccagacaagtttggaagttgcgtcccccacaccacccgtcctaagcgcgaatacgaaattgatggtagggattaccatttcgtcagctcaagagaaaagatggaaaaagatatacaagctcataaattcatcgaagctggtcagtataattcccatctgtacggaacaagtgttcagagcgtgagagaggtcgctgagcagggcaaacactgcatcttggacgtatcggccaacgctgtccgtcgcttgcaggctgcccatctgcacccaatcgccatctttatccgacctaggtcgttggagaatgtgctggaaattaacaaaaggatcactgaggagcaagcacgaaaagcttttgaccgcgctactaaattggagcaggagtttaccgagtgtttttctgcaatcgtcgagggggattcattcgaggagatctaccataaggtgaagagggttatcgaggacctttcgggaccctacatctgggttccagctagagaaaggctttag

SEQ ID NO: 185588 - DNA, 2004 bp, Artificial Sequence
  Description of Artificial Sequence: Synthetic coding sequence
atgagccagcggccccgggccccccggagcgccctgtggctgctggctcctccgctgctgaggtgggcacctccactcctgacggtgctgcactcagacctctttcaagcgttgctggacattttggattactacgaagcaagtctgtcagaatctcagaagtaccgttatcaggatgaggacacccctcccctggaacactcccccgcccatttgcccaaccaggctaattccccaccagtgatcgttaacaccgatactttagaggccccaggatatgagcttcaagtaaacggaacagaaggtgagatggagtatgaagaaattacccttgagcgtggaaactccggactcggcttttctattgccgggggcacggacaatccccatatcggggacgacccatcaattttcattacaaagataattccagggggcgctgcagcacaggacggtcgactgcgggtgaacgactccatcctctttgtgaacgaggtggacgtgagggaagtgacccattccgccgcggtcgaggccctgaaagaagccggctcaatagtccgtctgtacgtcatgcgccggaagcctcctgccgagaaggtcatggaaatcaagcttattaagggccctaagggcttgggattttccatcgccggcggggtggggaatcagcacatccctggtgacaactccatatatgtgacaaaaattattgagggcggtgctgctcataaggatggaaggttacagattggagacaaaatcctggctgtgaactctgtggggttggaggatgtgatgcatgaggacgccgtggccgccttgaaaaacacctacgatgtcgtctacttgaaggtagcgaagccttcgaacgcgtaccttagtgattcctacgcacccccggatatcacgacctcttactcacagcacttagacaatgaaatcagccactcctcctacctgggcactgattacccaacagccatgactcccacatcccctaggaggtactcgcccgtggctaaggaccttctgggggaagaggatataccgcgcgaacctcgacgaattgtaattcaccgcggctcgaccggccttggctttaatatcgtgggcggcgaggatggggaaggtatcttcatcagctttattctggctggtggtcccgccgacctctccggggaattacgcaagggggaccaaattctaagcgtgaatggagtggatctgagaaacgcctctcacgaacaggctgcgattgccctgaagaatgctgggcagaccgttactatcatcgcacagtacaaacctgaggagtactccaggttcgaagccaagatccacgacctccgcgagcagttgatgaactctagcctcggtagtggaaccgccagccttcgtagtaacccgaaaaggggcttctatatcagggctctcttcgactacgataagacaaaagactgtggatttctctcccaggcactgtcttttcgtttcggcgacgtgttgcatgtgattgacgcgagcgatgaagagtggtggcaggctaggagggtccactcggatagtgaaaccgatgacatcggctttatacctagtaaaagacgcgttgaacgaagagagtggtctaggctgaaggctaaagattggggttcaagttctggcagccagggtagggaagatagcgtcctgagctacgaaacagtgacacaaatggaagtgcactatgcacgcccaataatcattctcggcccaacaaaggacagggctaatgacgatctgctgagcgaatttcctgataaattcgggtcctgtgtgcctcatacaactcggcctaagagggagtatgagattgatgggcgtgactatcactttgtttcaagtcgcgagaagatggaaaaagatatccaggctcataagtttatagaggccgggcagtacaatagtcacctttatggaacgtcggttcagtcagtcagagaggtggctgagcagcgcgattag

SEQ ID NO: 185589 - DNA, 4740 bp, Artificial Sequence
  Description of Artificial Sequence: Synthetic coding sequence
atggagccccagcggcgggagctgctggcccagtgccagcagagcctggctcaggctatgacggaagtggaagcagtccttggtctcctcgaagcagccggtgcactcagccccggggagcgcaggcagctagacgaggaagctggtggggccaaagcagagctgctcctcaaactattgttagctaaggaacgtgatcactttcaggacctcagggccgctttggagaagacccagcctcatttgctcccaatactgtatctgaatggtgtcgtgggaccgcctcagcctgccgaaggtgccgggagtacctattccgtgctctcaaccatgccatcagacagcgaatcttcttcctctttatcatccgtcgggacaacgggcaaggcccccagcccgcccccgctgctcactgaccagcaggtgaatgagaaagttgagaacttaagtattcagttgaggctgatgacaagagagagaaacgagttgaggaagagattggcctttgcaacacacggaactgcctttgataaacggccctaccatagattgaatcctgactatgaaagactgaaaattcagtgcgtacgggcaatgagcgacttgcagtcattgcagaaccagcacacgaatgcgctcaagcgctgcgaggaagtagccaaggagaccgatttttaccacacactgcattctcgcctcctgagtgaccagaccagactgaaggacgacgtggatatgctgcggcgggagaatggccagctgctgcgcgaacgcaacctgcttcagcaatcctgggaggacatgaagagactacacgaagaagaccagaaggagattggagatctgcgggctcaacagcagcaggtcctcaagcataacgggtcatctgaaatactcaacaagctctatgacacagctatggataagttggaagtcgtcaagaaggactacgatgccctaaggaagcgttacagcgagaaggttgctatccataacgcagacctgtcccggctggaacagcttggtgaggagaaccagcgcctcctcaagcagacagagatgctgacacagcagagggatacagctattcagctgcaacaccagtgtgcgctgtctttaagacgctttgaagccattcaccacgaactgaacaaggccactgcgcagaataaggacctgcagtgggaaatggaactgttacagtcagagctgaccgaactgagaactacacaggtaaagaccgccaaagagtcagagaaatatcgtgaggaacgagacgctgtgtatagcgagtataaactgatcatgtctgaaagagatcaggtgattagcgaattagataaactgcagactgaagtggagcttgcagagtcaaaacttaaatcttccacttccgagaaaaaagccgctaacgaggagatggaagccctgcggcagattaaagacaccgtaacaatggatgcaggacgagccaacaaggaagtggagatattgcggaagcagtgtaaggccctctgccaggaactcaaagaagcgttgcaggaggcggatgttgccaagtgccgacgtgactgggcttttcaggagcgggataaaatcgtggctgagcgcgactctatccggactctctgtgacaacttgcgtcgggaacgtgatcgcgcagtatccgaacttgctgaggcactcagaagtctggatgatactagaaagcagaagaatgacgtgtctagagaactgaaggagctcaaggagcaaatggagtctcagctcgaaaaagaggcgcggttccgtcagctcatggctcactcttctcatgactccgccattgataccgatagtatggagtgggagactgaggtcgttgagttcgaaagggagactgaagacatcgacttgaaagcactggggtttgatatggcagagggcgtgaatgagccatgtttccccggcgactgcgggatctttgtaacaaaagtggataagggcagtatagcggatggacgcttacgagtgaatgactggctcctgcggatcaatgacgtggaccttattaacaaggacaagaaacaggccatcaaagcactgttgaacggtgagggcgccataaatatggtcgtgagaagacgcaagtcactgggtggtaaagtcgttacaccattacacataaatctttccgggcaaaaggattctggcatatccctggagaatggcgtctacgcagcagctgtgctgcctggttcccctgccgccaaggaaggctccttagccgtcggagatcggatcgtggccatcaacggaatcgctttggacaataagtctctgaacgagtgtgaatccctgctcaggtcctgtcaagacagtcttactctttctttattgaaggaacagaaatgtgtgccagcatcaggcgagctctcccccgaactgcaggaatgggccccatactcgccaggccattcaagtaggcactcgaatccaccactatacccgtcccgaccttctgtgggaactgtgcctcgtagtctgactcccagtacaacggtgtcctccattctgaggaacccgatttacactgtaaggagccatcgtgtaggcccttgttcatcaccccctgccgccagggatgccggcccacaaggccttcaccccagtgtgcaacaccagggccgcttgtctttagatctttcacacaggacctgttccgattattccgagatgagggctacccatgggtctaatagcctgcctagctcagcccggcttggctcctctagcaaccttcagtttaaagcagagcgaatcaaaatccctagtactccacggtaccctagatccgtggtgggcagcgagcgcggtagtgtttcccatagcgaatgctccaccccacctcaaagcccgctcaacatcgacacactgagctcctgcagccaatctcagacttcagccagcacactgcccagaattgccgtgaatccggcttctttgggcgagcgcagaaaggaccgcccatatgtggaagagcctcgccatgtgaaggtgcagaagggtagcgagcccttggggatctccatagtgtcaggcgagaaagggggaatctatgtgtcaaaagttaccgtgggcagtatcgctcaccaggccgggctggagtacggggaccagcttctggagtttaatggcattaacttacgctcagctaccgagcagcaggccaggctgattatcggccaacagtgcgatactatcacgattctggcacagtacaacccacacgtccatcagctgtcgtcacactcccgctcaagttctcatctggacccagcaggcacccattctactctgcaggggtcaggcacgacaacacctgagcatcccagcgtcatcgacccattaatggagcaggatgaaggcccaagcacaccaccagctaagcagagctccagtcgcatagccggggacgcgaataaaaaaactctagagccaagagtcgtttttataaagaagtcacagctggagctaggcgtccacctgtgcggaggcaatttacatggcgtgttcgttgctgaagtggaagatgattctccagccaaaggccccgacggcctcgtaccaggtgacctgatactggagtacggatcattagatgtgagaaataagacagtggaggaggtctatgtcgagatgctaaaacctagagatggggtacggctgaaagttcagtatcgcccagaggagttcactaaagccaaaggactgcccggcgattccttctatattagagccttgtacgaccgactggctgatgtagaacaggagctatcgttcaagaaagatgatatactgtacgttgatgacactctgccccagggaacttttgggagttggatggcctggcagttagatgagaatgcacagaaaatccagaggggtcaaatccctagcaagtatgttatggaccaggaattcagccgccgcctcagcatgtcagaggttaaagatgacaatagtgctactaaaacactgagcgccgcagctcgtagaagtttcttccgccggaagcacaagcataagcgaagcggctcaaaagatggtaaggacctgctggcattggacgctttctcgagtgactcaatacccttattcgaggactcagtgagcctggcctaccagcgcgtacaaaaggtggattgtacagccctcaggccggtgctgatcctgggcccgctgcttgatgttgtcaaagagatgctcgtgaacgaggctccaggaaagttctgccgatgccctctggaggtgatgaaggcctcccagcaggcaattgaacgtggagtcaaggattgtctgttcgtggactataagcgtaggtccggtcatttcgatgtcaccacagttgcatccattaaggaaataaccgagaaaaaccgccactgcctgctagacattgcaccccacgctatcgagcgcttgcaccatatgcatatctaccccatagtgatttttattcattacaagagcgccaagcacattaaagaacagcgcgatccaatctatttgcgcgataaggtaactcagaggcacagcaaggagcagttcgaagcggctcaaaagctggagcaggaatactccaggtacttcactggcgttattcaagggggggctctgagtagcatctgtacccagatccttgctatggtcaaccaggagcagaataaggtgctgtggatccctgcgtgccctctgtag

SEQ ID NO: 185590 - DNA, 5760 bp, Artificial Sequence
  Description of Artificial Sequence: Synthetic coding sequence
atggagccccagcggcgggagctgctggcccagtgccagcagagcctagcgcaggcgatgacagaggtggaggctgtgctggggctactggaagcggcgggggccttgtcccccggggaacgccgtcagctcgacgaggaggctgggggggcaaaggctgagctcctcttaaagctattgctagcgaaggagagagaccactttcaggaccttcgggcagctttggaaaaaacccagccccatctcttgccaatcctgtacctgaatggcgtcgttggcccacctcagcctgccgaaggagcaggaagcacatatagtgttttgagtacgatgccgtctgactccgaatcctcttccagcttgtcgagcgttgggactaccggtaaggcccctagtcctcccccattactcacagatcagcaggtgaatgagaaggtggaaaacctgagcatccagctacgtttgatgacaagagagaggaatgaactccggaagcgcctggcctttgctacacacggcaccgctttcgataagagaccttatcaccgtctcaatcctgattatgagagattgaagatccaatgcgtgcgtgcaatgtcggatctgcagtcccttcaaaaccagcatactaatgcccttaagcgatgcgaggaagtggccaaagaaacagatttttatcatactttgcattctcgcctcctttctgatcagactagactgaaagatgacgttgacatgctccgacgcgaaaacggccaactcttgagggagaggaacctcctgcagcaaagttgggaagatatgaaaagacttcacgaggaggatcaaaaagagattggcgacttgagagcacagcaacagcaggtcttaaaacacaacggcagcagcgagatcttgaacaaactgtatgataccgccatggataagctggaggttgtcaaaaaagactatgatgctctgcgcaaacggtattcggagaaggtagccatccataatgccgacctttcacggctggaacagctgggcgaagagaaccagcgactgctgaaacagacggagatgctcacccagcagcgggatacagccattcagctgcaacatcaatgtgctttatctctacgccggttcgaggccatccatcatgaactgaacaaggcgaccgctcaaaataaagacttgcagtgggagatggaactgctccagtcagaattgactgagctgaggaccacccaggtcaagacggcgaaggagagtgaaaaataccgggaagaacgcgacgccgtgtacagcgaatacaagctgatcatgagcgagcgggatcaagttatctccgagcttgacaagctgcagacagaagtcgaactggcagaatccaaattaaagagcagcaccagtgaaaagaaggccgctaatgaggaaatggaagctctcagacagatcaaggatactgtaacgatggatgccgggcgggctaacaaggaggttgagatactaagaaagcagtgtaaagccctttgtcaggaacttaaggaagccttacaggaagcagatgtggccaaatgtagacgggactgggcttttcaggagagggacaagattgtggcagaacgggattctattcgcactctgtgcgacaacttacggcgagagagggatcgcgcggtgtcagagttagccgaagcgcttcgatctcttgatgacacccgtaagcagaagaacgacgttagccgagaactgaaggaactcaaagaacagatggagtctcagcttgagaaggaagcccggttcagacagctgatggctcatagcagccacgactcggccatagacactgatagtatggagtgggaaacagaggttgttgaatttgaaagagagaccgaggatatcgatctcaaggctcttggcttcgacatggccgagggtgtgaacgaaccttgtttccctggagattgtggaattttcgtgactaaggtggataaggggagcatcgccgacggcaggctgagagtgaacgactggctgctccgaattaatgacgtggacttgattaacaaggacaagaaacaggccattaaggcactgctgaatggggagggcgcgatcaacatggttgttcgacggcgaaagagtttgggagggaaagtcgttacgcctcttcacattaacctgtccggacagaaagattcagggatttcgctcgagaatggagtttatgcggcagccgtgcttcctggcagcccagctgcaaaggagggctcattggctgtgggggacaggattgtggcaataaatggcattgcacttgataataagtcccttaatgagtgtgagagtctgttgaggtcttgccaggactccctcacactgtccctcctgaaagtgtttcctcaatcctcatcctggagcggacaaaatatattcgaaaacattaaagattccgacaaaatgctgtctttcagagcacacggacccgaagtgcaagcgcataataagcgtaacctcatccaacataataactctacacagaccgacatcttttacaccgataggctggaagataggaaagagccagggccacctggtggcagctccagctttttgcataagccattcccagggggtcctctccaggtgtgtcctcaagcttgtcccagcgctagtgagcgatccctgagcagttttcgctctgacgcttctggcgatcggggtttcgggctcgtggatgtcaggggcaggaggcccctgctcccttttgagacagaggtaggtccttgcggcgtaggcgaagcaagcttggacaaagccgattctgagggatcaaactccggtggtacctggcctaaggcaatgctctcctctactgcggtgccagagaagctatccgtttataagaagcccaaacaacgtaaatctatctttgaccctaacactttcaaacgcccgcaaacccccccaaaaatcgactatcttctcccaggtccaggacccgcccatagccctcagccttccaaaagggcaggtccactgacaccgcctaagccgcctcgcagaagcgattccatcaaatttcagcatagactcgaaacctctagtgaatccgaggctactctcgtgggaagtagcccgtccaccagtccaccctccgctctgccaccagatgttgaccctggagagcccatgcacgcttctccgcccagaaaagccagagttaggatcgcaagttcctactatcccgagggggacggagatagctctcatctgccagccaagaaatcctgcgacgaggatcttacttctcagaaagtggacgaactgggccaaaagagaagacggcccaagtcggcccctagtttccggccaaagctggcccctgttgtaatccccgcacagtttcttgaagaacaaaagtgtgtgccagcttccggagaattaagcccggagctccaggaatgggctccctactcccctgggcatagctccagacattcgaacccaccactgtatccttccagaccatcagttggtacagtccctcggagtctgacgccctctactactgtgtcgtctatcctgaggaatcccatctatactgtgcgctctcatagagtcgggccatgcagtagcccgcccgccgcaagggatgccggtccccaaggcttgcacccttcagtgcagcatcagggccggctgtcattagacctcagccataggacttgttctgactacagcgagatgcgggctacccatgggtctaacagtctgccttcctccgcccgcctcggctccagtagcaacctccagtttaaggccgagcggattaagattccttccacgcctcggtatcccaggtctgtggttggctcagagaggggttcagtctcacattccgagtgcagtactccccctcagtcgcccttgaacattgatactctcagctcctgctctcagtcccagaccagcgcgagtactctgccacggatcgctgtgaaccccgcatctctgggggagaggcgcaaagatagaccctacgtcgaggagcccagacacgtcaaagtacagaaaggatctgagcctctggggatctccatagtctccggtgagaaggggggaatctacgttagtaaagtgactgtcggcagcatcgcccaccaggcaggattggagtacggggaccagctgctcgaattcaatggcattaatctccggtcagccaccgagcagcaggctcgcttgatcattggccagcaatgtgacaccatcactatcctggctcagtacaacccgcacgtccatcagctgagctcacatagcaggagctctagtcacctggatccagctggcacccattctactctgcaaggctcagggacaaccacacccgagcatcctagcgtcatcgaccccctcatggagcaagatgaaggcccttcaacgccaccggccaaacagtcatcttcgcgcatcgctggggatgccaacaaaaaaacgcttgaaccaagagtagtgttcatcaagaagtcacagctggagctgggagtccatttgtgcggtggaaacttgcacggtgtctttgtagcggaggtggaagacgactctcctgccaaggggcccgacggtctcgttcccggggacttaatacttgaatacggttcattagatgtgcgcaacaagacggttgaggaggtatacgtggagatgctcaagcctagagatggcgtaaggctcaaagtccagtatcggccagaggagtttaccaaagctaagggattaccgggtgacagcttctacatccgcgcactgtacgatcgcttggccgacgtcgaacaggagctctctttcaaaaaggatgatattctttacgtggatgacaccctgccccaggggacttttggctcttggatggcctggcagctggatgagaacgcccagaaaatacagcgggggcagatcccatcaaaatatgtgatggatcaagaattcagtcgccgactcagcatgtcagaagttaaagatgataattcagccactaagactctctcggcagccgccaggcgctcgttctttcgtcggaaacacaagcataaacgatcggggtccaaagatggaaaagacttgcttgcactcgacgcatttagttcagactccattcctctctttgaagactccgtcagcctcgcctaccagcgcgtgcagaaagtggattgcaccgcactccggcctgtactcatcctaggacctttacttgacgtcgttaaagagatgcttgtgaacgaggcccccggcaaattctgtcgctgcccactcgaggtgatgaaggcatcccagcaggcgatcgagagaggagtcaaggattgtcttttcgtggactacaaaaggcgaagtggacacttcgacgtaacgacggtcgcctctattaaagagatcactgagaaaaaccgccactgcctgctggatattgccccccatgctatcgagaggcttcaccatatgcatatttatccaatagtaatctttatccactacaagtcagctaagcacattaaggaacagcgagatccgatatatcttcgtgacaaagtgactcagcgccattccaaggagcagtttgaagccgcccagaaactggaacaggagtatagtcgctatttcactggtgtcattcagggtggcgctctctcatcgatctgcacacagattctggctatggtgaatcaggaacagaataaggtgttgtggatccccgcttgccccctttag

SEQ ID NO: 185591 - DNA, 2052 bp, Artificial Sequence
  Description of Artificial Sequence: Synthetic coding sequence
atggagccccagcggcgggagctgctggcccagtgccagcagagcctcgcgcaggccatgacggaggtggaggcagtgctcggcctgctggaggctgcaggcgctctttctcccggggaacgacggcagctagatgaagaggctgggggcgccaaggccgagctactgcttaaattgcttctggctaaggagcgggaccatttccaggatctccgcgcagctctggaaaaaactcagccccatctgctgccaattctgtacctgaacggtgtagtcggacctccccaacccgccgagggcgccggaagtacgtattctgtgctcagtacaatgcccagcgacagcgagagttctagctccttgtccagcgtcggaactacggtgaaacacctgcgtgagcagatggagtcacaactcgaaaaggaggctcggtttaggcagttgatggcccattctagccatgatagcgccatagatacggactcaatggaatgggagacggaagtggttgagttcgaaagggaaactgaggatatagaccttaaggcactaggcttcgacatggccgagggagtcaatgagccatgttttcccggtgattgtgggattttcgtcaccaaggtggataagggctccatcgctgacggccggctgcgagtgaatgattggctactgcgaattaatgacgtggacctcattaacaaagacaagaagcaggccataaaagccctattgaacggcgaaggagcgattaacatggtcgtcagacgaagaaaaagtctcggaggaaaggtagtgaccccgctgcacatcaatcttagcggccagaaagatagtggcataagcttggagaacggggtctatgcagcagctgttctacccggctcccccgctgctaaagagggatcactcgctgttggagaccggattgtggccatcaacggtattgcactggacaataaatctttgaatgagtgcgagtcactgctgcggagttgccaagactccctgaccctgtccctgctgaaagtcttcccgcaatcgagctcctggtcaggacaaaacatcttcgagaacatcaaggattcagacaaaatgctctcatttcgcgcccatgggcctgaggttcaggcccacaacaaaagaaacctgattcaacacaacaactctactcaaaccgatatattttatacagatcgactggaagacagaaaagagccaggccccccaggaggcagcagttcatttctccacaaaccctttcccggcggtcccttacaggtgtgtcctcaagcatgtccctcggcctctgaacgctcattgtcctcctttcgaagcgatgcctcaggcgacagaggctttggactcgtggacgtccgcgggcgaaggcccctcttgccatttgaaacagaagtgggaccatgtggagtgggggaggctagccttgacaaagctgacagcgagggaagcaatagcgggggtacatggcctaaggctatgctttcttccacagcagtgccagagaaactttccgtgtacaaaaagcccaaacagcgcaagagcattttcgaccccaacacttttaagaggcctcagactccccccaagatcgattacctgctacccggccccgggcctgcgcatagtccccagcctagtaaaagagcaggaccactgactccacccaagccccctaggagatctgactcgattaagtttcagcataggctcgagacttccagtgaatctgaagctacattggtcggatcttccccttccacctcacccccctccgccctaccacctgatgttgacccgggggagcctatgcatgcttctcccccacgaaaggccagggtgcgaatcgctagttcttattaccctgagggggatggtgattcttctcacctgccggctaagaaatcatgcgacgaggatctaacttcacagaaggtcgatgaactcggtcagaagcgacggaggcctaagagcgcaccctctttcagaccgaaacttgccccagtcgtcatccccgcgcagttcctggagtag

SEQ ID NO: 185592 - DNA, 2643 bp, Artificial Sequence
  Description of Artificial Sequence: Synthetic coding sequence
ggcgccatcaacatggtggtgcggcggcggaagagcctgggcggcaaggtggtcaccccacttcacatcaacctgtctgggcagaaggatagcggaatatccctggagaacggggtctatgccgccgccgtcctgcctggcagtcctgctgccaaggaagggtcccttgccgtgggagatcggattgtagcaataaatgggattgcactggacaataagtcccttaatgagtgcgaaagcttattacgcagctgtcaggacagcctgacgttatccctgctgaaagaacagaaatgtgtcccagccagtggcgagttatcacccgaactgcaggagtgggcaccttattctcctggacatagcagccgccattcaaaccctcctctttatccaagtcgcccttcagtcggtacagtgccacggtccctgacccccagcacaaccgtatccagtatacttcgaaaccccatttataccgttcggtcccatcgtgtcggcccctgctcaagcccgcctgcagccagggacgctgggccccagggattacatccatccgtacagcaccagggacgtctgtccctcgacctgtcccatagaacatgttccgactatagcgagatgcgcgcaacacacggctctaactctttgccatcctcagctagactcggatcaagctccaatctgcagtttaaggccgaacgcattaagattcccagcacaccccgatacccgagaagcgtggtcggatctgaaagaggatctgtgtcccacagcgaatgttctacccccccacagagtccccttaacattgatacactctcctcttgcagccaaagccagacgagtgcttctactcttccgagaatcgcagtcaatcccgcatcgctgggagagcgcaggaaagatagaccgtacgttgaggaacctaggcacgtgaaggtacagaaggggagtgaaccactgggcatctcaatcgtcagtggagagaagggagggatttacgtgtctaaggttactgttgggtctattgctcaccaagccggcctcgaatacggcgaccagttgctggaattcaatggcattaatcttcgatctgccaccgagcagcaagctagactgatcattggacagcagtgtgacactatcaccatactcgcacagtataacccacacgtccaccagctgagttcgcacagtcggtcgagctctcatctggacccggcgggcacgcactctacactgcaaggatctgggactacgactccagaacaccccagcgtgatcgatcccttgatggaacaagacgagggacccagtacccctccagccaaacagtcttcctctcgcattgccggcgacgctaacaagaaaacattggaaccaagggtcgtgttcataaagaagagtcagctcgagctcggggtgcacctgtgtggggggaacctgcatggggtgttcgtggcagaggtggaggacgattcccccgccaaggggcctgatggcttggtgccgggagatctgatccttgagtacggaagtctcgatgtgcggaataaaacggtggaagaggtatacgtggagatgctgaaaccccgcgacggggtcaggttgaaggtccagtatcggccagaagaattcactaaagcaaagggacttcccggcgactcattctacataagagccttgtatgacagactggcggatgttgaacaagagttgtcattcaagaaggacgacattttgtatgttgatgacactctcccgcagggcacctttggctcctggatggcctggcagctggacgagaacgcgcaaaagatacaacggggacagatcccttccaaatacgttatggaccaggagttcagcaggagactcagcatgtccgaagtgaaagatgacaactccgctactaagaccctctccgccgccgcccgcaggagcttcttcaggcggaagcacaagcataagaggtccggcagtaaagatggaaaagacctgcttgcactggatgcattctcgtccgattccattccattgtttgaagactctgtatcactagcataccagagggtccagaaggtggactgtacagccctgcggcctgtcctgatactgggccccctgttggatgtagtgaaggagatgctcgtcaacgaagcaccggggaagttctgtagatgcccactcgaggtgatgaaagccagccagcaggcaattgagagaggggttaaggattgcctgttcgttgattataagcgtcgttctggtcacttcgatgtgaccacagttgcttccatcaaagaaattaccgagaagaacagacactgtctgctggacatcgccccccatgccatagagcgtttgcaccacatgcatatttaccctattgtcatctttatccactacaagtctgcaaagcacattaaggagcaacgtgatccgatatatctacgggataaagttactcaaagacactccaaggaacagttcgaggctgcgcagaagctggagcaggaatattcccggtatttcaccggcgtcatacagggaggggcactctctagtatctgtacccaaattttggcaatggtgaatcaagagcagaacaaagtgctgtggatccccgcctgcccactgtag

SEQ ID NO: 185593 - DNA, 3237 bp, Artificial Sequence
  Description of Artificial Sequence: Synthetic coding sequence
atggccccccggaagcggggcggccggggcatcagcttcatcttctgctgcttccggaacaacgaccatccggagattacttatagactgaggaatgactcgaatttcgcgcttcagacaatggaaccagccctcccaatgcctccagttgaagagttggatgtaatgttttctgagctggtggacgagctggacctgaccgacaaacaccgtgaggccatgttcgcgctcccagccgaaaagaaatggcaaatttattgcagcaagaaaaaagatcaggaagaaaacaagggagctacttcctggccagagttttacattgaccagcttaatagtatggctgcgagaaagtccttgctcgccctagaaaaagaggaggaagaggagaggtcaaagaccattgagagcttgaagacagcactcaggacaaagcctatgcggtttgtgacgcgcttcatcgaccttgacgggttatcctgtattctgaactttctaaagacaatggactacgagacgtcagaaagtcgtatccatacgtccctgattgggtgtattaaagctctcatgaacaatagccaggggcgggcacacgttctggcccattcggaatcaataaacgtgatcgcacagagtctgtcaacggaaaacattaaaactaaggtggcagttttagaaatactaggagccgtttgcttggttcctggaggtcataagaaagtgctgcaagcaatgctccactaccagaaatacgcaagtgagagaactcgctttcagacacttataaacgatctggacaaaagcaccggacgctaccgtgatgaggtgtccctgaagaccgccatcatgagcttcattaacgccgtgctgtctcagggggccggcgtggagagccttgactttcgactgcaccttcgctatgagtttctgatgctgggcatccagccggtcattgataagctgcgcgagcacgaaaattccactctggatcgacacctcgacttcttcgagatgctgaggaacgaggatgaactggaattcgctaaacgcttcgaactggttcacattgacactaagtcagcgacacagatgttcgagctcactagaaagaggctgacccactcagaagcgtatcctcactttatgtctattctgcaccactgtctacaaatgccatacaagcgttctggtaacactgtgcagtattggttgctgctagaccgtatcatacagcagatagtaatccagaatgacaaaggtcaagatcccgatagcaccccccttgaaaactttaacatcaagaatgtggtgcgcatgctcgtgaatgaaaacgaggtaaaacagtggaaagagcaggccgagaagatgcgcaaagagcataacgagctgcagcagaagctggagaaaaaggaacgagaatgtgatgccaagacccaggagaaagaggagatgatgcagactctgaacaagatgaaagagaagctggagaaggaaacaaccgagcataagcaagttaagcagcaggtggcggatctgaccgctcagttgcatgaattatctaggcgggccgtctgtgcctctattcctggtggccctagtcccggggctcccggcgggccgttccccagcagcgtgcccgggtccttactgcccccccctcccccacctcctctccccggcggaatgcttccaccgcctcctccgccactgccacccggcgggccacctcccccccctggccctccgccattgggggcaataatgcctcctccgggagcgcccatgggtttggcattaaagaaaaagagcatcccacagccaaccaacgcccttaagtcattcaactggtccaagctgcccgagaataagcttgaagggactgtgtggactgaaattgacgacactaaagtcttcaagattcttgatctggaagatttggaaagaaccttttctgcgtatcagcggcaacaggacttcttcgtgaattcaaattccaagcagaaggaagctgatgccatcgatgacacactctcctctaaactcaaggtgaaggagctctccgtcattgacgggcgtcgggcgcagaactgtaatatcttattatcccggctgaagctgtcaaacgatgaaatcaagcgagccattctcaccatggacgaacaggaggatctgcccaaagacatgctcgagcagctactcaagttcgtgccggaaaaatcagatatcgacttgctggaggagcacaaacacgaactcgatagaatggctaaggcagacaggtttctgttcgagatgtcacgaatcaatcattaccaacagcggctgcaaagcctgtactttaagaaaaagttcgctgagcgggtggccgaggtaaagcctaaggtggaagcaattagaagcggaagtgaagaggttttccggagcggcgcattgaaacaactcctcgaggtggtcttggcttttggaaattacatgaataaagggcagaggggcaacgcctacggattcaaaattagcagtctgaataagatcgcagatacaaagtcttccattgacaaaaacattacgctcttacactacctgattaccattgtggagaacaagtaccccagtgtgctgaatctcaacgaagagttgcgggacattcctcaggccgctaaagtaaatatgacagagctcgataaggagattagtacactgaggagcggattgaaagcagttgagaccgaactggagtaccagaagtcccagcctccacaaccaggagacaagttcgtgtctgttgtgtctcagttcatcactgtcgcctctttctccttctccgacgtggaggatttgttggccgaggcgaaagatctcttcaccaaggctgtgaaacacttcggggaggaggccggcaagatccagccggatgaatttttcggcatcttcgaccagtttctgcaggcagtgtcagaggctaagcaagagaatgaaaatatgaggaagaagaaagaagaggaagaacggagggctcgcatggaggcccaattaaaagagcagagagaacgagaacgtaaaatgaggaaggccaaagagaatagcgaagaaagcggtgagttcgatgaccttgtgtctgctttgaggtctggggaagtctttgacaaagacctgtccaagcttaaacggaatcgcaagcgaatcactaatcaaatgacagattcctcccgcgaaagacccatcaccaagctcaacttctag

SEQ ID NO: 185594 - DNA, 2649 bp, Artificial Sequence
  Description of Artificial Sequence: Synthetic coding sequence
atggccccccggaagcggggcggccggggcatcagcttcatcttctgttgtttccgtaacaatgatcaccctgaaatcacctatcgacttaggaatgactccaatttcgcgctgcagaccatggagcccgccttaccaatgccacccgttgaagagctggacgtaatgttttctgagcttgtcgacgaattggaccttaccgataagcaccgcgaggccatgttcgccttacccgcagaaaagaagtggcagatctattgctctaaaaaaaaggaccaggaggagaacaagggagccacatcctggcccgaattttatatcgatcagctgaacagcatggccgcccgcaaaagcttgctggccctggagaaagaagaggaggaggagcgcagcaagacaatagaatctctcaaaacagccctcagaaccaagcccatgcgctttgttacacggtttatagacctagacggccttagttgtatacttaatttcctaaagaccatggattacgagacttctgaatcacggatccatacgtcactcatcggatgtatcaaggcactgatgaataattcacaagggagggcacatgtcctggcccacagtgaatccatcaacgtgatagcccagtccctcagtactgaaaacatcaaaactaaagtggcagttctggaaatcctgggtgccgtgtgtttggttcccggaggtcataaaaaagtgttgcaagctatgcttcattatcaaaaatacgcaagcgagcggacacgcttccaaactctgattaacgacttggataagagtaccgggagatatcgggatgaggtttctttgaagacggccatcatgagctttattaacgcggtattgtcacagggggccggagtggagtctctggacttcaggttgcatctgcgttacgaatttctcatgctaggaattcagcccgttatcgataagcttcgtgaacatgagaactcaacacttgatagacacttggacttttttgagatgctgcgtaacgaggacgaacttgaattcgccaagcggtttgaactagtgcacattgacacaaagtccgcgacacaaatgttcgagctgacacgcaagcgcctgacccactccgaagcctacccccacttcatgagcatcctgcatcactgtctccagatgccttacaagagatcaggcaacacagttcaatattggttgctcctcgaccgtattatccagcagatcgtgatccaaaatgacaaaggtcaggaccctgactccactcctcttgaaaattttaatattaagaacgtagtaagaatgctcgtgaacgagaacgaggtcaagcaatggaaggaacaggccgagaagatgcggaaggaacataacgaactgcagcagaaactagaaaagaaagaacgagaatgcgatgccaaaacgcaagagaaggaagagatgatgcaaacactaaacaaaatgaaggaaaaactcgagaaagaaacaacagaacacaagcaggtcaaacagcaagtcgcggacctgacagcccagctccacgagctatcacgcagggctgtttgcgcgtctattcccggtggtcccagccccggtgctcctggcggcccgtttccttccagcgtccccggtagcttattgcctccaccccccccccctccactgcctgggggaatgctgcctccccctccacccccattgcccccaggcggacctcctccaccgccggggccacccccactgggcgcaatcatgccgccccccggagccccaatggggcttgccctaaaaaagaaaagcattccccagcccactaatgctcttaagtcgtttaattggtcaaaactaccggagaataaactggaaggcacggtgtggaccgaaatagatgatactaaagtattcaagatcctcgatttagaggacctggaacgcactttcagcgcctaccagcgtcagcaagacttctttgttaatagcaatagtaagcagaaggaggcggatgccattgacgatactctctcttcaaaattgaaagtgaaagagctgagcgtgatcgacggccggcgagcccagaactgcaatatcctgttgagccgacttaagctgagcaatgatgagatcaagcgggctatcctcaccatggacgagcaggaggacttacccaaggatatgctcgagcagctgttgaaattcgtgccagaaaagtctgacatcgacctcctcgaggagcacaaacacgagctcgatcgaatggcaaaggcagataggttcctatttgaaatgagtaggatcaaccactatcaacagagactgcaatccctgtacttcaagaagaagtttgctgagagggtggcattcggtaattatatgaataaaggccagcgcgggaacgcatatggtttcaagatcagcagcctgaataaaattgctgacaccaaatcatcaatcgacaagaatattacactcctgcactatctgatcaccatcgtggaaaataagtacccgagcgtactgaacttgaatgaggagctacgggacatcccccaggcggctaaagttaagtcatggaatatcagatcactgtcgccacactcacccgagatctctctttgcctgctcagcgcaagctcctctcagtag

SEQ ID NO: 185595 - DNA, 3207 bp, Artificial Sequence
  Description of Artificial Sequence: Synthetic coding sequence
atggccccccggaagcggggcggccggggcatcagcttcatcttctgctgcttccgcaacaatgatcacccggaaattacctacaggctgcggaacgatagcaactttgcccttcaaactatggaaccagctctgcctatgcccccagtggaggagctggacgtgatgttttcagagttagtggacgagctggatctgacagataagcaccgcgaggccatgtttgcactgcctgcagaaaaaaaatggcaaatctactgttccaagaagaaagaccaggaggagaataagggcgctacaagttggccggagttctatatcgatcagttgaattcaatggccgcacgtaaaagtctgctggccctagaaaaggaagaggaggaggaacggtcgaaaaccatagaaagtctgaagacggctcttaggaccaaacctatgaggtttgtcacacgcttcattgaccttgatggcttgagttgcattctgaattttctgaagacaatggattacgagacttctgaaagcagaattcacaccagccttattggttgcattaaggctctcatgaataatagtcagggcagggcccacgtactcgctcattctgagtcaattaacgtgattgcccaaagcctgtctacggaaaacatcaaaaccaaagtcgccgtcttggagattctgggggccgtgtgtttggtacccggcggacataaaaaggtgctccaggctatgctgcactaccagaagtacgcctccgaaagaacaaggttccagacgctgatcaatgaccttgacaagtccactggccgctaccgcgatgaagtttccctgaagacagccatcatgagctttataaacgcagttctttcacagggggctggtgtcgagtccttagactttcgcttgcacctaaggtacgagtttttgatgttggggatccagcctgtgattgataagcttagagaacacgagaacagcacattggaccgacatttagacttctttgagatgctcaggaacgaggatgaattggaatttgccaagcggttcgaattggtgcatatagacaccaaatcggctacccaaatgtttgagctgacgaggaagcgcttgacccatagtgaggcgtaccctcactttatgtcaatactgcatcactgcttacagatgccatataaacgctctgggaacactgtgcagtactggctccttttggataggatcatccagcaaattgtcattcagaatgataaggggcaggatcctgactctactcccctggaaaatttcaatataaagaacgtggtcaggatgctcgtcaacgagaacgaggtgaaacaatggaaagagcaagcagagaagatgcgtaaagagcataacgaactgcagcagaaactggagaagaaggagcgcgagtgcgatgcaaagactcaggagaaggaagaaatgatgcagaccctgaataagatgaaagagaagctggagaaagaaactaccgagcataagcaggtcaaacagcaggttgcagacttaactgctcagctccatgagctgagtaggcgagctgtgtgcgcttctataccaggtggacctagcccaggagctcctggggggccctttccttcttccgtacccggtagcttactgcctccaccaccccctccccccctgcctggaggcatgcttccccctcctccccctcccctgcctcctggcggtcccccaccaccgcccggccctccccctctgggcgccatcatgccccccccaggcgccccaatggggctggcattgaagaagaagagcatccctcagccaacgaatgccctgaagagcttcaattggagcaagctgcccgaaaataaactggaaggaacagtgtggactgagatcgatgacacaaaagtttttaaaatcctcgacctcgaggacttggagagaaccttctcggcttaccaaaggcagcaaaaggaagcagatgccatcgacgataccttgagcagtaaactcaaggtgaaggaattgagtgttatcgatgggcgacgagcacagaactgtaatatattactgagcaggctgaaactgtctaacgacgagattaaacgggctatcctcaccatggacgagcaagaggatctgcctaaggacatgctagaacaacttcttaaattcgtcccagaaaaaagcgacattgatttattagaggaacacaagcatgaactggaccgcatggccaaagccgatagatttctgttcgagatgagtaggatcaatcactaccagcagcgcctccagtccctatacttcaaaaaaaaatttgccgagagggtagcggaggtgaagcccaaggtggaggcaatacgatcaggctccgaggaggtattccggagcggcgcgctgaagcagctccttgaggttgtgttagctttcggaaactatatgaacaaaggacagagaggcaacgcatacggtttcaagatctcgtctctcaataagattgctgatacgaagagttccatagacaaaaacattaccctgctccactacctgattacgattgttgagaacaagtacccatccgtgcttaatctcaacgaggaactgcgcgatataccccaggcagctaaagtgaacatgacagagctagataaggaaatttctaccctgagatcgggacttaaggctgtggaaaccgagctggaataccaaaagtctcagccaccccagcccggggacaaatttgtatctgtggtgtcccaattcattacagtggccagcttctcgtttagtgacgtggaagacctgctcgccgaagctaaggatctgttcactaaggctgttaagcattttggagaggaggcagggaagattcagcctgacgagtttttcggaatctttgatcagtttctccaggctgtgtctgaggccaaacaagaaaatgagaacatgaggaaaaagaaggaggaagaggaacgcagagcacgcatggaggcacagctgaaagagcagagagaaagagagagaaagatgaggaaggcaaaagagaattcggaagagtcgggggagttcgacgatctcgtttctgccctgagaagcggagaagtctttgacaaagatctgtccaaactgaagaggaataggaaaagaataacaaaccagatgacggattcgtcacgcgagcgccccatcaccaagctcaatttctag

SEQ ID NO: 185596 - DNA, 3237 bp, Artificial Sequence
  Description of Artificial Sequence: Synthetic coding sequence
atggccccccggaagcggggcggccggggcatcagcttcatcttctgctgtttccgcaacaatgatcaccccgaaatcacctaccggctgcggaacgattctaactttgcattacagaccatggagcctgcccttcccatgcctcccgtagaagagcttgacgtgatgttttctgagttggtggatgagttagacttaaccgacaagcacagggaggcgatgttcgcattgccagccgagaaaaaatggcaaatctactgttcaaaaaaaaaggaccaagaagaaaataaaggggcaacttcatggcctgagttttatatcgatcaattgaattcaatggccgctagaaagtctctgctggctctcgaaaaagaggaagaggaagagcgttctaaaacaatcgaatcactcaagacggcactgaggactaagccaatgagatttgtgaccaggttcattgaccttgacggcctgagctgcatcctgaatttcctgaaaacaatggattatgagacatccgagtcacgaattcacaccagtctcatcggttgtattaaggcattgatgaacaactcccagggccgggcccacgttctggcacacagcgagagcataaatgtgatcgcccaaagccttagtacggaaaacatcaagactaaagtggccgtgctcgagatcctgggcgccgtctgcctggtgccaggcggccacaaaaaagtgctacaggccatgctccactatcagaaatatgcatctgagcgaaccaggttccagaccctcattaacgacctcgataaaagtacaggaagatacagagatgaagtctctttgaaaacagcaataatgtccttcatcaacgccgttttgtcacaaggagcaggggtggagtctctcgattttaggcttcacttacgctatgaatttttgatgctcggtatacaacccgtcattgacaagctacgtgagcacgaaaacagtacccttgacaggcacttagatttctttgagatgcttaggaatgaggatgaactggagtttgccaagcggttcgagctggttcacattgacaccaagtctgctactcagatgttcgagttgacacgtaagcgactcacccattcggaggcatatcctcactttatgtctatattgcatcactgcttgcagatgccttataagagaagcgggaatactgtccaatactggctgctgctggatcgcatcatccagcagatcgtcatccagaatgataagggccaggatcccgacagtacgcccctggaaaacttcaatattaagaatgtggtacggatgcttgtcaatgaaaatgaggtaaagcaatggaaagagcaagcagagaagatgaggaaggaacacaacgagctgcagcaaaagcttgagaagaaggagcgggagtgtgacgccaagacacaggagaaagaagaaatgatgcagacactcaacaaaatgaaagagaaactcgaaaaggagaccactgagcacaagcaagtgaagcaacaggttgcagacctgacagcccagttgcacgagctctcgaggcgcgcagtgtgcgcatccattcctgggggcccttctccaggcgcacctggaggacctttcccctcttcagtgcccggctctttacttcccccaccacctccgccccccttgcctggtggtatgctgcccccccctcccccccctctaccccccggaggcccacccccacctccgggacctccccccctgggggcaatcatgccccctcccggcgcccccatgggcctggcactgaagaagaagtcaatccctcagccaacgaatgcactgaagagcttcaattggtcaaagctacccgagaacaagctggaaggtaccgtgtggactgaaatcgatgacactaaggtcttcaaaattcttgacctggaggacctggagcgcaccttctcggcgtatcagcggcagcaggacttcttcgtaaattcgaatagcaagcagaaagaggcggacgcgattgatgacaccctctccagcaagctgaaggttaaggaactctcagttatcgacgggagacgtgcccagaactgcaacatcctcctgagccgactcaagctcagtaatgatgagataaagcgcgctatcttgactatggacgaacaggaagatttgccaaaagacatgctggagcaactactgaagttcgtgcctgagaaatcagatattgacttgctcgaggaacacaagcacgagctggacagaatggctaaggccgatagatttttgttcgaaatgtcacgaataaatcattaccaacagcgcctgcagtcactgtattttaagaagaaattcgccgaacgggtagcagaagtgaaacccaaggtggaagctatccggagcggatcagaggaggtctttagaagcggtgcgcttaagcagttgctcgaagtcgtccttgccttcggaaattacatgaacaaggggcagcgggggaacgcgtacggattcaagatctcaagccttaataaaattgcagatactaagtccagtatcgataaaaatattacactgctccattatctgatcaccatagtagagaataaatatcccagtgtgcttaacctgaacgaagagttgcgcgatataccacaggctgctaaggtcaacatgactgagctggacaaggagatatctaccctgcgatcgggccttaaagctgtggagacggaactcgagtaccagaagtcacagcctccccagcccggggacaaattcgtgtccgtcgtctctcagttcattaccgtcgccagtttcagtttttccgatgtcgaagacctgctggctgaggctaaggacttgtttaccaaagcagttaaacatttcggcgaggaggccggcaagatccagccagatgaatttttcggaattttcgaccagttcctgcaggccgtctctgaggccaaacaggagaatgagaatatgcgcaagaaaaaagaagaagaggagagaagggcgcgaatggaggctcagctgaaagagcagcgagaacgcgaacgcaaaatgcgcaaagcaaaagaaaacagtgaggagtcaggcgagtttgacgaccttgtgtcagcacttcggagtggtgaggtgttcgacaaggacctgagtaaactcaagaggaaccggaagcggatcaccaaccaaatgacagattcatcaagagagcggcccatcacaaaattgaacttctag

SEQ ID NO: 185597 - DNA, 3207 bp, Artificial Sequence
  Description of Artificial Sequence: Synthetic coding sequence
atggccccccggaagcggagccaccacggcctgggcttcctgtgctgtttcgggggatccgatatacccgagataaatctcagggacaaccatcccctgcaattcatggaattttcaagcccaataccaaacgcagaggaacttaatattagatttgctgaactggtggatgagctcgacctgaccgataaaaaccgcgaggccatgtttgccctcccgccggaaaagaaatggcagatctactgcagtaaaaaaaaggagcaagaagaccccaataagttggccacctcctggccagactactatatcgatcggattaacagcatggctgcaatgcagtctctctatgccttcgatgaggaggagaccgagatgagaaatcaggtggtggaagatctgaagaccgccctcagaacccaaccgatgaggttcgttacacggtttatcgagctcgagggactgacatgcctgctgaacttcctgaggtctatggaccatgcaacttgtgagagcaggatccacaccagcctgatcggctgcatcaaggcactgatgaataattcacaggggagggctcacgtgctcgcgcagcccgaagctatctccacaatcgcccaatctctaagaaccgaaaactccaaaaccaaggtggctgtgctcgaaattttgggcgccgtatgcctggtgcccggtggtcacaagaaggtgctacaggccatgctgcactaccaggtgtacgcagcagaaaggacgaggttccagacgctcctgaacgaattggacaggtctttaggtaggtaccgagatgaagtgaacctcaagacagcgataatgagcttcattaatgcagtactcaacgcaggcgccggggaggacaatttggaatttcgactgcacctacgttacgaattcctcatgctgggaatccaacccgtaatagataagttacgacagcacgagaatgcaattttagacaagcacctggattttttcgagatggtgcggaatgaagacgatctggagctggcgagacggttcgacatggtgcacattgacacaaagtctgcctctcaaatgttcgaactgattcacaaaaagctcaaatataccgaggcctacccgtgcctgctgtctgtgcttcatcactgcctgcagatgccctacaagcgcaacggcggctacttccagcaatggcagttgctcgatcgtattctgcagcaaatagtgctgcaggatgagagaggcgttgatccagatctggccccactcgaaaacttcaatgtgaaaaacatcgtgaacatgctcatcaatgagaatgaggtcaaacagtggcgggatcaggccgagaagttccgcaaggaacacatggagctggtttctcggctggagaggaaggagcgggaatgtgaaacgaagacactggagaaggaggaaatgatgcgtaccttaaataagatgaaggacaaacttgctcgcgaaagccaggaattacggcaggcacgcggacaagtggcagagctcgttgcccagttgagtgagctgagcacgggcccagttagcagtccgccccccccaggggggcccttaacactcagttcatctatgactaccaacgacctgcctccgccccccccaccattgcctttcgcctgttgccctccgcctcctccaccaccgctaccccctgggggaccgcccactcctcctggcgctccaccttgcttaggaatggggctccccttaccccaggatccctatcccagctctgatgtgccactgagaaagaagagggtgcctcagccatctcaccctttaaaatcttttaattgggtgaaactgaacgaagagcgcgtgcctgggaccgtgtggaacgagatcgacgacatgcaagtgttccgaatcctagatctggaggactttgaaaagatgttctccgcttaccaacgccaccagaaggagctaggaagtaccgaagatatttatttggcatctaggaaagtcaaagagctgagcgttatcgatggccgccgcgctcagaactgcattatactcctttcaaaactaaaactgtccaacgaggaaatccgacaggcaattttgaaaatggatgaacaagaggatctggcaaaagacatgctcgagcagctgctgaaatttatcccagaaaaaagcgacattgacctactggaagaacacaagcacgaaattgagagaatggcaagagccgacagattcctgtatgagatgtctaggattgatcactaccaacagcggttgcaggccctattcttcaaaaaaaagttccaggagcggctggccgaagcgaagccaaaagtagaggctatcctgctagcatcacgtgaactggtgcgttcgaaaaggcttcgccagatgctagaagtgattttggctatcggcaactttatgaacaaaggccagcggggtggggcttacggcttccgggttgctagcttaaacaagatcgcagacacaaagtcaagtatagaccgtaatatatcactgctgcactatctaatcatgattcttgaaaaacacttccctgacattcttaatatgccatccgagcttcaacacttgcccgaagctgctaaagttaacctggccgaattggaaaaagaggtgggcaatctgagaagagggttgagagctgttgaggtggaactggaatatcagagaaggcaggttagagagccatccgataaatttgtgcccgtgatgagcgactttattaccgtgtcaagtttctctttctccgagttggaggaccagctgaacgaggctagggataaatttgccaaggcccttatgcattttggcgagcacgattctaaaatgcagccagacgaattcttcggcattttcgacacattcctgcaggccttttctgaagctcgacaagatctggaagcaatgaggcggcgcaaggaagaggaagaacgacgcgccaggatggaggccatgctgaaagaacagagagaaagggaacgatggcaacgtcaacgcaaggtgctcgcagccggctcctctctggaggagggtggagaattcgacgacctggtttctgccctgcggagcggagaagtgttcgacaaagacctttgtaaactgaagaggtctcgcaaacgcagcggctctcaggcactcgaggtgacgcgagagagggccatcaaccggcttaactactag

SEQ ID NO: 185598 - DNA, 3207 bp, Artificial Sequence
  Description of Artificial Sequence: Synthetic coding sequence
atggccccccggaagcggagccaccacggcctgggcttcctgtgctgttttggtggttcagatatccctgagatcaacctgcgtgacaaccatcctctccaatttatggaattctcctccccgatccccaatgcagaagagctcaatatacgctttgctgagctggtggatgaactggaccttaccgataaaaatcgcgaagccatgtttgctctccctcctgagaaaaagtggcagatctactgctctaaaaagaaggagcaagaggaccctaataagcttgctacatcttggcccgattactacatcgaccggatcaactctatggccgccatgcagtcgctctatgcattcgacgaggaagagacagagatgaggaatcaggtcgtcgaagatctgaaaaccgccctaaggacccagccaatgcgcttcgttacacggtttattgagttagaaggcttgacatgtttgctgaatttcctgaggtctatggaccatgccacctgcgagagcagaatccatactagtttgatcggatgcatcaaggcccttatgaacaattcccagggcagggcgcacgtcctggcccagcccgaggctattagtacaatcgcacagagtctgcgcacagagaactccaaaacaaaagtagctgtgctggaaatactcggagccgtttgcctggtcccaggcggtcacaagaaggtgctgcaggccatgctccactatcaggtttacgcagccgagagaacccgtttccagacactcctcaatgaactggaccggagcctcgggaggtacagggatgaagtgaatctgaagacagcaatcatgtccttcattaatgcagttctgaatgcaggggccggcgaagacaatcttgagtttcgcttacatttacggtatgaattccttatgctggggatccaacccgtgattgacaagctgcgccagcacgagaacgccatactcgataagcacctcgatttttttgagatggttcgcaacgaggacgacttggaattagctcgacggttcgatatggtacacattgacaccaagtctgcctcacagatgttcgaattaatacataagaaactaaagtacacagaagcctatccctgcctgctgtctgttctgcaccattgtttgcagatgccctataagcgcaacgggggctactttcagcagtggcagcttctggataggattctacagcagattgtgctccaggacgagcggggcgtcgatcctgatctagccccacttgagaattttaacgtcaagaacatcgtgaatatgctgatcaacgagaatgaagtgaagcaatggcgagatcaggccgagaaatttagaaaggagcatatggaacttgtctctaggctcgagcggaaagagagggaatgtgagacaaaaactctggaaaaggaggagatgatgcgaacactcaataaaatgaaggacaaactggccagagaatcccaggagctgcggcaagctcggggacaggtagccgagcttgtagctcagctcagcgaactgtctacaggtcctgtgtcttcaccccccccaccaggcggaccacttacccttagttcttcaatgacaacaaacgacttacccccccccccccccccactgccgttcgcctgctgtccaccaccaccgccccctccgctgccacccggaggccctcctactcctcctggggcaccaccgtgcctcgggatggggctgccacttcctcaggacccctacccaagttctgacgtacctctaaggaagaaacgggtcccccagccaagccaccctcttaagtcgtttaactgggtgaaacttaacgaggaaagggtgccaggtaccgtgtggaacgagatagacgacatgcaggtcttccggattctggacctcgaggacttcgaaaagatgttctcagcctatcagcgccaccagaaagaactggggtcaaccgaggatatatatttggcttcacgcaaggtgaaggagctctccgtaatcgacggacggcgagcacagaattgtattatcctcttgtctaaactgaagctatcaaatgaagaaatccggcaggcaatattaaagatggatgaacaggaggatttggcgaaagacatgttagagcagttacttaagtttattccagaaaagagtgatatagacttactcgaggagcataagcacgaaattgaacgcatggccagagccgatagattcctttatgagatgtcaaggatagaccactatcagcagcgactgcaggcgctgttcttcaagaaaaagttccaagaacgcttggctgaagcaaaacccaaagtcgaagcaatcttgctggccagccgcgaactggtccggtccaaacgcctgagacagatgctggaagttattctggccatagggaacttcatgaataaaggtcaacgcggtggcgcttatgggttccgcgttgcaagcctgaacaagatcgctgacactaagtcatccatcgatcgaaacatttccctgttacactatcttatcatgatcctagagaagcactttccggatatcctgaatatgccttcagaattacagcatctacccgaagctgcaaaggtaaacctggcagagctcgagaaagaagtgggaaacctccgccgaggtttgagagccgtggaggtcgagcttgaatatcagcggcgtcaagtgcgcgagcctagcgataaatttgtgcccgtgatgtctgacttcatcactgtaagcagttttagtttttctgaattggaggaccagttaaatgaggccagagataagtttgccaaggcactgatgcactttggggagcacgacagtaaaatgcagcctgacgaatttttcggcattttcgacaccttccttcaagcatttagtgaagctagacaggatcttgaagccatgagaagacgcaaagaggaggaggaacgcagagctcgaatggaggcgatgctgaaagagcagcgtgagagggagcggtggcagcggcaacggaaggtcttagccgcggggtcttcccttgaggaagggggtgagttcgacgatctggtgtcagctctgcgctccggcgaagtgtttgataaggatctgtgtaagctcaagaggtctcgtaaacgctcaggctctcaggccctggaggtaacccgtgaacgcgcaatcaataggctgaactattag

SEQ ID NO: 185599 - DNA, 399 bp, Artificial Sequence
  Description of Artificial Sequence: Synthetic coding sequence
atggccccccggaagcggagccaccacggcctgggcttcctgtgctgctttggaggttcagacattcccgagatcaatctgagagataaccatccactgcagtttatggagttcagttccccaatccccaacgcagaggaactcaacattcgattcgccgagttagtggatgaattggatctcaccgataagaatagagaagctatgttcgcgctccctccagaaaagaaatggcagatttactgctccaaaaaaaaagtgccctcactgacccccttggctactagccagggatcatggcacggggtggccctggccgctctggcatgctcgtgtatacacttgatgttcatcacatgtcaaccatgtagcagatgttggcgtaataactccgaatag

SEQ ID NO: 185600 - DNA, 3204 bp, Artificial Sequence
  Description of Artificial Sequence: Synthetic coding sequence
atggccccccggaagcggagccaccacggcctgggcttcctgtgctgtttcggggggtcagacatacccgagatcaacctccgggacaatcacccactacagtttatggaattctcctcgcccatacccaatgctgaggagttgaacattagattcgcagagctggtcgatgagctcgatctgactgacaaaaacagggaggcgatgttcgcactgccacctgaaaagaaatggcagatctattgcagtaagaagaaggaacaggaggaccctaacaaacttgccaccagttggccagattattatatcgaccgtatcaactccatggcagcaatgcagtcactgtatgcctttgacgaggaggagacggagatgagaaaccaggtggttgaagacttgaaaactgccctccggacacagcctatgaggttcgtcacacggtttattgaactggagggcctgacatgtcttttgaatttcctgcgatcaatggatcatgccacgtgtgagtctcggatccatacaagcttaatcggctgtatcaaagcgctaatgaacaacagccagggccgagcccacgtccttgcacagccagaggccattagtaccattgcccagtccctgcgtacagagaacagcaagacgaaggtggctgtcctggagatactcggcgctgtgtgcctcgtccctgggggtcataagaaagtactgcaggctatgctgcactatcaggtctacgccgcggaacgaacgcgttttcagactctgctgaacgaacttgatagatcattgggtagatatagggacgaggttaatctgaagacagcaatcatgtcttttataaacgccgtgctcaatgccggcgcaggcgaagataatttagagtttcggctgcatctgcgatacgagtttctgatgctcgggatccaacccgttattgacaagctccgacagcatgagaacgccatattggacaaacatctcgacttcttcgagatggtgcggaatgaagacgacctagaacttgcgcgaagatttgacatggtccacatagacactaagtccgcctcacagatgttcgagctgatccacaaaaagctcaaatataccgaagcatacccctgcttgttgagtgttctccaccactgtctccaaatgccatataaaagaaatggcggatattttcagcagtggcagctgctggacagaatcctccagcagatcgtgctgcaggatgagaggggtgtggaccctgatctggctccactagagaatttcaatgtcaagaacattgtcaatatgctcatcaacgagaatgaagtcaagcagtggagagatcaggctgagaaatttcggaaggagcatatggaactggttagtagattggaaaggaaggaacgggaatgcgaaactaaaaccctggaaaaggaggaaatgatgcgcactctgaataagatgaaagacaagctggcccgcgagagccaggagctgcgccaagctaggggccaagttgctgagctagtggcacagctgtcagagctcagcactggacccgtaagctccccacctcctccagggggccccctgacattgagctccagtatgaccaccaacgacctaccacccccaccgcctcccctgccttttgcatgttgtccacctcctccccccccgcccttgcccccgggaggtccacccaccccacccggcgcgccgccatgtctcggtatgggtttgccacttccacaagacccctatccctcatctgacgttccccttaggaaaaagcgcgtgccacagccgtctcacccactaaagtcctttaactgggtcaaattgaatgaagagagagtccctggcacggtctggaacgaaatcgatgatatgcaagtcttcaggatactagacctcgaggattttgagaagatgttctctgcttaccaaaggcatcagaaggagctagggtccaccgaagatatctatttggcttcccgcaaggttaaggagctttctgtgattgatggccggcgtgcgcaaaactgcattatcctgttgtccaagctcaagttaagtaacgaggaaatcaggcaggccatcctcaaaatggatgaacaggaggatttggccaaagacatgcttgaacagctcctcaagtttatcccagaaaagtccgacattgacctgctggaagaacacaaacatgaaattgagagaatggcgagagccgatcgctttctatacgaaatgtctcggatagaccactaccaacagcgtttacaggccttgttttttaaaaaaaaattccaggagaggctcgctgaggccaaacctaaggtggaagcaattctcctagcatctcgggaactagttcgctcaaagcggttaaggcagatgctggaagtgatcctggctattgggaatttcatgaataaggggcaacggggcggagcctatgggtttcgagtcgcgtcactgaataagatagctgacactaaaagcagcattgaccgcaatatatccctccttcattacctgattatgattctcgagaagcacttccccgatattctcaatatgcctagtgagctgcagcatctgccagaggccgccaaggtcaatttggcggagctggagaaggaggtggggaatctgaggagagggcttcgcgccgtggaggtgctggagtatcagcggcgtcaagttagagaacctagcgacaagttcgtgcccgtgatgagtgacttcattaccgtgtcctctttttcattctctgagttagaggaccagctgaacgaagcccgtgacaagtttgcgaaagccttgatgcacttcggggagcatgactctaagatgcagccggatgaattttttggtatctttgataccttcttgcaggccttttccgaggccaggcaggacctcgaagccatgagacgccgcaaagaggaagaggagagacgggccaggatggaggctatgctgaaagaacagcgagagcgcgagcgatggcagaggcagcgcaaagttctcgctgccggctcttctttggaagaaggcggtgaattcgatgatcttgtgtcggctttgagatcaggcgaagttttcgataaggacctgtgcaaactgaagcggtctcgaaagcggtccggatctcaggcactagaagtcacacgagagcgggcaataaaccggttgaactactag

SEQ ID NO: 185601 - DNA, 1062 bp, Artificial Sequence
  Description of Artificial Sequence: Synthetic coding sequence
atgggcgccctgctgtgcgaccaccggagctgccggcccatcagcctgaccgtggcaaagtgttgggatcccactccaagatcatacttcaccgtcccccgggccgacccagtgcgacccatagaccccgctgcctggctgagtcacacagctgccctgaccggcgcattacccagatatgaattggaagaggcccctcttacagtcaagtctgacatgtcggcagtggttcgagtaatgcaattgcccgattccggtttggagattagagacaggatgtggctgaagattaccatcgcgaatgcagtaataggagcagatgtcgtggattggctgtacacacacgtggaaggattcaaggagaggcgcgaggctagaaagtacgcgagctcattgctgaagcacggcttcttgcggcacaccgtgaacaaaatcactttttctgagcaatgctattatgtatttggcgacctctgctctaatttagccacactgaatctgaactcaggctcaagtggtacaagcgaccaggatactcttgcccctcttccgcaccctgctgctccatggcccctcggccagggatatccatatcagtatcccgggccccccccttgcttccctcctgcttatcaagaccctggatttagctatgggtctgggtccacgggctcacagcagtctgagggctccaaatcaagcggatcaacacgctcctcacgccgcgcccctggacgagagaaggaaagacgggccgccggggctgggggatctggatctgaatctgatcatacggccccctctggtgtagggtcgagctggagagagagacccgcaggccagctcagccgggggtcatcacctagaagccaagctagtgccacagctcctgggctgccaccaccccaccctaccaccaaagcatacacagtggtcggtgggccacctggtggccctccggtccgcgagttagccgcggtgccacctgaactgacagggagtcggcaatcattccagaaagccatgggtaacccctgcgagttttttgtagacattatgtag

SEQ ID NO: 185602 - DNA, 1335 bp, Artificial Sequence
  Description of Artificial Sequence: Synthetic coding sequence
atggccgagaccaagatcatctaccacatggacgaggaggagaccccatacctggtcaagttgccagtcgcccccgaacgggttaccctagcggactttaaaaatgtcctttcgaatcgaccagtgcatgcctacaaattcttttttaagagcatggaccaggacttcggggtggtgaaggaagagatcttcgacgacaatgccaagttgccgtgtttcaatgggagagtcgtgagttggctggtactcgccgagggagctcactccgacgccgggagccagggaacagacagccacaccgatctacccccccctctggagcgcacagggggcataggagacagtcgacctccatctttccaccccaacgtcgccagctcccgtgacgggatggataacgagaccgggactgagtccatggtttcccacaggcgcgaaagggcccgacggagaaatcgagaagaggccgccaggacaaacggacaccctaggggcgatcggcggcgtgacgtcggcttaccccccgattcagcctccaccgccctctcttctgagctcgagagttcgagcttcgtggattcagacgaagatggaagtaccagtagactgtcctctagcaccgaacaaagcacctcatccagactcatccggaagtatgcttcaagcctcctgaagcatgggtttttaagacacaccgttaataaaatcaccttttccgaacagtgctactatgtattcggggatctgtgtagcaaccttgctaccctgaacctaaattcagggtcctcaggaacgtcagaccaggataccctggctccgctgccgcaccccgctgctccatggccactaggacagggatatccttatcagtaccctggccctccaccatgcttccctccggcctaccaagaccccggtttctcatatggctcgggatccaccggaagccaacagagcgaaggcagcaaaagctccggcagtactcggtcttcccggcgggcaccaggaagagagaaggagcggagggcggcgggggccggcggcagtggctccgagagtgaccatacggcaccatcgggagtcggttcttcctggagggagcgtcctgctggacagttgagccgtggcagcagtcctaggtctcaagcgtccgccactgcccccggactgccccctccccaccctacaacaaaggcatacaccgtggttggggggcctcccggtggcccccctgtgagggagctggctgcagtcccgccagaattaaccggatctagacagtcttttcagaaggccatgggtaacccgtgcgaattctttgtggacatcatgtag

SEQ ID NO: 185603 - DNA, 2088 bp, Artificial Sequence
  Description of Artificial Sequence: Synthetic coding sequence
atggccgagaccaagatcatctaccacatggacgaggaggagaccccatatcttgtcaagctgcccgtggcacctgaaagagtaacactggctgactttaaaaacgtgctctctaatagacccgtccatgcatacaaattttttttcaagtctatggaccaagattttggcgtggtcaaggaggaaatcttcgatgacaacgccaagctcccatgctttaacggccgggtcgtcagttggctcgtgttagctgaaggagcacactcagacgctgggtcccagggcaccgacagccatacagacttgcccccacccctcgagcgcaccgggggcatcggagactctcgtccaccaagctttcatccaaatgtcgcctcctctagagacggcatggataatgagacaggaaccgaatcgatggtatcgcataggagggaaagggccaggcgccggaatcgcgaggaagccgcacggaccaacggacatccccgcggagacaggcgccgcgatgttggactgccacccgactccgctagcacagctctgagctctgagcttgaatcatctagcttcgtggacagtgacgaggacgggtcaacgtctagattaagctcttctaccgaacagtccacatctagtaggctcatacggaaacacaagaggcgacggcggaagcagcgcctgagacaggctgacagggcctcctcctttagcagcatcaccgactccacaatgtcactgaacattgtgactgtgaccctgaacatggaacgccatcacttcctcggaataagcatcgtcgggcaatctaatgaccgcggggacgggggaatttacatcgggagcataatgaagggtggagcagtagccgcagatgggcgcatcgagcccggcgatatgctgctgcaggtgaatgatgtgaatttcgaaaatatgagtaatgatgacgccgtaagggtcctgcgtgaaattgtgtcccagacaggtcctatttccctgactgttgccaagtgctgggatcctacaccccgctcttatttcacagtgccacgtgccgatcctgtcaggcccatcgatccggccgcttggctgagccacacagctgctcttaccggtgccctgcctaggtacggaacatcgccttgttcatctgctgtgactaggacaagttcctcaagcttgacctcttccgtacccggcgctccccagctagaggaagcaccattgaccgtgaagtccgacatgagcgccgtcgttcgcgtgatgcagttacctgactccggactagagatacgggatagaatgtggctcaagattaccatcgcaaacgctgttattggagccgatgtcgtagattggctatacacccacgttgaaggcttcaaggaaagacgagaggctaggaagtatgcttcttcgttgttgaagcacgggtttcttcgccacacagtgaataaaatcaccttctccgagcagtgctactatgtgttcggcgacctgtgcagcaatctggcgacccttaacctgaatagcggctccagcggcacatcagaccaagataccttggctccacttccccacccagctgccccttggccgctgggccaaggatacccttaccaatatcccggtccccctccttgtttccccccagcctatcaagatcccggtttctcatatgggtcaggcagtactgggagccaacagtctgaggggtccaaaagttctggttccacaaggtccagcagaagggcccctgggcgggaaaaagaacgccgtgcagccggtgccggtggcagcggctcagagagcgatcataccgccccgagcggagttggatcttcttggcgcgaacgtcccgctggtcagctctcgagaggaagctcccctaggtctcaggcctccgctacagcccccggactgcctccaccacatcccaccaccaaagcctacaccgtagtgggcgggccaccaggaggccctcccgtacgtgagttagctgctgttcccccagagctgacgggatctcgccagtctttccagaaagccatggggaatccttgcgaatttttcgtcgatattatgtag

SEQ ID NO: 185604 - DNA, 2013 bp, Artificial Sequence
  Description of Artificial Sequence: Synthetic coding sequence
atggccgagaccaagatcatctaccacatggacgaggaggagaccccctatttggttaagctgcctgtcgctcctgagagggtaaccttagctgacttcaagaatgtcctttcaaatcgccctgtccacgcatacaagttcttctttaagagcatggatcaggattttggcgttgttaaggaagagatctttgatgacaatgccaaactgccgtgtttcaacgggcgagtggtctcatggctagtactggccgagggggctcactctgacgccggatcacaggggacagacagccacacagaccttccacccccgctggagagaacaggcgggataggggattctagaccaccctcctttcatcccaacgttgccagttcccgcgacggaatggacaatgaaacgggcacagagtcaatggtgtcccatagacgcgagagggcgcgccggagaaatagggaggaggccgccaggaccaacggtcacccgaggggtgacagaaggcgggatgtggggctacctcccgacagcgcgtccaccgccctctcctcggaattggagagttcttccttcgttgacagtgatgaggacggttcaaccagtcgcctatcaagttcgactgagcagagcacatctagcaggctaatcaggaagcacaagagacggaggaggaaacagcgcttgcgccaggccgacagggcatccagcttctcatcaatcaccgacagcaccatgtcattgaacattgttacagtaactctcaacatggagagacatcattttcttggcattagcatcgtgggccagtcaaatgacaggggcgacggtggcatatatattggatcaatcatgaaagggggcgctgtcgccgccgacggtaggattgagcccggtgacatgctccttcaagtgaacgacgtgaactttgaaaacatgagcaatgacgatgccgtccgtgtgctgagagaaatagtttcacagacaggtcccatctctctcacagtggccaaatgttgggaccccactccacgatcttattttaccgtgccaagggccgatcctgtgcgaccaatagatcctgccgcatggttgtcgcacactgcagctcttaccggagcattgcctcgctatgaactggaagaggctcccttgactgtcaagtcagacatgtcagccgtggttcgcgtgatgcaactgccggacagcgggctggaaatccgcgacagaatgtggttgaagatcaccattgctaacgccgtgattggagccgacgttgttgactggctgtacactcacgtggaaggattcaaagagcggcgagaggctcgaaagtacgcttcaagtctactgaaacatggattcctgcgacataccgtcaacaaaataaccttctctgaacagtgctactacgtttttggagatctgtgcagtaacctcgccacactgaacctcaacagtggcagttccggaactagcgatcaagataccttggctccactaccccatccagccgccccctggcctctcggccaaggatatccctaccagtatcccggccctccgccctgttttccgccagcgtatcaggacccgggtttctcatacgggtccggatctacaggatctcagcagtcggaaggcagcaagtcctcggggtccacacgcagctctaggcgggcccctggccgcgaaaaggaacggcgtgctgctggggctggcggcagcgggtcggaaagcgaccataccgccccttctggcgttggcagcagctggagagagcggcccgccggacagttgagcagaggatcctccccccggtctcaggcttcagctactgccccaggcctgcctccaccccatcccacgactaaagcatatactgttgttggcggacctcctggtgggcccccggtgcgggaattagcagcagtgccaccggagttaactggtagtaggcagtcttttcagaaggcaatgggcaatccatgtgagttttttgtagacatcatgtag

SEQ ID NO: 185605 - DNA, 2151 bp, Artificial Sequence
  Description of Artificial Sequence: Synthetic coding sequence
atgggcgagaccaagatcatctaccacctggacggccaggagaccccctacctggtgaagctgcctttacctgccgagagagtaacactggccgatttcaagggagtgctgcaacggccaagttacaagttctttttcaagtcaatggatgacgacttcggcgtcgttaaagaagaaataagtgacgacaatgctaagcttccgtgtttcaatggccgggtggttagttggcttgtgagcgcagagggttcgcaccccgatcctgctcctttctgcgctgacaatccttcagagctgccacccccaatggagcgcacgggaggcatcggcgacagcagaccccccagcttccacccacacgcaggcggcgggtctcaggagaatttggataatgatacagagactgacagtcttgtatccgctcagagggagcgaccccggcgccgagatggaccagagcatgccacccggcttaatggaactgcaaagggggaaaggcggcgcgagcccggcggttatgacagttcctccacactcatgtcatcggagttggaaacaacgtcattttttgattctgatgaagacgactccacctcccggttcagctccagcacggagcagtcttcagcctcacgcttgatgcgcaggcacaaaaggagacgccgcaagcagaaggtgagccggattgagagatcctcttcgttctccagtatcactgactctactatgagtttgaacatcataaccgtcacactcaacatggaaaagtacaactttcttggtatctcaatcgtgggccagtcaaacgagaggggggacggagggatttacattgggagcataatgaagggcggggccgtggccgcagacggccgtatcgaaccgggggacatgctcttgcaggtcaatgagatcaacttcgagaacatgtcaaatgatgatgccgtaagagttctgcgagaaatcgtacataagcctggcccaattacgctgaccgtggcaaagtgctgggacccaagtccacgaggttgcttcacgctgccgcgaagcgaaccaattagaccaattgaccctgccgcttgggtctctcataccgcagccatgaccgggacattccctgcttatggcatgagcccttctctgtcgactattacctcaacatccagcagcatcacgtcttcaatccccgacactgagcgtcttgatgacttccatctgtcaatccactcggacatggccgccatcgttaaggctatggcctcaccagaatccggcctcgaggttcgcgaccgcatgtggctaaaaataacaattcctaatgcgtttatcggaagcgacgtcgttgactggctgtaccataatgtagaaggatttactgatcgacgtgaggccaggaaatatgccagcaaccttctaaaggctgggtttatccgtcacaccgtcaacaaaatcacgttcagcgagcagtgctattacatatttggggatctttgtggaaacatggccaatttgtcactgcacgatcatgatgggtcctccggtgcttcagatcaggacacactggctccactcccccacccaggggccgccccatggcctatggcatttccatatcagtatccaccccctccacacccctacaatcctcatcccggattcccagaactaggctatagctacgggggcggctctgcatcatctcagcactctgaaggctctagaagttccgggtcgaatcggtctggatcagaccgaagaaaggagaaagacccgaaagcaggcgactcaaaatccgggggttccggttccgagtctgatcacacaacacgctccagcttgcgtggccctagggagcgggcccctagcgagcgtagtgggcccgccgccagtgagcatagccatcgcagccatcattcactagcctccagtctgcgcagtcaccacacccacccttcatacgggccaccgggagtccctcccttgtacggtccacctatgcttatgatgccacctcccccggccgctatgggacctccaggggctccccccgggcgcgatttagcaagcgtacctcccgagctgacagcttcacgccagagtttccgcatggccatgggaaacccctcagagttctttgtggatgtgatgtag

SEQ ID NO: 185606 - DNA, 2172 bp, Artificial Sequence
  Description of Artificial Sequence: Synthetic coding sequence
atgggcgagaccaagatcatctaccacctggacggccaggagaccccctacctggtaaagctccccctgcccgcagaaagagtcaccctggctgacttcaaaggcgtcctgcaaagaccctcttacaaatttttcttcaagagtatggatgacgattttggcgtggtgaaagaggaaatctccgatgataacgctaagctgccttgtttcaacggccgggtcgttagttggctggtgagtgcggaggggtcacatcccgaccccgcccctttctgcgctgataatccgtccgagttgcctcctccaatggagaggacaggaggaatcggtgacagccggcccccctccttccatccccacgcagggggcggatcacaagaaaacctggacaatgatactgaaaccgattcacttgtatcggcccagagggaacgcccgcggcgacgggacgggcccgagcacgcaacgaggctcaacggaacagccaagggagagaggaggcgcgaacccggtggctatgacagtagtagtaccctgatgagttctgaattggagacaacctctttttttgactcagatgaagacgattccacgtctagattcagcagttctactgaacaatctagcgcatcgcggcttatgcgcaggcataaaaggaggcgtagaaagcagaaagttagtaggatcgagagatcgtcctccttcagctctataaccgattcaacaatgagcctcaacattattactgttaccctgaatatggaaaagtataactttttgggaattagcattgttggtcaatccaacgaaaggggagacggcggaatctacatcggctctattatgaagggtggggctgtcgctgccgatgggcgaatcgagccaggcgatatgttgttacaagtaaacgagatcaactttgagaacatgagtaatgatgacgcagtccgtgttctgcgcgagattgtccacaaacccggcccaattacgttgacagttgcgaagtgttgggacccgtcacctaggggctgttttaccctcccacgatccgaacctatacggcctatagatccagccgcttgggtcagccatactgccgccatgaccgggacttttccggcatatggcatgagcccttccctcagcaccatcacatcaacctcaagtagtatcacgtcctctatccctgatacagagagactcgacgattttcacctctctatacactcggacatggccgccatcgttaaggccatggcatctcccgaatcgggactggaagtgcgagaccgtatgtggctgaaaatcactattcctaacgccttcatcgggagtgatgtggtcgactggttgtaccataatgtggaagggtttactgaccgccgcgaagcacgcaaatacgcctcaaacctgctgaaagccggtttcattaggcacactgtgaataagatcacgttcagtgagcaatgttactatatctttggcgatctgtgtggaaatatggcgaatttgtctctgcacgatcacgacgggtcatctggcgcctcggatcaggatacccttgcacccctgccgcacccaggcgctgctccatggcccatggcatttccctatcagtatccccctcctccccacccgtataacccgcaccccgggttccccgaattgggatactcatacggtggcggtagtgcgagcagtcagcattcagaaggctcgcggagtagcggctcaaacaggagcgggtcggaccgcagaaaggaaaaggacccaaaggctggggactctaaatcaggaggcagtggatctgaatcagaccatacaaccagaagctcattgcggggacctagggagagggctccatccgagcgatcgggtcccgcggcctccgagcatagccatcgatcccaccacagcctcgctagctcactcaggagtcaccacacccatccctcttatggcccccccggtgtgccaccgctctatggtcctcctatgctaatgatgccccctccccccgcggccatgggccccccaggggcccctccaggacgggacctggcgagtgtgccgccagagctgactgcttccaggcagagctttcgtatggcaatgggtaatccgtccgaattcttcgttgacgtcatggtcctccggggctggggggcgtag

SEQ ID NO: 185607 - DNA, 2100 bp, Artificial Sequence
  Description of Artificial Sequence: Synthetic coding sequence
atgggcgagaccaagatcatctaccacctggacggccaggagaccccttatctcgtaaaacttccgctgccggcggaacgtgtgactctggctgacttcaagggcgtactgcagaggcccagctacaagtttttcttcaaatccatggatgatgacttcggtgttgtgaaggaggagatctcagacgataatgctaaactgccgtgcttcaacggtagggtggttagctggctggtttctgccgaaggatcccaccccgatccggcccctttttgtgccgataatccttcagagctgcctccccctatggaaagaacgggaggaattggcgacagccgtccgccaagcttccacccccacgcaggaggcggatcacaggagaacctggataatgacaccgagaccgactccctggtttcagctcagagggaacgaccaaggcgaagggatgggccagagcatgccacccgactgaacgggacagctaaaggagaaaggcgcagggagcccggagggtatgacagttctagtacgctcatgtccagcgagctggaaaccacatcattttttgactctgatgaagacgacagtacatcccggttttcttcgtcaaccgagcagagttcggcctctcggttaatgcgcagacacaaacgccggcgacgcaaacagaaagtctcacgaatcgaaagaagctcctcgtttagttctatcactgactcaaccatgagcttgaacattatcacagtgactttgaacatggagaagtacaatttcctcggaatcagtattgtggggcagtccaacgagcgaggtgatgggggaatctatatcgggagtataatgaaaggaggtgctgtggccgcagacggtcggatagaacctggagatatgctcttacaggtgaatgagattaattttgagaatatgagcaacgatgacgcagttcgggtgctgcgcgagattgttcacaaacctggcccgataacgctcaccgtggccaagtgttgggacccatcccctagggggtgtttcaccctgccgcgtacaatgactggcacctttcctgcctacggaatgagtccttccctgtccacaataacgtcaacatcatcatcaatcactagctccattcctgacactgaacggctcgacgactttcacctctcaatccacagcgatatggccgcaatcgtgaaggcgatggccagcccggagtcgggacttgaggtgcgggacagaatgtggttgaaaatcacaattcccaacgcgtttattggttccgatgtagtggactggctgtaccacaatgtagaaggtttcaccgaccgcagagaagctaggaaatacgcctcaaaccttttaaaggccggtttcataagacacactgtgaacaagataacgtttagcgagcaatgctactacatcttcggtgacttgtgcggtaatatggctaacctttccttacatgaccacgacggatcatcaggggcttccgaccaggatacgctggctccccttcctcacccaggcgccgctccttggcctatggcgtttccataccagtatccgcccccaccacatccctataatccccatccaggttttcccgaattagggtacagctacggcgggggctcagcgtcatcccagcattcggaagggtctcgctctagtgggagcaaccgtagcgggagtgaccgtcggaaagagaaggatcctaaggcaggcgattctaaatccggaggctctgggagtgagtcagaccacacaacccgttcgagcttgaggggtcctcgagaaagagccccatcggaacggtctggtcccgctgctagtgaacactctcaccggtcacaccactctctggcctcatctctacgctcgcaccacactcacccctcatacggcccccccggcgtcccccctttgtatggacccccaatgttaatgatgcctcctccaccagctgccatgggcccgccgggtgccccacccgggagagatttagcaagtgtcccaccggaactcacagcctcgcgccagtcttttaggatggccatggggaatccatctgagtttttcgttgatgtgatgtag

SEQ ID NO: 185608 - DNA, 315 bp, Artificial Sequence
  Description of Artificial Sequence: Synthetic coding sequence
atgcccgaggcccacatgcagcccgccaagctgcagaccagcctgcccaccacggaccatggcagtaagaaacctgtttcttgttaccttccaccgctctctaacgctcatcccatgtgcatcgaagtgcagaacgcacagaactgtagtagcgccgcggcaaccctagagccaagcataatttctgacacatgcttttacaagcccatcactaaggaccagctcagcagcagaagcgaactgaatacggtgaggctgaagtgtctcaatagccttcggggatggaaaatcctaaatcagctctcactaacgtag

SEQ ID NO: 185609 - DNA, 1437 bp, Artificial Sequence
  Description of Artificial Sequence: Synthetic coding sequence
atgggcagccggtggagcagcgaggaggagcggcagcccctgctgggaccagggcttgggcccggactaggagccagctggaggagcagagaagcagcggcagctgcactgcccgccgccgtccccggcccaggccgggtttatgggagacggtggctggtcctgctcctatttagtctgctggcgttcgtgcaggggctggtctggaacacgtggggccccatacagaactctgcccggcaggcttatgggttttctagctgggatattgcgctactggttctgtggggacctatcggattcctgccgtgctttgctttcatgtggttgctggacaaacgggggcttcggatcacagtcctgcttacttccttcctgatggtcctgggaaccggtctgcggtgtattcctatctctgacttaatcttgaaacgaaggctgatacacggtggtcagatgctcaacggactagctggccctaccgtgatgaacgcggctcccttcctgtcaacaacctggttttcagcagatgagcgagccaccgccacagcaatagcttctatgttgtcctacctggggggcgcgtgtgccttcctggtgggccctctcgtagtgccagccccaaacgggaccagccccctcctggcggcagaaagttcaagagctcatatcaaagatcggatagaagccgtcctctatgctgaatttggtgtcgtgtgcttgatctttagtgctacactagcatatttccccccaagacctcctttacccccaagcgtagccgctgcaagtcagcggctaagctaccggaggagtgtctgtaggctactcagcaacttcagattcctcatgatcgccctagcctacgccatcccccttggggtgttcgcaggttggtctggcgtgctggatctgatactgaccccagcgcatgtctctcaggtggacgctggttggataggcttctggagcatcgtgggcggatgtgtcgtcgggatcgccatggccagattcgctgacttcatacgcggcatgcttaagctgattctcctgttactgttctccggagcgacgctgtccagcacttggtttacccttacctgtctaaacagcattacccacctgcctctgaccaccgtaacgctctatgccagctgtatcctgctcggagtgttcctgaattcttcagtgcctatcttctttgagctcttcgttgagactgtctaccctgtaccggaaggcattacctgcggcgtggtcactttcctctcaaatatgttcatgggcgtgctgttattcttccttacattttatcatacagagctgtcctggttcaactggtgtctgcctggttcatgcctcctgagtttactcctgattctctgcttcagggagtcttacgaccgcctgtatctcgacgtcgttgttagcgtctag

SEQ ID NO: 185610 - DNA, 1644 bp, Artificial Sequence
  Description of Artificial Sequence: Synthetic coding sequence
atgcccggcggcggcccccagggcgcccccgccgccgccggcggcgggggagtcagccaccgggctggctcacgggattgcctgccacccgccgcctgttttcgacgaaggaggttggcaaggaggcctgggtatatgcgatcttctacaggacctggaatagggtttctctcgcccgctgttggaacactattccggtttcccggaggcgtgagtggggaggagtctcaccatagtgaaagtagagctagacagtgtggtctagactcccgtggcctgctggttcgctcaccagtttcaaagtccgctgcggctcccaccgtcaccagcgtccgaggcacaagcgcccacttcgggatacaactgagaggcgggactcgactccccgaccgtctgtcgtggccctgtggcccaggatctgctgggtggcagcaggaattcgcggcgatggattccagtgagacactggatgcctcatgggaggcagcgtgctctgacggagctcggagggtgcgcgcggctggaagcctgccctctgctgaactaagttctaactcttgctctccaggatgcggtcccgaggtaccaccaacacccccaggatcgcatagcgcgttcacctcctctttcagtttcattagactgtccctggggagtgcaggagaaaggggagaagccgagggatgtcccccatcacgtgaagcagaaagccactgtcaatcacctcaggagatgggggcaaaggcagcatctctggatggaccacacgaagacccccggtgtttgagcagaccattctccctgttggcaacacgagtgtctgccgatctcgctcaggctgccaggaattctagccgcccggagagagacatgcacagtctgcctgatatggatcccggatcttccagtagcctggacccatctctggcaggatgtgggggtgacgggtcctcaggatctggagacgcacatagctgggacactctgttacgcaagtgggaacccgtgctcagggactgcctgttacgtaaccggcggcagatggaagtaatttcactacgcctcaagctccagaagctgcaggaagacgctgtcgaaaatgatgactacgataaagctgagacactccaacaacggctggaggatctcgagcaggaaaagatctctctgcactttcagctgccttcacgccagccagccctgagtagcttcctgggacatctggccgcccaggtgcaggccgcactgaggcgcggcgccacccaacaagcgtcaggggatgatacacatacccctctgagaatggagccaagactgctggaacctaccgcccaggattctctacacgtttctataactagaagggactggcttttgcaggaaaaacagcagcttcagaaggagattgaggccctgcaagcgcggatgtttgtgcttgaggcaaaggatcagcagttaagacgtgaaattgaggaacaggagcagcaactccagtggcagggttgcgacctaacccctctcgttggacagttatccctcggccaactgcaggaagtgtccaaggctttgcaggataccctcgcgagcgctggccaaatccccttccacgcggaacccccggaaaccatccgtcggtgcgtctag

SEQ ID NO: 185611 - DNA, 1110 bp, Artificial Sequence
  Description of Artificial Sequence: Synthetic coding sequence
atgcccggcggcggcccccagggcgcccccgccgccgccggcggcggtggcgtctcgcaccgtgcaggatctagggactgcctccccccggccgcctgtttcaggcggagacggctagccaggcgtcccgggtacatgcggtctagcaccggccccggtatcgggttcttatctccagctgtggggactttgttccggttcccaggaggagtgtcaggggaggagagccatcactctgagtcaagagccagacaatgcgggctggatagtcggggcttgctcgtccggagcccagtcagcaaaagcgccgctgctcctactgtcacaagcgtgagagggacctcggcacactttggcatccagctccgcggcggaacgcgactgcctgatcgtctgagctggccctgcggtccaggctccgctggctggcagcaggaattcgccgccatggattccagtgagacacttgatgcctcatgggaggccgcctgcagtgacggcgctcggagggtccgggcggctggatctttaccctctgccgagctgtcatctaactcctgcagccctggctgcggcccggaagtaccccccacacctcctggatcccattcagcattcacctcctcatttagtttcatccgcttgagcctcgggtctgctggagaaaggggagaggcagaggggtgtccaccaagtagagaagccgagtctcactgtcagagcccccaggaaatgggagctaaggcggccagcctcgatggccctcacgaagacccccgttgcctatcgcgccccttttccctgctggccactcgcgtgtccgcagatctggctcaggctgctcgaaactctagcagacctgagcgcgatatgcacagcctccctgacatggaccccggaagttcaagttctttggatccttcactcgccgggtgtggcggggacgggagctctggtagtggtgacgcacactcatgggacaccctgcttcgcaagtgggagcccgtgctccgggattgccttctgcgtaataggagacagatggagcttgagcccatagctctggacccaccgtggaagcctagacacccagagccaaactcctattag

SEQ ID NO: 185612 - DNA, 717 bp, Artificial Sequence
  Description of Artificial Sequence: Synthetic coding sequence
atggacagcagcgagaccctggacgccagctgggaggccgcctgctctgacggcgcccgtagggttcgcgccgctggcagcctaccctccgccgagctgagttcaaactcttgttccccaggatgcggcccagaagtgcctccgacccctcccggttctcactccgcctttacctcatcctttagtttcatcagattgtcactggggagtgccggcgaacggggagaagctgaaggatgccctccgagtcgagaagccgagagccattgccagtccccccaggaaatgggtgccaaagccgcctcactggacgggccacatgaagaccctcggtgtctttcaagaccatttagtctacttgcaacccgagtgtcagctgacctggcacaggctgctagaaattcctcaagaccagaacgggacatgcactcgctcccggatatggatccaggatcctcttcttcattagatccttcattggccgggtgtggcggcgacggcagctcaggctctggagacgcgcactcgtgggacaccctgctccgtaaatgggaacctgtcctgcgggactgcttactaagaaatcgaaggcagatggaggttatttcattgcggctgaaacttcaaaagctgcaggaggatgccgtggagaatgacgactacgacaaagcggggacgaactgcttcgggtcaacgatggaggcatctaccagctag

SEQ ID NO: 185613 - DNA, 2268 bp, Artificial Sequence
  Description of Artificial Sequence: Synthetic coding sequence
atgcccggcggcggcccccagggcgcccccgccgccgccggcggcgggggagtgtctcatcgcgccgggtcccgggattgtcttccaccggcagcctgtttcagaaggagacgtttagctcggagacccggctacatgcgctcaagcaccgggccaggaattggatttttatcaccggctgtggggacacttttccgctttcctggaggcgtgagtggagaggagtcccatcactccgagtctagagcaaggcagtgtggcttggattctaggggactcctggtgcgctctccggtaagcaaatccgccgcagcacctaccgtgactagcgttaggggaacttctgctcatttcgggatccaactccgtggggggacacggttgccagaccgcctgtcatggccttgcggtcccgggtctgctgggtggcagcaggaatttgcggctatggactcctcagagacactagatgccagttgggaggccgcatgttccgacggcgcaaggcgcgtgagggcggccggatccctcccaagtgcggagttgtcgagcaattcgtgctctccaggatgcgggcctgaggtacctcctaccccccctgggtcccattcagcttttaccagcagtttttctttcatccgactatctctgggtagcgctggggagcgcggagaagcagagggttgcccccctagtagagaggctgagtctcactgccagtccccacaggagatgggggccaaagctgcttcccttgatggaccccatgaggacccaaggtgtctatctcggccctttagtttgctggccacccgagtcagcgctgatctagcccaggcggcacgtaactcatcacgtccagagcgggatatgcactccttgcctgatatggatcccggatcgtcatcctccttagacccatccctggcgggttgcggcggagacggtagtagtggctccggagatgcacattcttgggataccctattacgaaaatgggaaccagtgctgcgggattgtctcctcaggaatcggcgtcagatggaggttataagcttgaggctcaagttgcagaagctgcaggaggacgccgtggagaatgacgactatgataaggccgaaaccttgcaacagagactggaggaccttgagcaggaaaaaataagtctgcacttccagctgcctagcaggcagcctgcgctttcatcctttttgggacatctggctgctcaagtgcaggccgccttgcggcggggcgccactcagcaggccagtggcgatgacactcatacccccctacgaatggaaccacggcttcttgagcctacagctcaggactctctacacgtctcaattacgcggcgtgattggttactccaggaaaaacagcagctccaaaaagaaatcgaagccctgcaggctcggatgttcgtcttggaggctaaggaccagcagcttcgccgagagattgaggaacaggagcaacaactgcagtggcaagggtgtgatctgaccccccttgtcggccagctgtcacttggacagcttcaggaggtcagtaaggccttgcaggatacgctcgccagcgcaggtcagattccctttcacgctgagccccccgagactatacgtagcttgcaggagcgcatcaagagcctcaacctcagcctgaaggagatcacaactaaagtgtgcatgagtgaaaagttttgtagcacactaaggaagaaggttaatgacatcgaaacgcagctgcctgcattgctggaagcaaaaatgcatgccattagcggcaaccacttctggacagctaaagacctgactgaggagatcagatctttaacctcagagcgggagggtctggaaggattattatcaaagttgctcgtgctgtctagtcgcaatgtaaagaagctaggaagcgtaaaggaagactataacagattgagacgagaagtcgaacaccaggaaacagcctatgacggggtctcgctgtgccgacctgtttggtccgccgtcgtaaggagctgcagtttgcaacctttgccgccagagttcaaacaattcagctgtctttcgttgagatctagctgggattaccgatgtccccctccctgtttggctaactttgtgttcttagtcgaaatgggattttaccatgtcgaccaaacaggcctgaaactacttacgagctcagacccgccaagttctgccagtcagagcgcaggaattacggatatgagccattgcgcctggccactgcagtag

SEQ ID NO: 185614 - DNA, 2037 bp, Artificial Sequence
  Description of Artificial Sequence: Synthetic coding sequence
atgcccggcggcggcccccagggcgcccccgccgccgccggcggcgggggggtcagccacagggcaggcagccgcgattgtcttcctccagccgcctgcttccgccgtcgcaggctcgcccgtcgtcccggatatatgagatcctctacggggcccggcattgggtttctcagcccagctgttgggaccctcttcagattccctgggggcgtctctggagaagaatcacatcattctgagagtagggcccggcagtgtgggcttgattcacgaggactgctcgtgcgaagccccgtcagcaagtctgcagctgctcccactgtgacatcagtgcggggcacgtccgcacactttggtatccagcttagaggaggaacccgattgcctgaccgtctgtcatggccgtgtggccctggctcagcggggtggcagcaggaatttgccgcgatggattccagtgagacactagacgctagttgggaggccgcatgctcagatggtgctagacgtgtgcgagctgcaggctcactccccagcgccgagctgtcctccaacagctgttctccaggctgtgggccggaagtacctccaacgccacctgggagccattccgcctttacatccagctttagcttcatcagactgagtctgggcagcgccggcgaaaggggtgaggctgagggttgccctccctcgagggaggctgagtctcactgtcaatccccacaggagatgggtgctaaggcagctagcctggatggcccacatgaagaccctcggtgcctgagccgtccattctcgctcctggcgacaagggtctccgcagacctcgcacaggccgctcgaaactcaagtcgacccgagcgggatatgcacagtctccccgatatggatccggggtcttccagcagtctggatccttctctggcaggctgtggaggtgacggcagttccgggtcgggagatgcccacagttgggatactctcctgcgaaagtgggagccagtcttgcgagattgcttactccgcaaccggagacagatggaggtaataagcctccggttgaaattgcagaaacttcaggaagacgccgtggaaaacgatgactatgataaagctgaaactttacagcagcggttggaagatctggaacaggaaaagatatctctgcatttccaattgccctctcgacagcctgctctgagctcctttcttggtcatctggccgcccaggtgcaggcagccctgcgcaggggagcaacacagcaggcaagtggtgacgacacccatacccctctccgaatggaacctcgcctgctcgagcctacagcccaggacagtctacacgttagcatcacccggcgggactggctgctgcaagaaaagcaacagcttcagaaggaaatagaggcactgcaggcccgtatgtttgtcctggaagctaaggaccaacagctacggcgagagatcgaggagcaagaacagcagctgcagtggcaaggatgtgatttgacacccctcgtcggtcagctctcactgggccagttacaggaagtgagtaaagccctgcaggataccctggctagtgcaggacagatccctttccatgccgagccaccagaaactatccgcagtcttcaggagaggatcaagagccttaatctgtcactgaaggagataacaactaaagtctgtatgagcgagaagttctgctcgaccctgagaaaaaaggtgaatgatatcgagactcagctacctgcactcttagaggccaaaatgcacgcaatctctgggaaccatttttggaccgcaaaggatttaaccgaagagatacggagccttacatcagagagggaaggactggaaggcctcttgtctaaactcttggtcttaagtagccggaatgtgaaaaagctgggttctgtcaaggaagactataacaggttgcgcagagaagtggaacaccaagagactgcttacgggtataagtactgtgacgccgagtcttggacccagagaagccagcagctggcttag

SEQ ID NO: 185615 - DNA, 2499 bp, Artificial Sequence
  Description of Artificial Sequence: Synthetic coding sequence
atgcccggcggcggcccccagggcgcccccgccgccgccggcggcggcggtgtgtctcaccgcgccggttcccgcgactgtttgccacctgccgcatgtttcaggagaagacgcctcgcccgcaggcctgggtatatgcgatcctctacaggacccggaataggctttctctcaccagccgtgggcacattattccggttccctggcggggtttctggcgaagagtcccaccattccgaaagccgagctcggcagtgcggacttgattcacgtggactgctggtacgcagtccagtctctaaatccgcagccgccccaacagtgacttccgtgaggggcactagcgcccatttcggcatccaactgaggggcggcacgcggctgcctgatcgcctgtcgtggccttgcggccccgggtcagctgggtggcagcaggagtttgccgctatggattcctccgagacgctggacgcgtcttgggaagcagcctgctctgatggagcacggagagtgagggccgctggaagtcttcccagcgccgaactttccagcaactcttgctctcctggctgcggcccagaggttccacccacgcctcccggatcgcattccgccttcaccagctcattcagcttcattagattgtccctgggctcagctggagagcggggcgaagcagaaggctgcccaccctccagagaggctgagtctcactgtcaatcaccccaggagatgggcgcgaaagcagccagtctggacggcccccacgaggatccacggtgcctttctcgccccttctccctgctggcaacacgggttagtgcggacctggcacaggcagcgaggaattcatcaagacccgagagagatatgcactcacttcctgatatggatcccggatcatctagctcactggacccttccctggccggctgtggtggagacggttccagtggaagtggggacgcgcattcctgggacacactgctccgtaagtgggagcctgtgctacgcgactgtctgctgagaaacagacgccaaatggaggtcatctcgttacggctgaagttgcaaaaactgcaggaagacgccgtggagaacgatgactatgataaagccgaaacattacaacagagattggaagatctggagcaggagaagatttccctgcatttccagctcccaagtagacaacctgctctcagctcatttctgggacatttggccgctcaagtgcaggccgcgctccgtcgtggggccacccagcaagcctcaggtgacgatactcatacgccactgaggatggaacccaggctactcgagccaactgcacaggacagcctgcacgtcagtatcactcggagggactggctgctgcaggaaaagcagcaattgcagaaggagatcgaagccttacaagctcgaatgttcgtgcttgaggcaaaagatcagcagctccgcagggagatcgaggagcaggagcagcaactgcaatggcagggctgtgatctcacaccactggttggccagctgagtctgggccagctgcaagaagtgtccaaagctctgcaggatacccttgcatcagctggacaaatcccttttcatgccgagcccccggaaacgatccggtccctgcaggaacgaataaaatcgctcaatctctctctcaaggaaatcactactaaagtctgcatgtctgagaaattttgcagtactctgaggaaaaaagtgaacgacatcgagacacagcttcccgcactgcttgaagctaagatgcatgcaatttccggtaaccacttttggacagctaaggatcttactgaggagatcaggtcgctcaccagcgagcgagagggattagaggggctgctttcgaagctgctggtgctctcatctcgaaacgttaagaaactggggtctgtcaaagaagattacaatcgcttacgaagggaagtcgagcaccaggaaacagcttacgaaacatcagtgaaagagaacaccatgaaatacatggagactctgaagaacaaactgtgtagctgtaaatgtcccttgctgggtaaggtctgggaagccgacctggaagcttgccgcctgctcatacagagcctgcagctgcaggaggcccgtggctcacttagcgttgaggatgagcgtcaaatggacgaccttgaaggtgcggcaccaccaatcccacccaggctgcacagcgaagacaagagaaaaacaccattgaaggagtcctacatcctgtcggcagagctcggtgagaaatgcgaggacattgggaaaaagctgttgtatttagaagaccagctccacactgctatacattcgcatgatgaagacctgatccactctctgaggagagagctccagatggtgaaggaaacccttcaggcaatgattctgcagcttcagcctgcaaaggaagcaggcgagcgtgaggccgccgcgtcgtgcatgaccgccggcgtacatgaagctcaggcatag

SEQ ID NO: 185616 - DNA, 2661 bp, Artificial Sequence
  Description of Artificial Sequence: Synthetic coding sequence
atgcccggcggcggcccccagggcgcccccgccgccgccggcggcggtggggtgtcacacagggctggctccagggactgcctccctcctgccgcatgcttcagaaggaggcgtctagcaaggcgccctggctatatgcggagtagcaccggccctggtattggtttcctttcccccgccgttgggaccttatttagattcccaggcggcgtaagtggggaagaatcacatcattctgaatcgagggcacgccagtgcggcttagactcgcgtgggttgctggtcagatcacccgtcagtaagtcagccgccgctccaaccgttactagcgttagaggtacaagtgcacattttggcattcagctgcgtggtggtacgcgcctacctgatcgtctgtcttggccttgtgggccaggctctgccgggtggcaacaggaattcgctgccatggactcttcagagactctggatgcctcctgggaagcagcttgctccgacggtgcacgacgggtcagagccgcagggagcctgccatccgcggagctttccagcaacagctgcagtcctggctgtggaccagaggtaccccccactcctccaggaagtcactcagccttcacttctagcttttcttttatccgcctgagcctgggctctgccggtgagaggggcgaggcagaggggtgccccccaagccgagaagctgagtcccactgccagtctccacaggaaatgggcgccaaggctgcctctttagacggcccccacgaagacccgcgctgcctatcccgtccctttagcctgctggcgactagggtgtctgccgaccttgcccaggcagccagaaactcttcacgcccggaaagggacatgcactccctgcctgatatggacccaggctcaagtagtagccttgacccatcactggccggctgtggcggcgacggcagttccggctctggtgacgcacacagctgggatacactcctgcgcaaatgggagccagtccttcgcgattgtctcctgaggaatagaagacagatggaagtcatatctctgcgtctgaaactccagaagcttcaggaagacgctgtcgagaatgacgattacgataaggtcgagacaggctttcattatgtgggacaagcaggtctcgaactgctcaccagctcaaaccctcctgcaagcgcatctcaaagtgccgggataaccgcggagaccttgcagcagaggctagaggacctcgaacaagaaaaaatctccctgcactttcagctccctagtagacaacctgccctgtcttcttttctcgggcacctggctgcacaggtgcaggcagcactgcggaggggagccacacaacaggcaagcggagatgacactcataccccactgagaatggaaccacgactactggagcctaccgcgcaagactcccttcacgtgagcattacaaggcgcgactggctgctgcaagaaaaacaacagctacagaaggagattgaagccctgcaggctaggatgtttgtccttgaggcaaaagatcagcagttgaggagggaaatcgaagagcaggagcaacaacttcagtggcaggggtgtgatttaacaccactggtgggacagctgtccctggggcagctgcaggaggtaagtaaggcattgcaggataccttggctagcgccggtcagataccattccacgcggaacctcctgaaacgattagatcactgcaggagaggatcaaaagtctgaacctgagcctaaaggagattaccaccaaggtgtgtatgagcgagaagttctgctcaaccctgcgcaaaaaggtgaacgacattgaaacccaacttcccgccttgctggaggctaaaatgcacgctatatccgggaaccacttttggacagccaaagacctgacagaggagattaggagtctcaccagtgaacgggaggggcttgaaggactcctttctaagctgctggtgctgagttcccggaacgtgaagaaactgggatctgtaaaagaggactataacaggctgaggagggaggtggaacatcaggaaactgcttatgaaacatccgtaaaggaaaataccatgaagtacatggaaacgctaaagaacaagctctgtagctgcaagtgtccactgcttggtaaagtgtgggaggctgatctcgaagcatgccgcttgcttattcagagcttgcagctccaagaggccagagggagcctcagcgtcgaggacgagcgacagatggatgaccttgaaggggctgcccctcccatccccccccggctgcactctgaggacaaaagaaagactcctctgaaagtcctggaggagtggaagacacatctcataccctcactccactgtgccggcggagagcaaaaagaggaatcatatattctgagtgccgagctcggagaaaagtgcgaagatattggaaagaaattactgtacctggaggaccagttacatactgctattcactcccatgacgaggatctcattcattccctccgccgcgagctgcagatggtgaaggaaactctgcaggccatgattctccagttgcagccggcgaaggaagccggagaacgcgaggcagccgcatcatgtatgaccgctggtgtgcatgaggcccaagcctag

SEQ ID NO: 185617 - DNA, 621 bp, Artificial Sequence
  Description of Artificial Sequence: Synthetic coding sequence
tgaaaccacttctggaccgccaaggacctgaccgaggagatccggtcgctgacatcggagagggaaggcttagaagggctcctttcaaagctgctggtcttgtctagcaggaacgtcaagaagctcggcagcgtgaaggaagactataaccgcctccggcgtgaagttgagcaccaggaaacagcttatgagacatccgtcaaggagaacaccatgaagtacatggaaacactcaagaataaactgtgtagctgtaagtgccccctcctaggtaaggtgtgggaagccgaccttgaagcgtgccggttgctcattcagtcccttcagcttcaagaggcaagaggatctctgtcggtcgaagatgagcggcagatggacgaccttgaaggcgcagctccgcctattcctccccgactgcactcggaagacaagagaaaaacaccgctgaaagtgttggaggaatggaaaacacatttaataccaagtctgcactgtgccggtggagagcaaaaagaggtgtgcccattccatatggccagtcggggggacccttactccaagggttgtttcggcaccatgctgcagatgggtacaataaacattggtaaggcatcccactag

SEQ ID NO: 185618 - DNA, 279 bp, Artificial Sequence
  Description of Artificial Sequence: Synthetic coding sequence
atgaagtacatggagaccctgaagaacaagctgtgcagctgcaagtgcccgcttcttgggaaggtctgggaggccgacctggaggcatgtcgtctgctcattcagtcactccagctccaggaggctcgcggctcattgagcgttgaagacgagcgtcagatggacgacctagagggagcagctccgccgatcccccctcggctgcattcggaggataaaaggaaaacccccctgaaggtcctggaggagtggaaaactcacctcataccatctctctag

SEQ ID NO: 185619 - DNA, 2565 bp, Artificial Sequence
  Description of Artificial Sequence: Synthetic coding sequence
atgcccggcggcggcccccagggcgcccccgccgccgccggcggcgggggagtgagccacagagccggctcacgggactgcttaccgccagctgcctgtttcaggagaagaagactcgctaggcgcccaggttatatgcgttcctctacagggccaggcataggcttcctgtcccccgctgtaggaaccctgttccggtttcctggaggggtttccggagaggagagtcaccattctgagagccgggcaaggcaatgcggattggacagtaggggtttgctggttaggtcccctgtctctaagtccgcagccgccccaaccgtcacgtccgttagaggtactagcgcccacttcgggattcaacttcgggggggcacccgcctgccagataggttgagttggccatgtggccctggtagcgccggatggcagcaagagtttgccgccatggactcctccgagacactggatgctagttgggaggctgcctgctcggatggggcacgccgggtgcgtgccgcgggctctctgccaagtgcggaacttagctccaactcttgcagcccggggtgtggccctgaggtgccccccactccccccggttcccactctgccttcacgagttccttttcattcattcggctttcacttgggtccgcaggcgagaggggcgaggcggaaggctgccctccgagcagggaagcagagagccactgtcagtctcctcaggaaatgggagccaaggcggctagcttggacggccctcacgaggacccccgctgtctatccaggcctttttctctgttagccactcgagtttccgctgatctcgcccaggcagctagaaattccagccgccctgagcgagatatgcactctttacccgatatggaccccgggagtagctctagcttagatccatccctcgccggttgcggtggggacggtagcagtggaagtggcgatgctcattcctgggacaccctcttgaggaaatgggaaccagtcctcagagattgtctgcttcgcaaccggcggcagatggaggtgattagcctgcgcttgaagcttcaaaaactacaggaagatgcagtggagaacgatgactacgataaagcagagacccttcagcaaagacttgaggaccttgagcaggaaaaaatatctctccattttcagctaccaagcagacagccagctctctctagcttcttaggacaccttgcagcccaggtccaggccgcacttcgcaggggcgcaacccaacaggccagtggggatgatactcacacgccattacgtatggagccgaggctcctcgaacccaccgctcaagactccttacatgtgagtatcacgaggcgggattggctgcttcaagagaaacagcagcttcaaaaagagatcgaggcccttcaggcacgaatgttcgttctggaggcaaaggaccagcagttgcggcgtgaaatcgaggaacaagagcagcagctgcagtggcaggggtgtgacttgacccctctagtcggacagctaagtctcggccagctgcaggaagtttccaaggctctgcaggacacattagcctctgcaggccagatacccttccacgccgagcccccagagactatccggtctctgcaggagagaattaagagcctgaatctgagtctcaaggagatcaccacaaaggtctgtatgtccgaaaagttctgtagcaccttaaggaagaaggtaaacgacatcgaaacacagctgccagcgctccttgaggcaaaaatgcatgccattagcggcaatcatttttggaccgcaaaggaccttaccgaggagattaggagtctcacgtccgaacgggaaggcctagaaggtctactgagcaaattgttagtgctgtccagcaggaatgtcaagaaactggggagtgtcaaagaagactacaatagactccggagggaagttgaacaccaggagactgcttacgaaacctctgttaaggagaacaccatgaagtacatggagactctcaagaataagctgtgcagctgcaaatgtcctctcctgggtaaggtctgggaggctgaccttgaggcatgtagactgttaatacaatccctgcagcttcaagaggctcgtgggtccctgtccgtggaagatgagcgacagatggacgacctcgaaggggctgccccccccattccccctcggttgcacagtgaagataagcggaagaccccactgaaggtcctggaggagtggaaaactcatctaattccttccctccattgtgccggaggtgagcagaaggaagagagctacatcttgtctgctgagctgggagaaaagtgcgaagacattggaaagaaactcctttacctagaggaccagctacacacagctatccacagccacgacgaagatctgattcattccctccggcgagaactgcagatggtgaaggagacactacaggctatgatactgcaattgcagcctgccaaggaggccggcgagagagaagccgctgcatcctgcatgactgctggagtgcacgaggctcaggcctag

SEQ ID NO: 185620 - DNA, 2199 bp, Artificial Sequence
  Description of Artificial Sequence: Synthetic coding sequence
atgcccggcggcggcccccagggcgcccccgccgccgccggcggcggcggcgttagccatagagctggctctcgggactgtcttcctccagctgcctgctttcgcaggcgtcgtctagcgagaaggccagggtatatgcggagcagcaccggacctgggatcggctttttgagtcctgcagttgggacattattcaggtttccaggcggcgtgtccggggaggagtcacaccattcagagtcacgggccaggcaatgtggattggactctagaggcctgctggtcaggtcaccagtttctaagagcgcagctgcccccaccgtgacctctgtccggggtaccagcgcccatttcggcatccaactgcgcggtgggactcgcctgccggatcggctttcatggccttgcggtccaggttcagcaggctggcaacaggaatttgccgccatggacagttcggagactctggacgcttcgtgggaagctgcatgcagcgacggagctcggcgcgtaagagccgccgggagcctgccaagtgccgaattgtcaagcaacagctgctcacctggctgcggccctgaagtgcctcctaccccgccgggatcacactccgcatttacctcatccttcagtttcatccgcttatccctcggctctgccggagagagaggggaagctgaaggttgtcccccctccagggaagcagagtcccattgccagtcaccccaggaaatgggagccaaggccgccagcctggacggcccacacgaggatccacgctgtctctctcgaccattcagcttgctggccacccgggtgagtgccgatctggcccaagccgcacggaactcttcacggcctgagcgagacatgcacagtctccctgacatggatccgggtagtagtagttccctggatccatccctggcggggtgcggaggcgatggatctagtggtagcggtgatgcccattcttgggacacactgctgcgtaagtgggaacctgtgctgagagactgccttctgagaaacagacgtcagatggaggtgatttctcttagactgaaattgcaaaagctgcaggaagatgcagttgaaaacgacgattatgataaagctgaaacgctccagcaacggttagaggatctggagcaggagaaaatttccctgcacttccagctgccaagcaggcagccagccctaagctccttcctgggccatctggctgcacaggtgcaggcagctctgcgtcggggtgctactcagcacctgcaggagcgcatcaaatcgttgaatctctccctcaaagagatcacaaccaaggtatgcatgtccgagaagttctgtagtacgctccggaaaaaagttaacgatattgagacacagctccccgccctgctggaggctaagatgcatgctatttccgggaatcacttctggacagctaaagatttaacagaagagattcgcagtctgacaagcgaaagagaaggactcgaggggctcctgtccaaactgctagtgttaagttcgaggaacgtcaaaaaactaggaagtgtgaaggaggattacaatcgcctgagacgtgaagtcgagcatcaggagacggcatacgaaacatctgtgaaagaaaataccatgaagtatatggaaactctcaaaaataagctctgctcctgcaaatgtccccttctggggaaggtgtgggaggctgatctcgaagcctgcagacttctaatccagtcgctgcaactccaggaagctagaggcagtttgtccgtcgaagatgagagacagatggatgatttggaaggagccgctcctccaatcccgccacgtctccatagcgaggataagcggaaaacaccattgaaagttcttgaagaatggaaaacacatctcatccccagtctgcactgcgccggcggagagcagaaggaggagagttatattctttctgcagagttaggtgagaagtgtgaggacattggcaaaaaactcctgtatctggaagaccagctgcatacagccatccactctcacgatgaagatcttatacacagtcttagaagggaactccagatggtgaaggaaaccctgcaggcaatgatcctgcaacttcagccagctaaggaggcaggggaaagggaggccgctgcctcttgcatgacagcaggtgtgcacgaagcacaggcctag

SEQ ID NO: 185621 - DNA, 1830 bp, Artificial Sequence
  Description of Artificial Sequence: Synthetic coding sequence
atgcccggcggcggcccccagggcgcccccgccgccgccggcggcggtggagtaagtcaccgggcagggagtcgcgactgcctccctcctgcggcctgcttccgtaggcggcgtttggctcgcaggcccgggtacatgcgctcttcgactggacccggtattgggttcttgtctccagccgtgggcaccctgtttcgctttccagggggggtgagtggagaggaaagccaccacagcgagtctcgcgcacgccaatgtggcctcgatagtcgtgggctgctggtgaggtcccccgtatcaaagagtgcagctgctcctacagtcacttccgtcagaggcacatccgcccatttcggaattcaattaagaggcggtacccgtcttcccgaccggttaagctggccttgcggtcccggcagtgcaggatggcagcaggagttcgcagccatggattcatctgagacactcgacgcttcatgggaagccgcctgctcagatggcgccaggcgggtgagagcagccggatctttgccatccgctgaactgtcaagcaacagctgctcacccggctgtggacctgaagtgccacccacacctcccggctcccactccgcttttacctcaagcttcagcttcatcaggctgtctttggggtcagcaggagaacgcggagaagcggaggggtgcccgccctccagagaggccgaatcacactgccagtctccccaagagatgggagctaaagcggcctcactggacggtccgcacgaggatccacgttgtctgtcccgacccttttccctgctggcaactcgggtgtctgccgatttagcccaggcagctaggaactcgagtcggcccgaacgtgatatgcacagcttgcccgatatggacccaggatcatccagtagcctcgacccctctcttgccggatgcgggggggatgggtcctccggtagcggggacgcgcatagctgggacactctcctgcgaaagtgggagccagttctgcgggactgtttactgcgaaaccgtagacagatggaagttatatcattaagactgaagctgcaaaagttacaggaggacgccgtcgagaacgacgattacgataaggcagagactctgcagcagagactcgaagacttggagcaggagaagatcagcttgcacttccaacttcctagtcgacaacccgccttgtctagtttccttggacacttagctgctcaggtacaggccgctctgagacgcggcgctacacagcaagccagtggagacgacacccacactcccctgagaatggaaccaagactcctggaacctactgcccaggatagcttacatgtgtcgatcacccggcgcgattggctccttcaggagaaacagcagctccagaaagagatcgaggcactccaagcacgcatgtttgttcttgaggcaaaggatcaacagctgcgtagggagatcgaggagcaagagcagcaactccagtggcaggggtgcgaccttacccctctcgtgggccaactctcccttggccagctccaggaagtcagtaaagcacttcaggacacactggcttccgcaggtcagatacctttccacgcagaacctcccgagacaatccggcgagaggtgcgccaccagaccgctccctgtagaaatcaccaacttgagaaacccgtgatcaacatctgggcctttcacctgagaagaaaaatctgtttgtttcaggcggacgggctccagcatggcagcgcagaagtgaaacatctgaaagaaacctctgtggagcccgctggaagtactgcctcccgcaaggagtag

SEQ ID NO: 185622 - DNA, 2088 bp, Artificial Sequence
  Description of Artificial Sequence: Synthetic coding sequence
atgcccggcggcggcccccagggcgcccccgccgccgccggcggcggcggggtaagtcaccgagctgggtctcgagattgtctgcctcccgctgcttgttttaggcgccgccgactggcccggaggcctgggtacatgaggagttctacaggtccaggtatagggttcctgagtccagcagtgggcacactctttcggttccccggcggagtttccggggaagaatcccaccattcagagtcccgtgcgaggcaatgtggacttgatagccggggactccttgtgaggtccccggtgtctaaaagcgccgctgcccctactgtcacctctgtgcgagggacaagcgctcactttgggattcagctgcgggggggcacccgtctgcccgaccggctgtcttggccatgtgggcccggtagtgccggctggcaacaggagttcgctgcgatggattcttcggagacacttgacgcctcatgggaggcagcctgcagcgacggtgccagacgggtgcgggcggctggctccctaccatctgccgaattgagttccaactcttgctctccaggatgcggaccagaagttccccctacaccccctgggtcccactcggcattcactagctcattttctttcataaggcttagccttggctctgcaggcgagagaggagaagctgaagggtgtcctccctctagggaggccgagagccactgtcagagtccccaggagatgggagccaaggccgcgtctctggacggcccacacgaagacccacgatgcttgtctcgacccttcagcctccttgctactcgggtgtcggccgacttagcccaggcggcccggaatagctctcgtccagagagagatatgcatagtctgcccgatatggatccgggcagctcttcatcactggacccatcactggctgggtgcggaggcgatggctcctccggcagcggtgatgctcattcatgggacaccctactacggaaatgggaacctgtgctcagagactgtttgttacgcaacagaaggcagatggaagttattagccttaggctgaaactccagaaactgcaggaagatgcagttgaaaacgacgactatgacaaagccgaaactctacagcagcgcctcgaggatctggaacaagaaaagatctctctgcactttcagttaccctcccgccagcctgctctctcctctttcctgggtcacctagccgcccaggtccaggcagcgcttcggagaggtgccacccagcaggctagtggcgacgatacacatacccctcttcggatggaacctcgattgctggaacccaccgcgcaggacagcctgcacgtgtccattacccgtagggactggctgctgcaggagaagcagcagcttcagaaggaaattgaagcgctgcaggctcgaatgttcgtcttagaagccaaggaccagcaactcagacgggagatcgaggaacaggaacagcaattgcagtggcagggatgcgatctcacacccctggttgggcagctttcattaggtcagctgcaagaagtgtctaaagcactgcaggataccctggcctccgctggtcaaattccgttccacgcagaacctccagagacgatacgcagtctccaagagcggatcaagtcgctgaacctgtctttaaaggaaattactaccaaagtctgtatgtcggagaagttttgcagcacattacggaagaaggtgaatgacatcgaaacccagctcccagcacttcttgaggcaaaaatgcacgctatcagcggcaaccatttttggacggcaaaagatctgaccgaagagattagatcactcacctccgagagagaggggttggaggggctactctccaagctgctggtactgtcatcccgtaacgttaaaaagctaggttccgtgaaagaggactacaaccgcctgagacgggaggtggaacaccaggagacagcctacgctgcctctgtgcactgtctgggcaagtgcggtaaattgacgtggaaacttgtggactgtctttctagggcttactccagccgtaagcctggagaagcttgcctgtag

SEQ ID NO: 185623 - DNA, 1680 bp, Artificial Sequence
  Description of Artificial Sequence: Synthetic coding sequence
atgcccggcggcggcccccagggcgcccccgccgccgccggcggcggcggcgtgtcccacagggctgggagcagggactgtctgccacctgctgcatgtttccggagacggcggcttgcaaggcgcccgggatatatgcggtcatccactggacccggtattggcttcctcagccctgccgtcggcaccctgttccgatttccggggggggtctcaggggaggagagtcaccattcagagagccgcgcaagacagtgcggccttgatagcaggggactcttagtacgctctcctgtctccaaaagcgcagccgcccctactgtgacatcagtgagggggacttcagctcacttcgggatccagctccgggggggcacgcgcctcccggaccgcctttcttggccgtgtggaccggggtccgccggatggcagcaggagtttgcggccatggattccagcgagacccttgacgcatcctgggaggccgcatgcagtgatggggcaaggagggttcgggcggccggcagcttaccttcagcggagctgtcgtccaacagctgtagtccaggctgtggccccgaagtaccacctactcctcctggtagtcacagcgcctttaccagcagtttttcgtttatcagactgagtcttggttctgctggcgaaaggggcgaagccgaaggttgtcctcctagcagagaggctgaatctcactgccagtcacctcaggaaatgggggccaaagctgcttctctggatggtccccacgaggatcctaggtgcttgtccagaccgttctctcttctggccactcgtgtgtccgccgacctggcacaggcagctaggaactccagcaggcccgaacgcgatatgcattccttaccagacatggatcctgggtcttcttccagtctggaccccagcctggcaggatgcggaggtgacggctccagtgggagcggagatgcccatagttgggacacactgctccgtaaatgggagcctgtcttgcgggactgcctgctaaggaaccggcgccaaatggaagtgatctcactgagattgaagctccagaaactccaggaagacgccgttgaaaacgatgattatgataaggctgagaccctccagcagagattagaggacctggagcaagagaagattagcttgcacttccagctgccctctaggcagcctgccttgagtagttttctggggcacctggcggctcaggtccaggctgccctgcggcggggcgctacccagcaggcttctggggacgacactcacacccccctacggatggaacctcgcttgctggagccaacagcacaggacagcctccacgtgtcgataacgagaagggattggttactgcaggaaaagcagcagttgcagaaggagattgaagcgctgcaggcacggatgtttgtgctcgaagcaaaggatcaacaactcagaagagagattgaggagcaggaacagcaactgcagtggcaagggtgtgatttgacaccgctggtgggccagctgtcgcttggtcagctgcaggaggtgtctaaggcgttacaagacaccctggcttcagctgggcagatcccttttcacgcagaacccccagaaactatccgtcggaacaaatgcgagggtaaatactacgaggtgcacggcaatacatag

SEQ ID NO: 185624 - DNA, 1740 bp, Artificial Sequence
  Description of Artificial Sequence: Synthetic coding sequence
atgcccggcggcggcccccagggcgcccccgccgccgccggcggcggcggtgtgtctcaccgcgccgggtccagggactgtctgcctccagccgcatgctttcgacgtagacgacttgctaggaggcccggatacatgcgcagctccacgggaccaggaattgggtttctgtccccagctgtcggcaccctcttccggtttccaggtggcgttagcggcgaggagtctcatcattccgaatccagggcgagacagtgcgggctcgattcccggggcctgctggtgagatcgcccgtctccaagagcgctgctgctccaacagtcacaagcgtcagagggacttccgcccactttggaatccagctgcgcggtggtaccagactccctgaccgcctttcttggccatgcggacctggcagcgccggatggcaacaagagttcgcagccatggatagctctgaaaccctcgacgcttcatgggaagccgcctgtagtgatggagcccgccgcgtgcgtgcggctggtagtctcccatccgccgaattgagttccaatagttgctctcctggatgcggtcccgaggtgccccccacccctccaggcagccatagcgcctttacctctagtttttctttcatccgattaagcctcgggtctgctggagaaaggggcgaggcggaaggttgcccgccttcaagggaggccgaaagccattgccaaagtccacaagaaatgggggccaaggctgcttccctggacgggccgcacgaggacccacgttgtctgagccgccccttcagccttttagcaacaagggtgagcgccgatttggcacaagcggctcgtaattctagcagacccgagcgggatatgcatagtctgcccgatatggaccccggcagttctagctccctggatccttcgcttgccgggtgtggaggtgacggatcatctggatcaggcgacgcccattcctgggatacactgctgcgcaagtgggaacccgtattaagggactgtctcctgaggaatcgccggcagatggaagtgatatctcttcgcctgaaattacagaaattgcaggaggatgcagtcgagaacgatgactatgataaggcagagaccctgcagcagcgcttggaagacctcgaacaggaaaagatctctctccactttcagctgccctctcggcagcctgcactgagctcgtttctgggtcacctggccgctcaggtgcaggctgctcttcggcggggagccacccagcaagccagcggagatgacacccacactcccttgcggatggagcccaggctgttagaacctaccgcccaggacagcctacatgtctctatcaccagacgggactggttgctacaggagaaacagcaacttcagaaggagatcgaagctctgcaagccagaatgtttgtgttggaggccaaagaccagcagcttagacgggaaatcgaggagcaggaacagcagctccaatggcagggctgtgacctgacccccctcgtgggacaattgagcctgggtcagttgcaggaggtgagtaaagctttgcaggacaccctggcatccgccggacagatcccatttcacgccgagcctcctgagacgatacggagcttgcaggaacggataaaatccctgaacttgtctctcaaagaaataaccacaaaggaaacgatttctggaagactgaagacttcccccaggaggctcgatcactag

SEQ ID NO: 185625 - DNA, 390 bp, Artificial Sequence
  Description of Artificial Sequence: Synthetic coding sequence
atgaccatgaccaccatgcccgagagcctgaacagccccgtgagcggcaaagcagttttcatggagtttggaccacctaatcagcagatgagcccctcccccatgagtcacggccattatagcatgcactgtttgcactccgcaggccacagtcagcctgacggcgcatattcatcggccagctccttctctaggccactgggttatccgtacgtgaattccgtcagctcacacgcgagctccccctatatcagctctgtccaatcatacccaggctccgcgagtctggcccagagcagactggaggaccctggccaggacctcgtacccaaacaggctatccaggtgcaggaggcggacgaagccggatgggggggtagtggcgggtag

SEQ ID NO: 185626 - DNA, 516 bp, Artificial Sequence
  Description of Artificial Sequence: Synthetic coding sequence
atgaccatgaccaccatgcccgagagcctgaacagccccgtgagcgggaaggccgtttttatggagtttggcccccccaaccagcagatgagtccttctcccatgtcccacggacattactcaatgcattgcctccactcggctggccactctcaacctgatggggcatatagctccgcctcttccttctcacgtcccctcggatatccctatgtcaattcagtgagcagtcacgcaagtagcccttacataagcagcgtgcaaagctatccagggagcgcaagcctggctcaatccagactggaggaccccggggctgatagtgagaaaagtactgtggtggagggaggggaggtgcgttttaatggaaaaggaaagaaaatccgtaagccccgcacgatctacagttcgttgcagcttcaggctcttaaccgcagattccaacagacccagtacctcgccttaccagagcgggccgaattggcggcatccctagggctgacacagacccaatag

SEQ ID NO: 185627 - DNA, 768 bp, Artificial Sequence
  Description of Artificial Sequence: Synthetic coding sequence
atgaccatgaccaccatgcccgagagcctgaacagccccgtgagcggaaaggctgtgttcatggaatttggcccaccaaaccagcagatgagtcccagcccgatgtcccacggccactactccatgcattgcctgcactcagctggacattcccagccggatggtgcctacagctctgcgtcatcgttctcccgtcccttgggctacccgtatgtcaactctgtctcatctcacgcttcatccccgtacatttcttcagtacagagctatccggggagcgccagcctcgcacagtccaggttggaggatcctggggcagacagtgaaaaatcaactgttgtggaaggcggggaagtgcgattcaatggcaaggggaagaagatacggaagcctaggacaatttactctagtctgcagttacaggcgctgaacaggagatttcagcagacccaatatctggcccttccagagcgtgcagagcttgccgcaagtctgggtttgactcagacacaggtcaagatctggtttcaaaacaaacgcagtaagttcaaaaaattgatgaagcagggaggggcggccctcgaagggtcagccctggctaatgggagggcactttctgctgggagtccccctgttccgccagggtggaaccccaattcctcatccggcaaaggctccggcgggaacgcgggatcctatattccaagctatacatcgtggtatccctccgctcatcaagaggccatgcagcagcctcagttgatgtag

SEQ ID NO: 185628 - DNA, 564 bp, Artificial Sequence
  Description of Artificial Sequence: Synthetic coding sequence
atgaccatgaccaccatgcccgagagcctgaacagccccgtgagcggtaaggccgtcttcatggaatttgggccacccaaccagcagatgtccccctcacctatgagtcatggtcactatagtatgcactgcctgcattctgccggacactctcagccggacggagcttacagcagcgcaagcagttttagtcgacctctaggttacccctatgtgaattcagtgtcctcccatgccagctccccttatatttcttccgtgcagagttaccccggctccgcaagtctcgcccagtcacggcttgaagaccccggagccgattccgagaaatccacagtcgtcgaagggggagaggtgcggttcaatggcaagggcaaaaagatcaggaagccgcgaaccatatattcctctcttcaactccaggccctgaaccgacggtttcagcagacacagtaccttgccctacctgaacgggccgagctggccgcctctctgggtctgacacagactcaggtcaagatctggtttcaaaacaagaggagcaagttcaagaagctgatgtag

SEQ ID NO: 185629 - DNA, 1722 bp, Artificial Sequence
  Description of Artificial Sequence: Synthetic coding sequence
atgggcaagtgcctgagctgctgcaaggaggaccagagcttccagcgctgttctccggaagaccaggtcagtactgatgctcagcatagaggcgcctcgtcaatctctcagccttctattagtctgggacacaagacttcatattcccctgtgacccacaaagtgaacgccgctaaggctagtagaagattgctgtctgtgagttccccttcattctcagaacggcgttactcacttttcgttggattccagaagcgtaacgcctccccgtactggcaacagagccgcgctaactttgatagtgaggaagataccgggttcaccgatataaaaagcagctcagaccactgtggctcctttatctctcgtcggcgtagattctcttcccggaagctttcaatcgtgagctactataagtctgcaattttctttgaccctcaagcctctggccaaaatgtctttaacctcaacgaaatagaaattttttctaagacttcttccaatacggacgcaaagaaacatatcacaattagcgcaccagagtacaataccaagaactttaaaaatttcgagacgaataccacgagccccgcatttggcaacactatcgatacggcctcatatcagcagagcacctcctcattttttagcctcgcctccgatatctccagccccgatcaacagaacggcatcgctaatgacatccaacagaggggccaactctgcaaggacttaaaggatttcctccatccgagaccggaatcatacagtacaggacactctccaattatgatcccccagcaccccagccagtccggcacgttcccattcttacataaagctggattcagtagctcttataagaatagtggctgttttattccacctcagagcgagctgactagtggtttgttcgaagacgaagactttgcagtgctgttccaggacgaggacaggagctctcctattgagattcccaagattcggtatataacggcaaacaccgacaccgaggaacagagctttccagttcccaaggccttcaacacccgcgtcgaggaactcaatctagacgtgctgctccagaaggtggaccacttacggatgtcggagtcaggcaaatccgagagctttgaattgctgcgggaccacaaagagaagttcagggatgaaattgaatttatgtggcggttcgctcgggcttacggcgacatgtatgagctgagcaccaatacccaagaaaagaagcattacgctaatatcgggaaaaccctctctgagcgagccataaaccgagcccccatgaatggtcattgccacctttggtatgctgtcctttgcggatatgtttcagaatttgaaggcctgcagaataaaattaattacggtcatctgtttaaggagcacctggatatagctatcaaactactgcctgaggaaccattcctttactatttaaagggtagatactgctacactgtatccaagctaagctggattgagaagaaaatggccgctaccttattcgggaagattccctcctcaaccgttcaggaggccttacacaatttcttaaaagctgaagagctgtgcccaggttatagcaatcccaactacatgtacttggctaagtgttataccgacttggaggagaatcagaatgccctgaaattctgcaacctggcacttctcctgccaacagtaactaaggaagaactctag

SEQ ID NO: 185630 - DNA, 654 bp, Artificial Sequence
  Description of Artificial Sequence: Synthetic coding sequence
atgaccggcgtgttcgacagcctggtggccgacatgcacagcacccaaattgctgctagttccacataccaccagcaccagcagcctccttccgggggtggcgccgggccgggggggaatagctcttcgagtagcagcctgcataaaccccaagaatcaccaaccctacccgtgtccactgccaccgattccagttactacacaaaccagcagcatcccgctgggggcggaggaggaggagggagtccttatgctcatatgggaagttatcagtaccaggcttcaggtttgaataacgttccatactccgcaaagagttcctacgacttgggctatactgccgcctatacaagctatgccccatatggtacctctagtagtccggctaataacgagccagagaaggaggacctggagccggagataaggattgttaacgggaagcctaaaaaggtgaggaagccgaggacaatctacagtagcttccagctggccgctctccagcgcagatttcagaagactcagtacctggcactccccgagagagccgaactggccgcatccctcggcctgacccaaacgcaagtgggcctggcaccgtgcaggggcgaggaaagcgcagggctgcgttggttgggctcccggcgggtgtag

SEQ ID NO: 185631 - DNA, 864 bp, Artificial Sequence
  Description of Artificial Sequence: Synthetic coding sequence
atgagcggcagcttcgaccggaagctgagcagcatcctgaccgacatcagcagcagtctcagttgtcatgctgggagcaaagacagccccaccctcccggagagctccgtgactgacttggggtattactccgcccctcagcacgactactacagtgggcagccatatggtcagactgtgaacccatacacttaccaccatcagtttaacctaaatgggctcgcaggcacaggcgcctatagccccaagtcagaatatacctatggggccagctatcgccaatacggtgcttatcgagaacaaccgcttcctgctcaggaccccgtgtccgtgaaggaagagcccgaggctgaggtgagaatggtgaacggcaagcccaaaaaggttcggaagccccgtaccatctacagttcatatcagctggccgcacttcaaaggcggttccaaaaagcccagtacttggccctgcctgaacgagcagaactagccgcgcagctgggactgacccagacacaagtgaagatttggttccagaataggcgttcaaagtttaaaaagctctataagaatggagaggtacctttagagcactctcccaacaattccgactctatggcctgtaattcacccccttctcccgccctatgggataccagcagccactctactccagcgccggctcgtagccagctcccaccaccgttaccctactccgcctcaccttcctatttggatgacccgactaatagctggtatcatgctcaaaacctttcgggacctcatctgcagcagcagcctccccaacctgcaactctgcatcacgcttcaccaggccccccgccaaacccaggtgctgtctactag

SEQ ID NO: 185632 - DNA, 723 bp, Artificial Sequence
  Description of Artificial Sequence: Synthetic coding sequence
atgaccagcctgccctgccccctgcccggccgggacgccagcaaggcggtctttcccgacctggctccagttccatccgtggcagcagcctatcccctgggactgtctccaacgacagcggccagccctaatctctcctacagccggccatatggacacctgctgagttacccctacacagagcctgccaatcctggcgattcatacttgagctgccagcagccagcagccctgtctcaaccactctgtggtcccgcggagcacccacaggagcttgaggccgatagcgagaaaccaagactctccccagaacctagtgaaaggaggccccaggcaccagccaaaaagttacgaaagccacgaaccatatattcaagtctccagttgcaacacctgaaccaacggttccagcacacccagtatcttgccctgccagaacgggctcagctcgcagcccaattagggctcacccaaacccaggtgaagatctggttccagaacaagaggagtaaatataagaagctcctgaaacagaatagcggggggcaagaaggtgatttccctggccggactttttctgtgtcaccatgctccccacccctgccatctctgtgggatcttcccaaggccggcaccctgcctacaagcgggtatggtaactctttcggggcctggtatcaacatcactcaagtgatgtactggcttctccccagatgatgtag

SEQ ID NO: 185633 - DNA, 507 bp, Artificial Sequence
  Description of Artificial Sequence: Synthetic coding sequence
atgaagctgagcgtgctgcccccccggagcctgctggccccctacacagtactgtgctgccccccagattcggagaaacctcgcctgagcccggagccttccgagaggaggcctcaggcccctgccaaaaagctgagaaaaccgaggactatctactcttcccttcagctgcagcatctcaaccagaggtttcaacacactcagtacctggcactgcctgagcgagcccaactggccgcccaactgggcctcactcagacccaggtaaaaatttggttccagaataaacggtcgaagtacaagaaactgcttaagcaaaacagcggcgggcaagaaggcgatttccccggaagaacgttctccgtttccccctgttctcccccacttccatctttatgggatctacccaaagccggaaccctccccacatccggctacggcaactcttttggggcttggtaccagcaccacagcagtgatgtgctggcctcacctcagatgatgtag

SEQ ID NO: 185634 - DNA, 1473 bp, Artificial Sequence
  Description of Artificial Sequence: Synthetic coding sequence
atggaccacaccgacaacgagctgcagggcaccaacagcagcggctccctaggcggtttagatgtgagacggcgaatcccgattaaattgatcagcaaacaggcgaacaaagcaaaacctgcaccacgcacacaacggaccatcaaccggatgcctgctaaagcaccaccgggggatgaggggtttgattataacgaggaggaaaggtacgactgcaagggtggagagctgtttgcaaatcaacggaggttccctggacacctcttttgggatttccaaattaatattcttggtgaaaaagacgacacgcccgttcatttctgcgataaatgcgggttgcccatcaaaatctacgggagaatgattccctgtaagcacgtgttttgctacgactgcgctatactgcacgagaagaagggcgataagatgtgccctggttgctctgatccggtgcagagaatagagcagtgcactaggggatcgctgttcatgtgtagcatcgtgcaaggatgtaaacgtacatatctgtctcagcgggatctgcaagcccacatcaatcaccgtcatatgagggctggaaagccggtgaccagggctagtctggaaaatgtgcacccacctattgctccccccccgactgaaatccccgagcggttcattatgccacccgataagcatcatatgagccatatcccaccaaagcagcacatcatgatgccacctccgcctctgcagcacgtgccccatgaacattacaaccagcctcacgaggatatcagggcaccccccgctgaactgtcaatggccccccctccgccacgcagtgtctcccaggaaacctttagaattagtacacggaagcactccaacctaattactgtgcctatccaggatgatagtaacagtggagcccgcgagccccctccaccagcccctgccccagcacaccaccaccctgagtaccaaggccagcctgtcgtgagccacccccaccacataatgccacctcagcagcactacgcaccaccaccccctcctcctccccccatcagccatcctatgccacatccaccacaggcagcaggaaccccgcacctggtctacagccaggcaccaccccctcccatgacaagcgctccgcctccgataacccctcctccaggccatatcatcgcccagatgcctccctatatgaatcacccccctcctggaccgcctccaccacagcacgggggcccccccgtgacagcaccaccaccccatcactataacccgaattccctaccacagttcacagaagaccagggaactctgtccccgccctttacacagccgggcggaatgtcacctgggatctggccggctccaagaggaccgccgccaccgccccgcctgcaagggcctccgtctcagacaccacttcccggaccacaccacccagaccaaacacggtatcgcccatattaccaatag

SEQ ID NO: 185635 - DNA, 798 bp, Artificial Sequence
  Description of Artificial Sequence: Synthetic coding sequence
atgatgaccatgaccaccatggccgacggcctggagggccaggactccagtaagtctgcttttatggaattcggccaacaacagcagcagcaacacagtccagccatggccggcgcccattaccccctgcactgtctgcactccgcggccgccgctgccgcagccggcagccaccaccaccaccaccaccaacatcatcaccacggtagcccatacgcctccgggggcggcaacagctataatcataggtcactcgccgcatacccatacatgtcccactcccaacattctccctacctgcaaagctaccataatagttccgccgctgcccagacacgtggggatgacactgaccagcagaagactacggtcatcgagaacggggaaatcagattcaacggcaaaggcaaaaagattcgtaaaccgcggactatctactcgagtttgcagctgcaggctctgaaccatcggtttcaacagacccagtatctggcactgcccgagagagccgagctcgcagcctcacttgggttgacacagacccaggtgaagatttggttccaaaacaaacggtctaagttcaagaaattattgaagcagggatccaaccctcatgagtccgaccctttacaaggcagcgccgccttgagccctagaagtcccgccttacctcctgtgtgggacgtgagtgcctccgccaaaggcgtttccatgccacctaatagttatatgcccggctactcccattggtacagcagcccccatcaggacaccatgcagaggcctcagatgatgtag

SEQ ID NO: 185636 - DNA, 882 bp, Artificial Sequence
  Description of Artificial Sequence: Synthetic coding sequence
atgatgaccatgaccaccatggccgacggcctggagggccaggactccagcaagtctgcttttatggagtttgggcagcaacagcagcagcagcaacaacagcagcagcagcagcagcaacagcagcagcagccgccccccccccctcctcccccgccacaacctcattctcaacagagttctccggccatggccggcgcgcattacccattgcactgcctccacagtgccgcagctgccgcagctgctggctcccaccaccatcaccaccatcaacaccaccaccatggcagtccttatgcttcaggtggcgggaacagttataatcacaggtccctggcggcctatccctacatgtcccacagtcagcatagcccatatcttcagagctaccataattctagtgcggcagcccagacaagaggagacgacaccgatcagcagaaaacgacagtgatcgagaatggagagatccgcttcaatggaaaggggaagaagatccggaaacccagaacaatttactctagcctgcagctgcaggctctgaatcaccgcttccaacagacacagtatctggccctgccggagcgggctgagttggcagcctctctggggctgacacaaacccaggttaaaatttggttccaaaacaagcggtctaaatttaaaaaacttctcaagcagggtagcaacccccacgagtctgaccctctccagggtagtgcggcattaagcccccgctctccagcgctgccaccggtgtgggatgtgagcgccagcgccaaaggagtctctatgcctcccaattcctacatgccagggtattcccactggtactcgtcgccccaccaggataccatgcagagaccgcagatgatgtag

SEQ ID NO: 185637 - DNA, 9084 bp, Artificial Sequence
  Description of Artificial Sequence: Synthetic coding sequence
atgaacctgcaccaggtgctgaccggcgccgtgaaccccggcgaccactgcttttctgtgggcagcataggcgaccagagatttactgcctatgccagtggctgtgacatcgttatccttggctctgatttcgaaaggctgcagattatcccgggtgccaaacacggaaatattcaagtcggatgcgtcgactgctctatgcagcagggtaaaatcgcagctagttacggcaacgtgatcagcatttttgaacccgtaaaccttccaaagcagaagaagaatctggagttgtacagtcagtggcagaagagtggccagttctttctggaaagcatagcacataatattacctgggacccgacaggttcacgtctgttgacaggttccagctatctgcaactatggtcaaacacgaacttagaaaaaccaacagaagacgagaatctgaacaagaccgatctgaactttggcgactggaaatgtatctggcactgcaagactgcctcccaggtacacctcatgaaatttagccccgacggggagttctttgccacagccggaaaggacgattgtttactgaaggtttggtacaacgtggaaaattggcgcactgcggtgaccagccccgatggctcctcagagaaacagtctcagggcgaaatcgatttctcgttcgtgtaccttgcacaccccagagccgtcaatggcttttcatggaggaagacttctaaatacatgccccgggcctccgtgtgtaatgtcttgctgacatgctgcaaggataacgtttgcagactgtgggtagagacctttttacccaatgactgccttttgtatggcggagattgctctcattggacagagagcattaatttgaccaataacttcaagaggaacgctagctcaaaagagcgcgtccaaaacgctttagaagtgaaccttaggcacttcaggagaggtcgccggagatcacttgccctggtggcccatactggctatctgccacatcagcaggatccgcaccacgtgcacaggaatacgcctctacacgctaacgcgctctgtcactttcatatagctgcctctattaaccccgctacagatatccccttattaccgagcataaccagcctttcactaaatgaaaacgaggagaaaacaggcccctttgtagtgcactggctgaacaataaggagcttcactttacactgagtatggaggtgttccttcaacagttaagaaagtctttcgaacagccaagcagcgaggccagtgtcgaggactccaatcaagccgacgtgaaatccgatgaagagactgacgacggagttgatgatctgaaaattaatccagaaaaaaaggaactgggctgtgacaaaatggtgccaaattctagtttcaccagcctaagcagcgctgctatcgaccatcagattgaggtgttattgagcgagtggagtaagaacgccgacatgcttttttccatccacccgatggatggttctttgcttgtgtggcacgttgactggcttgatgaataccaaccgggaatgtttcggcaagtccaggtgtccttcgttagtagaatccccgtggccttcccgaccggagatgcaaactccctgtgtaagagtattatgatgtatgcttgtaccaagaatgtggatttggccatacagcaaggcaagcagaagccaagcggcctgactaggagtacctcgatgctgatttcatcaggacataataaaagtagtaattctctgaagctatcaatattcacaccaaatgttatgatgattagcaagcacgcagatggctccctgaaccagtggctggtttcctttgccgaggagtcggcgttctctactgtcctgtctattagccataagtcacggtactgcgggcaccggttccacctgaatgaccttgcctgtcattctgttctgcctctattattgaccacttcgcaccataacgccttacggacccccgatgttgacaatcccgaacagccattcgatgccctgaacatcgaagaatgctccttgacccaacagaacaaatccaccgtcgacgtggcttttcaggacccttcagccgtctacagtgaactgatcctttggagggttgaccccgtggggcctctatcctttagcgggggagttagcgaactggcacgtattaattcacttcatgtgagcgcattttccaacgtggcctggttgcccaccctgattccatcatactgcctgggagcctactgtaattccccttctgcctgtttcgtggcgtccgatggtcagtatttgaggctgtacgaggccgtcatcgatgccaaaaaactactgtccgagctaagcaaccccgaaatcagcaaatatgtaggcgaggtcttcaatattgtatcacagcagagcactgcgagaccaggttgtatcattgccctggacccgattaccaaactccacggccgtaagacccagctgttgcatgtgttcgaagaagattttatcttgaataaccttgagaagaagagccttggtaaagatagcatcttatctaacgcgggaagttcaccgaacggcttttcggaaaaattctacctgattgtcatagagtgtacccaggacaaccggagcctcttacacatgtggaaccttcacctcaaatctatccctgtgagtctggatgagaaagtggatactaagctgtccgaagctgtttggcagcctgaggaacattacagctctagcccagagaagatcctctcacctttttctcagaaataccaagcttgtcgagcaaacttgcagtcaacatcacggctgacactgttctccgaaatggtatattcacaagaacttcacttacccgaaggggttgaaatcatcagcatcaaaccttctgccggtcacctctctagctcctccatttaccccgcttgcagcgcaccatatctgctggctacatcttgttctgatgagaaggtgcgcttttggagatgccgagtaacagatggcgagtctgcaacctccaagaacgggaagatagacttagcttatatctgggaagagtggccattgctgatcgaggacgggctgcagtcaaattctagcatcacagtccctggtcggccagtagaggtgagctgtgctcatactaatcggctcgcggtcgcatacaagcagcctgccagcaacagcagatctagccaggactttgtgatgcacgtgagcatattcgaatgcgaatccacaggaggatcctgttgggttctcgaacagaccatccacctcgacgaactgtctacagtgctcgatagtggaatctccgtcgattccaatctcgtggcctataataagcaggacatgtacctctcctcaaaagagaatataacgtctaacacaaaacacctcgtacacctcgactggatgtcacgggaggatggctcccatattctgacagtaggcatagggagcaaattgttcatgtacggccccctagccggcaaggtccaggaccagacaggcaaggaaacgttagcattccccctctgggaatcgaccaaagttgttccgctgtctaagttcgtgctgctcaggagtgtcgacctggtgtccagtgtggacggctctccaccattccccgtatctcttagctgggtccgcgatggtattttagtggttgggatggattgcgagatgcacgtttattgtcaatggcaaccctcctccaagcaagagcccgttatcactgactcatactcaggcagtacaccctccataacctccctcataaagcagtccaattcctcttccggcctgcacccaccaaagaaaaccctgactcgatcaatgacatcactggcccagaaaatttgcggcaagaagaccgcttttgatccttccgtcgacatggaggattctggactgttcgaggccgcacatgtgctgtcccctaccttgcctcagtaccatcccttacagctgctggagctgatggatctggggaaggtgcggagggctaaggcaatactcagccatcttgtgaagtgcatcgctggagaagtcgtggccctgaacgaggccgagtcgaaccatgagcgccgcctgagatctcttacgattagcgcctctggttctaccacccgggatcctcaggcattcaataaagccgaaaacacagattacactgaaattgacagtgtgcccccgctccctctgtatgccctactggccgcagacgacgattcctgctattcatcacttgagaaatcatccaatgaatccacactgtccaagtccaatcaattatcaaaggaatcttatgatgagctgttccagacccagctcctgatgaccgacacacacatgttggagactgacgaagagaatactaaaccacgggttattgatctgagccagtacagccctacctattttggtcccgaacacgcacaggtcctatccgggcacctcctgcattcttctctcccgggcctcagccgaatggaacaaatgtcactcatggccctcgccgacaccattgccaccacgagcacggacatcggcgagagccgggacagatcacagggcggtgaaacactagacgagtgtggactgaagttcctgctagctgttagactgcacacttttctgactactagcctccctgcttatagggcacaacttctacatcaggggctttctacctcccacttcgcgtgggcttttcactcggtggcggaggaagagctactgaatatgctccccgcaatgcagaaggacgatcccacctggagcgaactgagagccatgggagtgggttggtgggtgcgaaacactcggattcttcgtaagtgcatcgagaaggtggcgaaagccgcgttttacagaaaaaacgatcccctagatgccgccatattttatcttgcgatgaagaaaaaggcagtaatttggggactgtacagggctgagaagaatacacggatgacacagttcttcggacacaatttcgaagatgaacgctggaggaaagctgcgcttaagaacgccttcagcctcctggggaagcaacgattcgagcactccgcagccttctttctgttggccggctgcttgagagacgccatcgaggtctgccttgagaaactgaatgatatccagttggcccttgtgatcgctcgactctatgagtctgagttcgatacttctgctgcttataaaagtatactcagaaagaaagtcctagggattgattcccctgtgtctgaactgtgctccctcaacatcaacatgcatcatgatccgttcctgagaagcatggcgtattggatcctggaagactactcaggcgccctggaaaccctgatcaaacagcccatccgagagaacgatgatcaagtgctatcagcatctaaccccaccgtgttcaacttctataattacctgcggacacaccctctcctcctgcgtagacattttggcagctcggacaccttttccacccatatgagcctgactggcaaaagtggcctcgccggaactataaacttgtctgaacggcggttattcttcactactgcctcggcccacctaaaagccgggtgcccaatgttagcgctggaggtgctctccaaaatgccgaaagtgattaaaaagacccgccctttttacagagcaagttcctttctggacacttcaaaggattgttccccgagctcgccactgaagctggacgcaagagaggataaatcttcagccgtagactggtcccaatcactgattaatggatttggaagctctagcgaaggttcttccgagaagcagagcaactcaactctgtctttcgactggagtcaaccctccgtggtttttcaagacgacagcctcgaactcaagtgggactccgacaatgacgaagagaatgaggacgtgcccatcagcatgaaagagctcaagcccctgcagcggaagactgataagaagttagatgacatctcttcaaactacacggaaagtttttctaccctcgatgaaaatgacttgcttaatccctccgaggatatcattgctgtccagctaaagttccgggcatgtttgaagatcttgactgtcgaactcaggacactcagtaccggctacgaaatcgatggtgggaaactcaggtaccagctgtaccactggctggagaaggaagtgatcgccctccagcgcacgtgtgatttttgcagcgacgcagaggagctccaatcagcctttgggaggaacgaggatgagtttggattaaacgaagacgcagaagacctgccccatcaaaccaaggtaaaacagctgagggagaacttccaagagaaacgtcaatggttgctgaagtaccagtctctgctacgtatgttcctttcttattgtatacttcacggatcacacggaggtggcctcgccagcgttcgcatggagttaattctgcttcttcaggagtcacagcaggaaacgagcgagccgctgtttagcagcccactgagcgagcaaacttccgtacccctgctcttcgcctgcacagcaaatgcaaagacggttgtagcgaatccattacttcacttatcaaatcttacacacgacattctgcatgcaattatcaactttgattcgccaccacatcctgacatccagtctaacaaagtgtatgtaatgcacacactagcagcttcactctcagcctgcatttaccagtgtctctgtggctctcataactattcttcatttcagacgaaccaatttaccggaatggtttatcaaactgtgcttctgccccacagacccagcctgaagaccgggagccttgacgaagctctgacgccgaatacctcgccggcccagtggccagggattacctgcctaattcggctactgaatagtagcggcgaggaagcacagtcgggactgactgtgctcctctgtgagattctgacagctgtctacttgagcctcttcattcatggcctcgcaactcatagttctaatgagctgttcagaatcgtagcccaccctctcaatgaaaaaatgtggtcggctgtgttcggtgggggcgcccacgtgccatcaaaagaacagactcactccaagactctgccagtctcctctctggtggaagagggtgaaaaacaaaacaagcgattccggccgtccaagatgagctgcagagagagtgctcctttgaccccctcctcagcgcctgtgtcacaggagagtctggccgtgaaagaaaagtttatcccgcccgaactcagcatttgggactattttatagccaaaccatttttgcctagctcccagagccgtgctgaatatgactccgaagagagtctggggagtgacgacgatgataatgatgacgacgatgacgttctcgcatccgacttccacctccaagaacattcaaattccaattcctacagttggtctctaatgcgcctggcaatggtgcagctggtgttaaataacctgaagaccttttatccgttcgcggggcacgacctagctgagctgcctgtgagttcacccctgtgccacgctgtgttgaagaccctgcagtgttgggagcaggtactgctgcgccggttggaaatccacggcgggcccccccagaactatatcgcttctcacacagccgaggaaagtcttagcgcaggccccgctatactgcgccacaaggcactcctagagcccaccaacacgccctttaagtctaagcaccacttggctttgagcgtgaaacggctatggcaatacctagtgaaacaggaagagattcaggaaacattcatcaaaaacatcttcactaagaagcggtgcttgaatgaaatcgaggctgatctggggtatcccggagggaaggctcgcattatccacaaggaatctgacattatcaccgcatttgcagtgaataaggctaatagaaattgtattgctatcgctagttcccacgacgtacaagagctggacgtgtctggtattctggccacccaagtttatacctgggtcgacgacgacattgaggttgagactaagggaagcgaggactttctggtgatccatgctcgagatgatctcactgcagtccagggaacaacgccctacacacacagtaaccccggcacacccattaacatgccgtggctcggaagtacccagacaggaaggggtgcttctgttatgatcaaaaaggcaattaataacgtgcgccgaatgacaagccatcctacactgccatactacctgaccggggcccaagatggctccgtgaggatgtttgaatggggacactcacagcaaatcacctgcttccgtagcggaggcaattcccgggtgacacggatgaggttcaattatcaggggaataaatttgggatcgtggatgcagatggctacctcagcctctatcagacaaactggaaatgctgtccagtgacaggcagcatgccaaaaccatatctgacctggcaatgtcacaacaagactgctaatgatttcgtgtttgtgagttcgagcagtctgatagccacggccggtctgtccaccgataatcggaatgtctgcctatgggatactttggtggctcccgccaattcactcgtgcatgcgttcacctgccacgattcaggagccaccgttctcgcttatgccccaaagcatcaactgctcatatctggtggacgaaaaggcttcacttatgtttttgatctctgtcagcgtcaacagagacaattgttccagtcccacgactcccctgtgaaggcggtcgcagtcgaccctaccgaggaatattttgtcaccggtagcgcggaaggcaatattaagatatggagtttgtcgacctttggattgctgcacacgtttgtcagcgagcacgccagacagtccatcttccgcaacatagggaccggggtgatgcagattgagaccggtcccgccaaccatatcttctcctgtggagctgacggcacaatgaaaatgcggatcctccccgaccaatttagccctttgaatgaagttctgaagaatgatgtcaaattcatgctatag

SEQ ID NO: 185638 - DNA, 1770 bp, Artificial Sequence
  Description of Artificial Sequence: Synthetic coding sequence
atgaacctgcaccaggtgctgaccggcgccgtgaaccccggcgaccactgcttcagcgtggggtcaatcggggatcagcggtttaccgcatatgcttcaggttgtgacattgtgatcctgggttcagattttgagagactgcagataataccaggagctaaacatggaaacattcaagtcggctgcgttgattgcagtatgcagcaggggaagatcgctgccagctacggcaacgtgatttctatttttgagcctgtgaacctaccgaaacagaagaagaatctcgaactgtactcgcaatggcagaaatctggccaattttttcttgaaagcatcgcccataatataacctgggatcccacaggctcccgtcttctgactggatcatcctacctgcagctgtggtccaatacaaatctcgaaaagccaaccgaagacgagaacttaaataagaccgacctgaactttggagattggaagtgtatctggcattgcaagacggcttcacaggtccaccttatgaagtttagcccggatggagaattcttcgctacggcaggcaaggacgactgtcttcttaaggtgtggtacaacgtagaaaactggcgcacagccgtgactagcccggacggatcatccgaaaaacagagtcagggggaaatcgacttctcttttgtgtacctcgcacacccccgcgctgttaacggtttttcttggcggaagacctccaagtatatgccaagagcgtccgtgtgcaatgtgctgctaacctgctgtaaggataatgtctgtcgactgtgggtggaaacttttctcccaaacgactgtttgctgtatgggggggactgcagtcactggacagagtcaatcaatctgacaaataatttcaagagaaatgcttcctccaaggaacgagttcagaacgctttggaggtgaacctgagacatttcaggagggggagacgaagatcactggccttggttgcacacacaggttatctcccacatcaacaggaccctcaccacgtgcaccgaaatacccctcttcacgcgaatgcgttgtgtcactttcatatcgcagcgagcattaatcctgcaactgacatcccgcttcttccatctatcacctccctttccctgaacgagaacgaagaaaagacaggtccatttgtggtccattggttaaataataaagagctgcatttcacactctccatggaggtcttcctgcaacaactacggaagtctttcgagcagccctccagtgaagcctctgtagaggatagtaatcaggcagacgtcaagtccgacgaagaaaccgatgacggcgtggatgaccttaaaattaaccccgaaaaaaaggagttgggctgtgataaaatggtcccgaattcttcattcacctcattaagctctgcggccatcgatcaccagatcgaagtgctgctgtctgaatggtccaaaaatgccgatatgctgttctcgattcatcccatggacggtagcctgctcgtttggcacgtcgattggttagacgagtatcagccaggcatgttcaggcaagtgcaagtctcatttgttagtcgcatacccgtcgctttcccgacaggcgatgcaaatagtctctgcaaatccatcatgatgtacgcctgtacgaagaacgtggatcttgctatccagcagggtaagcagaagcccagtggcctcacacggagcacctcgatgctgatttcatccggccacaataaaagttcaaatagccttaagtag

SEQ ID NO: 185639 - DNA, 9147 bp, Artificial Sequence
  Description of Artificial Sequence: Synthetic coding sequence
atgaacctgcaccaggtgctgaccggcgccgtgaaccccggcgaccattgctttagtgtgggcagcattggcgaccaacgatttaccgcctatgcttccgggtgtgatatcgttatattggggtcagacttcgaaaggctccagatcatcccgggcgcgaaacacggcaatatccaggtgggttgcgttgattgtagtatgcagcaaggtaagatagccgcttcttacggaaacgttatcagtatctttgaacccgtgaacctgccaaagcagaagaagaacctggagctgtattctcaatggcagaaaagcggacagttcttcctggaaagcattgcccacaatatcacctgggatcccacagggtctcgcttgctaacaggctcatcctatttgcagctgtggtcaaatactaatcttgagaaacctactgaagacgaaaatttgaataagactgacctgaatttcggggattggaagtgcatctggcactgcaagactgcttcccaagtgcacttaatgaaattttctcctgatggggagttttttgccaccgctggaaaagacgattgtctgctgaaagtgtggtataatgtcgagaactggcgcacagccgtgacgtcacccgatggatcttccgaaaagcaatcccagggagaaattgattttagttttgtgtatctggcccacccacgggctgtcaacgggtttagctggaggaaaacatctaagtatatgcctagagcttcagtgtgtaacgtgcttctgacatgctgcaaagacaacgtctgtagactttgggtcgaaaccttcttacccaacgattgcctcctctacggtggcgactgctctcactggaccgaatcaataaacttgaccaataactttaaaagaaacgccagcagtaaggaacgtgtccaaaatgcactggaagtcaacttaagacactttagacgtgggagacggagatcacttgcactggtcgcccacaccgggtacctgccacatcaacaggatcctcatcacgtgcataggaacacccccctgcatgccaatgccctctgccacttccacatcgcggcctccattaacccggcaactgatatccccctcctgccaagtatcacctccctaagcttaaatgagaatgaagaaaagaccggacccttcgtagtccactggctgaataacaaagaattgcatttcactctgtctatggaggtgttcctgcagcagttaagaaagagttttgagcaaccatcgagcgaggcatctgtggaggatagtaatcaggctgacgtgaaatccgacgaggaaactgacgatggggtcgacgacctcaagataaaccctgaaaaaaaagagctcggctgcgataaaatggtccctaacagttctttcactagcctctcctccgcagcgatcgatcaccagatcgaggtgctgcttagtgaatggtctaaaaacgctgacatgttattttcaatacaccccatggatggcagcctactggtctggcacgtcgactggctggatgagtaccaaccaggtatgttcaggcaggtccaagtgtcttttgtaagccgcattccggtggcatttcccaccggggatgcaaacagcctctgcaaaagtatcatgatgtacgcatgtactaaaaacgtagatctcgccatccagcagggtaagcagaagccatctgggcttaccaggagcacttctatgctcatttcaagcgggcacaacaagtcctctaactccctgaagcttagcatcttcacacctaacgttatgatgatatctaaacatgcagacgggagcttaaatcagtggctagtgagcttcgctgaagaatccgctttctccaccgtcctgtccatctcacataaatctcgatattgcggccaccgctttcatctgaatgacttggcctgtcatagtgtgctgccgctgctcctgacgacttcccatcacaatgccttacgaactccggatgtggataatccggagcaaccattcgatgcccttaatattgaggagtgctcacttacacagcaaaataagtctactgtcgatgtcgcctttcaggaccccagcgcggtgtacagtgagctgattctctggagggtggatccagtcggaccacttagtttctccggcggagtcagcgagcttgctcgtattaactccttacatgtttccgccttcagcaatgtggcttggctccccaccttaattccttcgtattgccttggagcttactgcaactcacctagcgcctgctttgtcgcgagcgacggccagtatcttcggctttacgaggcagtgatcgatgcaaagaaattgttatcagaactctcaaatcccgagatatccaagtatgttggtgaggtgtttaatatcgtgtcgcagcagagtaccgcccgacccgggtgtatcatcgcactcgacccaatcacaaaactacatggacgcaagacacagctgctccacgtatttgaagaggacttcatcctaaataacctggagaaaaagagtctgggcaaggacagtatcctgtctaacgccggatcttcccccaatggcttctcagagaagttctacctgattgtgatcgagtgcactcaagacaatcgatccctattacacatgtggaacctgcacttaaagagcataccagtgtctcttgatgaaaaagtggatactaaactttctgaagctgtgtggcagcctgaggagcattattcatcttcccccgagaaaattttgagtccattctcccagaagtaccaagcctgccgcgctaatctccaaagcacaagccgtctgactttatttagtgagatggtgtacagtcaagagctccaccttcccgaaggcgtggagatcatctccattaagcccagcgctggacacttgtcgtcttccagcatataccccgcctgctccgcgccttacctgttagccacatcttgcagtgatgagaaggtgaggttttggcgctgccgagtcaccgacggtgagagcgccacatcaaagaatggcaaaatcgatttggcgtacatatgggaagaatggcctctattgatcgaagatggtctccagtctaattcctcaattactgtgcctgggaggccagtggaagtcagctgcgctcatacaaaccgattggcagtggcctacaaacagcctgcatcgaactcccgcagtagtcaagactttgtcatgcacgtctcgatttttgagtgcgagagtactggtggttcttgttgggtgcttgaacagaccattcacctcgacgaactgtcaacggtgcttgatagtggtattagtgtggattcgaacctcgtagcatataataagcaggacatgtacctctcatccaaggagaatattacttccaatacgaaacacttagtgcacctggattggatgagtcgggaggacggttcccacattctcacggtgggaattgggtcgaagctgtttatgtatggccccctagccggtaaagtgcaggaccagacagggaaggaaacactggcattccccctttgggaaagcacgaaagtggtgcccctcagcaaattcgtgttactgaggtccgtagaccttgtttcatctgtggacgggtccccgccctttcctgtctccctgagctgggtgagggatggaattctggtcgtcggcatggactgcgaaatgcacgtatattgtcaatggcagcccagttctaagcaggagcctgtaattactgactcttacagcggatcaacgcctagtatcacgtccctgatcaagcagtccaactccagcagcggccttcatccaccaaagaaaacgttaaccagatcaatgaccagcctcgcgcaaaagatttgtggtaagaaaaccgcctttgatcccagcgtagacatggaagattcaggactttttgaggcagcgcatgtgctatcacctacactccctcaataccatccattacagctgttagagcttatggatctcggcaaggtgcggcgtgcaaaagcaatactgtctcacttggtgaaatgcatcgcaggagaggtagtcgcccttaatgaggccgagtcaaatcatgagaggaggctccggagtctgacaatctcagcttctgggtccacgacgagggacccccaggccttcaataaagccgagaacacagactatacagaaattgactcagtgccccctctgccgctttatgcccttctggcagccgatgacgattcctgctattcatccttagagaagtctagcaacgaaagtacgctgtctaagtcgaatcaattgagcaaagaaagttatgacgagctctttcaaactcagctcctgatgacggatactcatatgctggagactgacgaagagaacacaaaacctcgtgtgattgacttatctcagtactcccctacttacttcggacctgaacacgctcaggtgcttagcggacacctgctccattcaagtctgcctggcctgtcaaggatggaacagatgtctctgatggcactagctgatacaatcgcgaccactagcacggacataggcgaatcccgagaccgaagccaggggggggagacgctggacgagtgtggattaaagtttttgctggccgtgaggttgcacacctttttgacgacgtcattaccggcgtaccgtgcacagctgctccatcaggggctttccacatcccactttgcttgggccttccattctgtcgcagaagaggagctgctgaacatgttgccagctatgcaaaaggacgaccccacctggtccgagttgcgcgcgatgggagtcggttggtgggtgcgcaacacccggattttgaggaaatgtattgaaaaagtggccaaggccgcattttatcggaagaacgatccactcgacgccgccatcttttacctggccatgaaaaagaaagccgttatatggggtctgtaccgggcagagaaaaacactcggatgacgcagtttttcggacataatttcgaggatgaaagatggcgcaaagcagcattaaagaacgccttcagcctgctgggcaagcaaaggtttgagcactcagcggcattcttcctccttgccggctgtctcagagacgccattgaagtttgtttggagaaattaaacgacattcagttagcactggttattgctaggctgtacgagagcgaattcgatacatcggcagcttataagtccattctgagaaagaaagtcctgggtatagacagtcccgtttcagagctttgttccttgaacattaatatgcaccacgaccctttcctccgctccatggcctactggatcctcgaggactatagcggcgcactagaaacactaatcaaacagccaatccgggagaatgatgatcaagtgctgtcagcgagtaaccccaccgtcttcaacttttacaactacctccgtacccaccctctactcttgagacgccattttggatcatccgacaccttctcaacccatatgtcgctgaccggtaagtccgggcttgccggaaccatcaatcttagtgagcgcagactcttctttacaaccgctagcgcccacttgaaggctgggtgccctatgctggctttggaggtactttctaagatgcctaaggtcatcaaaaaaacccggccgttctacagggcctcgagcttcctggacacttctaaggactgcagcccaagttcccctctgaaactggatgcccgcgaagataaatctagcgcagtggattggagccagagcctgattaatgggttcggctctagtagtgagggatcttctgagaaacaaagcaactctactctgagttttgactggtctcagccctctgtcgtcttccaggacgattccctcgagctcaagtgggatagcgataacgacgaagaaaatgaggatgtgcccatcagcatgaaagagctcaagccccttcagcgcaagactgataagaaactggacgatatcagctcgaactacactgagagcttctcaactttggacgaaaatgatcttttaaatccttcagaagatatcattgccgttcagctgaagtttagagcttgtctgaaaattcttaccgttgaattgcgcaccctaagcaccggctatgaaatagacgggggaaagcttcggtaccaactgtatcactggcttgaaaaagaagttatagctcttcagcggacctgcgacttctgctctgatgcagaagaactgcagtctgctttcggacgaaatgaggacgaattcggcctaaacgaggatgccgaggatctccctcatcaaaccaaggtgaagcagttgagggaaaactttcaagaaaaaagacagtggctcttaaagtatcagtccctcctgcgcatgttcctctcctattgtatccttcacggaagccacgggggagggttagccagcgtgagaatggagttgatattgttgctacaagagtctcaacaggaaacatcggagcccctgttttcttcccctctgtccgagcagacctcagtgccactcctattcgcctgtaccgctaatgccaagacagtggttgcaaacccgctcctgcacctctcaaacttgacccacgacattctgcatgctatcattaactttgacagtccaccccatccagacattcagagcaacaaagtgtacgtaatgcacactcttgcagctagtttgagtgcctgcatctaccagtgcctgtgtgggagtcataattattcctcgttccagaccaatcagttcacaggcatggtctatcagactgttctgctgcctcatcgtcctagtctgaaaacagggtctttggatgaggctctgacacccaacactagccccgcacagtggccgggaatcacttgtttaatccggcttctgaactcgtctggagaggaggctcagtccgggctgactgtgctgttatgtgagatcttgactgcagtttatctgagcctctttattcatggcctggccacacacagctcaaatgaactgtttaggatcgtggcacatcccctcaacgaaaagatgtggagcgcggtctttgggggtggcgctcacgtcccctctaaagagcagacccattctaaaactttaccggtctcctctcttgtggaggaaggcgagaagcaaaataaacggttcaggccctctaaaatgtcctgccgggagtctgctcccctaaccccatcatcagcccccgtgtcacaagaatcactggccgttaaggaaaagtttattcctcccgaactgagtatttgggactactttatagcaaaaccgttcctgccttcatcccagtctagggctgagtacgattccgaggaatctctcggcagcgacgatgacgacaacgacgacgacgacgatgtgctggcctcagactttcacctgcaagaacacagcaactcaaattcgtattcttggtcgcttatgcggctggccatggtccaacttgttctaaataacctcaagaccttctacccgttcgcggggcatgaccttgccgagttacccgtgagctctcctctatgtcatgcagtgcttaagacacttcagtgttgggaacaagtacttttgaggcgcctggagatacacgggggacccccacagaattacattgcttcccataccgccgaagaatctctttcggctgggcctgcaatcctcaggcataaggccttactcgaaccaactaataccccttttaaatctaagcatcatctggccctctccgttaaacgtttatggcagtacctcgttaagcaagaagaaattcaggaaacatttatcaaaaacatttttacgaaaaaacgctgtctcaatgaaagcttggaggataactcagagaccatcaagaactctatgatggaggaacccaatattaataaaatagaggcagatctgggctaccctggaggcaaggcccgcatcatacataaagaaagtgatatcatcacggcatttgctgttaataaggctaatcggaattgcatcgcaattgcgtcttctcacgatgtgcaggaactggacgtctctggcatattggctacccaggtgtacacttgggtggacgatgacattgaggtggagacaaaaggctccgaggactttctcgtgatccatgcgagggacgatctgacagccgtgcaggggactactccatatactcacagcaacccagggacacccatcaatatgccctggcttggtagcacacaaaccgggagaggcgcaagtgtgatgatcaagaaggctattaacaatgtcagacggatgacgtctcacccgacacttccatattacctcactggcgcacaggacggatctgtccgcatgttcgagtggggccactctcaacagatcacgtgctttagatctggcggaaatagtcgtgtgacccgcatgcgcttcaattaccagggtaacaaatttggtatcgtcgacgctgacggttacctgagcctgtaccagacaaattggaagtgctgccccgtgacagggagcatgccaaaaccttacctgacctggcagtgccataataagaccgccaatgacttcgtgtttgttagctctagctcccttattgctaccgctggactctcaacagacaaccggaacgtctgtctgtgggatactctcgtggcgcctgcgaacagcctggtccacgccttcacatgtcacgatagtggcgcgaccgtgctggcctacgcccccaagcaccagctgctgatcagcggcggtaggaaagggttcacatacgtatttgatctctgtcagcgacagcagaggcagctctttcagtcgcatgatagcccagtgaaggctgtggctgtggacccaaccgaggagtacttcgtgactggctccgctgagggaaatatcaaaatctggagcctaagtacttttgggctccttcacacatttgtcagtgagcacgctcggcaatcgatctttagaaatatcggtacaggggttatgcagatagaaacgggccctgccaaccatattttctcctgcggtgctgacggaaccatgaagatgaggattctcccggatcagtttagccctttgaacgaagtcctgaagaatgacgtgaagtttatgctttag

SEQ ID NO: 185640 - DNA, 9111 bp, Artificial Sequence
  Description of Artificial Sequence: Synthetic coding sequence
atgcacctgcaccaggtgctgaccggcgccgtgaaccccggcgacaattgttactccgtagggtcagtgggggacgtccctttcaccgcctatggttccggctgcgatatcgtcattttagccaatgatttcgaatgtgtgcaaatcattcccggcgctaaacacggtaatatccaggtgagttgcgtggagtgttccaaccagcagggccgtatcgcagctagttacggcaacgccgtctgcatctttgagcccctgggcatcaacagccataagcgcaactgccagctgaagtgtcaatggctgaagacgggacagttcttcctatctagcgtcacttacaacttggcctgggacccccaagataaccgtctgctgacagctacagactccattcagctgtgggcccccccgggggatgatattctggaggaagaagaagaaatcgataatactgtcccccctgtgcttaacgactggaagtgcgtgtggcagtgtaagacaagcgtatccgtgcacctgatggaatggtcacccgatggtgagtactttgctacagccggcaaagacgattgcctgctaaaggtctggtatcccatgactggatggaagtctagcataatcccccaagaccaccacgaggtcaagcgacgtcagtcatcaacccaattcagcttcgtatatttagctcatccccgggccgtgaccggattctcatggcgaaagacatccaagtacatgccaaggggctccgtgtgtaacgttctgctgacatcatgtcacgacggagtttgtagattgtgggccgagaccctgctgcctgaggattgtctccttggggaacaaatctgcgagacaacgacctcctctattgcgtcttcactgtctcatgcaggccgacataaagatcgaatccagcacgcccttgaaaccatccaccatttaaagaatctcagaaaggggcaaaggcgttctagtgtcttggtgacacacgcagaactgatgccagatcagaccgccatgcacgaagtgcagcggcatatctcacaccacgcgaacgcattgtgtcactttcatatcgctgctagtatcaaccccgcgaccgatatccctaatgtgctggttggaaccgctttcaacgtagacgatggaaacggaggatttgtggtgcactggcttaataacaaggaattccacttcacctccagtacagaggtcttcatgcaccagctgaggaagctaagcgacaagcaggtcgaccacgaaaatgatgatgccgatcgagaggacgaagagcattcccaggaagatagagagagagggttacacatgaagctggaccacgacttgtccctggatcgggaatctgaggctggcacaggctcttctgaacacgaggatggggagagagaaggcagcccacggacctactccagactatcagtccccatgccactgccaactgtcttgcttgatcgaaaaattgaaaccctccttacagagtggaacaaaaaccctgatatgctctttaccatccaccctgtcgacgggacctttctggtgtggcacgttaaatacctggacgagtacaatccgggtatcttcaggcaggttcaggtgtctttcagctcccgaattccagtcgcttttccctccggcgatgcctcctcactatctaagaacatcatgatgtatgcctgcattaacgcgaccaaagattcgcatcacacccttctgcaccaggaggggatgagcgtggggagccctcacggaagtcagcctcattcacgcagtcactctactcacatgaatatcctggctcctacggttatgatgatttcaaagcatatcgacggctcattaaaccagtgggcagtcacatttgccgataaaagcgccttcacaacagtgttaacagtgtcccacaagttccgatactgtggacaccgctttcacctcaacgatttggcctgtcatagcgttctgcctcttctgctgactagctcccaccacaacgctctgctgacccccgaattggattgtcagtgggatagtgataataaactttctcgactgatggacccagttaagcacattaaaggcagctccaagcaaccactgaggaacgccgctacgcgcacattccatgaccccaatgcgatttactctgaactgatcctctggcgcgtggatccaattggccccctgtcatacaccggcggcgtgtcggaactggctaggatcaactcattgcacaccagcgcttttagcaacgttgcatggcttccgacattgatacccagttactgcctgggtacctattgcaattctgcgtccgcctgtttcgtcgcctcagatgggaagaacctccgactctaccaggcagtagttgatgcccggaagcttctcgacgagctttccgatcctgagtccagcaagttaataggtgaagtattcaacatcgtgagtcagcagagtactgccaggcccggatgcatcattgagctggatgccattaccaaccaatgtggaagtaatacacagctcctgcacgtgttccaggaggatttcattattgggtacaagcctcataaggaggacatggaaaagaaagaaacagagatcttttttcagccctcacagggctacagacctccgcccttttccgagaaattcttcctggttgtcatcgaaaaggatagcaataacaattcgatcctgcatatgtggcacttgcatttaaaatcagttcaggcttgccttgccaaagcttctgaaggtgcctcatcggaaagccttctctccgtgccaggccagaaaaacgttgatagcagtccggagactagcccatcggtcagccccatgccccacagttcatccattgctaatctccagacagcttcaaagctgatcctgtcatcacgcctagtgtacagccagccactcgatctaccagaaagtgttgaggtgattcgcgccactccaagcgctggccacttatctagctcatcgatctaccctgtgtgtctggccccctacctggtggtgacaacttgttccgacaataaggtcaggttttggaagtgctgcatggaggccaatcctgagtgtaacaagagtgacgagaaagaaatttatcattggaagcggtggcctctgatgaatgatgagggcgaggataatagcagcacagtttcaatcgtggggaggcctgtggcagtcagctgttcatacacgggcaggttggccgtcgcttataagcagccaatccaccataacggcttcgtgtccaaggagttcagcatgcacgtgtgcatctttgagtgtgaatccacggggggctccgaatgggtactggagcaaaccatccacttagacgatctggtcaaggtcggcagcgttctggactcaagagtttccgtcgattcgaatttatttgtctatagtaagtcggacgcattgctctcgaaagatcggtacttaatcccaaacataaaacaccttgttcatttggactgggtatccaaggaagacgggtcccacattctcacagtgggcgttggcgcaaacatctttatgtacgggcggctgtctggcatcgtgacagagcagacaaactctaaggatggagttgcagtcattacccttcccttggggggcagcatcaagcagggagtgaagagccggtgggttttacttagatcaatcgatcttgttagcagtgtggatggaacaccgagcctgcctgtatcactctcctgggtcagggacggtattctggttgtaggtatggattgcgagatgcatgtctatgcccagtggaagcacgcagtgaaattcggtgatacagaggcagattcctctaacgccgaagaagcagccatgcaggaccattccacctttaagtcaaacatgctggcccgcaagtcggtggtagagggcaccgcgatttccgacgacgtcttttgcagtccaaccgtgattcaggatgggggactgttcgaggccgcccatgtcctgtcgccgacattacctcagtatcatcccacgcagcttttggaactgatggacttagggaaagtccggagggctaaagccatcctttctcatcttgtcaaatgcatcgctggggaggtagccatagtacgagatcccgatgccggagaaggtactaagcgccacctctctagaacaatttcagtgtcaggaagtaccgccaaggagaccgtcacagtcggtaaggacggaacgagggattataccgagatcgattctatccctccattacctttgtacgcgcttctcgccgcagatcaagacaccagttatagaatcagcgaagagagtaccaaaatcccgcagtcctacgaggatcagaccgtgagtcagcccgaggatcagtactcagagttattccagatacaggatattcctactgacgacatcgatttagaacccgaaaaacgcgaaaataaaagcaaggttatcaacctatcgcagtatgggcccgcatacttcggtcaagaacacgcgcgggttctatccagccatctgatgcacagctcgctccctggcctgaccagactggagcaaatgttcctcgtagctcttgctgacactgtagctaccacaagcaccgagctagacgaatcaagagacaaatcctgcagcgggagggatacccttgacgagtgcgggctgagatacttgctggccatgagactgcacacctgcctcctgaccagccttcctcccttgtatcgagtacagttgctgcatcagggcgtttccacttgtcactttgcctgggcgtttcactcggaagcggaggaggaactgattaacatgatcccagcgatccagagaggtgatcctcagtggtccgagttgcgcgccatgggcatcggctggtgggtgcgtaacatcaataccctccggcgctgtattgagaaagtcgctaaggcgagctttcagcgcaataacgacgctctggatgctgcattattttacctatccatgaaaaaaaaagccgtcgtgtgggggctctttaggagccagcacgacgagaaaatgaccactttcttttcacataatttcaacgaagatcgttggcggaaggcagcgctgaagaacgcattctccctgctgggcaaacaacgcttcgagcaatccgccgcatttttcctcctggctgggtcactgaaggacgcgattgaggtatgccttgaaaaaatggaggacatccagctggccatggtgatcgccagactctatgagagcgaattcgaaacaagctctacgtatatcagtattctcaaccagaagatcttggggtgtcaaaaggacggttccgggttctcctgtaagagactccaccctgatccttttctccgaagtcttgcctattgggtgatgaaagattacactcgtgctctcgacactctgcttgaacagacaccaaaggaggacgacgagcaccaggtgataataaagagctgtaatccagtcgcattctcgttttataactacctgcggactcacccactcctgatacgaaggaatctggccagcccagagggaacactggcaacactggggttaaagactgaaaagaacttcgttgacaaaatcaacctgattgagaggaagcttttctttacaaccgcaaatgcgcacttcaaggtgggctgcccagtcttggcactggaggtactttctaagatccccaaggtgactaaaactagtgcgctaagtgccaagaaggatcagcctgacttcattagtcacagaatggacgatgtgcccagtcactcaaaagcactttcggacggcaatggatctagtgggatcgagtggtccaacgttacatcctcccaatatgactggtctcagccaatcgtgaaggtagatgaagaaccactcaacctggattggggggaggaccacgacagtgccctggatgaggaggaagacgacgccgttgggttggtgatgaaaagcactgacgcccgagaaaaggacaagcaatctgaccagaaggcctccgaccctaacatgttattgactccacaggaagaagacgacccggagggggacacagaagtcgacgtcatcgcagaacagctgaagtttcgcgcgtgcctcaagatactgatgaccgagctcaggaccctggcgacggggtacgaagtagatggtgggaaactccggttccagctgtataattggctggagaaggagatcgccgcccttcacgagatttgcaaccatgaaagtgtcattaaggagtattccagcaaaacctactccaaggttgagagtgacctactggaccaggaagagatggtcgataagcctgatattggtagttacgagagacaccaaattgagcggcgtcgactgcaggctaaaagagagcacgccgaacggcgcaagtcctggttgcaaaagaatcaggatttgctgagggtgtttcttagttattgctcccttcatggtgctcagggcgggggcctggcaagcgtacgcatggaactgaaattcctgttgcaggagagccaacaggagaccactgtgaaacagttgcaatctcctctaccccttcccacaacccttccactgctgtctgcatccatcgccagtaccaaaacagtgatcgcgaatcccgtattgtatttgaacaatcatattcatgacatcctgtataccatcgtccaaatgaagacacccccccacccaagtatcgaggacgtgaaagtgcacaccctacactcccttgccgcaagcctgtccgcgtccatttatcaagctctgtgtgatagccactcatacagccaaacagagggaaaccagttcaccggcatggcctaccaaggactgttgctgtctgacaggcgccgactccgcacagagtctattgaggaacacgctactcccaattccagtccagcccagtggccaggtgttagttcgttgataaacttgttgtcatccgcacaagacgaagaccagccgaagcttaacattctgctgtgcgaggcagtggttgccgtgtatctctccctgttgattcacgccctggcgaccaattcctcctccgagcttttccgcttggcagctcatccattgaacaacaggatgtgggccgctgtctttggtggaggagtgaagctagtcgtgaagccgcgcagacagtccgaaaacatcagcgcgccaccagttctttcagaggatattgataaacaccgtagacgttttaacatgcgcatgctggtgccaggtaggcctgttaaagacgcaacacccccaccggtcccagctgaacgcccctcctacaaggagaagtttataccccccgaactgagtatgtgggattatttcgtggcgaaaccttttctgccactctccgactccggagttatatatgacagcgacgaatcaatacactccgacgaggaggacgacgctttcttcagcgacacccaaatccaggaacatcaggaccccaattcttactcctgggccctgctgcacctcaccatggtcaagctggccctgcacaatgtgaagaatttcttcccaatcgccgggctggagttcagcgaacttccagtgacttccccgttggggattgcagtgatcaagaatctcgagaactgggaacagattttacaagagaaaatggatcaatttgaaggtccccccccaaattacattaacacctacccaacagacttatcagtcggcgcaggcccagctatcctgagaaacaaggccatgctcgaaccagagaatacccctttcaagtcacgagactctagtgcttttcccgtgaaacgactgtggcactttctggtcaaacaggaggtcttacaggagacctttatccgctatattttcactaagaaacgcaaacagagtgaggtggaagccgacttaggatatcctgggggtaaggcgaaagttattcataaagaatctgatatgataatggccttctccgttaataaggctaactgcaatgagatagtcttggcctccacccacgatgttcaggaactggatgtcacgtcactgcttgcctgccagagctacatttggatcggagaagagtatgatagagagtcgaagtcaagcgatgatgtcgattaccgcgggtctacgactacactataccagccaagtgctacctcttacagcgcctcccaggtacaccctccgagttccctgccctggctcgggacaggccagacatccacaggcgctagtgtgcttatgaagcgcaatcttcataacgtgaaacgaatgacttctcaccccgtacaccagtattatctcacaggtgcccaggatggatccgttcggatgtttgaatggacccgccctcaacagctcgtgtgtttccgccaggctggcaacgcgcgcgtgacccgactgtactttaattctcagggcaacaagtgcggtgtcgcagatggagagggattcttatcaatctggcaagtgaatcaaacagccagtaaccccaagccatacatgagctggcaatgtcactcgaaggccacctccgacttcgccttcataaccagtagtagcctggtcgcaacttctggccactccaacgataacagaaatgtgtgtctgtgggacactctgatatctcccggaaacagcctgattcacggattcacatgtcacgatcacggtgcgaccgtcttgcagtatgcccccaaacagcagttactgatttctggcggcaggaagggccacgtttgcatcttcgacatcaggcagcggcaactgattcacacatttcaagcgcacgactccgccatcaaggctctcgcactagacccctatgaggagtactttacaaccgggagcgccgaaggaaacattaaggtatggaggttgacaggtcacggactaatacatagcttcaaaagtgaacacgccaagcagtccatctttcgcaatattggtgcaggagtgatgcagattgatatcattcagggaaaccggctcttctcatgcggggctgatggtacactgaagacgcgcgtgctgcccaacgcattcaacattcctaatcgaatactggacattttgtag

SEQ ID NO: 185641 - DNA, 1809 bp, Artificial Sequence
  Description of Artificial Sequence: Synthetic coding sequence
atgtgggactacttcgtggccaagcccttcctgcccctgagcgacagtggagtgatctatgactcagacgaaagcatacacagtgacgaagaagatgacgccttcttctctgacactcaaattcaggagcaccaggacccaaactcatactcatgggcccttctgcatctgactatggtcaaactggccctgcacaatgtcaaaaatttcttcccaatcgctggcctcgagttcagtgagctgccagtcacttcaccactcggaatcgccgtgattaagaatctggaaaattgggagcaaatcctgcaagaaaagatggatcagtttgaagggccaccaccgaactacatcaatacatacccaacagatctgtccgtcggagccgggcctgctatcctcaggaacaaagctatgctcgaaccagaaaatacacctttcaagagtcgggactcaagtgcattcccagtcaagcgcctctggcacttccttgtgaaacaggaagtccttcaagaaacattcattaggtacatttttactaaaaaaagaaaacaatccgagtctatcgaggaacacgtggagcaggtcaaccaaaactgcatcgccgaagactgccatatcaaagtggaagcagatctgggctatcccggaggaaaggcgaaggtcatccacaaggagtctgacatgatcatggcttttagtgtgaacaaggcaaattgcaatgagattgtactagcctctactcatgacgtccaggaactcgatgtcacatccctgctggcctgtcaatcctacatttggatcggcgaagaatatgatcgtgagtccaaatccagtgacgacgtagactacagaggttctacaaccaccctttaccagccctcagccacctcatatagcgcttcgcaggttcacccccccagctccctgccctggctgggtacggggcagacgtcaacgggagccagcgtgttgatgaagcgcaatctgcataatgtgaaaaggatgacctcccaccccgttcaccaatactacctgactggcgctcaagatggctctgtgcgaatgtttgagtggactcgccctcagcagcttgtgtgcttcaggcaggcaggtaacgcgcgggtcactaggttatactttaatagccaggggaacaaatgtggagtagctgacggggaaggctttctgagcatttggcaggttaaccagaccgcgtccaatcccaagccatacatgagttggcagtgccactcgaaagccaccagcgactttgcattcattacatcctcgtcccttgtggctacatcaggccacagcaatgacaataggaatgtctgtctctgggacaccctcatttcaccaggaaattctctgattcacgggtttacatgccacgaccacggggccactgtgcttcaatacgctcctaagcagcagctgctgatctcgggaggacgaaaggggcacgtgtgtatattcgacatcaggcagaggcagcttatccatactttccaagctcacgactctgctatcaaggccctagcccttgacccctacgaagaatattttactacaggtagcgcagaggggaacataaaggtgtggagactaactggacacgggctgattcattccttcaagagcgaacacgctaagcaatccatttttagaaacatcggggccggagtgatgcagatagatatcattcaggggaatcggttgttttcatgcggggccgacggtaccctgaagacacgtgttttgcctaacgcattcaacattcctaatagaatactggatatcttatag

SEQ ID NO: 185642 - DNA, 7203 bp, Artificial Sequence
  Description of Artificial Sequence: Synthetic coding sequence
atgcacctgcaccaggtgctgaccggcgccgtgaaccccggcgacaactgttattccgtgggtagcgtgggtgatgtgcctttcaccgcttatggatctggatgcgacatcgttatccttgccaatgactttgagtgtgtacagatcatccccggagcaaaacacggaaatatacaggtgagctgcgtcgagtgtagtaatcaacaagggcgcatcgcggcatcatatggtaacgcagtgtgtatcttcgagcctctgggcatcaactcccacaagcgtaactgtcagctgaaatgccagtggcttaagacagggcagttctttctttcatctgtgacttacaacttggcctgggacccacaggataacagactcctgaccgccacagatagtatccagctttgggcccccccaggcgatgacatcttggaagaggaggaagagatcgataatacagtgcccccagtgttaaatgattggaagtgcgtctggcagtgtaagacctcggtgagcgtgcacttgatggagtggagcccagacggtgaatatttcgcaaccgccggcaaggacgactgcttgctgaaagtctggtaccctatgaccggttggaaatcatcgatcattcctcaagaccaccacgaagtgaagaggcgacagagttctactcaattttcttttgtctatttagcccatcctcgggctgtcaccggattctcctggaggaaaacttcgaaatatatgcccagaggctcggtctgcaatgtactgcttacctcctgccatgatggcgtttgtagattgtgggcagaaacactcctgcctgaagattgcctgctcggggagcagatctgcgaaactacaacgtcgagtattgcatccagtctatcccatgcgggaaggcataaggatcggatccaacacgctttggaaactatacaccacctgaagaatctcaggaaaggccagaggcgctcctccgtcctggtaacgcacgccgagttgatgcccgatcagacagccatgcatgaagttcagcgtcatatttcacatcatgccaacgctctgtgtcatttccacatcgcagcgtccattaatcctgccaccgatattcccaacgttctggttgggaccgcgttcaacgtggatgatggaaacggcggctttgttgtgcactggctgaacaataaagaattccactttacttcaagcacggaggtttttatgcaccagctcagaaagcttagtgacaagcaggtcgatcatgagaacgatgatgccgaccgcgaggacgaggaacactctcaagaggaccgggagagaggcctccatatgaagttggatcacgatttgtctttagatcgcgagtcagaagccggcaccgggtcatccgagcatgaagacggggagagagagggtagcccccggacttatagccgcctttccgtgccaatgcctctgccaacagttctgctggatcgtaagatcgaaaccctgctgacagaatggaacaagaaccctgacatgctatttaccatccaccccgtggacggtacttttcttgtgtggcatgtcaaatacctcgacgaatacaaccccgggatttttaggcaggtgcaggtgtccttttcctcccgcatacctgtagcattccctagcggagatgccagttctctgtctaaaaatattatgatgtacgcctgcatcaatgctaccaaggattcacaccacaccctgctccaccaggaaggaatgtcagtgggaagcccacatggatctcagccacactccagaagccatagcacccacatgaacatcctcgcacctacagtcatgatgatatcaaagcacatcgatggatcattgaatcagtgggctgttacattcgccgacaaaagcgcctttacgacagtgcttaccgttagccataaattccgctactgcggccaccgtttccacctgaatgaccttgcctgtcattccgttctacccctgctgctaaccagcagtcaccacaacgccctgctgacccctgagctggattgccagtgggactccgataacaagttgagcaggctgatggatcctgttaagcacatcaagggctcctccaaacaaccactgcggaacgccgccacgaggacttttcacgatccgaatgcaatctattccgaattaatcttgtggcgggttgaccccatcggccccctttcatacacaggcggagtgtctgaattggctcggatcaatagcctgcacacctctgctttttccaatgtagcctggctgcccacactcataccttcatactgtctcggaacatactgcaattctgcctccgcctgcttcgtagcttccgatgggaagaatctcagactttaccaagcggtcgtggacgctcgaaagttgctcgacgagctgagtgaccctgagtccagtaaactgataggggaagtctttaatattgtcagccaacagagcactgcacgcccggggtgtatcatcgagctagacgccataaccaaccagtgtggatcgaacacacagctattgcacgtattccaagaagactttataatagggtacaaacctcataaggaggatatggagaaaaaggagactgagatatttttccagccatcccagggctatagacccccgccattcagcgagaaattcttcttggtggtcatagagaaagacagtaacaataactccattcttcacatgtggcatctgcacctgaaatctgtccaagcatgcctaggtcgggataccttggacgagtgcggcctgcggtacctgcttgctatgagattgcatacatgcctgctgaccagccttcctcccctctatcgcgtacaattgcttcatcagggtgtttcaacgtgtcattttgcttgggccttccattcagaagccgaagaggaattgatcaacatgatcccagccatccagcgcggagatccacagtggtcagaactccgggccatggggatcggttggtgggtcagaaatataaacacattgcggcggtgtatcgagaaagtggctaaggcgtccttccaacgcaataacgatgcactcgacgcggccctcttctaccttagcatgaagaagaaagcagtcgtctggggtcttttccgctctcagcatgatgagaagatgacaacttttttttcacataactttaacgaggatagatggcggaaggccgccctgaaaaacgccttttctttacttggtaaacaacggttcgaacagtcagcagcattttttctactggctggctccctcaaggatgccatcgaggtatgtttggaaaaaatggaggacatccagctggctatggtgattgcaaggttgtatgagagcgagttcgagacctcctcaacctacatctcaattctgaaccagaaaattttgggctgccagaaggacgggtctgggttcagctgcaaacgcttacacccagatccatttcttcgctccctagcctactgggtgatgaaggactacacgcgcgcactggatacgcttctggaacagactccgaaagaggacgatgagcatcaggtcatcattaaatcttgtaacccagtagccttcagtttttataactaccttcgaacccaccctctgctgatcaggcggaacctggcctccccggaagggaccctagctacattaggtcttaaaaccgagaagaatttcgtcgacaaaatcaatctgattgagcgaaaattgttttttacaacagctaatgcccattttaaagttggctgccctgtcttagctcttgaggtcttaagcaaaatccccaaagttacaaagacatctgccctttccgccaagaaggatcagccagactttatttctcacagaatggacgatgttccaagtcatagtaaggctctgtcagacggaaacggctcctctggcatcgagtggagtaacgtgacttccagtcagtacgattggtcgcagcccatagttaaagtggacgaagagcccctgaatctagactggggagaagaccacgattctgctctcgacgaagaggaagacgatgctgtaggcttagtgatgaagtcaacggacgcccgcgaaaaggataaacagagcgaccagaaagcctctgatcccaacatgctcctgaccccccaagaggaggatgacccagaaggcgataccgaagtggatgtgatagctgagcagttgaagttcagagcctgtctcaagatacttatgacagaactgcgaaccttggctacaggatacgaggttgacggagggaagctgcggttccagctgtacaattggctggaaaaagaaattgctgccctgcacgagatctgtaaccacgagagcgtgattaaggagtacagctctaagacatacagcaaggtcgagagcgatctcctggaccaggaagagatggtggataagcccgacatcggatcttacgagcggcaccagatcgagcgacgcaggttgcaagccaaaagagaacacgctgagcggaggaagtcctggcttcagaaaaatcaggatctgttacgcgtcttcctaagttattgttccctccatggtgctcaggggggtggactggccagcgtccgcatggagttgaaatttctcctccaagagtcccagcaggaaaccacagtgaaacagttacagtcccccttgccattaccaaccacacttcctctcctgtccgcttcaatcgcatctaccaaaacagtaatagccaacccggtgctttatctgaacaatcatatacacgacatcttatatactatagtacagatgaagacaccccctcatccatctattgaggacgtcaaagtgcatactctgcactccctggctgctagcctgtctgcttctatttatcaagcactgtgcgacagccattcctactcacagaccgaggggaatcagtttactggcatggcttaccagggcctgctcctcagtgatagacggcggctcaggaccgagagtattgaggaacatgctacgcctaacagtagccccgcccaatggcctggggtgtcatcacttataaacttactgtcctccgctcaggacgaagaccagccaaaactgaatatcttgctatgcgaggccgtggtcgccgtatatctgtcgttgctgattcatgctctggccactaactcttcctcggagttgtttcgcctggctgcacacccgctgaataaccgcatgtgggctgccgtttttggtggaggggtcaaactcgtggtgaagccaagaaggcagtctgaaaacatctccgctcctcccgtgctttccgaagatatcgataaacaccggcgtcggttcaatatgcgtatgctggtcccaggtcgccccgtcaaagacgcaaccccacctcccgttcctgccgaaaggccctcgtacaaggagaaattcataccaccagagctgtccatgtgggactactttgtagctaagccgttcctgccacttagcgacagcggcgtaatctacgactctgatgagtcaatccactccgacgaagaagacgacgccttcttctccgatacgcaaatccaggagcatcaggatcctaactcttatagttgggccctgttgcatctcaccatggtaaaactggctttgcataatgtcaaaaacttttttcctatagctgggttggaattttccgaacttcccgtcaccagcccattgggcatagccgtaatcaagaatctcgagaattgggagcagattcttcaggagaaaatggaccagttcgaggggccccctcccaactacatcaacacgtatcctacagatttatcagtcggcgcaggcccggcaatcctgcggaataaagccatgctggagccagaaaatactccctttaagagccgagactcatccgcgttccccgttaagagactgtggcacttcctcgtgaagcaggaggtattgcaggaaacttttattcggtacatttttacaaagaagcgtaaacagagcgaggttgaggctgatttagggtatcccggtgggaaggccaaggtgattcacaaggagagtgacatgataatggcattctccgtgaacaaggccaactgtaatgaaatagtacttgcttctacacatgatgtgcaggaattggacgtgacatcgcttcttgcatgccaatcatatatatggattggggaagagtatgaccgcgagtccaagtcaagtgacgatgtagactaccgcgggtccactacaacactatatcagccaagcgcaactagctattctgcatctcaagtacaccccccaagctcgctgccttggctggggaccggccagacgagcactggggcttctgtgctgatgaaacgcaacctgcacaacgtgaaacgcatgacgtctcacccagtgcatcagtactacctaacaggagcccaggacgggagtgtcagaatgttcgaatggacccggccacagcaattagtctgcttcagacaggcaggcaatgcccgggttactagattgtactttaactcccaggggaacaagtgcggagttgcagatggcgagggctttctctccatttggcaagtgaaccagacagcctctaatcctaagccttatatgagctggcagtgtcactctaaagccacatccgatttcgcctttattacgtcgtcatccctggttgcgacaagcggccactcaaatgacaacaggaacgtgtgtctatgggacaccctgattagccccgggaacagcctgatacacggattcacatgccacgaccatggggctacggtgctccaatacgcacctaagcagcagctccttatttctggtggccgtaaggggcacgtttgcatatttgatatccggcagaggcagctgatccacaccttccaggcccacgactcagcaattaaggcgctcgcgctggacccttacgaggagtacttcactactggctctgccgagggcaatatcaaagtctggagactgacaggccacggtctgattcactccttcaaatctgaacatgcgaaacagtctatctttcgaaatatcggcgcgggtgtaatgcaaatcgacatcattcaggggaatcgccttttttcgtgtggcgcagacggtacattgaagaccagagtcctacccaacgccttcaatatccctaatcggatccttgatattctctag

SEQ ID NO: 185643 - DNA, 9114 bp, Artificial Sequence
  Description of Artificial Sequence: Synthetic coding sequence
atgcacctgcaccaggtgctgaccggcgccgtgaaccccggcgacaattgctactccgtgggctcagtcggggatgtccccttcaccgcatacggtagtggctgcgatatcgttatcctagcaaacgactttgagtgcgtgcaaataataccgggagctaaacacggaaacatccaggttagctgcgtagaatgcagcaatcaacaaggtcgtattgctgccagctacggtaacgcagtttgtatattcgagcctctgggtataaatagccataaaagaaactgtcagctgaaatgccagtggctgaagaccggtcagttttttctcagtagcgtcacttataatctggcctgggacccccaagacaatcggttgttaaccgcaaccgacagtatccaactgtgggctccccctggggacgacatcctggaggaagaggaggagatcgataataccgtgccaccagtactgaacgattggaaatgcgtgtggcagtgcaagacaagtgtgagcgtgcatctgatggagtggagtccagatggtgaatactttgcaacggcaggaaaggatgactgcctcctgaaagtctggtaccccatgaccggttggaagagctctatcattccgcaggatcatcatgaggtaaaacggcggcaatcatccacacagttttcttttgtatatctggcacacccaagagctgtcaccggattctcttggcgcaagacctctaaatacatgccaagaggctctgtgtgcaatgtcctcttgaccagttgtcatgatggtgtctgtcggctgtgggctgaaactctgctccccgaagattgtctgcttggcgaacagatttgtgagactacgaccagctccatcgccagtagcctgtcccatgctggacgtcacaaggatagaatccaacacgccctcgagactatccaccatctgaagaatctcagaaaggggcaacggagaagcagcgtacttgttacacacgcggaactaatgccagatcagacggccatgcatgaggttcagcgacacatctctcatcacgccaacgctttatgccactttcatatagccgcttcaataaaccctgccaccgatatccctaacgtattggtaggcactgccttcaacgtggacgacggcaatggggggttcgttgtgcactggctcaacaacaaggaattccacttcacgagtagcaccgaagtatttatgcaccagctgcggaaattgagtgataaacaggtcgatcacgaaaatgacgacgctgacagagaggatgaagagcattcccaggaagatcgcgaacgcggactccacatgaagctagaccatgacctgtccttggatcgagagtccgaggctgggacggggtcgtccgagcacgaggatggagagagagagggctccccaaggacatactcaaggttgtcagtgcccatgcccctgccaacagtactgttggataggaagattgaaactctcctgactgaatggaacaaaaaccccgacatgctttttacaatccatccagttgatggcacctttctggtttggcacgtaaaatatttggacgaatataatcccggcatatttcgacaagtacaggtcagtttttcttccagaatccccgtagcgtttccaagtggtgatgccagctctttgtcaaagaacatcatgatgtacgcatgcattaatgccaccaaggattcacaccacactctgttacatcaggaagggatgagcgtggggtcaccgcatggctcccaaccccacagccggagccattccacccacatgaacattttggcaccaaccgtgatgatgatcagcaaacacattgatggaagcctgaaccagtgggcagtgacgttcgcagacaagtccgctttcacaactgtgctgacagtctcgcacaaatttaggtactgcggccacaggttccatctcaacgacctggcctgtcactcagttctgccattgcttctgacttcctcccatcacaacgcactactgacaccagaactggactgtcaatgggactccgataataagttgtctagactgatggatcccgtgaagcacatcaaaggatcctccaagcagcctctgcgtaacgcagcaactagaactttccatgatcctaatgccatctatagcgagttaatcctctggcgggtggaccctatcggcccactttcatataccgggggcgtctctgaacttgcacgtatcaatagcctgcatacaagcgccttttccaacgtagcctggctcccaaccctgattccctcctactgcctggggacgtactgcaacagtgcaagcgcatgctttgtggcttctgatggaaagaatctgagactttaccaggctgtggtggatgccagaaagctcctagatgaacttagcgaccctgagtcctccaagttgataggcgaggtgttcaacatcgtctcacagcagtcaacagcccggcctggatgcattatcgagctggacgcgatcaccaatcagtgtggttcaaatacacagctacttcacgtgttccaggaggacttcatcatcggctacaagccgcataaggaggacatggaaaagaaggaaacagagatcttcttccagcccagccaaggatatcgcccccctccgttctcagaaaaatttttcctcgtggttatcgagaaggacagcaataacaattccatactacacatgtggcacctgcacctgaagtcggtgcaagcttgtctggctaaagccagtgagggtgcctctagcgagtctttactgtctgttccaggtcaaaaaaatgtggactcctctccagagacctccccgtccgtaagtccgatgccccacagttcatctatagcgaacttgcagaccgcctctaaattgattttgtcctcacgcttggtctacagccaaccgctcgacttgccggaatccgtggaagtgatccgggccacgcccagcgcgggtcacttgtctagcagctccatataccctgtctgtttggctccctacttagtggttacgacttgttccgacaataaagtccggttctggaaatgttgtatggaagccaatcctgagtgtaataagtcagacgagaaagagatttaccattggaagcggtggcctctaatgaacgacgaaggggaggataattccagcactgttagtatcgtgggccgcccggtggccgtgagctgcagctacaccggaagactagccgtggcttacaaacaacccatccaccataatgggtttgtgtcaaaagagtttagcatgcatgtatgcatttttgaatgcgaatctactggtgggagcgagtgggtgttggagcagactatccatcttgacgatctggtcaaggtcggatccgtcctggactctagagtgtctgttgattctaatctgtttgtgtatagcaaatcggacgccttacttagcaaagatcgatatctcatcccgaatatcaagcatctcgtgcatcttgactgggtcagcaaggaagatggttctcacattctgacagtcggcgtaggcgctaatatcttcatgtatgggagattaagcgggatagtgacggagcaaactaactcaaaagatggggttgcagtgatcacactacctctgggaggaagtatcaaacagggggttaagagcagatgggtattactccggtccattgatctggtttccagtgtggacggtacaccctcccttccagttagtctaagctgggtccgggatgggatcctggtggtgggcatggactgcgagatgcacgtctatgcacagtggaagcatgccgttaaatttggagacaccgaggcggactccagcaacgccgaggaagcagccatgcaagaccattccacattcaagtccaacatgttagcaagaaagagtgtggtcgaagggacagccattagcgatgatgtgttctgcagtccaactgttattcaggacggcggcctgttcgaagcggcacacgtactgagcccgaccctgccacagtaccatccgactcaactgctcgagctgatggacttggggaaggttcgccgcgcgaaggcgattttgtctcacttggtgaagtgcatcgccggtgaggtggcaatcgtgagggaccctgacgccggtgaggggacgaaacggcacttatcacggacaatctccgtcagcggatctacagcaaaagagacagtcacagtgggcaaggacggcacgcgggactacacagaaattgactcaatccctcctctccccctttacgcacttctcgcagctgaccaggacaccagctacaggatctctgaagaatctactaagatacctcagtcttacgaagatcagaccgtgtctcagcctgaagaccagtactccgagctgtttcaaatccaagatatacctaccgatgacattgacctcgagcccgagaagcgagagaacaagtctaaggtcatcaacctgtcgcagtacgggccggcttactttggtcaggaacatgccagggtgctctcctcccacttaatgcacagctctttgcccggcctgactaggctggagcaaatgtttctagtggcactcgcagatacagtcgcaaccaccagcaccgaactggatgagtcacgcgacaagagctgctcaggcagagacactctagatgagtgcggcttgaggtacttactcgccatgcggctgcacacttgcctgctgacttctctgccgcccctataccgcgttcaacttctacatcagggcgtctctacttgccatttcgcctgggcgtttcacagcgaggctgaagaagaacttattaacatgatccccgccatacagagaggcgaccctcaatggtccgagctgcgagctatgggtatcggttggtgggtccgtaacatcaacaccctccggcgatgtatcgaaaaggttgcgaaggcctccttccagcgtaataatgatgcgttagatgctgcccttttctatctgtcgatgaagaaaaaggcagtcgtgtggggactgtttcgcagccagcacgatgagaaaatgaccacgtttttttctcataactttaacgaagaccgttggcgcaaagccgcgctgaaaaatgcattttcccttctcggtaagcagcgctttgagcagtcagctgccttctttttactggcaggcagtctgaaagacgctatcgaagtctgtcttgagaagatggaagatattcagctggccatggtcatcgctcgcctctacgaatcagaattcgagacaagtagcacctacattagtatccttaatcagaaaattctcggctgtcagaaagacggttctggattctcctgcaagaggcttcacccagacccatttctccggagtttagcctattgggtgatgaaggattatactcgcgcgttggacacactgttagagcagaccccgaaagaagacgatgaacatcaggttatcataaagtcttgcaatccagtggctttcagtttttacaattaccttagaacgcatcccttactgattagacgcaacctggcatctccagagggaaccttagctaccctgggcctgaaaacagagaagaattttgtcgacaagattaacctgatcgaacggaagctgtttttcacaaccgctaacgcccacttcaaggtcgggtgtccagtccttgccctggaagtcctttcgaaaatccccaaggtcactaagacctcagcactcagtgcgaaaaaagaccaaccagatttcattagtcatagaatggatgatgtgccctctcactctaaggctttatctgacggcaacgggtcaagtggaatcgaatggagtaatgtgacctcttcccagtacgactggagccagccaattgttaaagtggatgaggaaccactgaacctggattggggagaagatcacgactccgcactggatgaagaagaagacgatgccgtcggtttagtgatgaagagtactgatgcgcgggagaaagataagcaaagcgaccagaaagcctccgatccgaacatgttgctcactccccaggaggaagatgatccagagggggacactgaggttgatgtcatcgccgaacagttgaagtttcgcgcctgtttgaaaattctcatgaccgagctgcgaacgctcgcaacaggttatgaggtcgacggtggcaaactccgattccaattatataactggctggagaaagagatcgccgcattgcacgagatttgtaatcacgaatcagtcattaaagagtattcaagtaagacctatagcaaagttgagagcgacctgctcgaccaagaagaaatggtggataagcctgacatcggatcttatgaacggcaccagatcgaacgaaggcgtttacaggctaagagggagcacgccgagaggagaaaaagttggctgcagaagaaccaagatcttttgagagtgtttctctcttattgcagtctgcatggagcacagggcggcggtttggcctctgtgcgaatggagcttaaatttctgttacaagaaagtcagcaagaaacaactgtgaagcaattgcagtctcctttgcctttaccaaccacccttcctctgctgtctgcaagcatcgcctccacgaaaacggtgattgctaaccccgtgctttatctaaataatcacattcacgatatactgtatacgattgtgcagatgaaaacccctcctcatccttctatcgaggacgtcaaggtccataccctgcactcgctcgccgctagcttatcagccagtatataccaagctctatgcgacagccactcctactcctcacaaaccgagggcaaccagttcactggtatggcctaccaagggttgctcctttctgataggagacgcctcaggaccgaatcaatcgaggagcatgcaacccccaacagttcacctgcacagtggcccggagtgtcctctctgatcaacttactttcaagtgcacaagatgaggatcaacctaagctgaacatcctgctatgtgaggccgtcgtagccgtgtacctatcccttctcatacatgcgctggctaccaattccagcagtgagctctttcgcctggccgcacaccccttgaacaataggatgtgggctgcggtgtttggcggcggcgtgaaattagtagtaaagccacggcgacagtcagaaaacatctcagcccccccagtcctcagtgaggacatcgataaacatcgacgccggtttaatatgcgcatgttggtgcctgggagacctgtgaaggacgcaacaccaccaccggtccccgctgaacgcccctcctataaagaaaaattcattccgcctgagctgagcatgtgggactactttgtggcaaagccgtttctcccactaagtgactcaggagtaatctacgacagcgacgagagcatccattccgacgaggaagacgatgctttcttctctgatacgcagatccaggaacaccaggacccaaacagttactcttgggccctgctgcatctgaccatggtcaaactggctctgcacaacgtcaagaacttcttccccattgcaggtttggagttcagtgagttacccgtcacttctccactaggcatcgctgttattaagaacttagagaattgggagcaaatactccaggagaaaatggatcagtttgagggcccccccccaaattatataaacacctatccaactgacctatctgttggagcgggcccagcaatcctccgcaataaagccatgctggagcccgaaaatacacctttcaagtctagggacagctccgccttccccgtaaaacggctgtggcacttcttagtaaaacaagaagtattgcaggaaaccttcattagatatatttttacaaagaaacggaagcagagcgaggtagaagccgacctggggtatcctggtgggaaagccaaagttatccacaaagagtccgatatgattatggcattttccgtcaataaggccaattgcaatgaaatcgtacttgcgtctacacacgatgtccaggagctggacgtgacctcactgctggcgtgccagtcttatatttggattggagaagagtatgatagagaaagcaaatccagtgacgatgttgattataggggttccaccactactttatatcaacccagcgccacctcttattccgcctcgcaggtgcatccaccgagttccctaccgtggttgggcactggccagaccagcacaggcgccagcgtgctgatgaaaaggaacctccataacgtcaagaggatgacaagtcacccagtgcaccagtattatctaactggtgcccaggacggaagcgtgagaatgttcgagtggacccggccccagcagcttgtgtgtttccgacaagcaggaaatgctagggttacgcgcttgtacttcaacagccagggaaacaagtgtggcgtggcagatggagaagggtttttgagcatatggcaggttaaccagacggccagcaaccccaaaccttatatgtcttggcaatgccatagcaaggctacgtccgattttgcttttattacctcctcaagcctggtcgccacctcaggacacagcaatgacaaccgcaatgtgtgcctgtgggacacactgatctccccaggcaacagccttatacatggatttacatgtcacgatcatggcgcgaccgtgctgcagtacgccccaaagcagcagttgctgatcagtggaggacgaaagggccatgtgtgtatttttgacatccggcagaggcagcttatccacaccttccaagcacatgacagtgccatcaaagctctcgcacttgatccctatgaggaatactttaccaccgggagcgccgagggcaatatcaaggtttggagactgacaggtcatggcctcattcacagctttaagtcagagcacgcgaaacaaagtattttccgaaacatcggggccggggtcatgcaaatcgacattatccagggcaataggcttttctcctgtggtgcagacggaacactgaagactcgagtgttgcctaatgcgttcaatattcccaaccgcatcctggacattctgtag

SEQ ID NO: 185644 - DNA, 4851 bp, Artificial Sequence
  Description of Artificial Sequence: Synthetic coding sequence
atgcccgcccggaccgcccccgcccgggtgcccaccctggccgtgccagccatctccctgccagacgacgttaggagaagactgaaagatctggagcgcgactccctgactgagaaagaatgtgttaaggaaaaattaaacctgctgcacgagtttctgcagactgagattaaaaaccagctttgcgacctggagacgaaactcaggaaggaggaactttctgaagagggttatcttgccaaagtgaaatcactgcttaacaaggacctgtcgctcgagaacggagctcatgcatataaccgggaggtgaacggccggctggaaaacggtaaccaggcacgctcagaggcacggagagtcggtatggccgatgcgaacagtccccccaagccactctcgaagccccggactccaagacgcagcaagtctgacggtgaggcaaagccggagcctagcccaagcccccggattacccgaaaatctacgcgccagactacaattacaagtcattttgcaaagggtccggctaagagaaaaccgcaggaggaaagcgagagagctaagtcagacgaatcaattaaagaggaagacaaggaccaggatgaaaaaaggaggcgcgtcacttcaagagagagggtagccaggccactgcctgccgaggagcccgaacgggccaaatctggcactcggacagagaaagaagaagagcgcgatgagaaagaggaaaagcgcctgcggtcgcaaactaaggagcccacacccaagcaaaaactgaaagaagagccagatcgggaagcccgggcaggggtacaggccgatgaggacgaggacggcgacgaaaaagacgaaaaaaagcaccggagtcagcccaaagacctggcggcaaaaagacgccccgaagaaaaggaaccagagaaagtcaatccccagatttcagacgagaaagacgaagacgagaaagaagagaaaaggcgaaaaacaaccccaaaagaacccaccgagaagaaaatggcccgggcaaagaccgtcatgaactcaaagacccacccgccgaagtgtatccagtgtggccagtatctcgacgacccggacctgaaatatggtcagcacccaccagatgccgtcgacgaaccccagatgctgaccaacgaaaagctgtccattttcgatgctaacgagtcagggttcgaaagttatgaagccctgcctcagcacaaactgacctgcttctccgtgtattgtaagcacgggcatttatgtcccatcgacactgggctcattgaaaagaatattgagctgtttttctccggctccgccaagcctatatacgacgacgacccctcactggaaggtggcgtcaatggaaagaatctcggacctatcaacgagtggtggatcacgggttttgatggcggtgaaaaagcactgattggtttttctacatccttcgctgaatacattcttatggacccaagccccgagtacgctcctatatttgggctcatgcaggagaaaatctacataagtaagatcgtggttgagttcctccagagtaattctgactcaacttacgaagatttgattaataagatcgaaaccaccgtgcctccttcagggctcaacctcaatcgattcacggaagattctcttttgcgacacgcccagtttgtggtggaacaggtcgaaagttatgacgaggccggagattccgacgaacagccgatcttcctgacaccatgtatgagggacctcattaagctcgctggtgttacccttggtcagagacgggcgcaggcccggcggcagaccatccggcactcgactcgggaaaaggaccgagggccaaccaaggccacgacaactaaactggtataccagatctttgatactttttttgcagagcagatcgagaaggacgacagggaggataaagagaatgcttttaagagaagacgttgcggcgtgtgcgaagtctgtcagcaacctgaatgcggcaaatgtaaagcatgcaaagacatggtcaagtttgggggatctggccgctctaagcaagcctgtcaagaacggagatgtcccaatatggccatgaaggaagctgacgatgatgaagaagtggacgacaatatcccagaaatgcccagccccaagaaaatgcatcaggggaagaagaaaaaacagaacaaaaatcggatttcttgggttggtgaggctgttaagacagacggaaagaagtcttattacaagaaggtctgcatcgacgcagagaccctggaggtcggagactgcgtctctgtcattccagatgactcgagtaaacccctctacctggcaagggtgacagctctgtgggaggacagttccaacgggcaaatgttccatgcacactggttttgcgccggtactgatacagtgttgggcgcgacttcagatccgctcgagctgttcttagtcgacgaatgtgaggacatgcagttgtcttatatccactctaaagtcaaggtgatttataaggcaccaagtgagaactgggccatggaggggggtatggatcccgaatcactccttgaaggggatgacggcaaaacctacttttaccagctgtggtacgatcaggattacgcccggtttgagtcaccacctaagacacagcctacagaggacaacaaattcaagttttgcgtttcatgcgcccgtcttgcagaaatgcgccagaaggagataccaagagtgctcgaacagctagaggatttagactcacgcgtgctttactactcggccaccaaaaatggaattctgtaccgggtgggagatggcgtgtatttgcccccagaggcttttaccttcaacatcaagcttagcagtccagtgaagcggccccgaaaggaacccgttgacgaagacctttaccctgagcactacaggaagtactcagattatatcaaggggagcaatctggacgctcctgaaccctatagaattggcagaatcaaagaaattttctgccccaagaaatcgaatggccgacctaacgagaccgacattaagatccgcgtgaacaagttctatcggcccgaaaatactcataagagcactcctgcctcatatcacgccgacattaatctactgtactggtcggacgaagaggccgtggtcgattttaaagcagtccagggtagatgtacagttgagtatggggaagacctgcccgagtgcgtgcaggtctatagcatgggcggaccgaaccgtttttacttcttggaagcatataacgccaagagcaagtccttcgaagatccacccaatcatgcacgttctcctggtaacaaagggaaaggcaagggaaaaggcaaggggaagcctaagagtcaggcttgcgaaccaagtgagcccgagattgaaatcaagctccctaaactgcggaccctggacgtgtttagtgggtgcggtgggttgtctgagggcttccatcaggccggaatctccgatactctttgggccatcgagatgtgggacccagcagctcaggcttttcgcctcaataatcccggtagcaccgtctttaccgaagattgcaacatccttctgaagcttgtgatggctggcgaaacaaccaatagcaggggacagcgtctccctcagaagggcgacgttgagatgttgtgcgggggcccgccatgtcagggcttctccggaatgaatcggttcaatagccggacctatagtaaatttaagaatagcttggttgtaagcttcttgtcctactgcgactattataggccccgattttttctccttgaaaatgtacgaaattttgtgtctttcaagaggtcgatggtgctgaagctgacattgagatgtttagttaggatgggctaccaatgtacctttggggttctgcaggccggacagtacggcgtcgcccagacgcgaaggagggccatcatacttgctgcagcaccaggggagaagctaccactgtttcccgagccactccatgtattcgctccacgagcctgccagttgagtgtcgtcgtcgacgacaagaaattcgtgagcaatattacaaggctgagcagtggacccttcaggaccatcaccgttagagataccatgtcggacctgcctgaggtgaggaacggcgcatctgcactggagatctcgtataacggcgaaccgcagtcttggttccagcgccagctgcgaggcgcccagtaccagcccattctccgcgatcatatctgcaaagatatgagcgctttagtcgccgctcgaatgagacatatccctctcgccccaggctctgattggagggatctacctaacattgaggtgcgcctcagcgatggtactatggcaaggaaactccgctatactcatcatgatcgaaaaaacgggcgttcctcctccggcgccctacgcggcgtgtgctcttgcgtcgaagcgggcaaggcatgtgacccagcagctagacagttcaacacattgattccgtggtgtctcccccacaccgggaatcgccacaaccattgggccgggctgtacgggcgcctcgaatgggatggcttcttcagcaccacagtcactaatcctgaacccatgggaaaacagggtagagttcttcacccagagcaacatcgggttgtaagcgttcgcgaatgtgccagatcacaggggtttcccgatacttataggctgttcggtaacattcttgacaaacatcgccaagtcggcaacgcggtgccacccccactggcaaaggctatcggactcgaaataaaactatgtatgttggccaaggcaagagagtcagctagcgctaagataaaggaggaggaggcagcgaaagattag

SEQ ID NO: 185645 - DNA, 4899 bp, Artificial Sequence
  Description of Artificial Sequence: Synthetic coding sequence
atgcccgcccggaccgcccccgcccgggtgcccaccctggccgtgccagcaatttccctgcccgacgacgtgaggaggcgcttgaaagatttagaacgtgactccctaacagaaaaggaatgcgtgaaagagaaactgaatttgctgcacgagttcttacagacagagattaagaatcaactgtgcgacttggaaacgaaactgaggaaagaggagctgtccgaggaaggttatctggctaaagtaaagtccctgctgaataaggatctctcactggagaatggcgctcacgcgtataacagagaagtaaatgggaggcttgagaatggcaaccaggcaaggtctgaggctagaagggtaggaatggccgacgcaaactctcctcctaagcccctgagtaagccgagaacacctcggcgctcgaagagcgacggagaggctaaacgaagtcgggacccccctgcttctgcgtcgcaggtcactggcattcgcgccgagccttcacccagcccacgaattaccagaaaaagcactcgacagactactattaccagccactttgccaagggccctgccaagcgaaagccccaggaagagagcgagagggcgaaatccgacgagagtattaaagaggaggataaagaccaggatgagaagcggcgccgagtgactagtcgggaacgcgtggctcggccattgcccgccgaggagccggagagggccaagtccggcacgcgcactgaaaaggaggaagagcgcgatgagaaggaggagaaaagactcaggtctcagacgaaagagcccactcctaagcaaaagctgaaggaagagcccgaccgggaagcaagagctggcgtccaggccgacgaggacgaagacggcgatgaaaaagatgagaagaaacatcgaagccaacccaaagatctcgctgctaaacggaggccggaggagaaggagcctgagaaggtgaacccccaaatcagtgacgagaaggatgaggacgagaaggaagaaaaaaggagaaaaactacacccaaagaaccaacagaaaaaaagatggccagagcaaagacggtaatgaatagtaagacccatccgcccaaatgtatccagtgcgggcaatacttggatgacccggacctcaaatatgggcagcacccccccgacgctgtcgacgagcctcagatgctgacgaacgaaaagctgtccattttcgacgcaaacgagtccgggttcgagtcttatgaagcgttgccccagcataaactcacctgttttagcgtgtactgcaagcacggacacttgtgccccatcgacactgggttgattgaaaagaacatcgaattatttttcagtggaagcgcaaaacccatttatgatgatgaccctagtctggagggcggcgttaatgggaaaaatctgggtcctattaacgagtggtggatcacgggctttgacgggggtgaaaaggccctcatcggctttagcacatcatttgccgagtatattttaatggatcctagccctgaatatgctccaatcttcggactcatgcaggagaagatctacatctcaaaaatcgtggtggaattcttgcagagcaacagcgatagtacatacgaagatctgattaataagatcgagacgaccgtcccacccagtggcctgaatctgaacaggtttactgaggattcactgctgaggcacgcccaattcgttgttgaacaagtggagtcttatgacgaggccggtgactcagacgaacagccaatttttctcaccccatgcatgagagatctcatcaagttagcgggcgtgactctcgggcagcgtagagcacaagcacgccgacagacaattcggcactcaacccgagagaaagatcgaggacccacgaaggcaacaaccacgaagcttgtctaccagatcttcgataccttttttgccgagcagattgagaaggacgacagagaagacaaagagaatgcttttaagcgaagaaggtgtggtgtgtgtgaggtgtgccagcaaccagagtgcggcaagtgtaaggcttgtaaagacatggtcaagtttggcggcagcggtcggtcaaaacaggcatgtcaggaacggcggtgtcctaatatggctatgaaggaggccgatgacgacgaggaggtggatgacaatatccccgagatgccatcaccaaaaaaaatgcaccaaggcaagaagaagaaacaaaataagaacagaatctcttgggttggggaagccgtaaaaaccgatgggaagaaaagctattacaagaaggtgtgcatcgatgcggagacgctcgaagtcggagattgcgtctccgttattcccgatgattctagtaaaccactgtacctggccagagttaccgcactttgggaggattcatccaacggacagatgtttcacgcccattggttctgtgccggtaccgacaccgtgttgggggccaccagtgaccctctcgagttattcctcgtcgatgagtgcgaagacatgcaactctcttacattcattctaaggtgaaggttatatacaaggcgcctagcgaaaactgggccatggagggagggatggacccagagtccctgcttgaaggtgatgacggcaaaacttacttctaccaactatggtacgaccaggactatgctagatttgagagcccccctaaaacacagcccactgaagacaacaaattcaagttctgcgtgtcctgtgcccgcttggccgagatgcgccagaaagaaattcctcgtgtgctggagcaactggaagacctggactcccgcgtgctctactatagtgcaacaaagaatggaatcctatatcgcgtcggcgacggcgtgtatttgccaccagaagccttcacattcaacattaagctctcctctcccgtgaagaggccacggaaggaacccgtggacgaagatttgtatcccgagcactacagaaaatactcggactatatcaaaggctctaacttggacgcaccagaaccttacagaattgggcgcattaaggagatcttctgccctaagaaatccaacgggcgccccaatgaaactgatattaaaattcgggtgaacaaattttaccggcccgaaaacacccacaaaagcacccctgcaagttaccacgctgacattaacttactgtactggagcgatgaggaggcagttgtcgacttcaaagctgtgcaaggccgttgcactgtcgagtacggagaggatctcccagaatgcgtgcaggtgtattccatggggggccccaaccgtttctactttttagaggcctacaatgccaagagcaaaagctttgaagacccgcctaaccatgctcgctcaccaggcaacaagggaaaggggaaaggcaaaggaaaaggaaagcctaagagccaggcttgcgagccttctgagcctgaaatcgagattaaattgcccaaactgcggaccctggatgtgttctccggatgcggaggtctttcggaaggattccatcaggctggcatcagtgataccctctgggctatagagatgtgggatccagccgcacaggctttccggcttaacaatcctggctcgaccgtttttaccgaggattgcaatatcctcctgaagcttgttatggccggcgagactactaactccagaggacagcgcctgccgcagaagggtgatgtcgagatgctatgcggcgggccaccttgccaggggtttagcggaatgaaccggtttaactcgagaacatactcaaagttcaaaaattctttggtagtgtccttcttgagctattgtgactattacagacctagattttttcttctcgaaaacgtccgaaattttgtctcattcaaaagatccatggttttgaaacttacactgcggtgcctggtgcggatgggttatcagtgtacattcggcgtgctgcaggccggacaatatggtgttgcccagacaaggagacgcgccattattctcgcagccgcaccaggcgagaaactgcctctgtttccggagccactgcacgtgttcgctccacgggcctgtcagctgtctgttgttgtcgacgacaagaagttcgtgagtaatatcacccgcctttctagcggaccttttcggacaattacggtgagggatacgatgtctgatctgcctgaggtgcgcaatggcgcgtccgccctggaaattagctataacggagaaccccaaagttggttccagagacagctaaggggggcccagtatcagccgatccttcgagatcacatctgtaaggacatgtcagcgctggtggcagccagaatgaggcatatccctctggcaccggggtctgattggcgggacttaccaaacatcgaggtcagactcagcgacggaacaatggcccgcaagttgcgctatacccatcacgatcggaaaaatggacggtcgtccagtggcgctcttaggggagtttgctcctgcgttgaagctggaaaagcatgtgatccggctgcccggcagtttaacacacttattccctggtgtcttccacataccggcaataggcacaatcactgggccgggctgtatgggaggctcgagtgggatgggttcttcagtactactgttaccaatccagagcctatgggcaagcaggggcgggtgctgcaccccgaacagcatagggtggtctccgtacgcgagtgcgctagatcacagggcttccccgatacgtacagactctttggcaatattctcgacaagcatcggcaggtcggcaacgcagtcccacctcctctggctaaagcaattggattagagatcaagctatgtatgctggcaaaggcccgcgagagcgccagcgccaagatcaaggaggaagaagccgccaaagactag

SEQ ID NO: 185646 - DNA, 4860 bp, Artificial Sequence
  Description of Artificial Sequence: Synthetic coding sequence
atgcccgcccggaccgcccccgcccgggtgcccaccctggccgtgcctgccatcagcctgcccgatgatgtgcggcgacgcttgaaagacctcgaaagagacagtttgacagagaaagaatgcgtgaaggagaaactcaatctgcttcacgaatttctgcagacagagatcaaaaaccagctatgtgatctggagacaaaattgcgcaaagaggaactgagcgaggagggctacctggcgaaagtgaaaagtctgcttaacaaagacctgtctctggaaaatggcgcccacgcctataatcgcgaggtcaacggaaggttagaaaacggaaaccaggcgaggtccgaagctagacgggtggggatggccgacgctaatagtccccccaaacctctcagtaaaccacgcacaccccgcaggtctaaaagcgatggagaagccaagcccgagccgtccccatcaccaaggataacccgcaagagcacgcggcagacgacgattactagccacttcgccaaggggccagccaagcgcaagccgcaggaagagtccgaacgggccaaaagtgatgagtcaatcaaagaggaagataaagaccaggacgagaagaggcgacgggtgacatcccgcgagagggttgcccgacctttgcctgccgaggagccggagagggctaagtctggcacccgaaccgaaaaagaagaagaacgggatgaaaaagaggaaaagcggctgcggtcccagaccaaagagccaacacccaagcagaaactgaaagaggagccagacagagaagccagagctggggtgcaggccgacgaagacgaggatggggacgaaaaagacgagaaaaagcaccggtcccaacctaaggatctagctgcaaaacgccgaccagaggagaaagagcccgagaaggtgaatccgcagatatctgacgagaaagatgaggatgaaaaggaggagaagcggcggaaaactaccccaaaagaacccacagaaaaaaaaatggcgcgggccaagaccgtgatgaattctaagacacacccgccgaaatgtatccagtgtggtcagtacctcgatgatcccgatctcaaatacggccagcacccacctgacgctgtggatgagccacagatgctcactaacgagaagctcagcattttcgatgcaaacgagtctggcttcgaatcctatgaggcccttccccagcataaactgacttgcttcagtgtttactgcaagcatggccacctgtgtcctatcgacaccggcctgattgaaaagaatatcgagctttttttttcaggaagcgccaaacctatctatgacgacgatccgtccctggagggtggggtgaacggcaagaacctgggaccaataaacgaatggtggattaccggattcgacggcggtgagaaagcgctaattgggttttctacctccttcgctgagtacatcctgatggatcctagcccagagtacgcaccgatctttggcttaatgcaggagaagatctatatatctaagatcgtcgtggagttcctccagagtaactctgatagtacttacgaggacttgattaataaaatcgagaccacagtgcccccttcaggattaaacttgaaccggttcaccgaagacagcctgcttagacacgcccagttcgttgttgagcaggtcgaaagctatgatgaagctggtgactcggacgagcagcctattttcctcaccccctgcatgagagatttgatcaaactcgctggagtgaccttaggtcaaaggcgtgctcaagcccgaaggcagacgatcagacattccactcgggagaaggatcgtggcccaacaaaagctacgaccacaaagctcgtctaccagatcttcgacactttttttgccgagcagatcgaaaaagatgacagagaggataaagaaaatgcgttcaagcggcgccggtgtggcgtgtgtgaggtatgtcagcaaccagagtgcggcaagtgcaaagcctgcaaggatatggttaagtttggtgggagtggccggagtaagcaggcctgccaggaaaggagatgcccaaacatggctatgaaagaagcagacgacgacgaggaggtagacgataacattccggagatgcccagtccaaaaaagatgcatcaggggaagaaaaaaaaacaaaataaaaacagaatatcttgggttggggaggcagtaaagaccgatggcaagaaaagttattacaagaaggtgtgtattgatgcagagactctggaggtcggcgactgcgtcagtgtcatacccgacgattcttcaaaaccactgtacctggcacgagttacagccctttgggaagattccagtaacggtcagatgtttcatgcccattggttttgtgcgggcacagatacagtcctcggtgccacgagcgacccacttgagttgttcctggttgacgaatgtgaggacatgcagctgtcctatatccactcgaaagtgaaggtaatctataaagcacccagcgagaattgggctatggaaggggggatggacccagagtctctccttgaaggggacgacggcaaaacatacttctatcagctgtggtacgatcaggattatgcgcgctttgagagcccccccaagactcagcccacagaggacaacaaattcaagttctgtgtcagctgcgcccggcttgcagaaatgaggcagaaggaaattccccgggtcctggagcaactcgaagacctcgattcccgtgtcctgtactatagcgctactaaaaatggtatcctgtaccgtgtgggggatggcgtgtatctgccccccgaagcgttcacatttaacataaagctctccagtcccgtgaagcgacccagaaaggagcccgtagacgaggatctgtaccctgaacactaccggaaatatagcgattacattaagggcagcaacctggatgcccccgagccctaccgcatcggccgcatcaaggaaattttttgtccaaagaagtccaacggccgtcctaacgagacagatatcaaaatcagggtaaacaaattttatcgcccagagaacacacacaagtccacacctgctagctaccatgctgatattaaccttctatattggtccgatgaagaagcagttgttgattttaaagcggttcagggcagatgtactgttgagtacggggaagatctcccagagtgcgttcaggtgtactccatgggtggacccaacaggttctattttctggaggcctataatgccaagtccaaaagcttcgaggatcccccaaatcatgcacgaagccccggaaataagggcaagggaaagggtaaaggcaaggggaaacctaaaagccaggcttgcgaacccagcgagcctgagatcgagattaagctaccaaaattgcggacccttgatgtgttcagcggatgtggtggactttccgagggttttcatcaggctggcatctccgatacactgtgggcgattgagatgtgggaccctgcggcgcaagccttcagattgaacaatcccggcagcactgtttttacagaggactgtaacatcctgctgaaattagtaatggccggcgagacaaccaatagcagagggcagcgcctgcctcagaagggtgatgtggaaatgctgtgtgggggacccccatgtcaaggattctcaggcatgaaccgatttaattcacggacctactctaagtttaaaaattccctggtagtgtctttcctgtcctactgcgactattacagaccgcggttctttctgcttgagaatgttagaaacttcgtctcctttaagaggtccatggtattgaaactgaccttgcggtgcttggttaggatgggatatcaatgtacgttcggcgtacttcaggccggtcaatatggcgttgctcagacgagaaggcgggccattattcttgccgcagcccccggcgaaaaactcccgctgtttccagagcccctccacgtgtttgcaccccgggcctgtcagttatcagtggtggtggatgataaaaagttcgtatctaatattaccagattaagttctggccctttcaggacgattacagtccgcgataccatgtctgacttgccggaagttaggaatggcgcatctgctctggagatttcttataacggggagccacagagctggtttcagaggcagttgaggggcgcccagtatcagccaatcctgagagaccacatatgcaaagatatgtcagccttggtggctgccagaatgcgccatattcctctcgcacccggtagcgactggcgggatctgcccaatattgaggtaagactgtctgatggcacaatggctcgcaagctgcggtacactcaccacgacaggaaaaatggacggtcatcctccggtgccctccgcggagtgtgcagctgtgtagaaggaggctcctccggcaaggcctgcgatcccgctgcccgccagtttaacactctaattccctggtgtctgccacacaccggcaataggcacaatcactgggccggcctctatgggcggttggagtgggatggtttcttttcaacaacggtcaccaaccctgagcccatggggaaacagggcagggtgcttcatcctgaacagcatagagttgtatctgtgcgcgaatgtgccaggagtcaggggttcccggacacctaccgactgtttggaaatatcctggataaacaccgtcaggttggaaacgccgtgcctcccccactggctaaagcaatcggattagagatcaaactttgcatgctggctaaggcgcgagaaagtgccagcgccaaaatcaaagaagaggaggcagctaaggactag

SEQ ID NO: 185647 - DNA, 4455 bp, Artificial Sequence
  Description of Artificial Sequence: Synthetic coding sequence
ggcagctgccacagccccgccagcgccagccaggtggccggcaccaccgctgaacctagcccttcaccccgcatcacaagaaaatcaacccggcagactacaatcacttcacacttcgccaaaggaccagccaagaggaagccgcaggaggagagtgagcgggcgaagagcgacgagtctatcaaagaggaagataaagatcaggatgagaagcgcaggagagtgaccagcagagaacgggtggctcgcccattgcctgccgaggagcctgagcgcgcaaagtcgggcacccgcaccgaaaaggaagaagaaagagacgaaaaggaagagaagcgcctccgctcccagactaaggagcccacccctaaacagaagttgaaggaggaacccgaccgcgaagctcgggctggagtgcaggctgatgaggatgaggacggcgatgagaaagacgaaaagaagcaccgcagccagcctaaagatttggcagcgaagcgcagaccagaggaaaaagagcctgagaaggtaaatccacaaattagtgatgaaaaggacgaagacgagaaggaagagaaacgtaggaaaaccacccctaaggaacccacggaaaaaaaaatggcccgtgctaagaccgtaatgaatagtaaaacgcatccacctaaatgcattcagtgcgggcagtacctggacgatccagatctgaagtatgggcagcacccaccagacgctgtggatgaacctcagatgttgactaatgagaagctgtcaatctttgacgctaatgagtccggcttcgaaagctacgaggcgttgccccagcataagctaacctgcttctctgtctactgcaagcatggacatttatgccccatcgacaccggtctgattgaaaagaacatagaactgttctttagtggcagtgcaaaaccgatttatgacgatgacccctcgctggaggggggagttaacggcaagaacctcggccccattaatgagtggtggattacagggtttgatggtggagagaaagctcttatcggcttttcaacctcattcgctgagtacattttgatggatccatcgccagagtatgccccaatttttggtttgatgcaggagaagatctatatttctaaaatcgtcgtggaatttctgcagagcaattctgattccacgtacgaagacctgataaataaaatcgagactacagttcccccttccggtctgaacctcaatcgtttcaccgaggatagcttactacgacacgcccagtttgtggtggaacaggtggagagctatgatgaggccggcgactccgatgagcagccgattttccttaccccatgtatgagggacttaattaagcttgctggcgtgacacttggccaacgacgtgctcaagcccggagacagactattagacacagcactcgggagaaagaccggggccccacaaaggccactacaacgaagctggtgtaccagatttttgacaccttctttgcagaacagatcgagaaggatgaccgcgaggacaaagaaaatgcattcaaaagaagacggtgtggggtctgtgaagtgtgccagcagcctgagtgtggcaaatgtaaagcttgcaaagacatggtgaaattcggcggctctgggcggtccaagcaggcttgccaggagagacggtgccctaatatggcgatgaaggaggccgatgacgatgaggaggtagatgataatatacccgagatgccatctccgaagaaaatgcaccaggggaaaaaaaagaaacagaacaaaaatagaatctcatgggtgggggaagccgttaaaaccgacgggaagaaatcatattataagaaggtgtgcatcgatgccgaaactttggaggttggtgattgcgtgagtgtgatccccgatgattccagcaaacctttgtacctggctagagtgacagccctgtgggaagacagttctaatggccagatgttccacgcccactggttctgcgctggcaccgatactgtgctaggcgcaacttctgacccattggaactatttcttgtcgacgaatgcgaggatatgcagcttagctacatccacagtaaggtcaaggtgatctataaagccccatctgaaaattgggcaatggaagggggtatggacccggaaagtttactcgaaggtgatgacgggaagacctatttttatcagctgtggtacgaccaggactatgcaaggtttgagagtcctccgaagacccagcccacggaggataataagtttaagttctgcgtgtcttgtgctagacttgcagagatgagacagaaggagatcccaagggttttggagcagttggaggatcttgatagtagggtattatattactcagcaactaagaatgggattctgtaccgggtaggggacggcgtgtaccttccaccagaggcctttacttttaacatcaaactgagctccccggtgaagcgcccccggaaagaacccgtagatgaggacctctatcctgaacactataggaaatattcagattatatcaaaggcagcaatctggacgcgccagagccctaccgtatcggacgaatcaaggaaatcttctgccctaagaagagcaacggacggcccaacgaaactgatatcaaaatccgggtgaacaagttttaccgccctgaaaacacccacaaatcaacacccgcttcctaccatgccgatatcaacctgttgtattggtctgatgaagaggctgtcgttgattttaaagccgtacagggaagatgtacagtggaatacggagaagacctacccgagtgtgttcaggtatatagtatgggagggcctaacaggttctattttctcgaagcttacaatgccaaatcaaagtcgtttgaggaccctcccaatcatgcccgatctccagggaacaaggggaaaggtaagggcaaggggaaaggaaaacctaagagccaggcctgcgagcctagtgaacctgagatagaaattaagctccccaaacttcgaactctcgatgtttttagtgggtgtggaggactatccgaaggcttccatcaggccggcatcagcgataccctctgggctattgaaatgtgggaccctgccgcccaggcatttaggctgaacaatcctggaagcaccgtgttcactgaagactgtaatattctcctgaaattagtgatggccggggaaaccacaaactcacgtgggcagcgtctgccccagaagggggacgtggaaatgctctgcgggggtccaccctgtcagggcttcagcgggatgaataggtttaactcccgcacctactcaaagttcaaaaattctctcgtcgtgagctttctgtcctactgtgattattacagaccaaggtttttcctccttgaaaacgtcagaaactttgtgtcatttaaacgaagcatggtgctcaagctgacgttaaggtgtcttgtcagaatggggtatcaatgtactttcggagtgcttcaagctgggcagtacggtgtagcccagactcggcggagagctatcattctcgctgcagcccccggtgagaagctacctttgttccctgaaccactccatgttttcgccccacgagcgtgtcagctgtcagtcgtggtggacgataagaaattcgtgtctaacatcaccagattgagcagcggtccgttcagaaccattactgttcgcgatacgatgagcgacctgcccgaggtcaggaatggagcctccgccctggagatctcatacaacggcgagcctcagagctggtttcagcgccaactgcggggcgcccaataccagccgatccttcgagatcacatctgtaaagacatgtctgccttagtagcggcccgtatgaggcacattcccctggctccaggatccgattggcgtgatctgccaaatatcgaggttagactcagcgatggcaccatggctaggaaattacggtatactcaccacgataggaagaatgggcgaagctcgagtggcgcactccgcggggtgtgttcttgcgtggaggccggcaaggcttgcgacccggccgctcgtcagttcaacaccctcataccatggtgtcttccgcacacaggcaatcgtcacaaccactgggcgggcctttacggacgcctggaatgggatggatttttctccacaacagttaccaaccctgagccaatgggcaaacagggtagagtgctgcatcctgaacagcacagagtagtgtcagtccgcgagtgtgctcgcagtcaagggtttccagacacctaccggctgtttggtaacatcctcgataaacaccgacaggttggaaacgccgtacccccccccttagctaaggccataggactcgaaattaagctgtgcatgttggcaaaagcacgtgaatccgcctctgccaaaattaaagaagaggaggccgctaaggattag

SEQ ID NO: 185648 - DNA, 2739 bp, Artificial Sequence
  Description of Artificial Sequence: Synthetic coding sequence
atgcccgccatgcccagcagcggccccggcgacaccagcagcagcgctgcagaacgcgaggaagataggaaggacggcgaggagcaagaggagcctaggggaaaagaggagcgacaggagccaagcacaaccgcccgcaaggtgggccgacccgggagaaaacgtaaacacccacctgtggaatccggcgacacacctaaagacccagcagtaatctccaagtctccttcaatggcccaggactccggtgctagcgaactgcttcccaacggcgacctcgagaagaggtccgaaccccaaccagaagaaggttcacctgccggcggtcagaaaggaggagcacctgccgaaggcgagggtgcagccgaaacgctgcccgaagccagccgggcagtggagaacggctgctgcacacctaaagaggggagaggagcaccagctgaggccggtaaagagcagaaggagactaatattgagtctatgaagatggaaggaagtcgcggacgcctccgaggcggtttgggatgggagtcaagcctcagacaaagaccgatgcccagactgaccttccaagcaggtgacccgtattatatcagtaagaggaaacgcgatgaatggctggccagatggaaaagagaggcagaaaagaaggctaaagtcattgccggcatgaatgccgtggaggaaaaccaagggcccggtgaatcacagaaagtcgaagaggcatctccaccggcggtgcagcagcccactgatccagctagcccaacagttgcaacgactccagaacccgtgggcagcgacgcaggagataaaaacgctaccaaggccggcgacgatgagccggagtatgaagatggccggggcttcggtatcggagagctcgtgtggggcaagctccgcggttttagctggtggccagggcgcattgtgagttggtggatgaccggtaggtccagagccgctgagggcacaaggtgggtgatgtggtttggggatggaaagttcagcgtcgtctgcgtggagaaactcatgccgctctctagtttctgttcagccttccatcaggccacatacaacaaacaacctatgtatcggaaggccatttatgaagtcttacaggtcgcttcgagccgagctggtaagctcttccctgtctgccacgacagcgatgaaagcgataccgccaaggccgttgaggtgcagaataagcccatgatcgagtgggcactcggcggcttccagccaagcggccccaaggggctggaaccacctgaggaggaaaaaaacccctacaaggaagtatataccgacatgtgggtggaaccagaagctgctgcttacgcacccccacctcctgcgaaaaagccccgcaagtccaccgccgaaaaacctaaagtgaaggagattatcgatgaacggacccgcgaacgtctggtctacgaagttaggcaaaaatgccgcaacatagaagacatctgtataagttgtggtagcctaaacgtgactctggagcatccactcttcgtgggcgggatgtgccagaactgcaagaattgtttcttggagtgcgcctaccagtatgatgatgacgggtatcagtcctactgcaccatttgctgtggggggcgggaagtactcatgtgtggaaacaataactgttgccgatgtttttgtgtggaatgtgtggacctcctcgttggccctggagcagctcaagcagctattaaagaggacccttggaattgttatatgtgtggacacaagggtacttatggcctcctgcggcgccgcgaggactggccaagcaggctccaaatgttttttgctaataaccatgaccaggaatttgacccaccaaaagtgtacccaccagtgcctgcggagaagaggaaaccaatcagagtactgagcctcttcgacgggatagccactgggctattagtgctgaaagacttggggatccaagtcgatcggtatattgcatccgaggtctgcgaagatagcattactgtgggaatggttcgtcaccaggggaagattatgtatgtgggagacgtccgatcggtcacacagaagcatattcaggagtggggaccctttgaccttgtgattggtggttcaccctgcaacgatctatcaatcgttaaccctgccaggaagggcctttatgagggcactggacggcttttcttcgagttctacagactgcttcacgatgccagacccaaggagggtgatgaccggccatttttctggctgtttgagaatgttgttgcaatgggagtgtcagataaacgcgatatcagtcggttccttgagtcgaatcctgtgatgatcgacgctaaggaggtttcagcagcacaccgtgcccgttacttctgggggaacctaccaggaatgaatcggcctctagccagcaccgtgaacgacaaactggaactgcaggaatgtctggagcacggcagaatagccaagttcagtaaggtgcgaaccattacaacccggtccaactccattaaacagggaaaggaccagcactttccagtgttcatgaatgagaaagaagatattctgtggtgcaccgagatggagcgcgttttcggattccctgtacattatactgacgtctcaaatatgagcagattagcacgtcagcgtttgctggggagaagttggtcagtgcccgtaattagacacctctttgctcccttaaaagagtactttgcttgtgtctag

SEQ ID NO: 185649 - DNA, 2739 bp, Artificial Sequence
  Description of Artificial Sequence: Synthetic coding sequence
atgcccgccatgcccagcagcggccccggcgacaccagcagcagcgctgccgagcgggaggaggaccgaaaagacggcgaggagcaagaggagcctagaggcaaagaagagcgtcaggaaccttccactaccgcccgtaaagtcggccgcccaggacggaagcgcaagcacccacctgtggagtctggcgacacccctaaagacccggccgtgatatcaaagtccccgagtatggcccaggactctggcgcctctgagctgctgccaaacggcgatctcgaaaaaagatcggaaccacagccagaggaagggagccccgcaggcggccagaaagggggagccccagccgagggggaaggagcggctgagacgctccctgaggcttcccgggccgtagaaaacggatgctgtacacccaaagaggggaggggggcgcccgcagaggccgggaaggaacaaaaggagactaatattgaaagcatgaagatggagggctcacgaggcaggctgcgtgggggactcgggtgggagtcatccctgaggcagaggcccatgccccggctgaccttccaggctggtgatccctactatatttctaagcgcaaaagggacgagtggttagcgagatggaaacgcgaggctgagaagaaggcaaaagtgatcgccggtatgaacgccgtcgaggagaatcaggggccaggagagagccagaaagtggaagaggcctctcctcccgcagtgcaacagccaaccgacccagcctctccaaccgtggctaccacccccgaaccagttggatccgatgctggtgacaaaaatgctaccaaggccggagacgatgagcccgagtatgaggatggccggggattcggaattggggaactggtgtgggggaaattacgcgggttctcctggtggccgggaagaattgtttcctggtggatgaccggccggtcacgcgctgccgagggcacaagatgggtgatgtggtttggtgatgggaagtttagcgtggtttgtgtggagaagctgatgcccctcagtagtttctgcagtgcctttcaccaggcaacctataataagcagcccatgtaccggaaagccatatatgaggtgctccaggtcgcatcttcacgcgccggcaaactgttccctgtgtgtcatgactcagatgagtctgatactgctaaggccgtggaggtgcagaacaagcccatgatcgagtgggctcttggagggtttcaaccgagtggccctaaggggctggagcctcccgaggaggaaaagaacccctataaagaggtgtataccgatatgtgggtggagccagaggctgctgcctatgcccctcctccccctgccaagaagcctcggaaatcaaccgctgagaagcctaaggtgaaggaaataatagatgagaggactagagagagacttgtctacgaggtgaggcaaaaatgtcgcaacatcgaggatatctgtatctcttgcggcagcctaaacgtgacactggagcacccactgttcgtcggcggaatgtgccagaactgtaagaattgttttctcgagtgtgcataccagtacgacgatgacgggtaccaatcttactgcaccatctgctgcgggggccgcgaggttttaatgtgtggaaataacaattgctgccgttgcttttgtgtggaatgcgttgacctgttggttggacctggtgccgctcaggccgcgatcaaagaggatccatggaactgttatatgtgcggccacaagggaacatacggcctgctgcggagacgcgaggactggccctccagattgcagatgtttttcgcgaacaaccacgaccaggaatttgacccaccaaaagtctaccctccagttcctgctgaaaaaagaaaaccgatacgtgtgcttagccttttcgacggtatagctacgggccttctggtactcaaagatctcggaatacaggtcgatcggtacatcgcctctgaagtctgtgaggattccattacagtgggtatggtccgccatcagggtaagatcatgtacgtcggtgatgtcagatctgttacccagaagcacatacaggagtggggacccttcgatctggtcatcggcgggagcccatgtaatgatctgtccatagtaaatccagctagaaaaggcctgtatgaggggacaggaagattgtttttcgagttctacaggttgttacacgatgctcggccaaaggaaggagacgatcgtccattcttctggctgttcgaaaatgtcgtggcgatgggagtgagtgataaacgggatatctcgcgcttcttggaaagcaatccagtgatgattgatgcaaaggaagtgagtgccgctcacagagccaggtacttttggggcaacctgcctggaatgaacaggcctttggcaagtactgtcaacgataagttggagctacaggaatgcctcgaacacgggcgtatcgcaaagtttagcaaggtgagaaccatcaccactagatcgaactcaattaagcagggcaaggatcagcacttccctgtttttatgaacgagaaagaggacattctttggtgcacagaaatggagcgggtgttcggattccccgttcactacacagatgtgtccaacatgagtcgccttgcacgtcagcggctactcggcaggtcatggagcgtccccgtgatccgccacctgttcgcccctctgaaggagtacttcgcttgtgtctag

SEQ ID NO: 185650 - DNA, 2172 bp, Artificial Sequence
  Description of Artificial Sequence: Synthetic coding sequence
atgggcatcctggagcgggtggtgcggcggaacggccgggtggaccgctctttaaaggacgaatgcgacaccgccgaaaagaaggctaaagtgatagcagggatgaacgccgtagaggaaaaccagggccccggcgaatcacagaaggtggaagaggcctccccccccgcagtgcagcagcctactgaccccgccagtcccaccgtggccactaccccagagcctgtcgggagcgatgcaggggataagaacgctaccaaggccggtgatgatgaaccagagtacgaggacggccgaggattcggtataggcgagctggtgtgggggaagctgcgtggattctcctggtggccaggccgcatcgtctcctggtggatgaccggtcgatcgcgagctgctgaaggcacaagatgggtcatgtggttcggagatggcaagttctcggtagtgtgtgttgagaaactgatgcctctgagttccttttgcagcgcatttcatcaggccacttataataaacagccaatgtacagaaaggcgatctatgaagtactgcaggtcgccagtagtcgagcaggtaaacttttccccgtgtgccacgactcggacgagagtgacaccgctaaagctgtagaggttcagaataaaccgatgatcgagtgggccctgggggggttccagccctcggggcccaaaggtctcgagccgcccgaggaggagaaaaacccctacaaggaggtgtatactgacatgtgggtagaacctgaggcggccgcctatgcgcctccccccccagccaagaaaccaagaaagtccacagctgaaaagcctaaggttaaagaaattattgatgagcggacaagggagagactcgtgtatgaagtcaggcaaaaatgccggaacattgaagacatctgcatcagttgcggcagccttaacgtgacgctggagcaccctctgtttgtcgggggtatgtgccagaattgcaagaactgctttctggagtgtgcttaccagtacgatgacgacgggtatcagtcgtactgtacaatttgttgtggagggcgagaggtgctcatgtgtggtaataacaactgttgtcgctgtttctgcgtggagtgcgtagacttgctggttggtcccggtgcagctcaggccgccatcaaggaggatccatggaattgttatatgtgcgggcacaaaggaacctatgggttactaaggcggcgtgaagactggcctagccggctccagatgttcttcgctaataaccacgaccaagagtttgaccctcccaaggtgtatcccccagtacccgccgagaaaaggaagcctattcgggtactgagtctttttgacgggatagccactggactgcttgttttgaaagatcttggtatccaggtcgatcgctacattgcgtcagaggtatgcgaggactctataaccgtcgggatggtcaggcaccagggaaagatcatgtacgtgggtgacgtgagatctgtgacacaaaagcacattcaagagtggggaccgttcgacttggtgatcggggggagtccgtgtaacgatctctcaatcgtaaatccagctcgcaagggcctgtatgaaggcaccggcagactgttctttgaattctacaggttgttacatgacgccaggccgaaggagggcgacgaccggcccttcttttggctgtttgagaatgtggtagccatgggcgtgagcgataaaagagatataagcaggtttttggagagtaacccagtcatgattgatgccaaagaggtcagcgcggcacatcgggctaggtatttctggggaaatcttccaggaatgaacaggccactggccagcaccgtgaatgataagctcgagcttcaggaatgtctagaacatggcagaatcgccaaatttagcaaggttagaacaatcacaactaggtccaacagtatcaagcagggaaaggatcaacatttccctgtttttatgaacgagaaggaagatatactttggtgtacagagatggagcgcgtgttcggttttccagttcactatacggatgtgtctaacatgtcacgactcgctaggcagcgtctgctgggacgcagttggagcgtgcctgtgatccgccatttgttcgcccccctgaaggaatattttgcttgcgtgtag

SEQ ID NO: 185651 - DNA, 2070 bp, Artificial Sequence
  Description of Artificial Sequence: Synthetic coding sequence
atgaacgccgtggaggagaaccagggccccggcgagagccagaaggtagaagaggcaagccctcccgcagtccaacagcccacagatcctgcatctccaacggttgcgaccacacccgaacccgtcggatccgacgcaggtgataaaaacgcaaccaaagccggcgatgatgagcctgagtacgaggacggccgcggtttcggtataggagagctggtttggggaaaactacgaggtttcagctggtggcccgggaggatcgtgtcatggtggatgacaggccgatctagagcagccgaaggcacacgatgggtgatgtggttcggcgatgggaagtttagtgttgtgtgcgtggagaagctcatgcccctgtcctctttttgtagcgcatttcatcaggccacatacaataaacagcccatgtacaggaaggccatttacgaagtgctacaagtagcgtccagccgcgcagggaagcttttccctgtctgtcacgactctgatgagtctgatactgccaaggcggtggaggtgcaaaataaacctatgatagagtgggcattggggggcttccagccgagtgggccaaaaggtctggagcccccagaggaggaaaaaaacccctacaaggaagtgtacacagatatgtgggtggaaccagaggcggcggcatatgctcctcctccccctgctaaaaagccaaggaagtccacggctgagaagcctaaggtgaaagaaattatcgacgagcgtactagggagcgattggtgtacgaggtacgccagaagtgcaggaacattgaggatatctgcatttcctgcgggtcactcaacgtcacgcttgagcatccgctcttcgtaggtggaatgtgccagaattgtaagaactgtttccttgagtgtgcataccagtacgatgacgacggataccagtcctattgtactatctgctgcggcggcagagaggtgttaatgtgcggcaataataactgttgccgatgcttctgcgttgagtgcgtcgaccttctggtgggccccggcgctgcccaggctgctattaaggaggacccctggaactgctatatgtgtggccacaagggaacctacggcttgctcaggcgccgcgaggattggcctagccgtctccaaatgtttttcgccaacaaccatgaccaagagttcgacccccctaaggtataccctcctgtgccagccgagaagcgaaagccgataagggtcttgagtctctttgacggtatcgccacaggtctgctggtgctgaaggacctcgggatccaggtggacagatacatcgcatccgaggtctgtgaagactcaataaccgtgggcatggttaggcatcagggaaagattatgtacgtcggcgatgtcagatctgtcacacagaaacacattcaggagtggggacctttcgatttggtcatcggaggatctccgtgcaacgatttatcaatcgtgaacccagccaggaaggggctttatgaaggcaccggtagactgtttttcgagttctatcgcctcctgcacgatgcaagaccaaaagagggagatgatcgcccattcttctggctattcgagaacgtggtggctatgggcgtgagcgataaaagagacatctccaggttcctcgagtctaatcccgtgatgatcgatgcgaaggaggtctcggctgcccatcgagcccgctacttctgggggaacctccccgggatgaataggcctctggcttccaccgtgaacgacaagctcgaactgcaggagtgtttggagcatgggcggatagctaaattctccaaggttcgcaccattactacccgatccaatagtattaaacaggggaaagaccaacatttccccgtcttcatgaatgaaaaggaagatatattatggtgcacagagatggaacgagtctttgggtttcctgtccactacaccgatgtttccaacatgtcccggctcgcgagacaacgacttctcggacgatcttggtcagttccggtgatccgccacctcttcgccccattaaaggagtacttcgcatgcgtgtag

SEQ ID NO: 185652 - DNA, 501 bp, Artificial Sequence
  Description of Artificial Sequence: Synthetic coding sequence
atgcccgccatgcccagcagcggccccggcgacaccagcagcagcgccgcggaaagagaagaagatagaaaggatggagaggagcaagaggaaccaagaggcaaagaggagaggcaagaaccctcgactaccgccaggaaggttggaagacccggtcgtaaacgaaaacaccctcccgtggaaagcggcgatacacctaaggacccagccgtgatttcaaagtcacccagtatggcgcaagattcaggagcaagcgaactgttaccaaatggggatctcgaaaaacgatccgagcctcagcctgaggaaggaagtcccgcgggagggcaaaaagggggcgctcctgctgagggggaaggcgccgctgagactttgcctgaggctagcagggcagtcgaaaacggctgttgcacccccaaagaagggagaggggcgcccgccgaggctggggagagttcggccccgggcgcagcgagttctgggccgacaagcatcccttag

SEQ ID NO: 185653 - DNA, 2538 bp, Artificial Sequence
  Description of Artificial Sequence: Synthetic coding sequence
atggagcccagccccgagccccccagcctggagagcatgaagggcgatacccgccatcttaatggagaggaggatgccgggggtcgagaagattcaatccttgtcaatggcgcgtgctccgatcaaagtagtgattctcccccaattttggaggccatacgaacccctgaaatccggggccgcaggtcctcttcacgactcagcaagcgcgaagtcagctccctactgtcttatacacaggatttaaccggtgatggagatggcgaagatggggatggctctgataccccggtcatgccaaaattgttcagagagacccggacccggtccgagagccccgccgtgaggaccagaaacaacaattctgtgagctctagagaacgccatcggcctagcccacggtcaacgagagggcgtcagggacgtaatcacgtggacgagtctccagtggagtttccagccacgagaagtctgagaaggcgtgccaccgcatctgcgggaacgccttggccaagccctcctagcagttacctgacaatcgacttgacagacgacactgaggacactcacggcaccccccaatccagtagtactccctacgcccgtctggcccaggacagtcagcagggaggcatggagtcaccacaggtcgaagccgacagtggtgatggcgattctagcgagtatcaggacggaaaagagtttgggattggcgacctggtgtgggggaagatcaagggcttttcctggtggccagctatggtggtgtcatggaaagccacttctaagaggcaagccatgtccgggatgcgttgggttcagtggtttggcgatggcaagttttcggaggtctccgcagacaagttagtggctctcggcctcttttctcagcatttcaatcttgccacttttaacaaactcgtgtcctatagaaaagccatgtatcatgccttagaaaaggcacgggtgagggcgggcaagactttcccctcttctcccggagattcactggaggatcaactgaagcctatgctagagtgggcccatgggggcttcaaacccactggtatcgagggcctcaagcccaataacacccagccagaaaacaaaaccagaagacggactgcagatgacagcgcaaccagtgactactgtccagcccccaagcgccttaagacaaactgctacaataacggcaaagacagaggcgatgaggatcagtcccgagaacagatggcctcagacgtggctaataacaaatcctctttagaggacggctgcttgtcatgtggtcggaaaaatccggtctcatttcatccactatttgaggggggcctttgccagacatgccgggataggtttttggagctgttttacatgtacgacgatgatggatatcagagctactgtaccgtttgctgcgaagggcgtgagctcctgctctgctccaacacctcctgttgtcgctgtttctgcgtcgagtgcttggaagtgctggtgggcaccggtaccgccgcagaggcaaaactgcaagaaccttggtcatgctacatgtgcctgcctcagcggtgtcacggcgtcctccggagacgcaaagattggaacgtccgcctccaggcgttcttcacctctgacacaggcttggagtacgaagctcctaagttatatcccgctattccagcagcgagacgccgcccaatacgcgtgctgtctttgtttgacggtattgccactggatacctggtgcttaaggaattgggtattaaggttggcaagtacgtcgccagcgaggtgtgcgaggagtcaatagcagttggcaccgtcaagcatgagggaaacatcaaatatgtgaacgacgtaaggaacatcactaagaagaatatcgaagagtggggccccttcgacctagtgatcggggggtcaccctgtaacgatcttagcaacgtgaatccagccagaaagggactctatgaaggtacaggcaggctctttttcgagttctaccatctgctgaattatagccgaccgaaggagggcgacgaccgaccattcttctggatgttcgagaacgtggtggcaatgaaggtaggcgacaaacgggatatcagccgctttctggaatgtaatccggtgatgatagacgcaattaaggtgtcagcagcacatcgtgccagatacttttgggggaatctcccgggcatgaatcggccagtgatagcaagtaagaacgacaaacttgagctacaggattgcctcgagtacaaccggattgccaaattaaagaaagtgcagaccattacaactaagtccaattccatcaaacagggcaagaaccaactgtttccagttgtgatgaatgggaaagaagatgttctgtggtgcactgagctcgagcgaatctttggttttccagtgcactatacagacgtgtcaaatatgggacgtggggctcgccagaagttattaggtcgctcatggagtgtgcccgttatccggcacctttttgctcccttgaaagactatttcgcgtgcgagtag

SEQ ID NO: 185654 - DNA, 2562 bp, Artificial Sequence
  Description of Artificial Sequence: Synthetic coding sequence
atgaagggcgacacccggcacctgaacggcgaggaggacgccggcggccgtgaggattcaatcctggtgaatggtgcctgtagtgatcagagcagtgattctcctcctatcctcgaagcaattaggactcccgagattaggggtagacgttctagcagcaggctgtcaaagcgcgaagtgtcgagtcttctgtcctacacgcaagacttaaccggggatggggacggcgaggatggagacggtagtgataccccggtgatgccaaagttgttccgggagacccgtacccggtctgagtctccagctgtgcggactagaaataataattcggtgagctcacgcgagcggcaccgcccttcgccaaggtcaacacgcggcagacaaggacgcaatcacgtggacgagagccctgtcgagtttccagccaccaggtcgctgcgtcgtagggcaacggcatccgccggaactccgtggccctccccccccagcagctatctgactatcgacctgacggacgacaccgaggatacacatggcacaccgcagtccagttccactccctacgccagactggcccaggacagtcaacagggcgggatggagagccctcaggtggaggccgattccggcgatggggacagttccgagtaccaggatggaaaggaattcggcatcggcgacctagtctgggggaaaatcaaaggatttagttggtggccagctatggttgtgtcatggaaggccactagcaaaaggcaggccatgtctggaatgcgctgggtgcagtggtttggagacggcaaattttctgaggtgtccgccgataaactggtagcactgggcctcttctctcagcactttaacctggctacattcaataagttagtatcgtatcggaaggccatgtatcacgccctggaaaaagcccgcgtacgagctgggaagacttttccatccagcccgggcgatagcttagaagaccagttgaaacccatgttagagtgggcgcatggtggctttaagcccactggcattgagggcttgaaaccgaataatacacagcccgtcgtgaataagagtaaagtgagaagagcagggtcgagaaagttagaatccaggaagtacgagaacaagactcgccggcgtaccgctgatgacagtgctacatctgactactgtcccgcccccaagcggttaaagactaattgctataataatggcaaggataggggtgatgaggaccagtcaagggagcagatggcaagcgatgtcgcgaataacaaatctagcctcgaagatgggtgcttaagttgtggccggaaaaacccagtttcattccacccgctcttcgagggagggttgtgtcagacatgccgagatcgcttcttggaacttttctacatgtacgacgacgacggctaccagtcttattgcacagtgtgttgcgaaggccgggagcttctgctgtgttccaacacgtcctgctgcagatgcttctgcgttgagtgcctagaggtgctcgtcggtactggcactgctgccgaagccaagctgcaggaaccctggtcatgctacatgtgccttccgcagcgatgtcacggcgtactgcgacgcagaaaagattggaatgtgcgcctgcaagccttctttacctcggatacaggactggagtatgaagcacctaaactttaccctgcaataccagcggcccgacgaagacctatcagagtcctgagcctattcgatggcatcgccaccggatacttagtgctaaaggagctaggaatcaaggtgggcaagtacgtggcaagcgaagtatgtgaggagtctattgccgtaggcacagtgaaacacgaaggcaatataaagtacgtgaatgacgtgcgcaacattacaaaaaaaaacatagaggagtggggtccattcgatttggtcatcggcggatcaccctgtaatgacctgtccaatgtgaatccagccagaaaaggtctgtacgagggtacgggccggctctttttcgagttctatcaccttctgaactactctagacctaaggaaggtgatgacaggccattcttctggatgttcgagaatgtggtggccatgaaagtgggtgacaagcgtgacataagccgttttctcgaatgtaatccagtcatgattgacgcaataaaagtctccgctgcccatagggctaggtatttttggggcaatcttccgggaatgaatcgaccagttatcgcttcaaaaaacgataagcttgagctgcaggattgcctggagtataatagaatcgctaagcttaaaaaagtgcaaactatcactacaaagtcaaacagtatcaaacagggtaagaatcagcttttcccagttgttatgaacgggaaagaggacgtgctgtggtgcacagagctcgaaagaatctttggatttccagtgcactataccgatgtctcaaatatgggcaggggagcgcgccagaagctgctcgggagaagttggtccgtcccagtgatacggcacctgtttgcacccctcaaagactacttcgcatgtgagtag

SEQ ID NO: 185655 - DNA, 2379 bp, Artificial Sequence
  Description of Artificial Sequence: Synthetic coding sequence
atgaagggcgacacccggcacctgaacggcgaggaggacgccggcggcagagaggatagtatcctggtaaatggagcctgctcagaccagtcttctgatagcccgccaatcctggaggctatcaggactcctgagatccgcggaagaaggtcgtcctctagactgtctaaacgggaagtcagttctttgctgtcatacacccaggatctcacgggagatggggatggcgaggacggcgatggatctgacacccctgtaatgcctaagctgtttagagagactcgaaccagatcagagagtccagctgtacgcaccagaaacaataatagcgtgagttcccgcgagaggcacagaccaagtcctcggtccactcgtggcagacagggtaggaatcatgtggatgagtctcctgtggaatttcccgcgacacgtagtctaagacggcgagctaccgctagcgcaggcactccatggccttcccctccgtcctcctatctgacaatcgatctcacagacgacaccgaagatacacacgggaccccacagtcctctagcacgccatatgcccgcctggcccaggactcacaacaaggtggaatggaatcgccacaggtggaggcagactcaggcgacggagacagcagcgagtatcaggatgggaaagagtttgggatcggagatctggtgtgggggaagattaagggattctcttggtggcctgcgatggttgtctcttggaaagccacttctaagagacaggctatgagcggcatgcggtgggtacagtggtttggtgatggcaagtttagcgaggtctcagctgacaagctcgtggccctgggactcttctcccagcattttaacttggccactttcaacaagttggtgagttaccgaaaagccatgtatcacgctctagagaaagcacgtgtcagggctgggaagacattcccctcaagccctggagattctctggaggaccaactcaagcctatgttagagtgggcccacggcggttttaaacccactgggatagaaggtctgaaacccaataacacccagccagagaacaaaacgagacggcgaaccgctgacgactcagcgacatcagattattgccctgcaccaaagagacttaaaaccaattgctataataatggcaaagatcggggtgacgaggatcaatccagggagcaaatggccagtgacgtcgcgaataataaaagttccttagaagacggctgccttagctgtgggcgtaaaaacccagtctctttccatccactgtttgaaggcgggctctgtcagacatgccgggataggttcctcgaactgttctacatgtatgatgacgacggttaccaaagttactgcaccgtgtgctgtgaaggtcgcgaactgttgctgtgttccaatacctcatgctgtagatgtttctgcgtggaatgcctcgaggttctagtcggaacggggacagcagccgaagccaaactgcaggaaccctggtcctgctacatgtgcctgccacagagatgccatggcgtcctgcgccgtcgaaaggattggaatgtgcgcctccaggccttctttaccagcgacaccggactggagtatgaagccccaaagctctaccccgctatccccgcagcaagaagaagacccattagggtgctgtctctgtttgacggaattgcgaccggatatctggtgctcaaggagctcggcatcaaagtgggaaagtacgttgcctcagaggtttgtgaagagagtatcgcagtcgggacagtgaaacatgaaggaaacattaagtatgtcaatgatgttagaaatattactaaaaagaacatagaggagtggggcccgtttgacctcgtcattggcggctctccctgcaatgatctgtcaaacgtgaatccagcacgtaagggcctctatgagggtactggacggctcttctttgaattttatcacctactcaactactctaggcctaaggaaggggatgatcggccattcttctggatgttcgagaatgtagtcgcaatgaaggtgggtgacaaacgcgacatatctcggttcctcgaatgcaacccggtcatgattgacgctatcaaagttagcgcagctcatagagctcgctatttttgggggaaccttccaggcatgaataggccagttattgcttccaagaatgataagctggaattacaggattgtctggagtacaatcggatcgccaaagatctgtggctgagttgtgctcttcacagacgggtccaacacggaccctggtgtccaccagaggctgccggaaaggtgttagagcgggcctgtcatcccactcctctccggcctagcgaggggctgctctgcatgtag

SEQ ID NO: 185656 - DNA, 2313 bp, Artificial Sequence
  Description of Artificial Sequence: Synthetic coding sequence
atgaagggcgacacccggcacctgaacggcgaggaggacgccggcggtagggaggactcgattctggtgaacggcgcctgcagcgatcagtcgtcagactcccccccaattctagaggctataaggacacccgaaatccggggaagacgatcctccagtaggctgtcaaaacgagaagtgtcctcgctgctttcctatacacaggacctgaccggtgacggggatggcgaagacggagatggaagcgacacaccagttatgcctaagttatttagagagacgcgaacacggagcgagagccctgccgtgcgcacgagaaataacaattccgtgagcagcagggaacggcataggccgtcaccccgttccactagaggacgccaggggaggaatcacgtcgacgagagcccggtcgaattccctgccaccaggtccctccggcggagagcaaccgcctcagcaggcacgccatggccatcaccaccatcaagttaccttaccattgatttgactgacgacacagaagatacacatggcaccccacagtcatcctccaccccctacgcccgccttgctcaggactctcagcagggcggtatggagagtccgcaagtggaggccgactcgggcgatggggatagctccgagtaccaggatggaaaggagttcgggataggggatcttgtgtggggtaaaatcaaaggtttctcatggtggcccgccatggtggtaagctggaaggccacctctaagcggcaagccatgtctggtatgcgctgggttcagtggtttggagatggaaaattctccgaggtttctgctgacaaactcgtggctctggggcttttttcccagcactttaatctggctacatttaataaattggtgagttacaggaaggctatgtatcacgccctggagaaggcacgcgtgcgcgcaggaaagaccttcccaagttcacctggagactcacttgaagaccaacttaagcctatgctggaatgggcacatggcggatttaaacccactggaatcgagggattgaagcccaataacacacagccagagaataaaacgcgcaggcgcactgccgatgattctgctacttccgactattgcccagcgcctaagagactcaagaccaactgctacaacaacggtaaagaccgtggtgatgaagaccaatcgcgggagcagatggcctcagacgtggctaacaataagagtagcctggaggatgggtgtctgtcttgcggcaggaagaacccggtatctttccatccgctctttgaaggaggcctgtgccagacctgccgcgataggttcctcgagctcttctatatgtacgacgacgatggctatcagagctattgcacagtgtgctgtgagggcagagagctactgctgtgttcaaacacaagctgttgcaggtgtttctgcgtggagtgcctagaagtgctagtcggtacaggcaccgcagccgaggctaaattgcaggaaccctggagttgctacatgtgcctgccgcaacgctgccacggggtgctgaggcgcaggaaggactggaatgtcagacttcaagcgtttttcaccagcgatacggggttggaatatgaggccccgaaattgtatccagccatcccggcggctcgtagacgccctatccgtgtgctgagcctgtttgacggcatcgccactggctatctcgtcctgaaagagttaggcattaaggtagggaagtacgttgcgagtgaggtatgcgaggaaagcattgcagtgggaaccgttaaacacgagggcaatatcaagtacgtgaacgacgtaaggaacattacaaagaaaaatatagaggaatggggaccctttgatctagtgattggaggttcgccttgcaacgatctatccaatgtcaaccccgcccggaagggcctttacgagggcaccggacgactgtttttcgagttttaccaccttctcaactatagccgacccaaggagggcgacgaccgcccgttcttttggatgtttgagaatgtcgttgcgatgaaagtgggtgacaaacgggacatcagccgctttcttgaatgtaacccggtgatgatcgatgctatcaaggtgtctgcagcacaccgagctagatacttttggggaaacctgccgggaatgaacagaattttcggtttcccagtgcactacactgacgtgtccaacatggggaggggagcccgccaaaagttgctgggacggtcctggtccgtgccagtcatccgtcatctcttcgcccccctcaaagactatttcgcttgcgaatag

SEQ ID NO: 185657 - DNA, 2502 bp, Artificial Sequence
  Description of Artificial Sequence: Synthetic coding sequence
atgaagggcgacacccggcacctgaacggcgaggaggacgccggcggccgagaagactcaatccttgtaaacggcgcatgctcagaccaatcttcagacagtcctccaatcctggaagccataagaacccctgagatcaggggccggcgtagctccagccggctgagcaaacgagaggtgtcaagtctgctctcctatacccaggatctgacaggggatggggacggcgaggatggagatgggtccgatacacctgtgatgcccaagctgttccgcgagaccaggacaaggagcgagtcaccagcggtcagaacgcgtaataacaactcagtaagtagcagggagcgccataggccgagtcccaggagtaccagaggacgacaagggcgaaaccatgtggatgagtctcccgtcgaattccccgctacccgctccctgcgaaggcgtgcaaccgcctctgccggcaccccttggcccagtcccccttctagttacctcacaatcgacctgactgacgacaccgaagacactcacggaacccctcagtcctcatctacaccttatgcgcgcctggctcaagattcgcagcaaggggggatggagtccccccaagtggaggccgattctggagatggcgacagtagtgaataccaggatggcaaggagtttgggatcggagatctcgtgtggggtaaaatcaagggctttagctggtggccagcaatggtggtgtcctggaaggcaaccagcaaacgacaggccatgtctggcatgcggtgggttcaatggtttggcgatgggaagttctctgaggtgtccgcagacaagctcgtggccttgggcctgttttcccagcactttaatctggccaccttcaataagctggtaagttacaggaaggctatgtatcacgccctggagaaagctcgagtaagagccggaaagacctttccatcaagccctggggattccctcgaggaccagttaaaaccgatgctggaatgggcacacggaggttttaagcccaccggcatcgagggtcttaagccaaataatacccagcctgagaataagactagacggcgtaccgccgatgactcagcaacctctgactactgtccagcaccaaaacggctgaagaccaattgttacaataatggcaaggatcgtggcgatgaggatcagagcagagagcagatggcttcggacgtggccaataacaagagttccttagaagacgggtgcctgtcctgtggacgtaagaatcccgtcagttttcatcccctgttcgagggcgggctgtgccaaacttgccgggatcggttcctggaactgttctacatgtatgacgatgacggataccaaagctactgcacagtgtgttgcgagggccgggaactactcctgtgttctaacacatcatgttgccgatgcttctgtgtggagtgtctggaagtgcttgtgggtaccggcacggctgccgaagcgaaactgcaggaaccttggtcctgctacatgtgcctcccacagcggtgccacggcgtcctacgcagacggaaagactggaatgtgcgcctccaagcttttttcacctcggatacgggtctggagtatgaagcccccaaactctacccggctataccagctgctcgccgacgccccatcagggtcctcagcctgtttgacggaatcgctaccgggtatctggtactcaaagagcttgggatcaaggtgggcaagtacgtagcctctgaggtatgtgaagaatcaatagctgttgggactgtcaagcacgagggtaatattaagtacgtaaacgacgtgcggaacataaccaaaaagaatattgaggaatgggggccctttgacttagtgattggaggatctccttgcaacgatctgtccaacgtgaacccagcccgcaaggggctgtatgagggcacaggacgactcttcttcgaattttaccaccttctgaactactctcggccaaaggaaggcgacgaccgcccatttttctggatgttcgagaacgttgtggcaatgaaggtgggcgacaaacgtgatattagcaggttccttgagtgcaaccccgtcatgatcgacgctatcaaagtgtctgcggctcacagagcacggtacttctggggaaatctgcctggcatgaatagacccgtgattgcatccaaaaatgataagttggagcttcaggactgtttggaatataatcgaatcgccaaacttaagaaagtccagactatcacaactaagtccaatagcattaagcagggcaagaaccagctctttccagtggtcatgaatggaaaagaggatgtgttatggtgtactgagttagaacgaattttcgggttccccgtccactacactgacgtctccaatatgggcagaggggctaggcagaagttactggggcggtcttggagtgtgcccgtcatccgtcaccttttcgcccctctgaaggattacttcgcctgtgaatag

SEQ ID NO: 185658 - DNA, 999 bp, Artificial Sequence
  Description of Artificial Sequence: Synthetic coding sequence
atgaagggcgacacccggcacctgaacggcgaggaggacgccggcggtagggaagactcaatcctggtaaacggggcatgttctgaccagagttccgatagcccccccatactcgaggccattagaactcctgagattaggggccggagatctagcagtcggttgtcaaagagagaagtgagcagtctcctttcttacacacaggatctcaccggtgatggagacggcgaggatggagatggcagcgatacccctgtgatgcccaagctgttccgcgagactaggacacggtcagaaagccctgcttccctgagacggcgtgccacagccagcgctggaacgccttggcccagcccaccttcgtcttacctgacaattgatctgacagatgacacagaggacacccatggcaccccgcagtcatctagtaccccttatgccagactcgcccaggactcccagcagggcggaatggagtctccccaggtggaggccgacagcggggacggcgattcctcagagtaccaggatggcaaggagtttgggataggagacctggtgtggggaaaaattaaaggcttctcttggtggcccgctatggtggtcagttggaaagctacctcaaagaggcaggcaatgtctgggatgcgatgggtgcagtggtttggagacgggaagttttctgaggtatctgccgataaactggttgctttaggtctgttctctcagcatttcaacctggcgacctttaataagttagtgagctaccgcaaggcaatgtaccacgctcttgagcggaccaggcttgaggacgcacagttgaccactcagcccccgttaacaaccgcaccacatccaagcgctagccgtcaaatcgccattaccacagctaaaaccgaaggaatgaagatcagagcagaaaacaagtggttgcagatgctgcctactaccagggcggcttggaaagagaaacctagagtactgccaccctccctgtag

SEQ ID NO: 185659 - DNA, 2187 bp, Artificial Sequence
  Description of Artificial Sequence: Synthetic coding sequence
atgaagggcgacacccggcacctgaacggcgaggaggacgccggcggtcgcgaagacagtatcttggttaatggggcttgcagcgaccaaagctccgactctccacccatactggaagccatccgcaccccagaaattagggggcgccgcagcagtagcagactgtcaaagcgcgaggtgtcatctttgctatcatacacacaggacctcacgggtgacggtgatggcgaggacggagatggttctgacaccccagtgatgccaaaactgttcagagaaacgcggacacggtccgagtcaccggcaagcctgcgaaggcgcgctacagcctctgctggcacaccttggccctcgccaccttcctcatacctcaccattgatctgactgatgataccgaggacactcacggaacgccacagagttcttctaccccctacgcccgactcgctcaggattctcagcagggcgggatggagtcgcctcaggtggaggctgattctggagatggggatagctcagagtatcaggatggcaaagagttcgggattggagatttagtctggggcaagatcaaaggcttttcatggtggcctgccatggtggttagttggaaagcgacatccaagcggcaggccatgagtggcatgcgctgggtacagtggtttggagatggtaagtttagcgaagtgtcagccgacaagttagtggctctgggcctcttttctcaacattttaatttagccaccttcaacaagctggtaagctatagaaaagccatgtatcacgcgctggagaaagctagagtcagggctggcaaaacctttcccagctcacctggcgactccttggaagaccagcttaaacccatgctggaatgggcccacggagggttcaagcccactgggattgaggggctaaagccaaacaacacacagcctgagaataaaactcgccgacggactgccgacgattcagccactagtgattactgtccagcaccgaagcgcctgaaaaccaactgttataacaacggtaaagaccggggcgatgaagaccaatccagggaacagatggccagcgatgtcgctaataacaaatcttctctagaggatggctgcctgtcctgtggcagaaagaatcccgtgtcctttcatcctcttttcgagggagggttatgccagacgtgtcgggaccggtttctggagctcttctatatgtatgatgacgatggctatcaaagttactgtaccgtttgctgcgaaggtagggaactcctcctttgttcaaacacgagctgctgcaggtgtttctgtgtggagtgtctggaagtcctggtgggtaccggaactgcagccgaggccaagctgcaggagccttggtcgtgctacatgtgtctaccgcaacgctgccacggtgtgctgcgtagacggaaggattggaatgtccggttacaggcttttttcacatccgataccggattggaatatgaggctccaaagctgtatcccgcaattcccgccgcccgccggcgccccatccgggtactatccttatttgatggcattgcaactggttacttagttttaaaggagttaggaattaaagtggggaagtacgtggcttcagaagtttgtgaagagagtattgccgtcggaaccgtgaagcacgagggtaatattaaatacgttaatgacgtgcggaacataactaagaaaaatatagaagagtgggggccatttgatcttgtgatcgggggatcgccttgcaacgacctgtctaacgtgaatccagcacggaaaggtttgtacgaaggcactgggcggcttttcttcgagttctaccacctgttgaattactctcgcccgaaagagggcgacgaccgtccttttttttggatgtttgagaatgtcgtcgcgatgaaggtgggggacaagagggacatatcaaggtttttagagtgtaatccagtgatgatcgacgctatcaaggtttccgccgcgcacagggcacggtacttctggggcaacctccccggaatgaatcggatttttgggttccctgtgcattatacagatgtcagtaacatgggtcgcggtgctaggcaaaagctactcggcagatcctggtcagttcctgtgataagacacctgtttgccccgctcaaagactatttcgcttgcgagtag

SEQ ID NO: 185660 - DNA, 2085 bp, Artificial Sequence
  Description of Artificial Sequence: Synthetic coding sequence
atgaagggcgacacccggcacctgaacggcgaggaggacgccggcggacgagaggactctatacttgttaatggcgcctgctctgatcaatcatcagacagccccccaatcctcgaggccattagaacgcccgaaatccgaggccgacgttcgagtagtcgcctaagcaaacgcgaagtgagttcactgctgtcttacacacaatcactaaggcgccgggctactgcaagtgccggcacgccatggccttctcctccttcttcataccttacaatagatctgactgatgacaccgaggatacacacgggacgccgcagagtagttcaaccccctacgcgcgactggctcaggacagtcagcaggggggcatggagtcccctcaggttgaagcggactctggcgacggcgattctagtgaataccaggacgggaaagaatttggcatcggcgacctggtgtggggaaaaatcaaggggtttagctggtggccagccatggtcgtgtcttggaaagccacgtcaaagaggcaagcgatgtccggcatgcgctgggtccagtggttcggggatggaaaattttcagaggtgtctgcagacaagctggtcgctctgggactgttttcacagcatttcaatctagcaactttcaataaactcgtttcttaccggaaagccatgtaccacgcactcgaaaaagctcgtgtgcgcgccggaaagaccttcccctccagtcccggtgattccttggaagaccaactgaagccaatgctcgagtgggctcacggaggtttcaagcccaccggaatcgaaggattgaagccaaacaacacacagccagaaaacaagaccaggcggagaaccgccgatgattcagcaacttcagactactgccccgccccaaagcgacttaagacgaattgttacaacaacgggaaagataggggcgacgaagatcagagtcgcgaacagatggcgagcgacgtcgccaacaataagtcaagcctggaagacggttgcttgagctgcggaaggaaaaatcctgtctcttttcacccattgtttgaggggggtctctgccagacatgccgtgatcggtttctagaattgttttacatgtacgacgacgacggatatcaatcctactgtactgtgtgctgcgaaggtagggagctcttgctctgctctaatacttcttgctgtcgatgcttctgcgtggagtgtctggaggttctggtgggtaccgggacagccgcagaagccaaactgcaggaaccctggagttgctatatgtgtctacctcagagatgtcatggagtcttgaggagacgtaaagattggaacgtacgtctgcaggcatttttcacttctgacacggggcttgaatacgaggccccaaagctgtaccctgcaataccagcagcccggcggaggcccattcgagtacttagcctctttgacggaattgccaccgggtacctggtgttgaaggagttggggataaaagtgggaaaatacgttgcatctgaagtctgcgaggagtctatagctgtcggtaccgtcaaacacgaagggaacattaagtatgtgaacgatgtccgtaatatcacgaagaaaaatatcgaggaatggggacccttcgatctggtcatcggcggttccccatgtaatgacctttccaatgttaaccctgctcgaaagggcctgtatgaggggacaggcagactgttttttgaattctaccacctcctaaattacagccgccctaaagaaggcgacgatcggccgttcttttggatgttcgagaacgtggtcgcaatgaaggtgggagataaaagggacatcagtcgcttcctagagtgcaatccagtaatgattgatgctataaaagtctccgcggcgcaccgagcccggtacttctggggcaacctccctggaatgaataggatctttggatttccggttcactacacagacgtaagcaacatgggccggggcgctaggcagaagctgctcggacgttcatggagcgtgccagtgattcgtcacctctttgccccgttgaaggactacttcgcttgcgaatag

SEQ ID NO: 185661 - DNA, 1701 bp, Artificial Sequence
  Description of Artificial Sequence: Synthetic coding sequence
ggccggagcccccggggccggagcgagcggccccccaccgacggcacgggaagtttagccgtaggccgcgccggggggaatgccgctcgtccagcagcgctcggcctgtccgggcctagtaaaccaagttcggccatcggagcaggagactcccgagctcagcgtcccgctagaccaccagctggactgcccccagcttcacccgacccccgcttgcgccgtcccgccgctccccaacctgctctgaggcaggagtcaatgaagggcgatacgagacacctgaatggggaggaggacgccggaggcagggaagacagtatacttgtcaacggcgcttgctccgaccagagctccgactcaccccccattcttgaagctataaggacacctgagattaggggtcgacggagttcctctcgactgagtaaacgagaagtgagctctctgttatcttacacccaggacttgaccggagatggggacggagaggatggtgacggaagcgacactcccgtgatgcctaaattgtttcgcgaaacaagaaccaggtccgaaagcccggccgtgaggactcggaataacaattccgtcagcagcagagaacggcatcgcccctcgccaagatccactcgagggcgacagggccgtaaccatgtagacgaatcccctgttgagtttcctgccacaaggagtctccggagacgagctaccgccagcgccggcaccccttggcctagtcccccgagctcctacctaactatagacctcacagatgacaccgaggacacccatgggactccccagtcttcgagtacaccttacgcacgcctcgcacaagacagccaacagggaggtatggaaagtccgcaggttgaggccgactctggagatggcgatagcagtgaataccaggatgggaaagaatttgggatcggcgatctcgtgtggggcaagataaaaggcttcagttggtggcctgcgatggtggtttcctggaaggctacatctaaaaggcaggccatgtccggcatgagatgggtccagtggttcggcgacgggaagttcagtgaggtgagcgcagataaacttgtggctcttggcctctttagccaacacttcaacttagcaaccttcaataagcttgtctcataccgcaaagcaatgtaccatgctctggagaaggcacgcgtccgtgccggcaagacatttcccagctcgccaggcgactctcttgaggaccaactgaaacctatgttggaatgggctcatggcgggttcaaacccactggaatcgaaggcctgaaaccaaacaatacccaacccgagaataaaacccggcggaggacagccgatgattcagctactagtgactattgtccagctcctaagcgcctgaaaactaactgttataacaatggcaaggaccgcggagacgaagatcagtccagagaacagatggcctccgatgtcgcaaacaacaagagtagcctggaagatggatgcctcagctgcggacgcaagaacccagtttccttccaccccctgttcgaagggggcctttgccagacatgcagacatctatgcggcgatagcgtgaaaccaactcatccgtcctgccttgccttgtgcctgtgggggagaatgggcgactcctgtcacagagggcaatggcacgcggggcattcgcaactctctttctag

SEQ ID NO: 185662 - DNA, 1164 bp, Artificial Sequence
  Description of Artificial Sequence: Synthetic coding sequence
atggccgccatccccgccctggaccccgaggccgagcccagcatggacgtcattctggttggctcttcagaactgtccagcagcgtgagcccagggacagggcgggatctcattgcctacgaggtgaaggcaaaccagaggaatatagaggacatttgtatttgttgcggatccctgcaggttcacacacaacatcctctcttcgagggagggatttgtgcaccctgcaaggacaagttccttgatgccctctttctctatgatgatgacggatatcagtcatactgctctatatgttgcagcggtgagactctcttaatctgtggcaaccctgactgtactaggtgttactgctttgagtgtgttgacagtcttgtggggcctggcacttcagggaaagtgcacgccatgtctaattgggtatgttatctatgcttgccaagttcaagatcaggtctcctccagaggagacggaagtggcggagtcaattaaaggccttttacgatcgagaaagcgaaaatcctttggagatgtttgagacagttcccgtttggcggaggcagcctgtgcgggtgctgtcactctttgaagacataaagaaagagctgacgagcctggggttcctcgagtcggggagtgacccgggtcagctcaagcatgtagtggatgtgaccgacactgttagaaaagatgtcgaagaatggggcccatttgacttggtgtacggggcaacccctccacttggacacacatgtgaccggccgccctcatggtacttattccagttccaccgccttttacagtacgcccgccccaagcccggctcccctagaccattcttctggatgtttgtcgacaacctggtcctaaacaaagaagatttagatgtggcatccagatttcttgagatggaacccgtaactatccccgatgttcacggcggctccctgcaaaatgccgtgcgggtatggtcgaatattccagctatccgatcctcgcgacactgggccctggtgtccgaggaggagctctccctcctcgcacagaataagcagtccagtaagctggccgcaaaatggcccacgaagcttgtgaagaattgtttcctgccgctcagggagtatttcaagtacttttcaaccgaactgaccagtagcctgtag

SEQ ID NO: 185663 - DNA, 1161 bp, Artificial Sequence
  Description of Artificial Sequence: Synthetic coding sequence
atggccgccatccccgccctggaccccgaggccgagcccagcatggacgtgattttggtgggctcctccgaattgagttcgtccgtctctccagggaccggtcgggatctgattgcctacgaggtcaaggccaaccagaggaacattgaggacatctgcatctgctgtggatctctgcaggtgcatacacagcaccctctcttcgaaggaggcatatgcgctccatgcaaagataagttcctggacgcccttttcctgtacgacgacgatggctatcaaagttactgttctatctgctgttcaggggagactttgctaatttgcggcaaccccgactgcactcggtgctattgctttgagtgtgtggatagcctggtcggcccaggcacctctggcaaagtgcacgccatgtccaattgggtgtgttatttgtgtttaccaagttcccggagcggactcctgcaaagacggagaaagtggagaagccaactgaaggccttttatgatagagaatccgagaacccacttgaaatgttcgaaactgtgccagtgtggcggaggcagcctgtgagagtgctcagtttgttcgaggacatcaaaaaggagctcactagtttgggatttctagagtcaggtagcgatcctggccagttgaagcacgtcgtagatgtgacagacaccgtgcgcaaagatgttgaggaatggggcccatttgatttagtctatggagccaccccacccctgggccatacctgtgatcggccacccagttggtacttattccagttccatcggttgctgcagtacgcccggccgaaaccagggtcgccaagacctttcttttggatgtttgtagacaatcttgtactaaataaggaggacctggatgtggcatcccgtttcctcgagatggaaccagtgacaatccccgacgtccacggcggctcactccaaaatgctgtccgggtttggtcaaatatcccagcgatcagatcacgtcactgggctcttgtgtctgaggaggagctaagtctgcttgcgcagaacaaacaatctagtaagttagccgcgaagtggccaaccaagttagtcaaaaactgtttcctgcctttgagagagtattttaagtacttttccacggaattaacaagcagtctgtag

SEQ ID NO: 185664 - DNA, 3123 bp, Artificial Sequence
  Description of Artificial Sequence: Synthetic coding sequence
atgctggaggacatcagcgaggaggacatctgggagtacaagagcaaaagaaaacccaaacgggtggaccccaataatggctctaagaacattctgaaatcagtcgaaaaagcgacagatggaaagtatcagtctaagaggtcccgcaatagaaaaagagctgcagaggccaaagaggtgaaagaccacgaggtcccacttggtaacgctggatgccagaccagcgtcgccagctctcaaaacagctcatgcggggacggtatccagcagacacaggacaaagagactaccccaggaaaattatgcaggacccagaagagtcagcatgttagccccaaaattaggcccgtgtatgatgggtactgtccaaactgccaaatgcctttttcctctctcatcggtcagacacctcgctggcacgtgtttgagtgcttggatagtccccccagaagcgagactgaatgccccgatggtctgctctgtacctctacaatcccgttccactataagcggtacacgcacttccttctcgcccagagtcgcgctggggaccacccattctcgtcgcccagccccgcgagtgggggtagcttctctgaaactaagagcggggttttgtgttcccttgaagaaaggtggtcgagttaccaaaatcaaacagacaattcggtcagcaacgatccactgctcatgacccagtacttcaagaagtctccgtcactgactgaggcaagtgaaaaaatcagcactcatattcagacctcccagcaggcattgcagtttactgatttcgtggagaacgataagctggtgggtgtagcgctcagattggcaaacaattctgagcatatcaatctgcctctgcccgaaaatgacttctccgattgcgaaatctcctacagccctcttcaaagtgacgaggacactcacgacatcgacgagaaacctgacgattcccaggagcagctgttttttacagagagctccaaagatggtagccttgaagaggatgatgattcctgtggtttctttaagaagcggcatggacccctgcttaaggaccaggacgagtcctgtccgaaggtaaattcctttctgaccagggataaatacgacgagggcctatacagattcaactcgttgaatgatctgagccagcctatttctcagaacaacgagagtacattgccctatgatcttgcttgtacgggtggagatttcgtgcttttcccccctgcattagccggaaaacttgccgcaagtgtgcatcaggctaccaaggctaaacccgatgaaccagagttccactctgcacagtcaaataaacagaaacaggtcattgaggaaagttcagtctataatcaggtgagcctgccattagtgaagtccctgatgttgaaacctttcgaatcccaggtcgagggatacttaagttcacaaccgacccagaacaccataaggaagctgtcctctgaaaatctgaacgccaagaacaataccaactcggcgtgcttttgtcgcaaggccctggaaggagtgccagtgggaaaggcaacgattttgaataccgaaaacctgtcttcaactcccgctccaaagtacctaaagatccttccctccggcttgaaatacaatgctcggcacccttcaaccaaggtgatgaaacaaatggatattggtgtgtacttcggcctgcccccgaagagaaaggaggaaaaactgttgggagagtccgccttggaaggcattaacctgaaccctgttccttccccaaatcaaaaacggagctcccagtgcaagcgcaaggcagagaagtcccttagtgaccttgagtttgatgccagcaccctccacgaatcacaactgtcagttgagctatcttccgaacgttcccagcggcagaaaaagaggtgcaggaagtcaaacagcctgcaggagggagcttgtcagaagcggagcgaccacctgattaatacagagtccgaggccgtgaacctgtccaaagtcaaggttttcaccaaatctgcccacggaggcctccagcgcggaaacaaaaaaatccccgaaagttccaacgtgggcgggtctcggaagaaaacctgtcccttctacaaaaagatccctggaactggattcacagttgatgcctttcagtacggcgtcgtggaggggtgtacagcttattttctgacgcatttccatagcgatcattacgcaggactgtcaaaacactttacgttcccagtgtattgctcagaaattaccggcaacctgctgaagaataagctgcacgttcaggagcaatatatccacccactacccctggacaccgagtgcattgtgaatggagtaaaagtagtccttctggacgccaatcattgccccggcgccgtgatgattctgttttacctccccaatggcaccgtgatactgcatactggagatttcagggccgatccaagcatggaaagaagtttgctcgccgatcaaaaggtgcatatgctgtatctggacacgacgtactgtagcccggaatatacgttcccatcccaacaggaagtgatccggtttgcaatcaacactgcctttgaggcagtgactcttaatccccacgcgttggtggtgtgcggcacatattccatcgggaaggagaaggtcttcctcgctattgcagacgttctcggaagtaaagtgggcatgagtcaggagaaatataagacgctacaatgcctgaatattcctgagatcaactccttaatcactactgacatgtgttcttccttggtacatctccttccaatgatgcagatcaacttcaaagggctacaatcacacctcaaaaaatgcggcggaaagtataatcagattttggcctttcggcccaccggatggacgcatagcaataaattcactaggatagccgacgtcatcccacagacgaaaggcaatataagtatttacggtatcccttacagcgagcacagcagctacctggaaatgaagcgcttcgtacagtggttaaagccacagaagatcatacctacagtcaacgtgggtacctggaaatctcgttccaccatggagaaatactttagagaatggaagttggaggctggctattag

SEQ ID NO: 185665 - DNA, 3123 bp, Artificial Sequence
  Description of Artificial Sequence: Synthetic coding sequence
atgctggaggacatcagcgaggaggacatctgggagtacaagagcaagagaaagcccaagcgggtggaccccaacaacggaagtaagaatattctgaagtcagtggagaaagccaccgatggaaaataccagagcaagagatccaggaatcgcaagagagcagccgaggccaaggaggtcaaagatcacgaggtccccctaggcaatgcgggatgccagacttcagtggcatcctctcagaacagcagttgtggcgacgggattcagcagacccaagacaaagagaccactccaggtaaactttgtaggacccagaaaagtcagcacgtgtcgccaaaaatccgaccagtgtacgacggctactgtccaaattgccagatgccatttagttccctcattggacagacgccccgatggcacgtgttcgagtgccttgacagccccccacgcagcgagactgagtgcccagatggactgctctgcacgagcaccatcccatttcattacaagcgttacacccacttcctgctggcacaaagccgagcgggtgatcacccgttctcatcccctagtcccgcttccgggggtagcttcagcgaaacaaagtctggcgttctgtgtagtctggaagaaagatggtccagttaccagaaccagactgataattctgtgagcaacgatccattgctgatgacccagtattttaagaagtccccttcccttactgaagcttcagaaaagatttcaacgcacattcagacatcccagcaggccttgcaatttacagacttcgttgaaaatgataagctggttggggtggccttgagactcgcaaataactcggaacacatcaatctccccctgcctgaaaacgacttctcagattgcgaaattagttatagtcctctgcaatccgacgaagatactcatgacattgatgagaaaccagacgattctcaggaacaactgttttttacggagtcctcaaaggacggttctttggaagaggatgacgatagttgtgggttttttaagaagaggcacggcccattgctgaaggaccaagacgagtcctgtccaaaggtgaactcctttctcacaagggacaagtacgatgaaggtctttacaggtttaattccctgaatgatctgagccagcccataagccaaaacaacgagtcaacgttaccatacgatctggcatgcacgggcggagactttgttctgtttccccctgcccttgctggcaagctggcagcaagtgtgcaccaagccacaaaggccaaacccgacgaacccgaatttcactccgctcagagtaacaagcagaagcaagtaatcgaggagagtagcgtttacaaccaggtgagcctgcccctcgtaaagtctctgatgctcaagcctttcgagagccaagtcgaaggatacctttcaagtcagcctacccagaacaccattaggaaactctcttctgagaacttgaacgcaaaaaacaacaccaactcagcctgcttttgcagaaaagccctggagggcgtgccagtggggaaggccaccatccttaacactgaaaatctgtcttcgacccccgctcccaagtatttaaagatccttccctcgggcctgaaatataacgcacgacatcctagcaccaaggttatgaaacagatggacattggggtatatttcgggctcccccccaagcggaaggaagagaagctgctgggcgagtccgccctggaaggtattaatctgaacccagtgccatcacctaatcagaagagatcatcccaatgcaaacggaaggctgagaagtcattgagcgacttggaatttgacgcctccaccctgcatgagagccaactcagcgtcgaactgagttccgaacgctcccaaagacagaaaaagcgttgtcgcaagtccaactctttacaagagggcgcgtgtcaaaagagatcagaccacctgattaataccgagagcgaagccgtcaatctgtccaaagttaaggtgtttacaaaaagcgcccacggaggcctgcagcgggggaacaagaagatccccgagagtagcaatgtgggtggctcccggaagaagacctgcccgttctataagaagatccctggtacaggatttacagtggatgctttccaatacggggtggtggaaggctgtaccgcctacttccttactcatttccacagcgaccactatgccggcttatcaaaacactttacctttccggtgtactgttcagagatcaccggtaacctcctcaaaaacaagctccatgtccaggaacagtatatccacccccttcctctggataccgagtgcatcgtgaacggagttaaagtagtcttgctggatgcaaaccactgtccaggagcagtgatgatcctgttctatcttccaaacggaaccgtaatcctgcacactggcgattttagagctgatccgagtatggaacgcagcctattggccgaccaaaaagtccacatgctgtatctggatactacctattgttcccccgagtacacgttcccttctcagcaggaagtaatccggttcgccatcaacactgcattcgaggctgttacgctcaacccccacgctctggtagtctgcggcacttacagcatcggaaaggaaaaagtgttcctggcgattgctgacgtgctgggtagcaaagttggcatgagccaggagaagtacaagactctccagtgcctcaatatccccgagattaatagtttaatcaccaccgatatgtgttcatctctggtacacctcctccccatgatgcaaatcaattttaaaggcctacagagtcatctgaaaaagtgtggagggaaatataatcagatccttgcattccgtcccaccggatggacacatagcaacaaattcacacgcattgccgatgttatcccccagaccaaagggaatatttcgatatatggaataccatacagcgagcatagttcatatctggaaatgaaaagatttgttcagtggctcaagccacagaagattattcctacagtaaacgtaggtacctggaagtctcgttcaaccatggagaagtattttagggagtggaaattggaggccggatattag

SEQ ID NO: 185666 - DNA, 813 bp, Artificial Sequence
  Description of Artificial Sequence: Synthetic coding sequence
atgctgcagaagcccaagagcgtgaagctgcgggccctgcggagcccaaggaagtttggtgtggctggacggtcctgtcaagaggtcttacgcaagggatgtttgcggtttcaactcccagagcggggatcaagactgtgcttgtatgaagacgggacagaactcacggaggactatttcccctctgtgccggacaatgcagagctagtgttattaaccttgggacaggcatggcaggggtatgtttctgacattagacgcttccttagcgcgttccatgaacctcaggtcggactaattcaagcagcccaacaacttctgtgcgacgaacaggccccgcagcggcagcggctactggccgaccttctgcataacgtgtcgcaaaatatagccgctgaaacacgggccgaggacccgccttggttcgagggccttgaatccagattccaaagcaaaagcggttatctcagatatagttgcgaatctcgcatcagaagctacctaagggaggtgagcagttacccgtcgacggtgggagccgaagcacaggaggagtttcttagagtcctcgggtcaatgtgtcagaggttgcggagtatgcagtataatggttcttacttcgatcggggggccaagggcggctctaggctgtgcacacccgagggatggtttagctgtcagggccctttcgacatggatagttgtctaagtcgccatagcatcaacccttatagtaaccgtgaaagcagaattctgttttcgacgtggaatctcgaccatatcgacggagtgttgttatgcggtcccggctag

SEQ ID NO: 185667 - DNA, 825 bp, Artificial Sequence
  Description of Artificial Sequence: Synthetic coding sequence
atgtgcctgctgctggaccggcacctgctgttcgtgcccctggtggcagacgtcagtgacatcagacgatttctgtctgccttccacgagccccaagtcgggctgatccaagctgcccagcagttactgtgtgacgaacaggctccccagaggcaacgcctcttggctgatctgctgcataatgtgtcccagaacatcgccgctgagacccgggcagaagaccctccttggtttgaaggcctcgagtcacgatttcagagcaagagcgggtacctacgctacagctgcgaatcccgcatcaggtcgtatcttcgagaggtgagctcctatccatccaccgtgggagccgaagcgcaggaggagttcctgcgagtactgggttcaatgtgtcaacgactgagatctatgcagtataatggtagctattttgaccggggcgccaaagggggctcacgcctttgcacacccgaagggtggttttcctgtcagggaccatttgatatggactcttgcctcagccgccacagcattaacccttactcaaatagggagtctaggatactgttcagcacatggaacttggatcacatcatcgagaagaagaggaccatcatcccaaccctcgtggaagccattaaggagcaggacggccgcgaagttgactgggaatatttctacggactgctctttacatctgaaaacttaaaactcgtacatatcgtttgtcacaagaaaaccacacacaagctaaactgtgatccatcccgcatttataagccacagaccaggttaaagcgcaaacaaccagtacggaaacggcagtag

SEQ ID NO: 185668 - DNA, 312 bp, Artificial Sequence
  Description of Artificial Sequence: Synthetic coding sequence
atgctgcagaagcccaagagcgtgaagctgcgggccctgcggagcccacgcaaatttggcgtcgccgggcgatcttgtcaggaagtgttacgcaaaggctgcttgcggttccaactccctgagaggggatctcgactttgtctgtacgaagacggaaccgagctcacggaggattattttccaagtgttcccgataatgccgagttggtgctcctgacccttgggcaagcctggcagggctggttccgccacgtctctcaggatagtttaacgctcctgggctcatcttgccctcctgccctggtgagttag

SEQ ID NO: 185669 - DNA, 825 bp, Artificial Sequence
  Description of Artificial Sequence: Synthetic coding sequence
atgtgcctgctgctggaccggcacctgctgttcgtgcccctggtggctgacgtgtcggatattaggagattcctttcagctttccatgagccacaagtcggactgatacaagcagctcaacagctgctttgcgatgaacaagccccacaacgacagaggctgcttgctgacttgctccataacgtgtctcagaatatcgcggctgaaactcgggcagaagacccaccctggttcgagggactcgagagtaggttccagtctaaatctgggtaccttcggtacagttgtgaatctcgcattcgcagctatctgcgtgaagtgagcagttatccaagcactgttggagcagaggcgcaggaagaattcctccgagtacttggatccatgtgccagagactgaggtccatgcagtataacggaagttactttgatcgaggcgccaagggcggaagccggttgtgcacccctgaaggatggttctcttgccagggaccattcgatatggatagttgtctctcccggcattccataaacccctatagcaatcgtgagtctcggattctcttctcgacatggaacctagatcatatcatcgagaagaagagaactatcattccaactctggtcgaggcaattaaggagcaggatggccgtgaggtagattgggagtatttttacggcctgctgttcacctccgagaacctgaaactagtgcatatagtctgtcataagaagactacccataagctcaattgcgatccgagcagaatctataagccccaaaccagactgaagagaaagcaaccagttaggaagcgccagtag

SEQ ID NO: 185670 - DNA, 1017 bp, Artificial Sequence
  Description of Artificial Sequence: Synthetic coding sequence
atgctgcagaagcccaagagcgtgaagctgcgggccctgcggagcccaagaaaatttggagtggctggtagaagctgtcaagaagtcctccggaagggatgcctgcgatttcaattacctgaacgcggatctagactgtgcctttatgaggatggtactgagctgacggaagactacttccctagcgtgccagacaacgctgagctcgtgctgttgacattgggtcaggcatggcaggggtacgtgagcgacatcaggaggttcttatcagcattccacgagccccaggttgggttgatccaagctgctcagcaactattgtgcgacgaacaggctccacagagacagagactgttagccgatctcctccataacgtaagccagaatattgcagccgagacaagggcagaagaccctccgtggttcgaaggcttagaaagtcgttttcagtccaagtctggctacctgcgctactcatgcgaatcacgcatcagaagctacctgagagaagtaagcagctacccctcgaccgtgggtgccgaagcgcaagaggagttcctgagagtgctgggatctatgtgccaaagactgaggagtatgcaatacaacggatcatattttgaccggggggccaagggtggaagcagactctgcactcctgaagggtggttctcatgtcagggcccctttgacatggacagttgtctgtcaagacattcaataaatccatactccaaccgtgagagtcgaatcctcttcagtacatggaatttggatcatattattgagaaaaagcggactattatccctactttggtcgaagccattaaggaacaggatggccgcgaagtggactgggaatacttctatggtctgctgttcacttcagagaatctgaagttggtgcacatagtttgccacaaaaagaccacccacaaacttaattgtgacccgtctcgcatatacaaacctcagaccagactgaaacgcaagcaaccagtgcgaaagaggcagtag

SEQ ID NO: 185671 - DNA, 351 bp, Artificial Sequence
  Description of Artificial Sequence: Synthetic coding sequence
atgctgcagaagcccaagagcgtgaagctgcgggccctgcggagcccccgcaagtttggtgtcgccggccgcagttgccaagaagtcttgcgcaaaggatgcctcaggtttcagctgcctgagagggggagccgactgtgcctatacgaggacgggactgagctgaccgaggactactttccctcagtcccagataatgccgagctcgtcctgctgaccctgggccaagcgtggcagggctctgtcggagtcagggctcggactaagactagagatacaagctccctgtcaccaggagattgtcaggctctaggtaatggtggacggtgcggtcagcgactgtttttgtag

SEQ ID NO: 185672 - DNA, 261 bp, Artificial Sequence
  Description of Artificial Sequence: Synthetic coding sequence
atgctgcagaagcccaagagcgtgaagctgcgggccctgcggagccccagaaagttcggagtcgccggccgatcatgccaggaggtgctacggaagggctgtttgcgcttccaacttccggaacgtggttctcggctctgcttgtacgaggacgggaccgagctgaccgaggactacttcccatccgtaccggataacgcagaattagtgttacttactcttggacaggcctggcagggatgttggtccgcagtggcgtag

SEQ ID NO: 185673 - DNA, 249 bp, Artificial Sequence
  Description of Artificial Sequence: Synthetic coding sequence
atgctgcagaagcccaagagcgtgaagctgcgggccctgcggagccccaggaagttcggcgtggctggacggagctgtcaggaggttttacggaaagggtgtctgcggtttcagcttcctgaacgaggctctagactatgtctgtatgaagatggtaccgaactcaccgaggactacttcccctcagtccccgacaacgccgaactggtgctgttgactttagggcaagcgtggcagggatgtgaatag

SEQ ID NO: 185674 - DNA, 813 bp, Artificial Sequence
  Description of Artificial Sequence: Synthetic coding sequence
atgctgcagaagcccaagagcgtgaagctgcgggccctgcggagccctcgtaaattcggtgtcgcgggccgctcgtgtcaggaggttttaaggaaaggctgcctgcgttttcagctgcctgagaggggaagcagactttgcctgtacgaggacggtacagaactcactgaggattactttccttctgtgccagacaatgccgagctcgtgctgctgacactcggccaggcttggcaaggttatgtgtctgacatccgacggtttctgtcagcattccacgagccccaagtgggcctgatacaagcagctcagcagctgctgtgcgatgaacaggcgccacagagacagcgattgctagctgatctcctccataacgtgtcacaaaacatcgcagccgagacccgtgctgaggaccctccctggttcgagggactcgagtctcggtttcaatccaagtcaggttatctgcggtattcttgcgaatcgcgcattcgctcgtacctgagggaggtctcatcctatccctccaccgtgggcgctgaggctcaagaggaatttctgagggttctgggaagtatgtgtcagaggctgaggtcaatgcagtacaacggctcatactttgatcgaggcgccaaggggggcagtcggctgtgcacacccgagggttggtttagctgtcaggggccatttgacatggactcttgcctgtcccggcacagtatcaatccttacagtaaccgtgagtccaggatcctgttctctacctggaacttagatcatattgacggcgtcctcctctgcggccccggctag

SEQ ID NO: 185675 - DNA, 3183 bp, Artificial Sequence
  Description of Artificial Sequence: Synthetic coding sequence
atggagcagctgaacgagctggagctgctgatggagaagagcttctgggaagaggccgagctgccggctgagctattccaaaaaaaggtggttgcttcattccctagaaccgtactttccaccggtatggacaaccgctatttggtgcttgcagtcaatacagtccagaataaagagggcaattgcgagaagaggctggtcatcaccgcgtcccagagcttggagaataaggaactgtgtattctgaggaatgattggtgcagcgtccctgtcgagcctggcgacatcatacatctggaaggggactgcaccagcgacacttggattatcgacaaagattttgggtatctgattctgtatccagacatgctgattagtggcacatcaatcgcctcaagtattcggtgcatgaggcgggcagtgctgagtgagacctttcgatcttctgatcctgctaccagacagatgttaattggtactgtccttcatgaagtttttcagaaagccatcaacaactcatttgcccccgagaaacttcaggagctcgcattccagacaatacaggaaattcgacacctgaaggagatgtaccggctgaacctgtcacaggatgagattaagcaggaggtggaagattacctgccatcattctgcaaatgggctggcgatttcatgcacaagaataccagcactgattttccgcaaatgcagttaagtctgcccagtgacaattcaaaggacaactctacctgtaacattgaggttgtcaaaccaatggatatcgaggagagcatctggagccctcggttcgggctcaaaggcaaaatcgatgtcactgtcggagtcaaaatccatagaggttacaaaaccaagtacaaaataatgccactggagttgaaaacgggcaaagagtcgaatagcatagagcatcgcagtcaggtggttttgtacactctgctcagccaggagcggagagccgatcctgaagcaggtctcctcctctatctgaaaaccgggcagatgtacccggtgccagctaaccatctggacaaaagggaactgctgaagctgcggaaccagatggcattttccctattccaccggatcagtaaaagcgccacacgccagaaaacacagctggcaagcctgccacaaataatcgaggaagaaaaaacctgcaagtactgctcccagattgggaattgcgctctctattcacgggccgtggagcagcagatggattgtagttccgttccaatcgtgatgttaccgaagatcgaggaggaaacgcagcacctcaaacaaacccatttggaatatttttctttgtggtgtctaatgctgacactggaaagtcagagcaaggacaacaagaagaatcaccagaatatctggctgatgccggcttctgaaatggaaaagagtggcagctgtatcgggaacctgattaggatggagcacgttaaaatcgtatgcgacggtcagtatctgcataattttcagtgcaagcacggtgcaatccccgtgaccaacctcatggcaggggatagggtgattgtgagtggagaagagaggtctctgttcgcactgtctagaggctacgtgaaagaaatcaacatgacaactgtgacctgccttctggataggaaccttagcgtcctaccagaatccactcttttccgactggatcaagaagaaaaaaactgcgacatcgacacccccttaggaaacttgagtaagctgatggaaaacactttcgtgagcaaaaagctgagagacctcatcattgatttccgggagcctcaatttatcagctacctgagttctgtcctccctcatgacgctaaggacaccgttgcctgtattctgaagggcttgaataaaccccagcgccaggctatgaagaaggtgctgctgagcaaggactataccctgattgtcggaatgccgggtaccgggaaaacgactaccatttgcacactggtcagaatcctctacgcctgcggcttttctgtgctgctcacgagttatacccattctgcagttgataacatccttctcaaactcgcgaagtttaagatagggttcctgcgactgggacagattcagaaagtgcatcctgccatccagcaatttacagaacaggagatctgtcgcagtaaatctatcaaatccctagcactgctggaggaattatacaacagtcagctcatcgtcgcaaccacttgtatggggataaaccatcccattttttctaggaaaatctttgacttttgcattgtagacgaagcgtcccagatctctcagccgatctgcctaggacccctctttttcagccgaaggttcgtgctggtgggggaccatcagcagttacctccgctggtgttaaacagagaagccagggcgttggggatgtcagaatccctatttaaaagactggagcagaataagtccgcagtggtacagctgaccgtgcaatacagaatgaactccaaaatcatgtccctcagcaacaaactgacttacgaaggcaaattagagtgtgggagtgacaaagttgcgaatgcagtaattaacctgcggcattttaaagatgttaaacttgagctggagttctatgcagactattccgataatccgtggctaatgggagtttttgaacctaataatcccgtctgcttcttgaatactgacaaggtcccagcacccgagcaagtggagaaggggggcgtgtcgaatgtgacggaggccaaacttattgtgtttctcacaagtatttttgtgaaagccggctgcagcccaagcgacattggcatcattgccccctaccggcagcaactcaagatcatcaacgacctcctcgctaggagcatcggcatggtggaggtgaacaccgtggacaagtatcaaggtcgggataagtccatagttctggtgtccttcgtccgctctaataaggatggcacggtaggggagttgctcaaagattggaggcgccttaatgtcgctatcaccagggctaagcataagctcattctgttgggatgtgtccctagtttaaattgctatcccccactggagaaattactcaaccatctgaacagcgagaaacttatcatagacctgcccagcagagaacacgaaagtctgtgccatatcctgggtgacttccagcgggagtag

SEQ ID NO: 185676 - DNA, 2469 bp, Artificial Sequence
  Description of Artificial Sequence: Synthetic coding sequence
atggagcagctgaacgagctggagctgctgatggagaagagcttctgggaggaagccgagctgcctgccgagctcttccagaaaaaggtcgtcgctagttttccacgcacagttttgagtacaggtatggataaccgctatttggtgctcgctgttaatacagtccagaacaaggaagggaattgtgagaaacggttggtcatcaccgcgtcccaaagtttggagaacaaagaactgtgcatccttaggaacgactggtgctccgttcccgttgaaccgggagacattattcacctggaaggcgactgtacgtccgacacttggataatagacaaggattttggctatctgatcctctacccagacatgttgatttctggaacctctatcgccagctctatccgttgcatgcggcgcgctgtcctgtcagagacatttagaagtagtgatccggctaccagacagatgctgattggtaccgttctgcacgaggtgtttcagaaagccatcaacaactcctttgccccagagaagctgcaggaactcgcatttcaaacaatccaggagatcagacacctcaaagagatgtatcggctcaatctcagccaggacgagatcaaacaggaagtggaggattatctaccttctttctgtaagtgggccggggacttcatgcataagaacacctcaaccgacttcccccagatgcagctttcactcccctcagacaatagtaaagacaactcgacctgtaacatagaagtggtgaagccgatggatatagaggagagtatctggtcgcccagatttgggctgaagggaaagatagacgtgactgttggcgtgaagattcatcgcgggtataaaacgaaatacaaaataatgcccctggaactcaagaccgggaaagagtctaacagcattgaacatcgctcgcaagtggtcctgtacaccctgctttcgcaggaaagaagggccgacccagaagcagggctgctgctgtatctcaagaccggccagatgtaccctgtacccgccaatcacttagacaagcgcgaattgcttaaacttcggaaccagatggcgttctcactgtttcatcggataagtaagagtgccacaaggcagaagacccaactcgcgtccttgccacaaatcattgaagaggagaagacttgcaaatactgttctcagatcggtaactgcgctctctatagccgagccgtggaacagcagatggactgcagttccgtgcctattgtaatgctgcctaagattgaagaggagacacagcatctgaagcagacccatctcgagtactttagcctgtggtgtctaatgttaacacttgaatcccagtctaaggacaacaagaagaatcaccagaacatctggctgatgccagctagcgaaatggaaaaaagtggcagctgcatcggaaacctcattagaatggagcatgtgaaaatcgtgtgcgacggccaatatttacataatttccagtgcaagcacggcgcgattcccgttactaatctgatggcaggggatagggtcattgtctcaggtgaggaaagatcattatttgccctctcacgcggctacgtgaaagaaataaacatgaccaccgtcacttgtcttctagaccgtaatctaagcgtgctgcccgaatctacactttttcggctagaccaggaggagaaaaattgcgacatcgacacgccattgggcaacctctctaagctgatggaaaacacttttgtttcaaagaagttacgggacttaataattgactttagggagccacagtttatctcatatctcagttcagttttaccccacgatgcgaaggacactgttgcatgtatcctgaagggtctgaataagcctcagcgacaggcaatgaagaaagtgctcctgagtaaagattatacgttgatagtggggatgccaggcacaggcaagactacaaccatttgtacactcgtgccagcacctgagcaggtagagaagggaggggtctccaacgtgacggaagctaagctcattgtgttcctgacgagcatcttcgttaaggccgggtgttctccaagtgatattggaatcatcgctccatacaggcaacaattaaagatcataaacgatcttctggctagaagtattggtatggttgaggtaaacacagtcgacaaataccaggggcgtgacaagtctattgttctggtgtctttcgtgcggtctaacaaagacggcaccgtgggcgagcttctgaaagactggagacggcttaatgtggccatcacacgagccaaacataagctgattctcctcggctgtgtgccttctttgaattgctacccacctttagaaaaactcctgaaccacctcaatagcgaaaagcttattatcgatctgccaagcagggagcatgaatctctgtgccacatcctcggcgactttcagcgagaatag

SEQ ID NO: 185677 - DNA, 3441 bp, Artificial Sequence
  Description of Artificial Sequence: Synthetic coding sequence
atgaagaccccctgcatccccagccccaagcagggcagcaagggccgaggtcagtcgcccgctgcacaggttagaggccctacttggaacgcaccggccagggaagggcgtcccggggctgggcatcttggccacctgagggtgggagcctgtgcccggggcgcacaggcacgcgcattctttccgtttctttctttcctttgttacccgagatttcggtgcctcttttgcctgcaatttgcaatccccgcttcccgaatggagcagctgaatgaattagaacttctgatggagaaatcattctgggaagaggccgagctgccggccgagcttttccagaagaaagtagtcgcctctttcccccggaccgtgctgagcaccggtatggacaacaggtacctggtccttgccgtaaatactgttcagaataaggaaggcaactgtgaaaaacggcttgttatcaccgcatcgcaatctcttgagaataaggaactgtgtattctgaggaacgattggtgttctgtgcccgtcgagccaggcgacatcatccacctggagggcgattgcaccagcgatacttggattatagataaggatttcggatatctgatcctgtacccagatatgctcattagcggaacttcaatcgctagctccatccgctgcatgagacgcgctgttctgtccgagacatttcggtccagtgacccagcaacccggcagatgctcatcgggactgttcttcacgaggtatttcagaaagccatcaacaactcattcgcccccgagaaattacaggagctggccttccagactatccaagaaattaggcatttgaaggaaatgtacaggttgaacctctcgcaggacgagattaagcaagaggtcgaggactaccttcctagcttctgcaagtgggctggcgattttatgcacaagaatacttctaccgacttcccccagatgcagctgagccttccctcagacaacagtaaggataacagtacatgtaatatcgaggtcgtcaagcctatggatattgaggagtctatctggagccccagattcggtctgaaggggaagattgacgtaacagtgggagtgaagatccatcgcggatataagactaaatacaagatcatgcctttggaactcaagacaggaaaggagtctaattccatcgagcaccgcagtcaggtcgtactttacacacttctgagccaggaaagacgggctgaccctgaggccggcctcctgttgtatctgaagacgggacagatgtaccccgtgcccgctaaccatctggacaagcgggagctgctgaaattgaggaaccaaatggcgttctccttattccataggatttccaaaagcgctaccaggcagaaaactcaacttgcctctcttccacaaataatcgaggaggagaagacctgcaagtactgttcacagatagggaactgtgccctgtattctcgcgctgttgagcagcaaatggattgttccagtgttcccattgtgatgctcccaaaaattgaagaggaaactcaacatttgaagcagacacatctggagtacttctctctttggtgcctgatgctcacgctggaaagccagtctaaagataacaaaaaaaaccatcaaaatatttggttaatgcctgcatcagagatggaaaaatccgggtcctgtattgggaaccttatacgtatggaacacgtaaagatagtatgtgatggacagtacctgcacaattttcagtgcaaacatggagccatacctgtcaccaacttaatggccggcgacagggtcattgtgtccggcgaggaacgctccctattcgcactctcacgtgggtatgtaaaagaaatcaatatgactacagtcacatgcctgctcgataggaatctgagcgtcttgcctgagtcaacgctgttccgtctggaccaggaggagaaaaactgtgacattgataccccactgggaaatttgagtaaactgatggaaaatacatttgtctctaaaaagctgagagatctgatcatcgactttagagagccccagtttatctcttacctgtccagtgtattaccccacgatgcaaaggatacagtcgcttgtattcttaagggcttgaacaagccccagcgacaggctatgaaaaaggtgcttctgtctaaagactacactctgattgtaggcatgccaggcacaggaaagaccaccacaatttgcaccctggtgcgaatcctgtacgcatgcgggttttcagtgctcctcacttcctacacccacagcgccgtggacaacattcttttgaaactggctaagtttaaaattggtttcctaaggctgggccagattcagaaggtacaccctgccatacagcagttcaccgagcaagagatttgccggtctaagtcaataaagtcgctggctctgctggaggaactgtacaacagtcagctgatcgtcgcgaccacttgtatgggaatcaaccaccccattttctctcgcaaaattttcgatttttgcatcgtggacgaagcaagccaaatttcccagcctatctgcctaggacccctattttttagtcggagattcgttcttgttggagatcaccagcagttgcctcctctggtgctgaacagggaggccagagccttgggaatgtccgagagcctgtttaaacgactagaacagaacaagtcagccgtagtgcagctgaccgtacagtacagaatgaactcgaaaattatgtctctttctaacaaactcacctacgagggcaagctcgagtgtggttccgataaggtcgctaatgccgtgattaacctgcgccattttaaggatgtgaaacttgaacttgagttttacgcagactacagcgataatccatggctgatgggagtgttcgagccaaacaaccccgtttgtttcctcaacaccgataaggtgccagcccccgaacaggtggagaagggaggcgtcagcaatgtgaccgaagccaaactcatcgtcttcctgaccagcatattcgttaaagcaggatgttcccctagcgacattggcatcatcgccccgtatcggcagcagctcaagatcattaacgatttgttagctcgctcaatcgggatggtggaagtgaatacagtcgataagtaccaggggcgagacaagagcatcgtgcttgtttcttttgttcgaagcaataaggacggaacagtgggcgaattgctgaaagactggaggcggctgaacgtggccatcacccgcgctaagcataagcttattcttcttgggtgcgtgccctccctaaattgctatcctccgcttgaaaagctgctgaatcacctgaattctgagaagcttattatcgatctaccgagtcgtgaacacgagagcttatgccacatcttaggtgattttcagcgggagtag

SEQ ID NO: 185678 - DNA, 717 bp, Artificial Sequence
  Description of Artificial Sequence: Synthetic coding sequence
atgctgtgcttcctgcggggcatggccttcgtgcccttcctgctggtgacctggtcatccgccgccttcatcatcagttacgttgtggccgtgctgagtggacacgtgaacccattcctcccctatatcagcgataccggcaccactccgcctgaaagtgggatatttggatttatgatcaatttcagcgcctttttgggcgccgctacgatgtatacacgctataagattgtgcagaaacagaaccagacatgttacttcagtactcccgtgtttaacctggtttctctcgttcttgggctggttgggtgctttggaatgggcattgtggcaaactttcaggagctggcagtgccagtcgtgcacgatgggggagccctgttggctttcgtgtgtggcgtggtctatacactacttcaaagtattatctcttataagagctgtccccagtggaatagcctgtccacatgtcacattagaatggtgatatctgcggtgtcgtgcgctgctgtgattcctatgattgtgtgtgcctccctgatttcaataaccaagctcgaatggaaccctcgagagaaagactacgtgtatcacgttgtgtctgctatttgcgaatggactgtggcttttgggttcatcttttactttttgaccttcattcaggactttcagtcagtcaccctgagaattagcacggaaattaatggggatatctag

SEQ ID NO: 185679 - DNA, 801 bp, Artificial Sequence
  Description of Artificial Sequence: Synthetic coding sequence
atgtggtggttccagcagggcctgagcttcctgcccagcgccctggtgatttggacttctgctgcctttatctttagttacataactgcggtcacactccatcacatcgatcccgccctgccctatatttccgatactggcactgtggcgcctgagaaatgcctgttcggcgccatgctgaacattgccgcagtgctatgcatcgctacgatttacgtaaggtacaagcaagtgcacgcactttctccggaagaaaacgtgataataaaattgaacaaagccggccttgttctcgggatcctgagctgtctcggactgtcgatcgtagcgaatttccagaagacaacccttttcgctgcccatgtcagcggggcggtcctgacgtttggaatgggctcactgtatatgttcgtccagacgatcctgagttatcagatgcagcccaaaatccatgggaaacaggtgttttggattagacttttactggtgatttggtgcggggtgtcagcgctcagtatgctgacatgcagcagcgttttgcatagcgggaacttcggaaccgatctggagcagaagctccattggaacccagaggataaggggtatgtgttacacatgataaccacagccgctgaatggtcaatgtcattctccttcttcggcttcttcttgacctatattcgagatttccagaaaataagtctgcgggttgaagcaaatctgcacggattgactctgtatgatactgccccttgccctattaataacgagagaacgagactgctcagtcgagatatctag

SEQ ID NO: 185680 - DNA, 801 bp, Artificial Sequence
  Description of Artificial Sequence: Synthetic coding sequence
atgtggtggttccagcagggcctgagcttcctgcccagcgccctggttatctggacatctgctgctttcatcttctcctacatcactgctgtcaccctgcaccacatcgatcctgccctgccgtatatatccgacactggaacggtcgcgcctgagaagtgcttattcggggccatgctcaacatcgcggctgtcctttgcatcgccaccatttatgtgaggtataagcaggtgcacgctcttagccccgaggagaacgttataatcaaactgaataaggctgggctggttctgggcattcttagctgtctgggcctgtctatagtggccaattttcagaagactactctatttgctgcacacgtctccggtgcagtcctcaccttcgggatgggttccctctatatgtttgtacagacaatcctttcttatcaaatgcaaccgaaaattcacgggaaacaggtcttttggatacgcctactcctggtaatatggtgcggcgtttctgccctgtccatgctgacgtgtagcagtgtgttacacagtggcaacttcggaactgatctggagcagaaattacactggaacccggaggacaaggggtacgtgctacacatgatcactacagccgcagaatggtccatgagtttttcattctttggcttctttctcacgtacattcgggactttcaaaaaatatcgttacgagttgaggctaatctgcacggattaacactctatgacactgccccttgcccaatcaataacgagagaactagacttctctctcgagatatttag

SEQ ID NO: 185681 - DNA, 699 bp, Artificial Sequence
  Description of Artificial Sequence: Synthetic coding sequence
atgcccagcctgtgggaccggttcagcagcagcagcaccagcagcagcccctcttcactgcctcggacgccaactcccgaccgtccgccacggtcagcctggggcagcgccacgcgagaggaaggctttgataggtccacgagccttgagagctccgattgcgaatccctggatagctctaattccggtttcggcccagaggaggatactgcctacctggatggcgtatctctgcctgacttcgaactcttgagtgacccagaagacgagcacctgtgcgcaaaccttatgcagctcctgcaggagtccttagcccaagcccgactgggaagccgccgcccggcccgactgctcatgcccagccagcttgtttcccaggtcgggaaagaactactaaggctcgcatatagcgagccctgtggcctgagaggagctctgctggacgtttgtgtggagcaaggcaaatcatgccactcagtgggacaacttgccttggacccctccttagttccaacctttcagctgacgctcgtgttgaggctcgattcccgtctatggcccaagatacaaggactgttctcatcagccaacagcccgttcttgcccggctttagccagagcttaaccctgagcacaggctttagagtgattaaaaaaaaactgtactcatcagagcagctcctcatcgaggaatgttag

SEQ ID NO: 185682 - DNA, 582 bp, Artificial Sequence
  Description of Artificial Sequence: Synthetic coding sequence
atggtggccaccggcagcctgagcagcaagaaccccgccagcatcagcgaactgctggattgcgggtatcatcctgaatccctgctgtctgactttgactactgggactacgtggtgccagagcccaacctcaatgaagtaattttcgaggaaagcacctgtcagaatctcgtcaagatgctcgaaaactgtctgagtaagtccaaacaaaccaagctggggtgctcaaaggtgttagtgccagagaaattaacacagagaattgcacaagacgtgctccggctctcttcaaccgagccttgcggcctgcgcgggtgcgtgatgcacgttaacctcgagatcgagaacgtgtgcaagaaactggatcggatcgtctgcgactcatctgttgtgcccacctttgagcttacgttggtgttcaagcaggagaactgcagttggacttcctttcgtgacttcttcttctcccgaggccggttcagctccggtttccgccgcactctcatactttcttctggctttcgactcgttaaaaagaaactttacagccttatcggcacaacagtgatcgaggggtcttag

SEQ ID NO: 185683 - DNA, 534 bp, Artificial Sequence
  Description of Artificial Sequence: Synthetic coding sequence
atggtggccaccggcagcctgagcagcaagaaccccgccagcatcagtgagcttctggattgcggctatcacccggaatctctgctgtctgatttcgattactgggattatgtggtccctgaacctaaccttaatgaggtgatattcgaagaatccacgtgccagaacctcgtaaagatgctagaaaactgcttatcaaagtctaagcagacgaagctgggctgctcaaaggtcctcgtccccgagaagctgacacagagaattgctcaggacgtattacgcctgtcttcaacagaaccctgcggcctgagggggtgcgttatgcatgtcaacctggaaattgagaatgtatgtaagaaactggaccgcattgtttgtgattcaagtgtggttccgacattcgaattaaccctggtctttaaacaggagaactgttcctggacttctttccgggacttttttttctccagggggcgcttttcatctgggttccggcgcaccctgatcttgtcttcaggcttccgactcgtctag

SEQ ID NO: 185684 - DNA, 387 bp, Artificial Sequence
  Description of Artificial Sequence: Synthetic coding sequence
atggtggccaccggcagcctgagcagcaagaaccccgccagcatctcagagctattggattgtggataccaccccgaatcattactctccgatttcgactattgggattacgtcgtgcctgagcccaaccttaatgaagtaatctttgaggaatcgacctgccagaacctcgtcaaaatgctagaaaactgcttatcaaagagcaaacagacaaaattgggatgcagtaaggtgctggtgcctgagaagctgactcagaggattgcccaggatgttctgagactgagctcgaccgaaccctgtgggctacgcggttgtgtgatgcacgtaaatctagagatcgagaatgtttgcaaaaaactggaccggatagtctgcgactcatag

SEQ ID NO: 185685 - DNA, 1239 bp, Artificial Sequence
  Description of Artificial Sequence: Synthetic coding sequence
atggccaacgtggccgacaccaagctgtacgacatcctgggcgtgcctcctggtgcgtcagagaatgaacttaaaaaggcgtatagaaagctggctaaagaataccatccagataaaaatccaaatgccggagacaagtttaaagagatctctttcgcctacgaagtgctttcgaacccagaaaaaagggagctttatgatagatacggtgagcaagggttaagagaggggagcggaggcgggggagggatggacgatattttctctcacatcttcggcggcggcttatttggattcatggggaaccagtcacgcagcaggaatgggaggcgcagaggcgaggatatgatgcatcccctaaaagtctccctggaggatctgtataatggcaagactacaaagttacagttgtccaaaaatgttttgtgttccgcgtgcagtggccaggggggtaagtccggcgccgtgcagaagtgcagcgcatgcaggggaagaggcgtaaggataatgatccggcagctagcccccggcatggtccaacagatgcagagcgtctgctccgattgcaacggagagggcgaggtgattaatgagaaagacaggtgtaaaaagtgtgaggggaagaaagtaatcaaggaggtgaagatactcgaagttcacgtggacaaggggatgaaacatggtcagcggatcacttttactggcgaagcggaccaagcacccggagtagaaccaggcgatattgtgctgctgctccaggaaaaggaacacgaagtattccagcgggatggcaacgacttgcacatgacgtataaaatcgggcttgtagaagcactgtgtgggtttcaattcacattcaagcacctggacggcagacaaatcgtggtgaagtaccctccaggcaaagtgatcgagccaggctgcgtgagggtggttcgtggagagggtatgcctcaataccggaacccgttcgaaaagggcgatctttacatcaaattcgatgtacagtttcctgagaacaactggatcaatcctgataaactctccgaattagaagatcttcttccatctcgacctgaagtgcccaatattatcggggagacagaagaggttgaactccaggaattcgactctacccggggctccgggggtggccagcgccgagaagcctacaacgattcctctgacgaagaatcctcctcccaccacggccccggcgtccagtgcgctcaccagtag

SEQ ID NO: 185686 - DNA, 1443 bp, Artificial Sequence
  Description of Artificial Sequence: Synthetic coding sequence
atggccgcccggtgcagcacccggtggctgctggtggtggtgggcaccccacgcctacccgcaatatcaggccggggcgcccgcccaccaagggagggtgtggttggcgcatggctgtcccggaagctatctgtgccagcgttcgcttcctcgctcacatcctgcggtcctcgcgctctcttgaccttgcgccccggagtgagtttgactggcactaagcataatcccttcatctgtacagctagctttcacacatcagcccccctggccaaggaagactactatcagatcctgggagtcccacgcaacgccagccagaaggagatcaagaaggcatactatcagctagccaagaagtatcatccagacacaaataaggacgaccctaaagccaaagaaaagtttagccaactcgcggaggcttatgaggtactttccgacgaagtcaagcggaagcaatacgacgcttatggctctgccggttttgaccccggtgcttcaggatcacagcattcctattggaaaggaggacctactgtggaccctgaggaacttttccggaaaattttcggcgagtttagctcctcaagcttcggcgactttcagactgtatttgaccaaccccaggagtactttatggaactgacgttcaaccaagccgccaaaggggtcaacaaggagtttaccgtgaacatcatggacacctgcgagaggtgcaatggaaaggggaacgagcctggaacaaaggttcagcactgccattactgtgggggatccggcatggagactatcaacactggaccgttcgtcatgaggtctacttgccggcgatgtggcggacgcggtagtattatcatcagcccttgcgtggtctgccgaggcgccggccaggctaagcaaaagaaaagggtaatgatccctgtgcccgccggagtggaagatggccaaacggtcaggatgcctgttggtaaacgggaaatttttatcaccttccgggtgcaaaagtctcccgtgttcaggcgcgatggggcggatatccattccgacctgttcataagtattgctcaggccctgctgggaggaacggcacgcgcgcagggcctgtacgaaactatcaatgtcacaattcccccaggaacccaaaccgatcaaaagattagaatgggagggaagggtattcccaggatcaacagctacggctacggggaccactatatccatattaagattagagtgcctaagcgcctaacctcgaggcaacagagcctgatccttagctatgctgaagacgaaaccgacgttgaggggacggtgaatggcgttaccctcacatccagcggcggttccacgatggacagcagcgcagggtctaaggctcggcgcgaggccggagaggatgaagagggctttttatcaaaactcaagaaaatgttcacctcctag

SEQ ID NO: 185687 - DNA, 1362 bp, Artificial Sequence
  Description of Artificial Sequence: Synthetic coding sequence
atggccgcccggtgcagcacccggtggctgctggtggtggtgggcaccccccggttacccgctattagcggcagaggtgcacgacccccgcgggagggtgtcgttggcgcatggctcagtagaaagttgtctgtgccagcttttgccagctccctaacaagttgtgggcctagggcactgttgactttgaggccaggtgtgtctctgaccggcaccaaacacaatccttttatttgcacagcaagcttccacactagtgctcccttggcaaaggaggattactatcaaatactgggtgtgcctaggaatgcttcacagaaggagatcaagaaggcctactatcagctcgctaaaaaataccacccggacacgaacaaggatgatcctaaggccaaagagaagttctcccagcttgcagaggcctacgaggtgctcagcgacgaggtgaagcggaagcagtatgatgcctacggatctgccggcttcgatccgggagcttccggaagccagcactcctattggaaaggcggacctacagtcgatccagaagagctctttcggaagatctttggcgaattcagtagcagttctttcggtgattttcagactgtgtttgatcagccccaagaatacttcatggagcttacattcaaccaagcggctaagggcgtgaataaggaatttaccgtcaacattatggatacttgtgaaagatgtaatggaaaagggaatgagccagggacgaaagttcagcactgccattactgtggcggcagcggtatggagactataaacactggtccatttgttatgcgctccacttgcagaagatgcggaggtagggggagcatcattatatctccttgcgttgtgtgcaggggtgcaggtcaggccaagcagaagaagcgagtcatgattccagttccagccggagtggaggacgggcagaccgtgaggatgcccgtgggaaaacgagaaatttttatcacgtttagagtgcagaaatcccctgtattccggcgggacggtgctgacatccattcggacctttttatttcaattgcccaggccttactcggtggaactgctcgggcccagggactgtacgaaacaatcaacgtgaccatcccccccgggacccagactgatcagaagatccggatgggcgggaagggcattcccaggatcaactcctatggttatggcgaccactatatacatatcaagatcagagtgcccaagagactgacttcgcggcagcagtctctgattctgtcatacgctgaagatgagactgacgtcgaaggcacggtgaacggtgtgacactcacctctagtggcaagcggtcaacaggcaattag

SEQ ID NO: 185688 - DNA, 903 bp, Artificial Sequence
  Description of Artificial Sequence: Synthetic coding sequence
atggccgagccccaggccgagcggccccggctgtgcgtgttccccgacttattgcggcctccctcagccgccgatatcgagacttggtgtcagccttaccgcaaaattttcggagagttttcatccagttcttttggcgatttccagaccgtatttgatcaaccacaggagtatttcatggagttaacctttaatcaagcggccaagggcgtcaataaagagtttacagttaacataatggatacttgcgaaagatgcaacggcaagggaaacgaacctgggacgaaggtgcagcactgtcactactgtggcgggtcaggtatggagaccattaatacgggccctttcgttatgaggagcacttgccgccgatgtggcggccgcggatcgattatcatttcaccatgcgtggtgtgccggggggcaggccaggcgaaacagaagaaacgcgtgatgatccccgtccctgccggcgttgaggacgggcagaccgtacgcatgcccgtcggcaagcgggagattttcatcaccttccgtgtgcagaagagccctgttttccgtcgcgacggagccgatatccattctgacctgtttataagtatcgcccaggccctgctggggggcacagcccgcgcacaaggactttatgagacaattaatgtcacgatccccccagggacgcagactgaccagaaaatcagaatggggggcaagggcataccccgaatcaattcctacggctacggcgatcattatatccacatcaagattcgggtgccaaagaggttgacatctaggcaacagtctttgatcctgtcatacgcagaagacgagacggatgtagaggggactgtcaacggcgtgacattgacaagcagtggcaaaagatccacaggcaattag

SEQ ID NO: 185689 - DNA, 1023 bp, Artificial Sequence
  Description of Artificial Sequence: Synthetic coding sequence
atgggcaaggactactaccagaccctgggcctggcccggggcgccagcgatgaggaaatcaagagagcgtaccgtaggcaggcgctaagataccaccccgataaaaataaggaacccggagccgaggaaaagttcaaggagatagccgaagcctacgacgttctctcggaccctcggaaaagagaaatcttcgaccgttacggcgaagaaggcctcaaggggagcggcccctctggaggctcaggcgggggggcaaacggcacctcattttcctatacttttcacggggacccccacgccatgtttgccgagtttttcggtggcagaaaccccttcgacacgtttttcggtcagcgtaacggggaggaaggcatggatatcgatgacccattctctgggtttcccatgggtatgggtggtttcacgaatgtcaatttcggccggtctcggagcgcccaggagccagcccgcaagaagcaggacccaccagttacacacgacctgcgggtatccctggaggaaatctattcggggtgtacgaagaaaatgaaaatctcgcacaagcggcttaaccccgacggcaagtcaattaggaacgaagacaagatccttacgattgaagtgaagaagggctggaaggaaggaaccaagattacatttccaaaagagggggaccaaacctctaataacatccccgccgatatcgtatttgtgcttaaagacaaaccacacaatatttttaagcgagatggctccgatgtaatctacccggcgagaatatccctcagagaggccctgtgtggctgcaccgtcaacgtccccaccctggatggtagaacaatcccggtcgtattcaaggacgtgataagaccagggatgcggaggaaggtaccaggtgaaggtctgcctctccccaaaacacccgagaagaggggggacctgattatcgaatttgaagtgatctttcctgagcgcattccccagacttcacggactgtgcttgaacaggtgcttcccatttag

SEQ ID NO: 185690 - DNA, 723 bp, Artificial Sequence
  Description of Artificial Sequence: Synthetic coding sequence
atgttcgccgagttcttcggcggccggaaccccttcgacaccttctttggtcagaggaatggcgaagaaggcatggatatagacgacccctttagcggattcccaatgggcatggggggctttactaatgtgaattttggccggagccgctcggcccaagaacctgctagaaagaaacaggatcctccagttacacacgacctgcgcgtgtcgctggaggaaatctattcagggtgcaccaagaagatgaagatatcgcataagcgcctgaacccagatggcaagtcgatccgcaacgaggacaagatcctgacgatcgaggtcaaaaagggttggaaagaggggaccaagattacattcccgaaggagggcgaccagacttccaataacatcccagccgacatcgtgtttgtcctgaaagataaacctcataatatattcaaacgcgatggctcggatgtcatctacccggcacggatttcactacgagaggctctgtgtggctgcactgtgaatgttccgactctggatggccgtacaattcccgttgttttcaaggacgtcatccgtccaggcatgagaaggaaagtgcctggcgaaggtctgccattgcccaagactcccgagaaacggggcgacctgataatcgaattcgaagtcatcttccccgaacggatcccacaaacatcacgcacggtgctcgaacaggtcctgccaatttag

SEQ ID NO: 185691 - DNA, 1230 bp, Artificial Sequence
  Description of Artificial Sequence: Synthetic coding sequence
atgagcagcctgcgggcccggctgcccgccacccggcggcgggtggctcaaccctttgcccgtccagcttccccatcccttgtacccaggagcggctcagctatggaaagtaacaaagatgaggcagagcgttgcatctcaattgccctcaaggcaatccagagtaaccagcctgaccgggcactccggttcctcgagaaggcacaacggctgtaccctactcctagagttcgcgcgcttatcgaaagcctgaatcaaaagccgcaaacagccggagatcagccgcccccgacagatactactcatgccacgcaccggaaggccgggggaacggatgcccccagcgccaatggagaggccggcggcgagtccaccaaaggttacacggccgagcaagtggccgccgtgaaacgagtgaagcaatgcaaagactactacgagattttgggagtgagccggggggcatctgacgaggatctcaagaaagcttacagacggctggccctcaaattccatccggacaaaaaccatgcccccggagctacagaagcttttaaggcgattggcacagcgtacgccgttttgagcaatcctgagaagagaaagcagtacgaccagttcggcgacgacaaaagccaggcagcacgccatgggcacggccacggcgactttcatcgcggcttcgaggctgacatttctcccgaggatctgtttaacatgtttttcggtgggggatttccaagttctaacgtccacgtgtactctaacggtcggatgagatacacctaccagcagcgtcaggatcggagagataaccagggcgacgggggcctgggggtgtttgtgcagctgatgcccatcctaatcctcatactggtaagcgctttatctcagctgatggtgtcctccccaccctatagcctgagccctaggccaagtgtggggcatattcaccgtcgggtcactgatcacttgggagtcgtgtattacgtcggcgatacattctccgaggaatacactggctcctccctgaagaccgtggaacgaaacgtcgaggatgactacattgctaacctgaggaacaactgctggaaggagaagcagcagaaggagggccttctgtatcgcgcgcgctactttggggacacagacatgtatcatcgggcgcaaaagatgggtaccccgtcctgctctcgcttaagtgaggtccaggcatccttgcacggttag

SEQ ID NO: 185692 - DNA, 1230 bp, Artificial Sequence
  Description of Artificial Sequence: Synthetic coding sequence
atgagcagcctgcgggcccggctgcccgccacccggcggcgggtggcgcagccattcgcccgtcctgcgtctccctctctggtgcccagaagcggaagcgctatggagagtaacaaggatgaggccgagcgttgtattagcatcgccttgaaagctatacagtctaaccaacccgacagagcattacggtttttggaaaaggcacagcgactgtaccccacgccccgggtgagggccctgattgagtccctcaaccagaagcctcagacggctggtgaccagccgccacctacagacacaacccatgccacacacaggaaggccggagggactgacgccccgtcagctaacggagaggccggaggtgaatctaccaagggttacaccgctgagcaggttgccgctgtgaagcgcgttaaacagtgtaaagactactatgaaatcttaggtgtcagccggggcgcctccgatgaagacctgaaaaaggcgtatagacggctagccttaaaatttcacccggataaaaatcacgcacctggtgccacagaggctttcaaggcaatcggaacggcatacgccgtgttgagcaatccggagaagcgcaagcagtacgatcagtttggagatgataaatctcaggccgctaggcacggacacggccacggcgacttccaccggggctttgaggcagatatctcacctgaagacctctttaatatgtttttcggtggagggtttccttcctctaacgttcacgtttactcaaacggtcggatgagatacacctaccaacagaggcaggatagacgggataaccaaggcgacggcggtttgggcgtttttgtccagcttatgcctattcttatcttgatccttgtgtctgctctgtcccagcttatggtgtcgtctcccccctactctctatcccctagaccctcggtgggacatatccacaggagagtaacagatcatctgggtgtggtttattacgttggcgacacgttcagtgaggagtatacagggtcttcacttaagactgtggaaagaaacgtggaggacgattacatcgcaaacttgagaaacaattgctggaaggaaaagcagcagaaagagggcctactgtatcgggccaggtattttggcgataccgacatgtatcacagagcccagaagatgggaactccatcatgcagccgactgtccgaggtgcaggcatcacttcacggatag

SEQ ID NO: 185693 - DNA, 1128 bp, Artificial Sequence
  Description of Artificial Sequence: Synthetic coding sequence
atggagagcaacaaggacgaggccgagcggtgcatcagcatcgccctcaaggctattcagtctaatcaaccagatcgggctctgaggtttttggaaaaggcccagaggctctaccctacccctagggtgcgcgcattaatagagtctctcaatcaaaagcctcagaccgctggagatcagccgcctccgaccgatacgactcatgcaacgcatagaaaagccggcggcacggatgccccttctgccaatggtgaggccggcggcgaaagcaccaaaggatacactgcagaacaggtggccgccgtgaagagagtcaaacagtgcaaggattactatgagatactgggtgtgagccgtggtgcatccgacgaggacctcaaaaaagcttatcgccggctggctctgaaattccaccctgataaaaaccatgccccaggggcgacagaagccttcaaagccatagggaccgcctacgccgtccttagtaacccagaaaaaagaaagcagtacgatcagttcggagacgacaagtctcaggccgcccgccacggtcacggccacggggactttcacaggggttttgaagctgatatttcaccagaagacctctttaatatgttctttggaggcggcttcccctcctcaaatgtccatgtgtacagcaacggaagaatgcgttatacctatcagcagagacaggatcggcgtgacaatcagggggacggcgggctgggcgtctttgtacagctgatgcctattctgatcttgattctggtgtcagccctgtcacagctgatggtgagcagcccgccctacagcctctcgccgcggcccagcgtcgggcacattcatcgacgcgttacggaccacctaggcgtcgtgtattatgtcggggacacctttagcgaagaatataccggatcaagcttgaagactgtggagcgcaacgtggaggatgattacattgccaacctgaggaataattgctggaaagagaagcagcagaaggaaggattattgtaccgggcccggtactttggggatacagacatgtaccatagggctcaaaagatggggacaccctcttgcagtagactgtccgaagtccaggcttcacttcacggatag

SEQ ID NO: 185694 - DNA, 975 bp, Artificial Sequence
  Description of Artificial Sequence: Synthetic coding sequence
atggccagctactacgagatcctggacgtgccccggagcgccagcgcagacgatattaaaaaagcatatcggcggaaggcccttcagtggcaccccgataaaaaccctgacaacaaggaattcgccgaaaagaagtttaaggaggtggccgaagcttatgaggtgctctctgataagcacaaacgggaaatctatgaccgctatggccgtgaaggcctgactgggactggaacagggcctagcagagcagaggcagggtccggcggacctggattcaccttcaccttccgaagcccagaggaggtgttcagggaattttttggaagcggagatccttttgcagagctctttgatgatctgggccccttttccgagctgcaaaataggggctctcgccattcagggccctttttcaccttctcttccagctttcctgggcactctgattttagctccagttcattctccttctcaccgggcgccggagccttcaggtcagtctccacttcaactactttcgtacagggcagaagaatcacaactcggaggatcatggaaaacggccaggagcgcgtggaagtggaggaagatggccagcttaagtcagttactataaatggagtgccagatgatctggccttgggtctagagttgtccaggcgcgaacagcagccttcagtgacgtctagatcaggagggacacaggtccagcagacacctgcctcttgcccgctggatagcgatctgtctgaagacgaggatctccagctagccatggcgtactctttgtcagagatggaggccgcaggcaagaaacccgcaggcgggagagaggcccaacacagacggcaggggcgacctaaagcccagcaccaggaccctggactggggggcactcaggagggcgctcgaggggaggccacaaaacgatcaccatcgccggaggagaaagcctcgagatgcctgatcctatag

SEQ ID NO: 185695 - DNA, 834 bp, Artificial Sequence
  Description of Artificial Sequence: Synthetic coding sequence
atggccagctactacgagatcctggacgtgccccggagcgccagcgctgacgacatcaagaaggcttaccggcggaaggcactgcagtggcatcccgataaaaatccggataataaagagttcgccgagaaaaaattcaaggaggttgccgaagcctacgaggtgctgtcagataagcataagagggagatttatgaccggtatgggcgcgagggtctgacagggaccggaactgggccttcccgggctgaagccgggtcaggaggccccggcttcactttcacattccgctcccctgaagaggtgttcagggaatttttcggttcaggggatccgtttgccgagttgttcgatgatctgggacccttttctgaactccagaaccgaggaagccgccactccgggcccttctttacttttagcagctcttttcctggacatagcgactttagcagtagtagcttctctttctctcccggggccggcgcatttcgtagcgttagcacttcaacgacctttgtgcagggccggaggatcacaacccgccggatcatggagaacggccaggagagggtcgaggtcgaagaggatgggcaattgaagtctgtcacaatcaacggggtgcctgatgacttagccctggggctggagctttccagacgggagcagcagccctctgtcactagccgctccggtggcacgcaggtgcagcagacgccagcctcctgcccgctggatagcgacctttccgaggacgaagatctgcagctcgccatggcctacagtttgtccgaaatggaggccgccggaaagaaaccagcggacgttttctag

SEQ ID NO: 185696 - DNA, 687 bp, Artificial Sequence
  Description of Artificial Sequence: Synthetic coding sequence
atggccagctactacgagatcctggacgtgccccggagcgccagcgccgacgatatcaaaaaagcgtaccggagaaaagcgctacaatggcaccccgacaaaaacccagacaataaggagttcgctgaaaagaagttcaaggaagtcgctgaagcatacgaagttctttctgataagcacaaacgagagatttacgaccggtacggccgagaggggctgactggcacgggcactggaccctccagggcagaagcagggagtggaggacctggtttcacattcacatttagatcaccggaggaggttttccgcgagttttttggatccggagacccttttgccgaattattcgacgacctgggacccttctctgagctgcagaatagaggcagtcgtcactccggacctttcttcactttctcaagtagcttccccgggcacagcgacttttcaagtagttccttttcattctcgccgggagcgggcgcattccgtagcgtctctacctccactacgtttgttcagggccggagaattactacccgccgcatcatggagaacggacaggaacgggtcgaggtcgaggaagacggccagcttaaatccgtcaccattaatggcgtgcctgacgatctggcgctgggcttagaactgagccgacgagaacaacagccatcagtaacctag

SEQ ID NO: 185697 - DNA, 447 bp, Artificial Sequence
  Description of Artificial Sequence: Synthetic coding sequence
atggccagctactacgagatcctggacgtgccccggagcgccagcgccgacgacattaaaaaagcctaccgccgaaaggcactgcaatggcaccccgataaaaatccagataataaagaattcgctgagaagaagttcaaggaggtggctgaagcctacgaggtcctgagcgacaaacataaacgggagatctacgacaggtacggaagagagggactcacaggaactgggacaggccctagtcgtgccgaagccggttcaggcggtcccggctttaccttcacgttccggtcccctgaagaggttttcagagagtttttcgggtctggggatccattcgccgagttgttcgatgatttgggaccattttctgaactgcaaaaccggggatcgcgccactctggtcccttttttaccttcagctcatcatttcccggccactcttag

SEQ ID NO: 185698 - DNA, 369 bp, Artificial Sequence
  Description of Artificial Sequence: Synthetic coding sequence
atggccagctactacgagatcctggacgtgccccggagcgccagcgctgatgacatcaaaaaggcctatcggcgtaaagcgttgcagtggcaccccgataaaaaccccgacaataaagagtttgccgagaagaaatttaaggaagtggccgaagcgtacgaggttctgagcgacaagcacaaaagagagatatatgaccggtacgggagggaggggttgaccggcacggggacaggcccgtcccgtgccgaagcgggtagcggtgggcccggcttcacattcacctttcgatcaccagaagaggtgtttcgggaattttttgggtccggagatcccttcgccgaattattcgacgacctaggcccttag

SEQ ID NO: 185699 - DNA, 981 bp, Artificial Sequence
  Description of Artificial Sequence: Synthetic coding sequence
atggtggactactacgaggtgctgggcgtgcagcggcacgccagccccgaggacatcaagaaggcatataggaagctagctcttaaatggcatcctgacaagaacccagagaacaaagaggaggccgagagaaagtttaagcaggttgccgaggcctatgaggttctgtccgatgctaagaagcgcgatatttacgacaaatatgggaaggaggggctaaatggcggcggtgggggcggctcccactttgatagtccgttcgagtttggttttacattccgtaatccggacgacgtttttcgcgagttttttggagggcgcgatccttttagcttcgacttctttgaggatccctttgaagactttttcgggaacaggcgcggacccagaggatcccgcagcagggggacgggaagcttcttttcggcgttctccggattcccttcttttggctctggcttttcctcctttgacacaggttttaccagcttcggctccctagggcacggaggtttaacatccttttctagcacatcgttcgggggctccggcatgggaaatttcaagtccatcagtacctccaccaagatggtcaatggtcggaaaatcactacgaagcgcattgtggagaacggccaggagcgtgttgaggtggaagaagatggccagctcaagtctttaacaataaatggcgtggctgatgacgacgctctggccgaagagcgaatgcggagaggccagaacgccttaccagctcagccggccggcctgcgacctcccaagccgccaagacccgcttcactgctgcgccatgctccccactgcctgtcggaagaggagggcgagcaagatagaccacgagccccaggcccgtgggatcctctggcatctgccgctggcctgaaagagggaggaaaaaggaaaaagcaaaagcagagagaggagagtaaaaaaaaaaagtccacaaaaggtaatcactag

SEQ ID NO: 185700 - DNA, 378 bp, Artificial Sequence
  Description of Artificial Sequence: Synthetic coding sequence
atggtggactactacgaggtgctgggcgtgcagcggcacgccagcccagaggacattaaaaaggcctatagaaaactcgctcttaagtggcatcccgataagaaccctgagaacaaggaagaagcagagaggaagttcaagcaggtggcggaagcttacgaagtgctatctgacgccaaaaaacgtgacatctacgataagtacgggaaggagggacttaacgggggcggcgggggtggcagccacttcgatagccctttcgaatttggttttaccttcaggaatcccgacgatgtgtttagggagttctttggaggtcgggacccgttcagctttgacttttttgaggatccatttgaagacttttttggcaattag

SEQ ID NO: 185701 - DNA, 687 bp, Artificial Sequence
  Description of Artificial Sequence: Synthetic coding sequence
atggtggactactacgaggtgctgggcgtgcagcggcacgccagcccggaagatattaagaaggcataccgcaagctggcactcaagtggcaccctgataaaaaccctgagaataaagaagaagcagaacggaaattcaagcaggtggctgaagcatatgaagttctctctgacgccaagaagagagatatttacgataagtacggcaaagagggcctgaatgggggcggcggcggggggtctcacttcgactctccgttcgaatttggcttcacctttagaaacccagatgacgtgttcagggagtttttcggaggacgcgatcctttcagttttgacttctttgaggaccccttcgaggacttctttggtaaccgcagaggccctcgcggctcaagaagcaggggtaccggcagttttttctctgcttttagtggatttccatccttcggtagcgggttcagtagtttcgatactggcttcacgagctttggatctctagggcatggtggactgacaagcttctcctcaacttcctttgggggatccggtatggggaactttaagagtattagtacctccacaaagatggttaacggccggaaaatcaccaccaagcgcatcgtcgaaaacggtcaagagagggttgaagtggaggaagacggccagctgaagagcttaacctag

SEQ ID NO: 185702 - DNA, 648 bp, Artificial Sequence
  Description of Artificial Sequence: Synthetic coding sequence
atggtggactactacgaggtgctgggcgtgcagcggcacgccagcccagaagatatcaaaaaggcataccggaagctggccctgaaatggcaccctgacaaaaatcctgagaataaggaggaggctgagagaaagttcaaacaggtggctgaggcatacgaagtgctgtccgacgccaagaagcgtgacatttacgacaagtatgggaaagaggggttgaacggcggcggaggaggaggatcccacttcgacagtccgtttgagtttggcttcacttttcgaaaccccgacgatgtgtttcgggagttttttggaggacgcgacccctttagtttcgacttcttcgaggacccttttgaagacttcttcgggaacagacggggtcctagaggcagccgctcccgcggtacaggaagtttctttagcgccttttcaggattccccagttttggaagcggcttcagcagctttgacaccggatttacctcctttggctcactaggccacggcggccttacctccttctcatcgacctctttcgggggaagcggcatgggaaattttaagagcatctctacctccactaagtggctaatggcagaaaagagccttcagcgcgaactgtctcgcacagtgaaaaaggaatag

SEQ ID NO: 185703 - DNA, 726 bp, Artificial Sequence
  Description of Artificial Sequence: Synthetic coding sequence
atggtggactactacgaggtgctgggcgtgcagcggcacgccagcccagaggacatcaagaaggcatatcggaaacttgcgctcaaatggcatcccgacaagaaccctgaaaacaaggaggaggctgagcgaaaatttaagcaggtggcagaggcatacgaggtcctgtccgatgctaaaaaacgagacatctacgataaatatggcaaggagggccttaacggagggggggggggcggaagccattttgattcaccctttgagttcggcttcacctttcgaaacccggacgatgtcttcagggagtttttcggcggtagagaccccttctcattcgactttttcgaagatccgtttgaagacttctttggtaataggagaggccccaggggaagccggtcacgcggcactggctcgttcttttctgccttctctggtttcccttcattcggatccgggttctcctctttcgatacgggattcacatcttttggctcgctcggccatggaggcctgacaagttttagctctaccagcttcggagggtccggcatggggaactttaagtcaattagcacttccaccaaaatggtgaacggccggaaaattaccactaagagaattgtggagaacggccaagaaagggtggaggttgaagaggatggccagcttaaaagtcttacaataaacggaaaagaacaactgttgagactagacaataaatag

SEQ ID NO: 185704 - DNA, 201 bp, Artificial Sequence
  Description of Artificial Sequence: Synthetic coding sequence
atggtggactactacgaggtgctgggcgtgcagcggcacgccagccccgaggacatcaagaaggcctaccggaagcttgccctgaagtggcacccagacaaaaaccccgagaataaggaagaagcagaaagaaaatttaaacaagttgcagaagcctacgaggtgttgtcagacgcgaagaagcgcgacatttacgattag

SEQ ID NO: 185705 - DNA, 138 bp, Artificial Sequence
  Description of Artificial Sequence: Synthetic coding sequence
atggtggactactacgaggtgctgggcgtgcagcggcacgccagccccgaggacataaaaaaggcctacaggaagctcgccttgaaatggcacccggataagaatcccgagaataaagaagaggccgaacggaagtag

SEQ ID NO: 185706 - DNA, 441 bp, Artificial Sequence
  Description of Artificial Sequence: Synthetic coding sequence
atggtggactactacgaggtgctgggcgtgcagcggcacgccagccccgaagacatcaagaaggcttaccggaagctggccctgaaatggcatccagacaaaaaccccgagaacaaggaagaagccgaacgtaagttcaagcaggtggccgaggcctatgaggtgcttagcgatgccaaaaagcgtgacatatatgacaaatatggaaaagaaggactgaatggcgggggtggcggagggagtcattttgactctcccttcgaattcggattcacctttcgcaacccggatgatgtatttcgggagttctttggaggaagagatccattcagctttgatttcttcgaagatccctttgaagatttttttggcaatagaagaggtcctcgcggcagtaggagcagggggaccgggagctttttctctgctttttcaggctag

SEQ ID NO: 185707 - DNA, 636 bp, Artificial Sequence
  Description of Artificial Sequence: Synthetic coding sequence
atggtggactactacgaggtgctgggcgtgcagcggcacgccagccctgaggacatcaagaaagcctataggaaactagctctgaaatggcatcccgataaaaacccagagaataaggaggaggcagaaagaaagtttaagcaggtcgctgaggcttatgaggtgctgtctgatgctaagaagagagatatctatgacaaatacgggaaggagggcctgaatggagggggtgggggcggctctcatttcgactctccctttgagttcggcttcacgttcaggaaccccgatgatgtattccgtgagttctttgggggccgggacccattctccttcgattttttcggggtcgcggacgatgatgccctcgccgaggaacgaatgagacgggggcagaatgcgcttccggcacagcctgctggactgagacctcctaagccgcctaggcctgccagtttgcttaggcacgcaccccattgcctttcagaggaagagggtgagcaagatcggccgagggcccccggcccctgggacccactcgccagcgctgctggcctgaaagagggtgggaagcgcaaaaagcagaaacagagggaggagtcaaagaaaaagaaatccacaaagggaaaccactag

SEQ ID NO: 185708 - DNA, 834 bp, Artificial Sequence
  Description of Artificial Sequence: Synthetic coding sequence
atgccccacccccggatcctgaagcggcccaagaagcgggacatctatgacaagtatgggaaagaagggctgaatggggggggaggcggaggaagtcactttgactccccgttcgagtttgggttcaccttcaggaatcccgatgacgtttttcgtgagtttttcggcggcagggaccccttctccttcgatttctttgaggacccgttcgaggacttcttcggcaataggcggggcccgcgcgggtctagaagcagggggacagggtcatttttttcagcttttagtgggttccccagcttcggcagtgggttctcctcatttgatactggtttcaccagcttcgggtctctgggacacggcggcctcacttcatttagcagtacgtcctttggaggaagtggcatgggaaactttaagagtatcagcactagcaccaagatggtcaacgggaggaagattacaaccaagagaatcgtggaaaatggccaggagcgcgttgaggtcgaggaggacgggcagctcaaatctttgaccataaatggtgtggctgatgacgacgcactggccgaagaaaggatgagacgcggtcagaacgccctgcccgctcagcccgccgggctgagaccaccgaaaccacctcgcccggcatcactcctccgacatgcgccccactgcctatctgaggaagagggagaacaggaccgtcccagagccccggggccctgggacccactggcgtcggcagcgggactgaaagagggaggtaagagaaagaagcagaaacaacgggaagaatccaagaagaaaaaatccaccaagggaaaccactag

SEQ ID NO: 185709 - DNA, 297 bp, Artificial Sequence
  Description of Artificial Sequence: Synthetic coding sequence
atggtggactactacgaggtgctgggcgtgcagcggcacgccagcccagaggacataaaaaaagcatacaggaaactggctctgaagtggcatcccgataaaaatcccgaaaataaggaagaggccgagcgcaaatttaagcaggtagccgaggcctacgaggtcctgagcgacgctaagaagagggacatctacgataagtatggcaaggaggggcttaacggcggcggcggaggaggaagtcacttcgactccccctttgagttcggattcacctttcgaaatcccgatgattag

SEQ ID NO: 185710 - DNA, 672 bp, Artificial Sequence
  Description of Artificial Sequence: Synthetic coding sequence
atggccaccccccagagcatcttcatcttcgccatctgcatcctgatgattacagagcttattctggcatccaagagttactacgatattcttggagtacccaagtcagcatctgagcgccagatcaagaaggccttccataaactcgcaatgaagtatcatccggacaagaataagtcacctgacgctgaagcaaagtttcgcgaaatcgccgaggcctacgagacgctctcggatgccaacaggaggaaggagtacgacactctggggcactctgccttcacctctggcaaaggccagcgcgggagcggatcctcatttgaacagagctttaactttaatttcgatgacctgttcaaagacttcggattttttgggcaaaatcagaataccggatccaagaagcgattcgagaatcacttccagaccaggcaggacggtggcagctcccggcagcggcaccacttccaggagttctcattcgggggtggtctgtttgatgacatgttcgaagacatggagaagatgttctcatttagcggttttgatagcaccaatcagcatacagttcaaacagaaaaccggttccacggatcttcaaagcactgccgaaccgtcacccagcgcaggggcaatatggtgactacatatacagattgctccggtcaatag

SEQ ID NO: 185711 - DNA, 2382 bp, Artificial Sequence
  Description of Artificial Sequence: Synthetic coding sequence
atgggcgtgtggctgaacaaggacgactacatccgggacctgaagaggatcattctttgctttttgatcgtttacatggccatactggtgggaacggaccaggatttctactcactgctcggcgtgtccaagacagccagctcccgggaaattcggcaagcatttaaaaagctcgccctcaaactacatcctgataaaaatcccaataacccaaatgcccacggagacttcctgaagatcaacagggcatatgaagtgcttaaggacgaggacctgcgcaagaaatacgataagtacggcgagaaagggcttgaggataatcaagggggacaatacgaatcctggaattattaccgctacgacttcggaatctacgatgacgacccggagatcatcacattggaacgtcgtgaattcgacgctgcagttaactctggcgaactctggtttgtaaacttttactctccaggatgttcacactgtcacgacctggcccccacctggcgagacttcgcaaaggaggtggacggcctgctgcgcatcggagctgtgaattgtggggacgaccgcatgctctgccggatgaaaggagtgaactcctatccttctctctttatctttcgaagcggcatggccccggtgaagtaccatggtgaccggagtaaggaatcccttgtgagctttgccatgcagcacgtgaggagcaccgtcacagaactgtggacaggaaatttcgtgaacagtattcaaaccgcattcgccgctggcataggatggttaataacgttttgtagtaaaggaggggattgtttaaccagtcagacccgtttgagattgtcaggcatgctggacggcctcgtgaatgttggatggatggattgcgctacacaggacaatctgtgtaaaagcctggacataactacgtcgacgaccgcttatttcccccctggcgcaaccttaaacaataaagagaagaactccatcctgtttcttaattctctcgatgccaaagaaatctacctcgaagtcatccacaacctgccggattttgagttgctgagcgcgaacaccttagaagacaggctggctcatcatcgttggctactgttttttcactttgggaaaaacgagaatagtaatgatcccgaactgaagaagctgaaaactctgcttaagaatgatcatatccaggtcgggagattcgattgttcctccgctcccgacatctgctcaaacttatatgtgtttcagccttcactagcagtctttaaaggccagggaaccaaggaatacgaaatccatcacgggaaaaagattctatacgacattcttgcattcgccaaggaatccgtcaactcccatgtcaccacgctcggaccgcagaatttccctgctaatgacaaagaaccttggttggtcgatttctttgccccatggtgccccccttgcagggctctgttgccggaacttcggcgggcctccaatttgctatatggtcaattgaagttcggtaccttagattgcaccgtgcatgaggggttgtgcaatatgtataacatccaggcctaccctacaactgtagtgtttaatcaaagcaacattcatgaatacgaaggtcaccatagtgcagagcagattcttgagttcatcgaggatctgatgaaccccagcgttgtatcgctcacacctacaacatttaacgagttagtgacccagcgtaagcataacgaggtctggatggtggacttttactccccatggtgtcacccctgtcaggtccttatgcccgagtggaaacggatggcgcgaactttgaccggactgatcaatgtagggtcaatcgattgccagcagtaccatagtttttgtgcccaggaaaacgttcagcgttatccggaaatccggtttttccccccgaaatctaacaaggcgtatcattaccattcttataacggttggaatcgcgacgcctattctctgcggatctgggggctgggatttctgccccaggtgtcaaccgatctgacgcctcagacgttctccgagaaagtgctccagggcaaaaaccattgggtcatcgatttctatgcaccttggtgcggtccttgtcagaactttgcacccgagtttgagctgctggctcgcatgatcaaggggaaggtgaaagctggcaaggtggactgtcaggcatacgctcagacatgtcaaaaggccggcatcagagcatacccgaccgtgaaattttacttctatgagcgtgcaaaaaggaactttcaagaggagcaaatcaatactagggacgcaaaggctattgcagccctgatttccgaaaaactggagaccctccggaatcaaggcaagaggaataaggatgagttgtag

SEQ ID NO: 185712 - DNA, 2244 bp, Artificial Sequence
  Description of Artificial Sequence: Synthetic coding sequence
atgggcgtgtggctgaacaaggacgactacatccgggacctgaagcgtattattctctgctttttgatcgtttacatggccatcctcgtgggcacagatcaggatttctattcgctgctgggcgtgtccaaaaccgcatccagtagggaaattcgtcaagccttcaagaaactcgctttgaaactccaccccgacaaaaaccctaataaccctaacgcacacggagacttcctgaagatcaatcgggcatacgaagttctcaaagacgaagacctgcggaagaaatatgacaaatatggagagaagggcttggaggacaaccaaggcggtcagtacgagagttggaactattatcggtacgacttcgggatttatgatgatgaccccgaaatcataaccttagaacgacgagagttcgacgcggcagtgaattcaggcgagctgtggtttgtcaatttctattcaccgggttgctcccactgtcacgatctggcccccacatggcgggacttcgccaaggaggtcgacggcctcctgcggattggggcggtcaattgcggcgacgatcgtatgctctgcaggatgaagggcgtgaattcctatccttctctgttcatcttcaggagtggcatggcaccagtgaagtaccacggtgatcgcagtaaagagagcctggtgagtttcgcgatgcaacacgttcggtctacagtcaccgaattatggactggaaactttgtaaattcgatccaaacagccttcgccgctgggataggctggttgatcaccttttgctccaaagggggtgattgtctaacttcgcaaacaaggctccgtctctctgggatgcttttcctcaattcactggacgcgaaggagatctacctggaggttattcataatctgccggatttcgagctgctttcagctaatacattggaggatcgattggcacaccacagatggctgctctttttccatttcgggaaaaacgaaaattccaatgacccagagctgaagaagctgaagactcttcttaagaatgatcacatccaggttgggcggtttgattgttcgtcggcccctgatatctgctcgaacctatacgtatttcagcctagcctggctgtgttcaagggacaagggaccaaggaatatgaaatccatcacggaaaaaaaatcctgtatgacatcctcgcatttgccaaagagtccgtgaactcccacgtcactactttggggccccagaactttcccgctaacgacaaggaaccctggctggtggatttctttgccccttggtgcccaccttgccgagctctgctccccgaactgaggcgcgcatctaatctcctgtatggacaacttaagttcgggacactcgactgcaccgttcacgaaggtctctgcaacatgtacaacattcaagcataccctactaccgtggtgttcaatcagtctaatatccatgaatacgaaggtcaccactcagcagagcaaattttggagtttatagaggacctgatgaaccccagcgtcgtatccctgactccaacaaccttcaatgagcttgtgactcagcgaaagcataatgaggtgtggatggtagacttctacagcccctggtgtcacccgtgccaagtcctgatgccagagtggaagaggatggccagaacgctaaccggcttgatcaatgtcggtagcatcgactgccagcaataccactccttctgcgcccaagaaaatgtgcaacgctacccagaaataaggtttttcccaccaaagtctaacaaggcgtaccactaccacagctacaacggatggaaccgcgacgcttacagtctcagaatttggggcctcggtttcctgccacaggtttccaccgacctgacgcctcaaactttctccgaaaaggtcctgcagggaaaaaatcactgggtcattgatttttacgcaccttggtgtgggccatgtcagaattttgcacccgaattcgagctcctggcccgaatgatcaaaggcaaagtgaaggcaggaaaggtggattgtcaggcatacgctcaaacatgtcaaaaggccggaattagggcataccctacagtaaaattttatttttatgagcgcgcaaaacggaactttcaggaggagcaaattaacaccagggacgctaaagcaattgcagcattgatttccgaaaagctggaaaccctaagaaatcaggggaagaggaataaagatcacctctag

SEQ ID NO: 185713 - DNA, 534 bp, Artificial Sequence
  Description of Artificial Sequence: Synthetic coding sequence
atgggcgtgtggctgaacaaggacgactacatccgggacctgaagcgtattatcctgtgctttctcatcgtgtacatggccatacttgttgggaccgatcaagacttttacagcctactcggggtgagcaagacagcatcaagcagagaaatcaggcaggctttcaagaaacttgccctcaagttgcaccctgacaagaaccctaataaccccaacgcccatggtgactttctcaaaattaacagagcctacgaagtgcttaaagatgaggacctccgtaaaaagtacgataagtatggagaaaaggggctggaagacaatcagggcggacaatacgagtcttggaactattaccggtacgatttcggaatttatgacgacgaccccgagataatcactctggagaggcgtgagtttgatgctgcagtgaattctggggaactttggtttgtgaatttttattctcccggctgctcccactgtcacgacctcgcccctacatggagggactttgccaaagaaagtctccggtag

SEQ ID NO: 185714 - DNA, 999 bp, Artificial Sequence
  Description of Artificial Sequence: Synthetic coding sequence
atgggcgtgtggctgaacaaggacgactacatccgggacctgaagcgcatcatcctgtgcttcctgatcgtttatatggcaatcttggtgggcactgaccaggatttttactccctgctcggcgtaagcaagacagctagttctcgtgaaatccgccaggcttttaaaaagctggccctgaagctgcaccctgataaaaatcccaacaaccccaacgcccacggcgattttttgaagatcaatagggcatacgaagtccttaaagatgaggacctccgaaaaaagtacgacaagtatggggagaaaggactagaagataaccaaggaggtcaatacgagtcctggaactattatcggtacgacttcggcatctatgacgatgatcccgaaatcatcaccctggagcgccgggagttcgatgcggccgtgaattcaggggagctgtggttcgtcaatttctactcacctggctgttcacattgccacgacctggcgcccacctggcgagacttcgccaaggaagtagatggcttgctgaggatcggcgccgtaaattgtggggatgatcggatgctgtgtagaatgaagggagttaactcatatccttctctgtttatctttagaagcggaatggctcctgtgaagtaccacggtgatagatctaaggaatccctcgtctccttcgcaatgcagcatgtgcgctcaactgttacagagctgtggacaggcaatttcgtgaattctatccagaccgcatttgccgcaggcattggttggctgataaccttttgctccaaaggaggggattgtctcacctcacagacgcgcctacgactcagcggaatgcttgacgggcttgtgaatgtgggctggatggactgcgctacacaagataatttgtgtaagagtctcgatatcacaacttcaacaactgcgtactttccacctggtgccaccctcaataataaagagaaaaacagtattctactactacattag

SEQ ID NO: 185715 - DNA, 6732 bp, Artificial Sequence
  Description of Artificial Sequence: Synthetic coding sequence
atgaacatcatccgggagaacaaggacctggcctgcttctacaccacgaagcatagttggagaggaaagtataaacgggttttctccgtaggcacacatgccattacaacttacaacccaaatactctggaggtgaccaaccagtggccctatggcgacatctgttccataagtccggtaggaaaaggccagggtacagagttcaatctcacatttaggaaagggtccggaaaaaaatcagaaactcttaaatttagcactgagcacagaacagaactgctgactgaggccctgcgtttccgtaccgacttttccgaggggaaaataactgggcggcgatacaattgttataagcaccattggtccgactcccgaaagcctgttatactcgaggtcacgccggggggtttcgatcagataaacccagctactaacagagtcctgtgctcgtatgattaccgcaacatcgagggcttcgtagatttgagtgactatcagggaggcttctgtatcttatacggtggtttcagcaggctgcacctatttgcctccgagcaacgcgaagagattatcaagtcagccatcgatcacgctggtaactacatcggaatcagcctgcgaatacgcaaggagcctctcgagttcgagcagtatctcaatcttcgctttggaaagtatagcaccgatgagagcataacatccctcgcagagtttgtggtgcagaagatctcaccccgacactcagagcctgttaaaagggttttggctctgactgaaacctgcctcgtggagagggaccctgccacctacaacatcgcaacgctgaagcccctcggcgaagtcttcgctctggtgtgcgactccgagaacccccagctgtttactatcgaatttatcaaaggtcaggttagaaagtattcctccactgaacgggattctctgctggcaagcttgctggacggcgtgagggctagcggcaacagagatgtgtgtgtcaagatgacccccactcataagggccagagatgggggctgctgtctatgcctgtggatgaggaggttgagagtctccaccttcgatttctggccacccctccaaacggcaactttgctgacgcagtttttaggtttaacgccaacattagctacagcggcgttctgcatgccgtaacacaggacggactgttctcagagaacaaagagaagttaatcaataatgccatcacagccctgctgtcacaggaaggcgacgtcgtcgccagcaacgcggagcttgagagccagttccaggctgtgagaaggttagtcgccagtaaggctggcttccttgcttttactcagctgccgaagttccgggagcgtttaggcgtgaaagtggtgaaagcgctcaaaaggagcaacaacggtataattcatgccgcggtcgatatgctctgtgctctaatgtgtcctatgcatgacgactacgatctgcgacaagagcaacttaacaaggcatctctactcagttccaaaaagtttttggagaacctgctggaaaagttcaattctcacgtcgatcacgggaccggagccctcgtgatctccagcctcctggactttctgacatttgcattgtgcgccccttatagcgaaaccactgaggggcagcagttcgacatgttgctcgaaatggtggcctctaacggacgtactctctttaaactgttccagcatcctagtatggctataattaagggtgccggcctggtgatgaaggccattatagaggagggcgacaaagagatcgctactaagatgcaggagctggctctgagtgagggggccctgcctcgccacctccacactgccatgttcaccatcagttcggatcagcgtatgctgacaaataggcagttgagcagacacctggtgggtctttggactgcagataacgcgactgccactaacttgctgaagcggatcctccctcctggacttcttgcttatctggaatcttctgatctggtgcctgaaaaggatgccgacagaatgcatgtgcgcgataacgttaaaattgccatggaccagtacggcaaattcaacaaagtgcctgagtggcagcggctggctggcaaagccgccaaagaggttgagaagttcgccaaagagaaggtggacctggttttgatgcactggcgcgacaggatgggtatcgcgcagaaggaaaatattaatcagaaaccagttgttctgcggaagcgcaggcagagaatcaaaattgaggccaactgggacctgttttattaccggtttggacaggaccacgctcgttctaatctcatatggaatttcaagacccgcgaggaactgaaggataccttggagtcagaaatgcgggctttcaacatagaccgcgagttgggctccgccaatgtgatttcttggaaccatcacgaatttgaagtaaagtatgaatgcctggcagaagagataaagattggcgactattatctgaggttattattggaagaagatgagaatgaagaatcaggtagtatcaagcgatcctatgagttttttaacgagctctaccacagattcctgctgacacccaaggtgaatatgaagtgtctgtgtctgcaggctctcgctattgtgtacggtcgctgccatgaagaaattgggccgtttaccgatactcgatacatcataggaatgctcgagcgatgcaccgacaagcttgagcgggatcgcttaattctgtttctaaataaactcatcttgaacaagaagaacgtcaaagacctgatggacagtaacggaatcaggattttggtggacctgcttactctagctcacctgcacgtgagccgggcaacagtcccactccagtccaacgtcatcgaggctgcgccagacatgaaaagggaatcagaaaaggaatggtacttcggtaacgctgacaaggagcggtcgggtccgtacgggttccatgagatgcaggagctgtggactaagggcatgctgaatgctaaaactcgatgctgggctcagggcatggacggttggcgccctctgcagtccataccacagcttaagtggtgtctgctggcctccgggcaggcagtgctgaatgagacagatcttgccactctcatcctgaacatgctgattactatgtgcggctattttccgagtcgtgatcaggataacgccataatcagacccctgcccaaagtcaagaggctgttgtccgacagtacgtgcctgcctcacattatccagctgcttctcaccttcgacccaattctggtggagaaagtggcgatcttgctgtatcatatcatgcaggacaacccccaactgccccggctgtatctttccggcgttttcttctttataatgatgtacacaggctccaacgtgcttccagttgcaaggttcctgaaatatacccacacaaaacaggccttcaaatcagaagagacaaaagggcaggacatttttcagaggagcattctggggcatatcctccccgaggccatggtatgctaccttgaaaattacgaacctgaaaagttttcagagattttcttgggggagttcgacacccctgaggccatatggtcaagcgagatgcggaggctcatgattgaaaagatcgccgcccacttggccgatttcactccccgtttgcagagcaacacacgcgctctgtaccagtactgcccaattccaattattaattaccctcagctggagaacgaactgttctgcaatatttactacctgaaacaactgtgcgatacactaagatttcccgattggcctatcaaggatccggtcaagctgcttaaggataccttggacgcctggaagaaggaggtggaaaaaaagccacccatgatgtctattgacgacgcttatgaggttctgaatctgcctcagggacaggggccacacgatgagtccaagatccggaaggcatacttccgactcgcacagaaatatcaccccgataaaaacccggagggcagagatatgttcgaaaaagtaaataaggcctacgagtttctttgtacaaagtccgctaagatcgtggatgggccggatccggagaacatcatcctcattttgaagacccagtcaattctgttcaatagacacaaggaggatttacagccttacaagtatgccggttaccccatgctgattcggaccattaccatggagacgtccgatgatctcctgttttcgaaagagtctcctctgttgcccgccgcaacagaactagcctttcatacagtgaactgctcggctctcaatgcagaggagctgcggcgcgaaaatggcctggaagtcctgcaggaagcgttcagcaggtgcgtagccgtcttgacacgtgcctctaagccatccgacatgtcggttcaagtgtgcggctatatttctaaatgctactctgtggccgcccaattcgaagaatgtagagagaaaataaccgaaatgccatcaatcatcaaagacctgtgtcgcgtgctgtactttggtaagtccatccctagggtcgcagcactcggtgtcgagtgcgtcagctctttcgcagtcgacttttggctgcagacccacctctttcaggccggaatactctggtatctgctagggtttctatttaattatgactacaccctagaagaaagcggaatccagaagtcggaagaaacaaatcagcaagaggtagcaaatagtttagccaagctgtctgtacacgcactctcacgtcttgggggatacttagcagaagagcaggccacacccgaaaaccctaccatccggaagagtctggctggaatgttgacaccatatgtagcccgaaagttggccgtagccagcgtcaccgaaattctgaaaatgctgaactcaaacacggagagcccctatctgatttggaataacagcactcgggcagaactgttagaatttctggaatcacagcaggaaaatatgattaaaaagggcgactgtgataagacctatggcagtgaattcgtctattcagatcacgcgaaggagctgatcgtgggtgaaattttcgtgcgggtgtacaacgaggtccccacattccaattggaagtgcctaaagcttttgccgcaagtctgttggattacatcggtagtcaagcccaatatcttcacacattcatggccattacacatgcagcgaaagtcgagtccgaacagcacggagataggcttcctagggttgagatggctttagaagcccttcgaaacgttattaagtataatccaggcagcgagagcgaatgtatagggcatttcaagctgatctttagtttactacgcgtgcacggcgcgggacaggtccaacagctcgcgctggaagtggtgaatatcgtcaccagtaaccaggactgcgtgaataacatcgctgagagcatggtcctcagttcactgctggcactgcttcattcactgccgtcctcccgccagctcgtgttagagacattatatgcattgacctcttccacgaaaattatcaaagaggccatggcaaagggtgccctcatttatctcctggatatgttttgcaattccactcaccctcaggtgcgcgctcagactgcggaactgtttgccaagatgacggcagataaattaatcggacccaaggttagaattacccttatgaaattcctcccatcagtcttcatggatgctatgagggacaacccggaggccgctgtgcacatcttcgaaggcacacacgaaaacccagagctgatatggaacgataacagcagggacaaggtgtctacaaccgtacgggagatgatgctcgaacactttaagaaccagcaggataaccctgaggcaaactggaaactccctgaggatttcgctgtcgtcttcggcgaggccgaaggtgaactagctgttggcggagtgttcctgagaattttcatagctcagcctgcttgggttctgcgtaagccccgcgaatttctgatagcccttctggaaaagctgacggaattgctggagaaaaacaaccctcacggtgagacgctggaaaccctcaccatggctaccgtctgcctcttctctgcacagcctcagctggcagaccaggtccctccgctgggccacctccctaaggtgattcaggcaatgaaccaccgaaataatgccatccctaaatctgccataagagtgattcacgctctgagtgaaaacgaattgtgcgtccgggccatggctagtctggaaacaattgggccactgatgaatggcatgaaaaagagggctgataccgttggcttggcatgcgaagccattaatcgaatgttccagaaggaacaaagcgagctggtggcccaggccctgaaagctgacctagttccatacctactgaaattacttgaaggcatagggttggagaacctagacagtccagcagctacgaaggcccagatcgtaaaggcactgaaggccatgacacgctctctgcagtatggcgagcaggttaacgaaattttgtgtaggtcgtcagtgtggtcagcttttaaagaccagaagcatgatttattcatcagtgagagtcagacagctgggtatctgacaggtccaggcgtcgccggttatctcacagccgggacgtccacatcggtgatgtccaacctgccaccacccgtggaccacgaggccggggatctaggatatcagacgtag

SEQ ID NO: 185716 - DNA, 2673 bp, Artificial Sequence
  Description of Artificial Sequence: Synthetic coding sequence
atgtaccagatcagcaagaacagcggctgggcccggagccgggagtacaacttcaatctcaaaactcagtctatcctatttaatagacacaaagaagacctgcagccctacaagtatgcagggtatcccatgttgatccgcacaatcaccatggagacttccgatgacctcttattcagtaaggaaagccctctgctgccagcagccacagagttagcattccacaccgtgaattgctcagctctgaacgccgaggagttgagaagagagaatggcctcgaggtactgcaagaagctttcagcagatgtgtggctgtgttaacccgcgcctccaaacctagtgatatgtccgtccaagtctgcggttatattagtaaatgctattcagtggccgcacagtttgaggagtgtagagagaagatcactgagatgccctcaataatcaaagacctctgtagagtcctctattttggcaaaagtattcctagggtcgccgccttgggcgtggaatgcgtaagttcttttgctgtcgacttttggctccaaacccatttgttccaggcaggaatcttatggtacctgctgggttttcttttcaattatgactacacactggaggaatcaggcatacagaagagtgaggaaactaaccagcaggaggttgcaaatagcctggcgaagctgtccgtccatgcattgtccagactgggaggatacctcgctgaggaacaagccacccctgagaacccaactatcagaaaaagtcttgccggaatgttgaccccctatgtagcaaggaagctggcggtggctagcgtgacggaaatcctcaaaatgcttaattccaataccgagagcccctatctgatttggaacaattccacccgagctgaactgttagaattcctggaaagtcagcaggaaaacatgatcaagaaaggcgattgcgataagacctatggatctgaatttgtctattcagatcatgcaaaggaactgattgtgggggagatattcgtgcgagtgtacaatgaagtccccactttccagcttgaggtgcccaaagcttttgcagcctcactgctggactatatcggtagtcaggcgcagtacctgcacactttcatggctatcacacacgctgccaaggtggagagtgaacagcacggcgaccgcctccctcgcgtagaaatggcattagaggcactgagaaatgtcattaaatacaacccagggtctgagagcgagtgcatcgggcatttcaagctgattttctctttgctgcgggttcatggcgcagggcaggtgcagcagttggctctggaggtagtcaatatcgtaactagcaatcaagactgtgtaaacaacatcgccgaatcaatggtgctgtcctcactcttggctcttctgcactcacttccaagcagtcgtcaattggttctggagactctgtacgctctcaccagctccactaaaattatcaaagaagcaatggctaaaggcgccctcatatatctgcttgacatgttttgcaatagtactcatcctcaggtgcgggcccagacagcagagctgttcgctaagatgacagctgacaaactcattggtccgaaagttcgaataacacttatgaaattcctcccctccgtgtttatggacgcaatgcgcgacaatccagaggcagccgtccacatattcgagggcacccatgaaaacccagaactgatttggaacgataacagtcgagacaaggtgtctactaccgtccgcgaaatgatgctcgagcattttaagaatcagcaggacaaccccgaagcaaactggaaattacccgaggactttgccgtagtgttcggcgaagcagagggcgagctcgcagtgggcggcgtttttctcagaatcttcattgcacagcctgcctgggtcctgaggaaaccgcgcgaatttttgatcgccctactggagaaactgaccgaactgctggagaagaataacccccacggtgaaacactcgaaacactgacaatggcgactgtctgtctgttttccgcccagccacagctggccgatcaggtgccacccctgggccatttgcccaaagtcatccaggctatgaatcaccggaataatgccatccccaaatctgccatccgagtgattcacgccctgtccgagaacgagttgtgcgtacgggcaatggcgtcacttgaaacaattggacctctaatgaacggcatgaaaaagagggctgacactgtcggcctagcctgcgaagcaatcaatagaatgtttcaaaaagaacagtctgaactcgtagctcaggccctgaaagcggacctggttccttatctcttaaaactgttggaagggatcggccttgaaaacctggacagccctgcagctacaaaggcgcagatagtcaaggccctcaaggctatgacaagatctctgcagtatggtgagcaggtgaacgagattctctgtaggtccagcgtctggagcgctttcaaagatcaaaagcacgacttgttcatcagcgaatctcagaccgcggggtacctgacagggcccggggtggctggttacctgaccgctggcactagtaccagcgtcatgtctaacctgcccccccctgttgatcatgaggccggcgaccttggataccagacctag

SEQ ID NO: 185717 - DNA, 351 bp, Artificial Sequence
  Description of Artificial Sequence: Synthetic coding sequence
atggccagcaccgtggtggccgtgggcctgaccatcgccgccgccggatttgctggccggtacgttctccaagccatgaagcatatggagccccaggtaaaacaggtctttcagtccctcccgaaaagtgcgttttccggcggttattaccgcggcggatttgagcccaagatgacaaagcgcgaagccgcactcattctgggcgtgtctcccaccgcgaacaagggcaaaattcgagatgcccacaggcgcattatgctactcaatcatccagacaaaggaggctctccttacattgctgctaagatcaatgaagccaaagatctcctcgagggacaggccaagaaatag

SEQ ID NO: 185718 - DNA, 1707 bp, Artificial Sequence
  Description of Artificial Sequence: Synthetic coding sequence
atgctgctgctgcccagcgccgccgacggccggggcaccgccatcacgcacgcactgactagcgccagcactctctgtcaggttgaacccgtgggcagatggtttgaggctttcgtaaaacgccgtaacaggaatgctagcgcctcctttcaggaactggaggataagaaggagctgagtgaagagtccgaggatgaggaacttcagctagaggagttcccaatgcttaagactctggatccgaaggattggaaaaaccaggaccactatgcggtgctcggactaggccatgttcgatataaggctacccagagacaaatcaaggcagcccataaagctatggtcctgaaacaccatcccgacaaaagaaaggcagctggtgagcccattaaagagggcgacaatgactattttacttgtataaccaaggcatacgaaatgttgtctgatcctgtgaagaggagagcatttaactctgtggaccctaccttcgacaattcagtgccaagcaaaagcgaggcaaaggacaatttcttcgaggtgtttacacccgtgttcgaacgcaattctagatggagcaacaagaagaacgttcccaagctgggcgacatgaacagcagtttcgaggacgtagacatcttctattcattttggtataacttcgactcatggcgggaattctcctacctggacgaagaggaaaaagagaaagcggagtgtcgggatgagcggagatggattgagaagcaaaatcgcgctacccgggcccagagaaaaaaggaggaaatgaatagaattaggaccctggtcgataatgcgtatagttgtgatcctcgcatcaagaaatttaaggaagaagagaaggctaagaaagaagccgagaagaaagccaaagccgaggccaaaagaaaggaacaggaagctaaagagaagcagcgccaggcagagctggaagcagccaggcttgccaaagaaaaagaggaagaggaagtgaggcaacaggcgctgttagctaagaaagagaaggacattcagaaaaaagctatcaagaaagagcgccagaaacttagaaattcgtgtaagatcgaggaaattaatgaacaaataaggaaagagaaggaagaagccgaggcgagaatgaggcaagcatctaagaatactgagaaatctactggcggcggtggtaacgggagtaagaactggtcagaggacgacctccagctgttgatcaaggctgtcaatctcttccccgctggcactaactccagatgggaggtaattgctaattacatgaatattcattcctccagtggtgtgaagagaacagcaaaggacgtgatcggcaaggccaagagcctgcagaagctagaccctcaccagaaagacgacattaataagaaagcattcgataaatttaagaaagagcacggagtggtgccccaagccgataatgccacaccaagcgagagattcgaagggccttacactgacttcacgccctggaccaccgaagagcagaaactactggagcaggctcttaagacatacccagttaatacccccgagagatgggagaagatagctgaagctgtcccaggccggacaaagaaagactgcatgaaaagatataaagagcttgtcgaaatggtcaaggctaaaaaagctgcacaggagcaggtgctcaacgcatcacgggcaaaaaaatag

SEQ ID NO: 185719 - DNA, 1866 bp, Artificial Sequence
  Description of Artificial Sequence: Synthetic coding sequence
atgctgctgctgcccagcgccgccgacggccggggcaccgccatcacccacgccctcacatcagctagcaccctttgtcaggtggaacctgtggggcgttggtttgaggccttcgtcaagaggaggaacagaaacgccagtgcttccttccaggaactggaggataagaaggagctctctgaagagtcagaggacgaggagctgcagctggaggagttcccaatgctgaagaccctggacccaaaagactggaaaaatcaggaccactacgccgtgctcggcctcggtcacgtgaggtacaaagctactcagaggcagatcaaggccgcacataaggccatggttcttaagcaccacccagataagcggaaagctgcaggcgaaccgataaaggaaggtgacaatgattacttcacgtgtatcaccaaagcttatgagatgctgagcgaccccgtgaagcgtcgggccttcaatagcgttgaccctacattcgataatagcgtacctagcaagagcgaggctaaggataatttcttcgaggtgttcacaccagtgtttgagagaaattccagatggagtaataagaaaaacgtgccgaagcttggggatatgaatagttctttcgaagatgtggatatattttatagcttctggtataatttcgattcttggcgtgagttctcatatctcgatgaggaggagaaggaaaaggccgaatgccgcgatgaacgtcgctggatcgaaaagcagaatcgggctacacgcgctcagcgcaaaaaagaagagatgaacagaatacgaactcttgtagataatgcctatagctgcgatcctaggatcaaaaaatttaaagaggaggagaaggctaaaaaggaagctgagaaaaaggcaaaggcagaagccaagcggaaggaacaggaagcaaaggagaaacagagacaggccgagctagaggcagctcgcctggctaaggagaaggaggaggaagaggtgaggcagcaagctctcttggcaaagaaggaaaaggacatccaaaagaaagccataaaaaaagaacggcagaaattgaggaactcttgtaagacgtggaatcacttctccgataatgaggctgaacgagtgaagatgatggaggaagtcgagaagctttgcgatcgcctggaactggccagccttcaatgtcttaatgagactcttacatcttgcactaaggaggtgggtaaggctgcacttgagaaacagattgaggaaattaatgagcagatacgcaaggagaaggaagaagctgaagcccggatgcgccaggcatctaagaataccgaaaaatcaacaggcggcggtgggaatgggtccaaaaattggtccgaggacgacttgcagctgctaatcaaagccgtgaatctgtttcccgccggaacaaattctagatgggaggttattgcaaattacatgaacattcactcgagttcaggtgttaaacggacagcaaaggatgtgatcggaaaggccaaatcacttcaaaagctggatcctcaccagaaagacgatataaacaagaaagccttcgataaattcaagaaagagcacggtgttgtacctcaagccgacaacgctactccttctgaacgcttcgaggggccatacacggacttcacaccttggaccacggaggagcagaaacttttggagcaggctcttaaaacctatcccgtcaacacaccagagcgatgggagaaaatcgcagaggccgtgcccggcaggactaaaaaagattgtatgaagcggtacaaggaacttgtggaaatggttaaagcaaaaaaagctgcacaagagcaggtgctgaacgcctctagagcgaaaaagtag

SEQ ID NO: 185720 - DNA, 609 bp, Artificial Sequence
  Description of Artificial Sequence: Synthetic coding sequence
atgctgctgctgcccagcgccgccgacggccggggcaccgccatcacccatgcgctgaccagcgcaagtacgctgtgccaggtggagcctgtcggaaggtggttcgaggctttcgtgaagcggcgaaaccgcaacgccagtgcatctttccaagagctggaagacaaaaaggaactgagcgaggagagcgaggacgaggaactgcagttggaggaattccccatgctaaaaaccctagaccctaaagactggaagaaccaggatcattacgcagtattggggctaggtcacgtgcgctacaaggccacacagcgccagattaaggccgcacacaaggccatggttctcaagcaccatcctgataaacgtaaggcagccggcgagcccatcaaggagggcgataatgattattttacatgcataaccaaggcatatgaaatgctgtccgatcccgttaagcggagagcgttcaattctgtggatcccaccttcgacaattccgtgcccagcaagagtgaggccaaggataacttcttcgaagtgttcacgcctgtgtttgagcggaattctagggtttccatttctaaaaaaaagaagaaaaagagatag

SEQ ID NO: 185721 - DNA, 822 bp, Artificial Sequence
  Description of Artificial Sequence: Synthetic coding sequence
atggaggccaacatgcccaagcggaaggagcccggccggagcctgcgtatcaaagtgatctctatggggaacgccgaggtggggaagtcctgtatcatcaagcggtactgcgagaagagatttgtgtctaagtacctggccactatcggaattgattacggtgttaccaaggtgcacgttagggaccgggagattaaggtgaacatcttcgacatggcaggccaccccttcttctacgaggtgagaaatgaattctacaaagatactcagggcgtgatccttgtttatgatgtaggacagaaagattcatttgatgctcttgacgcttggctggccgaaatgaagcaggagcttggccctcatgggaacatggagaacatcattttcgtggtgtgtgccaacaaaatagattgtaccaagcaccgatgcgtcgatgaatccgaggggcggctctgggctgaatctaaggggtttctctattttgaaacctcggcacaaaccggcgaagggattaatgagatgttccagaccttctatatctcaatcgtggatctgtgtgaaaatggcggtaaacgccccaccaccaattcctcagcgtctttcaccaaggaacaggctgacgctatcagaaggattagaaacagtaaagacagctgggatatgctcggggtgaagccgggagccagccgagacgaggtcaataaggcctataggaagttagcagttctgctccaccccgacaaatgcgtggctcccggctctgaagacgcgttcaaggccgtcgtcaatgctaggactgcactgctaaagaatataaagtag

SEQ ID NO: 185722 - DNA, 609 bp, Artificial Sequence
  Description of Artificial Sequence: Synthetic coding sequence
atggccggccaccccttcttctacgaggtgcggaacgagttctacaaggacacccaaggagtcatactggtgtatgatgtgggacagaaggactcattcgatgccctggacgcatggctcgctgaaatgaaacaggagctcggacctcatggcaacatggagaacattatcttcgtggtgtgcgcaaataagattgactgcaccaaacaccggtgcgtagacgaatccgaggggaggctctgggcagaaagcaaggggtttctatactttgagacttctgctcaaactggagagggcataaacgaaatgttccagacattctatatctccatcgtcgatttgtgtgagaatggagggaagcgacccaccacaaattcctctgcttcattcaccaaggaacaggcagacgccatccggcgcataagaaactcgaaggactcttgggacatgttaggagtcaagcccggggcgtccagggacgaggtaaacaaggcctacaggaagttagcagtcttgctgcatcccgacaagtgtgtagcgcccggaagcgaagacgcatttaaagctgtagtaaacgccaggaccgccctgctcaagaatattaaatag

SEQ ID NO: 185723 - DNA, 1515 bp, Artificial Sequence
  Description of Artificial Sequence: Synthetic coding sequence
atggtggcccccggcagcgtgaccagccggctgggcagcgtgttcccatttttactggtgctcgtggaccttcagtacgagggggccgaatgcggggtaaatgcagatgtcgagaagcacctcgaactgggcaagaaacttctggccgctggtcagctcgccgatgccctgtctcagttccacgcagccgttgatggcgacccggataactacattgcttactacaggagagccaccgtgttcctggccatggggaagtctaaggctgccctgccagatctgaccaaagtaattcagctcaaaatggattttactgcagcacgcttgcagagaggccacctgttactcaagcagggtaaactcgacgaagccgaggacgactttaagaaggttctgaagagtaacccttctgaaaatgaggagaaggaagctcaatcacaactcatcaagagtgacgaaatgcagcggctccgcagtcaggccctaaacgcctttggcagtggagattacactgctgcaattgcatttctcgataagatcttagaggtgtgtgtttgggacgcagagctccgcgaactgagagccgagtgttttattaaggagggcgaaccacgtaaggctatctctgaccttaaagcagcctctaagctaaagaacgataatacagaagctttctataagatctcaacactatactatcagctgggagatcatgaactctccctgagcgaggtgcgtgagtgcctcaagctggatcaggaccataagcggtgcttcgcccactataaacaagttaagaagctaaacaagttgattgagagcgcagaagagttgattcgagacgggagatacacggatgcaacatccaaatatgagagtgtgatgaaaaccgagccctcgatcgccgaatatacagtccggtctaaagaaagaatctgtcattgcttttctaaggacgagaaacccgtggaagcaattcgcgtctgttcagaggttctgcaaatggaacccgacaatgtcaatgctctgaaagaccgagcagaagcctatctgatagaggaaatgtacgatgaggccattcaggactacgagaccgcccaagagcacaacgaaaatgatcagcaaatcagggagggactagaaaaggcacaacgattgctgaagcagtctcagaagcgtgattattataagatcctgggagtcaaacggaacgccaaaaaacaagagattattaaggcttatcggaagttagcactgcagtggcatccagataacttccaaaacgaagaagagaaaaagaaagcagagaaaaagtttattgatatcgccgccgctaaggaggtgctgagcgatcctgagatgcgcaagaaattcgatgacggagaggaccccctggatgccgaatcccaacaggggggaggcggcaacccgttccatcgcagttggaactcatggcaggggtttaatcccttcagctccgggggaccgttccggttcaaattccattttaattag

SEQ ID NO: 185724 - DNA, 597 bp, Artificial Sequence
  Description of Artificial Sequence: Synthetic coding sequence
atggccgaccagcggcagcggagcctgagcaccagcggcgagagcctataccatgtgctgggtctggacaagaacgctacctctgatgatattaagaagagctacaggaagctggctctgaaatatcatccggacaaaaaccctgacaaccctgaagccgccgataagtttaaggagatcaacaacgcacacgcaatcttaaccgacgctactaaacggaacatctacgataaatatggctcactgggtctttatgtggccgaacagttcggggaggaaaatgtgaatacctactttgtactgtcgtcttggtgggccaaagcactctttgttttttgtggcctattgacctgctgttattgttgctgctgcctgtgctgctgtttcaactgttgctgtgggaaatgtaaacctaaagcgccagaaggcgaggaaaccgagttctatgtaagcccagaggacctcgaagcgcaactacagagtgatgaacgcgaggcgacagatactccaatagtcatccagcctgcctccgctacagagactacgcagttaactgccgactcccatccctcgtatcataccgacggattcaactag

SEQ ID NO: 185725 - DNA, 504 bp, Artificial Sequence
  Description of Artificial Sequence: Synthetic coding sequence
atggccgaccagcggcagcggagcctgagcaccagcggcgagagcctgtaccatgtcctggggctggataagaatgccactagcgacgacatcaaaaaatcttacagaaagctggcccttaaatatcatcccgataagaatccggataatcctgaggccgctgacaaattcaaagagatcaataacgcgcatgcgatactgacggacgcaacaaagcggaatatttacgataagtatggtagtctgggcctttacgtggcggaacagtttggcgaggagaacgtaaacacctacttcgtgctctcgagttggtgggcaaaggctttgtttgtgttttgcgggctgctcacatgttgctattgttgctgttgtctgtgttgttgctttaactgctgctgtggaaaatgtaaacctaaggcccctgagggcgaggaaactgaattctatgtgtctcccgaagacctcgaggcccagctgcagagcgatgaacgcggcggacactag

SEQ ID NO: 185726 - DNA, 600 bp, Artificial Sequence
  Description of Artificial Sequence: Synthetic coding sequence
atggcctgcaacatccccaaccagcggcagcggaccctgagcaccactggggaggcactatatgaaatcctgggcttgcataagggcgcatctaatgaagagattaaaaagacatataggaagctagctttgaaacaccatccggacaagaacccggacgatcccgcagctaccgaaaaatttaaggagattaataacgctcacgcaatcttgaccgatatttccaaacggtcaatatacgataaatatggctcattaggcctctatgtcgctgaacagttcggtgacgaaaatgtgaatacatacttcatgctgtcgagttggtgggcaaaggctctgttcgtgatcgttggactgctcacaggctgttatttctgctgctgcctctgttgctgctgtaactgctgttgtggtcattgtcggcccgagagctcagttccagaggaagacttctatgtgtcacctgaggatctcgaggaacagattaaatctgacatggagaaggacgttgacttccccgtgtttttacagccaaccaacgcgaacgaaaaaacacagttgattaaggaagggtcacgctcgtattgtaccgactcgtag

SEQ ID NO: 185727 - DNA, 570 bp, Artificial Sequence
  Description of Artificial Sequence: Synthetic coding sequence
atgagcaccgtgaaggaggccgcccaccggctgagcaagagcgagatgagcttgtacgctgtgctggatttgaagaagggcgccagcccagaggattttaaaaaatcctactcccattccgctcttcttcctcacccgccattcgaatatcacttgggcaggaaactcgccctgcgatatcatcctgataagaaccctggtaatgctcaggcagctgagattttcaaggaaataaatgccgcgcatgccattctcagcgacagtaaaaagaggaaaatttatgatcagcatggtagcctgggcatctacttatacgatcatttcggagaagaaggcgtcaggtattacttcattctgaacagttgctggttcaagacccttgttatactctgcaccttgttgacctgttgctgtttttgctgctgctgctgcttctgttgcggggctctcaagcctccacctgaacaagattccggccgcaagtaccagcagaatgtgcagtcacagccccccaggtccggcgctaaatgtgacttccggtccgaggaaaattcggaagacgatttctag

SEQ ID NO: 185728 - DNA, 570 bp, Artificial Sequence
  Description of Artificial Sequence: Synthetic coding sequence
atgagcaccgtgaaggaggccgcccaccggctgagcaagagcgagatgtcgctatatgcagtcttggacctgaaaaagggagcttcccccgaggatttcaaaaagtcatacagtcacagtgccctcctaccccaccccccttttgaatatcacttgggacgtaaattagccctgaggtatcaccccgataagaacccaggcaacgcccaggccgccgagatcttcaaggagatcaacgccgcgcacgcaatcctgagcgactccaaaaagcgtaagatctatgatcagcacggttccctcggaatctatctgtacgatcattttggcgaggaaggcgtgcggtattactttatcctcaatagctgctggttcaaaacgcttgtgattctttgtactttgctaacttgttgctgtttttgttgttgttgttgcttttgttgtggcgcgcttaagcctcctcctgagcaagactccggaaggaagtatcagcagaatgtccagtcccagccacccaggtccggggccaagtgcgatttccggagtgaggagaattccgaggacgacttttag

SEQ ID NO: 185729 - DNA, 2703 bp, Artificial Sequence
  Description of Artificial Sequence: Synthetic coding sequence
atggagcccagctacggcggcggcctgttcgacatggtgaagggcggggccggaagactattttcaaatctgaaagacaatctgaaggacacattgaaagacacaagtagccgcgtgatccaaagcgtaacctcatataccaagggcgacctcgactttacctatgttaccagcaggatcatagtgatgagtttcccacttgataatgtggatatcgggttccgaaaccaggtggatgacatcagaagctttttagattctcgacatttagatcactacactgtctacaacttgtcaccaaagagttacaggaccgctaaatttcatagtagggtgtccgagtgctcatggccgatcaggcaggcaccgtccttacataaccttttcgccgtgtgcaggaacatgtataattggttactgcagaacccaaagaacgtctgcgttgtccactgcctcgatggccgggccgcctcatcaattctggtgggggccatgttcatcttctgcaacttgtactcgacgcccggtcccgctataagactgctctatgccaagcggcccgggattggcctgagtcctagccatcgtagatatctgggatacatgtgcgatctgctcgcagacaaaccttatcggccacattttaagccactgacaatcaagagcataacggtcagcccgataccattcttcaataagcagcggaacggctgccggccctactgcgatgtgttaatcggtgaaaccaaaatttacagcacctgtaccgacttcgagaggatgaaggagtatagggttcaggacggcaaaattttcattccgctcaatattacggtccaaggcgacgtggtggtctccatgtatcatctgcggtcaactatcggcagccggttacaggcaaaggttacaaacacacagatttttcagctacagtttcacacaggctttatcccactggacacaaccgtgcttaaatttactaagccggagttggatgcctgcgacgttcctgagaagtatccgcagctatttcaggtgactctggatgtggagctccagccgcacgacaaagtgattgacctgacaccgccatgggaacactattgtaccaaggacgtgaatccttctattctctttagctctcatcaagaacatcaggatacgctcgccttaggcggccaggctccaatcgacatacctccggacaaccctagacactacggccagtcaggtttctttgcctctctctgctggcaggaccagaaatctgagaaatcattctgcgaggaagaccacgcagccctcgtgaatcaggaaagcgaacagtctgatgatgaactgctcacactgtcatcccctcatgggaatgcaaatggtgataagccccacggggtcaagaagcccagcaaaaaacaacaggagcccgctgcccctccacctcctgaggatgtcgatctgctcggcctcgaggggagcgccatgtccaacagcttttccccccccgccgccccgcccaccaatagcgagctcctcagcgatctcttcggcggcggaggtgcagcagggccgactcaggcagggcagagtggcgtggaggacgtctttcatccgagcggtcctgccagcacccaaagcaccccgaggcgttccgccacctctacctcggcttccccaaccttgcgagtgggggagggggccacttttgaccccttcggcgccccctccaagcccagcgggcaggacctgttaggctcttttctcaacactagcagcgcatcctcagacccttttctccaacctacccgctcgcctagcccaactgtgcatgcatcatccactcctgctgtaaatatccaacccgatgtttctggcgggtgggattggcatgcaaaacccggcggcttcggtatgggctccaaatctgcagcgacttcgcctactggctcttctcatggaacacccacccatcagagtaagccccagacactcgacccttttgcagatttaggcacactaggctccagtagttttgctagtaagcccaccacaccaactggactaggcggtggctttccgcccctgtccagccctcagaaggcttcccctcagcccatgggaggaggttggcagcagggcggcgcatacaattggcaacagccgcaacccaaaccacagccatcgatgccccattctagtccacaaaatagacctaattacaatgtgagtttctcagccatgcccggagggcagaacgagagaggtaaggggtcctccaatctggaaggcaagcagaaggccgctgatttcgaagacctgctgtccggtcaggggttcaatgctcacaaggataagaaggggcccagaacgattgctgagatgcggaaggaggaaatggcaaaggaaatggatccagaaaaactgaaaatactggagtggatcgagggtaaagaacgtaatatcagagcgctgctgagtacaatgcatacagtgctgtgggcgggtgaaactaagtggaaacccgtcgggatggctgatctcgtcactcctgaacaagtgaagaaagtctaccgcaaggctgtgctggttgttcaccccgataaagccactgggcagccgtacgagcagtacgctaagatgattttcatggagcttaacgacgcgtggtcggaattcgaaaaccagggacagaagccactatattag

SEQ ID NO: 185730 - DNA, 2913 bp, Artificial Sequence
  Description of Artificial Sequence: Synthetic coding sequence
atgagcctgctgggcagctaccggaagaagaccagcaacgacggctatgagtccctgcagctcgtggattcgaacggcgacctgagcgccggatctgggggagtagggggaaaacagcgagtgaatgccggagctgccgcgagatcccccgccagacaacccccagatcgagcttctacaatggactctagcggtgcttctagtccagatatggaacccagctacgggggaggtctgttcgacatggtgaaaggtggtgctgggcggctatttagtaatctgaaagacaacttgaaagacacactgaaggatacttcgagtagggttatacagagtgttactagttatacaaagggggacctggactttacctatgtcacttcacggatcatcgttatgagcttcccgctggataacgtggacattggctttcggaatcaggtggatgatatcagatcctttttggatagccgccacctggatcattacacagtctacaatctttcccccaagagttatagaacagctaagtttcactccagggtgtcagaatgttcctggccgattagacaggcgccttctctacataacctcttcgccgtttgtagaaacatgtataattggctgctacagaacccaaagaacgtatgtgtggtacattgcctagatggccgggcagcatctagcatcctagtgggggctatgttcattttctgcaacctgtatagcaccccaggaccagccattcgactgctctacgccaaaagacctggaatcggactcagccccagccatcggcggtatttggggtacatgtgcgatcttttggctgataagccctatcgccctcacttcaaaccgctcacaatcaagtctatcacggttagccctatccccttcttcaataagcagagaaatgggtgcagaccttactgtgacgtgcttattggcgagaccaagatttacagtacatgtaccgatttcgaacgcatgaaggaataccgggtacaggacggaaaaattttcatcccgctgaatattaccgtacagggagatgtcgtggtgagtatgtaccaccttagatctactatcgggtcccgattgcaggccaaggttactaatacccaaatcttccaactgcagtttcatactggcttcatccctttagacaccacagtcctgaagtttaccaagcccgagctagacgcatgcgatgtgcccgaaaaatatccacaactgtttcaagttactctggatgtcgagttacagccccacgacaaagtgatcgacctgacacctccttgggaacactattgcacaaaagatgtgaatccttccattcttttctcctcgcaccaggaacatcaggataccctcgcactgggaggccaagctcccatcgatatcccacctgataatccacggcattatggccagagcgggtttttcgcttccctgtgttggcaggaccagaagagtgaaaaatcattttgcgaggaagatcacgcggccctggtgaatcaggaaagcgaacagtcagacgacgaactgctgaccctatcaagcccgcacggtaacgcaaacggggacaagccacacggtgtcaagaaaccaagcaagaagcaacaggagcccgcggctccaccccccccagaggacgtggatcttctaggcctcgagggcagcgccatgtcaaactccttttctccccctgctgcccctccgacaaatagtgagctcttgagcgacctgtttggcgggggaggcgcagccggccccactcaagctggccagtccggggttgaggacgttttccatccatccggacccgcctcaacacagagcactccccggcgatccgcaacatcaacctccgccagcccaacattgcgtgtgggggaaggggcgacctttgaccctttcggagctccatcaaagccatcaggccaggatctgcttggatcttttctgaacacttcctcagccagctctgaccctttcttacagccaactcggagtccaagccctacagtgcacgcaagtagtacacccgcggtcaacatccaaccggacgtgtcaggaggctgggattggcatgctaagccaggtggttttggcatggggtcaaaatctgctgctacaagccccacaggctcctcccacggtacgccgactcatcagagcaagccacagactcttgatccatttgccgatctgggaactctcggaagtagttctttcgcctcaaaacctacgactcccacaggcttgggaggggggttcccgccgttgtccagcccgcagaaggctagcccgcaaccgatgggaggaggttggcagcagggtggcgcatacaactggcagcagcctcagcccaaaccacagccaagcatgccacactctagtcctcagaataggccgaattacaatgtctcttttagcgccatgcccggcggccagaacgaacgtggcaagggctcttccaacctggagggcaaacagaaggccgctgacttcgaggacctgctgagtgggcaaggctttaacgcacacaaggacaagaaaggcccccgcactatcgcagaaatgaggaaggaggaaatggcgaaagagatggacccagaaaaattaaaaatcttggaatggatcgagggcaaggaaaggaatatccgcgctctgctctccacaatgcataccgtgctgtgggcaggagaaacgaagtggaagccagtgggaatggcagatcttgttacccctgaacaggttaaaaaagtgtatcggaaggccgtgttagtggtgcatccggacaaggctacgggacagccttacgagcagtatgcaaagatgatcttcatggagctgaacgatgcatggtctgagttcgaaaatcaggggcagaagccgctgtactag

SEQ ID NO: 185731 - DNA, 2742 bp, Artificial Sequence
  Description of Artificial Sequence: Synthetic coding sequence
atgaaggacagcgagaacaagggcgccagcagccccgacatggagcctagctacgggggaggcctgtttgacatggtaaagggcggcgctggtcggcttttcagtaatcttaaggataacctgaaagacactctcaaggacactagttccagggtcattcaatctgtgaccagttatacgaaaggtgatctggactttacctatgtgacttcacggatcattgttatgtctttccctcttgacaacgtcgatatcggattcaggaatcaggtggacgacattagatccttcctggacagcagacacctggaccactacactgtgtataatttgtcccccaagtcttaccgcacagccaaatttcatagtcgggtttctgagtgcagttggccgattcggcaggctccctcccttcacaacctgtttgctgtgtgccggaatatgtataattggctgctgcagaatccaaagaacgtctgtgttgttcactgtctggatggacgagccgcctccagcattctggtaggggcgatgtttattttttgcaacctttattccacgccaggtcccgcaattagactgctgtacgcaaagcggcccggaattggcttgagccccagtcatcgtagatacttaggttacatgtgcgacctactcgccgataagccatacagacctcacttcaaaccactgacgatcaagagcatcaccgtctctccaatcccttttttcaacaaacagcgaaatggatgtcgaccatactgtgatgtgctgattggggagacaaagatctattctacctgtaccgattttgaacgtatgaaggagtacagggtgcaagacggcaagatcttcatacctctaaatatcacagtgcaaggcgacgtcgtggtatccatgtatcatctgcggtccactattggatcacggctgcaggccaaggtcacaaacactcagatcttccaactgcagttccacactgggttcattccgctagacaccaccgtcctcaagtttacaaagccagaattggatgcctgtgatgtgccagagaaatatccgcagcttttccaggtcacgctggacgtggagttacagccccacgacaaggtgatagatctgaccccaccttgggagcactattgcaccaaagatgtgaacccctccatacttttttcttcacatcaagagcaccaggacaccctggccttaggcggccaggcacccatcgacatccctcctgacaaccctcggcactatgggcagtcaggcttctttgcctcattgtgctggcaggatcagaaaagtgagaagtccttctgcgaagaagaccacgctgccctggttaaccaagagagcgagcaaagcgatgatgaattgctgacactgtcctctccccacgggaacgctaacggtgacaagccacatggagtgaaaaagccgtctaaaaaacagcaggagccagccgcccctccccctccagaggatgttgacctgttaggcttggagggctccgcaatgtccaatagcttttcaccgccggcggcaccacccacaaattctgagcttctgtccgatctgtttggcggtggcggagccgccgggcccacccaagcgggccagtccggtgtggaggacgtattccatccaagtgggcccgcatccacccaatccacaccccgcagaagcgcaacctctactagtgccagcccaaccttaagggttggtgaaggcgcaacgttcgatccctttggggcgccctctaaaccctcgggccaggacttactaggaagctttctcaacacctcgagtgctagttcagacccctttttgcaacctactcggtcgccctctcccaccgtgcatgcttcttcgaccccggcagttaacattcagccagacgtctccggcggttgggactggcatgccaagccaggggggttcggaatgggaagcaagtccgctgccacctcacctactgggagctcccacgggacacccacacaccagagtaagcctcagaccctggacccatttgctgacctgggcacactcggcagctcatcctttgcgtcaaagccaaccaccccgacgggtttgggagggggatttccccccttgtcaagtcctcagaaggcatcccctcagcccatgggcggaggttggcagcagggaggagcgtataattggcagcagcctcagccgaagccccaacccagcatgccccatagttccccccagaacagaccaaactacaacgtgtccttttccgcgatgcctggggggcagaatgaacggggaaagggttcttcaaacctcgaggggaaacaaaaagctgccgatttcgaggacctgctctcagggcagggctttaacgcacacaaagacaagaagggtcctcgcaccattgccgaaatgcggaaagaggaaatggccaaggagatggatccagagaagttgaagatcctggaatggattgaggggaaggaacggaacattcgagccctgttgagcacgatgcacaccgtcctgtgggctggggagactaaatggaagcctgtgggcatggcggacctagtcacaccagagcaggtgaagaaggtgtaccggaaagccgtgctcgtagtgcatcccgataaagcaactggtcagccctacgagcagtacgccaaaatgatcttcatggagctgaacgatgcctggagcgaattcgaaaaccaaggccagaagcccctgtactag

SEQ ID NO: 185732 - DNA, 783 bp, Artificial Sequence
  Description of Artificial Sequence: Synthetic coding sequence
atgggcctgctggacctgtgcgaggaggtgttcggcaccgccgacctgtaccgtgtgctgggagtgcggcgcgaggccagtgacggggaggtccgccgtggatatcacaaggtgtccttacaggtccacccggatcgagtgggggaaggggacaaggaagatgctacgagaagatttcagatcctagggaaggtatatagtgttttatcagacagagaacagcgcgccgtgtatgatgaacagggaactgtcgatgaggattcacccgtgctcacccaggatcgtgactgggaagcttactggcgcctactcttcaagaagatctcacttgaggatatacaggcgtttgagaaaacatataaagggagcgaggaagaactggctgatataaagcaggcttacttggactttaaaggtgatatggaccagattatggaatcggtcttgtgtgtacaatataccgaagagcccaggattcggaatatcatccaacaagccatagatgcaggcgaggttccaagctataacgcattcgtcaaggaatcaaagcaaaaaatgaacgcacggaaaaggcgcgcccaggaagaagcaaaagaagccgagatgagtcggaaggagctaggcctggacgaaggagttgactccctgaaagcagccatccaatctaggcaaaaagaccgccagaaagagatggataatttcttagcccagatggaagccaaatactgtaagagctccaaggggggcggcaagaaaagcgcactcaagaaggagaaaaaatag

SEQ ID NO: 185733 - DNA, 1029 bp, Artificial Sequence
  Description of Artificial Sequence: Synthetic coding sequence
atgctggagaacagcctgtacagccccacctgggagggcagccagttctgggtgaccgttcagaggaccgaggccgccgagcggtgcgggttgcacgggtcctacgtgctgcgcgtcgaggctgaaaggctaacgctattgactgtcggcgcccagagccagatcttggagcccctcctttcatggccatacaccctgctgcgccggtacggccgggacaaggtcatgttttccttcgaggcagggcgcagatgtcctagtggccccgggacatttactttccagacagcacagggaaatgatattttccaagctgtagaaacagccatccaccgtcaaaaggctcagggaaaggctggtcagggccatgacgtcctgcgcgctgactctcacgaaggagaagtggcggaaggaaagttgcctagcccgcctggcccccaggaactgcttgactctcccccagcactgtatgcagagccactcgacagcctgagaattgccccctgcccctcgcaggactctctgtactctgatccccttgactcaacaagcgctcaggccggagagggcgtgcagagaaaaaagcccttatactgggacctctatgaacacgcccagcagcaactgctcaaggccaaactgactgatccaaaggaggatcctatttatgacgagcccgaaggtctggcaccagttccacctcagggtctgtacgacctgccaagggagcctaaagatgcctggtggtgtcaggccagagtgaaagaagaaggttacgaactaccctataatcctgcaactgacgattacgcggtccctccacctcgctctacaaaacccctcctggctcccaagccccaggggccagccttccccgagcctggaacagccaccggctcggggatcaaaagccataactctgcattgtactcacaagtgcaaaagagtggtgcctctggcagttgggattgtggcctttcaagagtgggtaccgataaaacaggcgtcaagtccgaaggctccacttag

SEQ ID NO: 185734 - DNA, 855 bp, Artificial Sequence
  Description of Artificial Sequence: Synthetic coding sequence
atggagcccggcatgctgggcccccacaacctgccccaccacgagccaatcagttttggcatagaccagattctgtctggccctgaaacgcctggtggagggctcggtttagggagagggggacagggccatggagaaaacggcgccttcagtggaggctaccatggcgccagcgggtatggccctgccggctctctggctcctttacccggatctagtggcgttggaccaggcggagttattagagtcccagctcatagaccccttcctgttccccctccagctggaggtgcccccgctgtgccaggtccttctggcttaggcggtgccggtggtctcgcgggcctgactttcccctggatggatagcgggcgcaggttcgcgaaggaccgcctgacggccgctctctcacctttcagcggcacccggagaattggccacccctatcagaaccgcaccccccccaagcgtaagaagccaagaacttccttctctcgatcccaggttctcgagcttgagagacgatttcttcgccagaaatacttagcatctgccgaacgggccgctcttgcgaaggctttgcgcatgaccgatgcccaggtgaaaacctggttccagaaccgaagaacaaagtggaggcggcaaaccgccgaggaacgcgaggccgagcggcacagagccggacggctgctgctgcacctgcaacaggacgcgctgcctcgcccactgagacctccactaccacctgacccactgtgcctgcacaattcgtctctcttcgctctgcaaaatctgcagccttgggcggaggacaataaggttgcctctgtgtctggcctggccagcgtagtctag

SEQ ID NO: 185735 - DNA, 1239 bp, Artificial Sequence
  Description of Artificial Sequence: Synthetic coding sequence
atgggcgacggcgccgtgaagcagggcttcctgtacctgcagcagcagcagacctttggcaaaaagtggagacggtttggggcctccctgtatgggggcagtgactgtgcgctggcgcgcttggagttgcaggaggggcctgaaaagcctagacgctgcgaggcagctcgtaaggtcatccgcctaagcgattgcctccgggtcgctgaggccggcggagaggcatcatcccctagggacaccagtgcgttttttctggaaactaaggaaaggctctatctgttggcggcccctgccgccgaacgaggggactgggttcaggccatatgtctgcttgcctttccgggtcagagaaaggagctgtcagggccagagggaaaacagagcaggccttgtatggaagaaaatgaattgtattcctcagcagtcaccgtgggcccccacaaagagtttgccgtcactatgcgccctactgaggcttctgagaggtgccatctgagaggaagttacacccttcgggctggagaatccgcgttggagctctggggtgggcccgaaccgggcacccagctctatgactggccatacaggtttctgaggagatttgggcgagataaggtgaccttctcattcgaagcgggccggcgttgcgtgagcggagagggaaacttcgagtttgagactaggcaaggcaatgagatcttcctggcccttgaggaggccatctcagcccagaaaaacgccgctcctgccaccccccagccacagccagcaaccatcccagcctccctcccccggccagattcgccttatagtagacctcatgattctctgccgccgcctagcccaaccactcctgtgcctgccccaagacccaggggccaggagggagaatacgccgtacccttcgatgccgtggccagatctctcggcaagaatttcagaggcatcctagccgtgcccccgcagttactagcggatccactctatgatagcatagaggagacactcccgccaaggccagaccacatctatgacgaaccagagggagtggccgcattgtcgttatacgactcgccccaggagcccagaggcgaagcctggcggcgccaggctaccgctgaccgggatccagctggtcttcagcacgtccaacctgctggccaggacttctccgcctccggttggcaaccaggtactgagtacgacaatgtcgtgttgaagaaggggcctaaatag

SEQ ID NO: 185736 - DNA, 777 bp, Artificial Sequence
  Description of Artificial Sequence: Synthetic coding sequence
atgcggcccaccgaggccagcgagcggtgccacctgcggggcagctatacacttcgcgccggcgaatctgccctcgagttgtggggcggacccgagcctggaacccaactgtacgactggccatacaggtttctcagaagattcgggagagataaggtcacattctcttttgaggcaggacgcagatgtgtgtcaggggagggcaattttgagttcgagacccgccagggaaatgagattttcttggctctggaggaggccatttcagcccagaagaacgccgcccctgctacaccacaacctcagccagccaccatccccgcctcgctccctcgccctgactctccatattctaggcctcacgattcccttccgccacctagtcctacgaccccagtgcccgcccccagacccaggggccaggagggtgagtacgcagtaccgttcgacgcagtggcccgctccctcggcaagaacttcaggggaattctggctgtgccaccacaattgctggctgaccccctgtatgactcaatcgaggagactctgccacctcgccctgatcacatttacgacgagccggagggcgtagcagccttgagtctatacgattccccccaggagcccagaggagaggcttggcgccgacaggcaacagcagatagggatcccgccggcctgcaacatgtgcagcctgcaggacaggatttcagcgcctctgggtggcaacctggcacggagtatgataacgtcgtgctaaagaaaggccctaaatag

SEQ ID NO: 185737 - DNA, 993 bp, Artificial Sequence
  Description of Artificial Sequence: Synthetic coding sequence
atggaccccctggagacccccatcaaggacggcatcctgtaccagcagcacgtgaaattcggcaaaaaatgttggcgcaaggtatgggccctgctctacgcaggcggtccctctggggttgctaggctcgaaagctgggaggtgcgcgatggcggactcggcgccgcaggggatcgctccgccggcccaggaaggcgcggcgagaggcgagtgatccggctggcggattgtgttagtgtgcttcccgcagacggggaatcttgcccgcgtgacacaggtgctttcctgctgaccacaaccgagcgctctcacctcttggctgctcagcatcgacaagcctggatgggaccgatctgccagctcgcatttccagggactggcgaggcctctagcggttcaaccgacgcccagagccctaagaggggcctagtccccatggaggaaaatagcatatactcctcatggcaggaagtgggggagttcccagtggttgtgcaaaggacagaggctgccactcggtgtcagctgaaggggcccgccttgcttgtcctagggccagatgcaatccaactccgcgaggccaaaggcacacaagcactttacagttggccctaccacttcctgcgcaagtttggtagtgacaaaatattattgggtactcccggcgtatccttactgatctgtaagggggagaggacagacgatgtgtctgggatcatactggacgaatcactgctgcgggcatattccgtgcccggtgccggcggacatagcagggtgcaggattctttaggtcctgtccttagggaaccaaccttccagggagaacggagtttccttaagacgagtatgcttagatccctgttatgttcatgctcatggagacaccctaggagccagccccggacacaggcctcttgcctgcagggctcagattgtcctgcaccacaccggaactcgactagtgccgcccacactctggggaccagttag

SEQ ID NO: 185738 - DNA, 1491 bp, Artificial Sequence
  Description of Artificial Sequence: Synthetic coding sequence
atgacccggggcgcccggctgcggagcgacgcccgggcccagctgaaccagctgagtctcgatggaggtactgggagcgggcagaagggaaagtgcgaggaattccccagctcgctaagctccgtgtcgccaggtttagaagccgccgctctgctcctggctgtcactatggatcctctagagacccccatcaaggatgggatcctttatcagcagcatgtaaagtttgggaaaaaatgctggcgcaaggtttgggcactgttgtacgcaggggggcctagtggcgtggcaagactcgagtcctgggaagtgcgcgacggaggccttggcgctgccggggaccggtcagcaggacctggcaggaggggggagcggcgtgttatccggttggcagactgcgtgtctgtgctgccagcggatggggagtcttgcccacgcgataccggcgctttcctacttacgacgacggaacgctcccatctgctggcagcccagcaccggcaagcgtggatgggtcctatatgtcagttggcgttcccaggcacaggagaggcaagctcagggagtacagacgcgcagtcccctaaacggggattagtgccgatggaggagaattctatctattcttcatggcaggaagttggggagttcccagtagtggtccagaggacagaagctgctaccagatgccagttaaaggggcccgcccttctggtgcttggacccgacgctatacagttacgagaggccaagggaactcaagcactgtactcttggccgtaccactttctgaggaaattcgggtcagacaagggcgtcttctccttcgaggccggcaggcgctgccattcgggcgaagggctgttcgcattttcgacaccctgtgcacctgacctgtgtagggcggtcgctggggctattgctcgccaaagagagaggcttcccgaattgacccgtccacaaccctgtccactgccccgcgcaacctcgctgccctctctcgacacgcccggggaactgagggaaatgcctcctggcccagaacccccaacatctcgtaaaatgcatctggccgagccgggccctcaaagcctgcccctgctactgggcccagaacctaatgatcttgccagcggtctgtacgcttcagtttgcaaacgggcctcaggcccaccaggtaatgaacacctgtacgagaacctatgtgttctggaagcgagccccacattgcatggaggagagcccgaaccgcatgaggggccaggaagtagaagccctacaacctctccgatctaccataacggtcaggacctctcttggccaggccccgccaacgactccaccttagaagcccagtaccggagactgctcgagctcgatcaggtggaggggaccggacgccccgacccgcaggccgggttcaaagctaaactcgtaacactgttgtcacgggagaggcgtaaaggtccggccccttgtgacaggccgtag

SEQ ID NO: 185739 - DNA, 687 bp, Artificial Sequence
  Description of Artificial Sequence: Synthetic coding sequence
atggaccccctggagacccccatcaaggacggcatcctgtaccagcaacatgtgaaattcgggaagggcactggcgaagcctcatcgggctccactgatgcccaatctcccaaacgcggccttgtccctatggaggagaacagtatttactcctcgtggcaggaggtgggcgagttccccgtcgtggttcagagaacagaagctgccacccgctgtcagctaaagggcccagctctgttggttctcggtcctgatgcgatccagctgagggaggcgaagggtacacaagccctctattcatggccctaccacttcttacgcaaattcgggtccgacaaaatcctgctgggaacgcccggagtatctctactgatctgcaaaggggagaggacggacgacgttagcggcattatattagacgaaagcttgttgcgcgcctacagcgtgcctggcgctgggggccatagtagagttcaggacagcttaggacctgtcctgcgggagcccacattccagggagagcgatcattcttgaagacttccatgcttcgaagcttattgtgttcctgcagctggcgccatcccaggagtcagcccagaactcaggcctcttgtttacaggggtctgactgccccgctccccacaggaattccacatcagcagcccacactttgggaacctcgtag

SEQ ID NO: 185740 - DNA, 435 bp, Artificial Sequence
  Description of Artificial Sequence: Synthetic coding sequence
atggaccccctggagacccccatcaaggacggcatcctgtaccagcagcatgtgaagtttggaaagaagtgctggaggaaagtgtgggccttgttgtacgcaggaggcccttccggggtggctagacttgagtcctgggaggtgagagacggaggactcggggctgccggggacagatcagccgggcccggtcggcggggtgaacgaagggtaatcagactggccgattgtgtttctgtgctcccggcagatggggagtcttgcccacgagacacaggcgcatttttactgaccaccacggaacgctctcatcttttggctgctcaacatcgtcaggcatggatgggccccatttgccagctggcatttcccggcaccggggaggcctcgagtggttctacggacgcgcaaagtccgaagaggggtctggtgtag

SEQ ID NO: 185741 - DNA, 471 bp, Artificial Sequence
  Description of Artificial Sequence: Synthetic coding sequence
atggaccccctggagacccccatcaaggacggcatcctgtaccagcagcatgtcaagtttggaaagaaatgctggcgaaaggtgtgggccttgctttatgccggaggtccgtcaggggtggcgcgcctagaaagttgggaagtaagggacgggggtttaggagccgctggcgataggtcagctggacccggtcgccgaggagagcgtagagtgattagattggccgattgtgtctccgtgctccctgccgatggtgaatcatgtcccagagataccggcgctttcctactgactaccactgagaggagtcaccttctggcagcccagcatcgccaagcatggatgggtcccatatgccaactggcatttcccggcacaggagaggcgtcctcagggagcacagacgcccagtctcccaaacgaggactggttcctatggaggaaaattcgatatactcctcttggcagtag

SEQ ID NO: 185742 - DNA, 132 bp, Artificial Sequence
  Description of Artificial Sequence: Synthetic coding sequence
atggaccccctggagacccccatcaaggacggcatcctgtaccagcaacacgtgaagttcgggaaaaaatgctggcgcaaggtgtgggccctcctgtatgccggtggaccgtccggagtagctcgcctttag

SEQ ID NO: 185743 - DNA, 642 bp, Artificial Sequence
  Description of Artificial Sequence: Synthetic coding sequence
atggaccccctggagacccccatcaaggacggcatcctgtaccagcaacatgtcaagtttggaaagaagtgctggaggaaggtgtgggcacttctatatgctggtggtccttcaggtgtggcacgcttggaaagctgggaagtacgggacgggggtctgggagctgcaggggatcgatcagccggccctggccgccggggcgagcgtagagttatccgcttagccgactgcgtgtccgttctgcccgccgacggagagtcgtgtccccgggataccggagccttcctgctcactactacagagagaagccacctcctagccgcccagcatcggcaggcatggatggggccaatttgccagctggctttccctgggaccggagaggcatctagcggttctacggatgctcagagcccaaagcgggggctcgttcctatggaagaaaatagtatctattcatcttggcaggaagtgggagagtttccagtggttgtccagcggacagaggcggctaccaggtgtcagctcaagggacctgctctgctggtgctaggcccagacgccattcaattacgggaggcgaagggaacacaggccctgtacagctggccataccatttcctccgtaagttcggctcatag

SEQ ID NO: 185744 - DNA, 42 bp, Artificial Sequence; identical to SEQ ID NO: 79550
  Description of Artificial Sequence: Synthetic coding sequence

SEQ ID NO: 185745 - DNA, 258 bp, Artificial Sequence
  Description of Artificial Sequence: Synthetic coding sequence
atggaccccctggagacccccatcaaggacggcatcctgtaccagcagcacgtgaagtttggcaaaaagtgttggcggaaggtatgggccctgctatatgcggggggcccatccggtgtggctagactggaatcgtgggaggtgcgagacggagggctgggggcagctggggatcggtccgcaggccctggcagacggggggagcggagagtgatcaggctcgctgactgtgtcagtgtcttgccggcggacggctag

SEQ ID NO: 185746 - DNA, 981 bp, Artificial Sequence
  Description of Artificial Sequence: Synthetic coding sequence
atggccaccaacttcagcgacatcgtgaagcagggctacgtgaagatgaagtcgcggaagttaggcatctaccggaggtgttggctcgtctttaggaagagttccagcaaaggaccccagaggctagagaaataccctgatgagaagtccgtttgtctacgcggctgccccaaggtgactgaaatcagcaacgtgaagtgcgtgacacggcttccgaaggagacaaagaggcaggccgttgcaattatctttactgacgactccgctcggactttcacttgtgacagtgaactagaggcggaggagtggtacaaaacattatcagtagaatgcttaggcagcagacttaatgacatttctctcggcgagcccgatttgctcgctcccggagtacaatgcgagcaaaccgaccggtttaacgtgttccttctgccctgccctaacttggatgtctacggggagtgtaaactgcagatcacccatgagaatatctatctgtgggatatccacaaccctagggtgaagcttgtcagctggcctctttgcagcctcaggcgctacggcagagatgccacacggtttacatttgaggccggccgcatgtgtgatgccggagagggactgtacactttccaaacccaggaaggcgaacaaatctatcagcgggtccactctgccactctagcaatcgctgagcaacacaaacgggtcctgttggagatggagaagaacgtgcggctgctcaacaagggtaccgaacactactcctacccctgcacacccacgacaatgttaccacgttccgcttattggcaccacattacagggtcccagaacattgctgaggcctcctcatacgccggggagggctacggggccgctcaggcttccagcgagacagacttattgaaccgcttcatcctgctgaagcctaagcctagtcagggggattcttcggaggctaagacccctagccagtag

SEQ ID NO: 185747 - DNA, 921 bp, Artificial Sequence
  Description of Artificial Sequence: Synthetic coding sequence
atggccagcaacttcaacgacatcgtgaagcagggctacgtgcggataaggtcccgccggctcggtatctaccaaagatgttggctcgtcttcaaaaaggcttcttctaaagggccaaaacggcttgagaagttcagtgacgagagagctgcctattttcggtgctaccacaaagtgaccgagctcaataacgtgaagaacgtggccagattgccaaaatcaacaaagaaacacgccattggaatatacttcaatgatgatacttccaaaacattcgcatgcgagtccgacctggaagccgacgaatggtgtaaagtgttgcagatggaatgcgtgggaactcggataaatgacattagtttgggcgaaccagatcttcttgccacaggtgtggagagggagcagtcagagcgctttaatgtctatctaatgcctagccccaacctcgacgtgcatggcgagtgcgcattacagatcacgtacgaatatatatgcctgtgggacgtgcagaaccctcgcgtgaagctgatcagttggccgctgagcgcattgcggagatatgggagagatactacatggttcacctttgaggctggtcggatgtgtgagacaggagaagggctgttcatattccagacacgtgatggggaagctatctaccagaaggtgcattccgccgccctggctattgctgaacagcacgagaggcttttgcagtccgtaaagaattcaatgctgcagatgaaaatgagtgagagggctgcctcactttccactatggtgccattgccaagaagcgcctattggcaacatattacaagacagcactccactggccagctctatcggctgcaggatgtgagctctcccttaaaattgcacaggacagaaacttttccagcataccgttcagaacactag

SEQ ID NO: 185748 - DNA, 1515 bp, Artificial Sequence
  Description of Artificial Sequence: Synthetic coding sequence
atgaccgaggccgccctggtggagggccaggtgaagctgcgggacgggaagaaatggaaatcccggtggttagtcctgcgaaagccttctcctgtcgccgattgtttgctcatgcttgtttataaggacaagtcagagcgcattaaagggctacgcgaacgcagcagcctgacactcgaggatatctgcggcctagagcccggcctgccgtatgagggcttggtacacactctggccatcgtgtgtctgtcccaggccatcatgctgggcttcgactcacacgaggccatgtgtgcttgggatgctagaatcagatatgcattgggggaagtccataggttccatgtcaccgttgcaccggggacgaagctggaatcagggcctgctaccctacacttatgcaatgacgtgttggtcctagcaagagacatccccccagccgtgacgggccagtggaagttgtcagatctgaggcggtatggggccgttccctcggggtttatttttgagggcggtacccggtgcggatactgggccggagtttttttcctgtcatcggcagaaggagagcaaatatctttcctctttgattgtatcgtgcgaggtatctctcccactaagggtccctttgggcttcgccctgtactccctgaccccagcccaccaggtccttcaaccgttgaggagcgcgtcgcccaggaagccctggaaaccctacagctcgagaagcgactatccctcttgtcacacgccggccggcctggaagcggcggcgatgacagatcactgtcttctagcagctcagaagcctcacacttggatgtcagtgcctccagtcgcctgactgcttggcctgagcagtcttcaagttctgcttcaacatctcaagaggggccccgtcccgcggccgcccaggctgccggtgaggctatggtgggggcaagtcggccccctccaaaaccactgaggcctcgtcagctccaagaagtcggcagacaatctagttccgatagcggtatagcgacaggatcccacagctcttattcctctagtcttagctcttacgccggcagttccctggacgtgtggcgggcaacagatgagctgggctccctgctttcactgccggctgccggggcccccgagcccagcctgtgcacctgcttacccggaaccgtggagtaccaggtgcctacctctttaagggcacattatgatacacccagaagcctctgtctcgctcccagggaccattctcccccttcccaagggtccccaggaaacagtgctgcgcgggatagcggggggcagacgtccgccggatgcccgtctggctggctgggcaccaggaggaggggcctggtaatggaggctcctcaaggctccgaggccacccttccaggcccagccccaggcgaaccttgggaagcgggaggcccacacgcgggtccaccccctgcatttttttccgcctgtcctgtgtgtggtggcttaaaagttaacccacccccctag

SEQ ID NO: 185749 - DNA, 1827 bp, Artificial Sequence
  Description of Artificial Sequence: Synthetic coding sequence
atgaccgaggccgccctggtggagggccaggtgaagctgcgggacggcaagaagtggaaatcgcgatggcttgtgctgagaaagcctagtccagttgccgattgcctgctgatgttggtttacaaagacaagagtgagaggattaagggcctgagggagcggtcttccttaacactagaagacatctgtggcctggaacccggtcttccatatgaagggctcgtacataccttggcaatcgtctgtctctcccaagccatcatgctgggttttgactcacacgaggctatgtgtgcatgggatgcacgcatcagatatgcactgggtgaagtccatcgcttccacgtcaccgttgcgcctgggacaaaacttgagtctggtcccgccactctgcacctgtgtaacgacgtgctcgtgctcgcacgcgacataccgcccgctgtgactggccagtggaagctctctgacttgcgtagatacggagccgtgccatcaggctttatcttcgagggaggaacacggtgtgggtactgggctggggtcttcttcttgagcagtgccgagggagagcaaatttcttttctcttcgattgcatcgttcggggaatttctcccacgaaggggccatttggactgcgaccggtactccccgacccgagtcccccaggaccaagtaccgtggaggagagagttgcgcaggaggccctggagaccctccagttggagaaacggcttagcctgctttcacatgcaggccgccctggctcaggaggtgacgaccgaagcctctcgtcatcctcatcagaggcctcacacttggatgtgagtgcctcttcccgcctgactgcctggcctgaacagtcctcttcatccgcatccacgagccaggaggggccaaggccagccgccgcccaggcggcaggggaggctatggtgggcgcttctcgaccaccccctaagcccttgcgacctaggcaactccaggaggtgggacgtcaatcaagttccgatagtgggattgccacagggtctcacagcagctattcttcctccctcagctcctacgctggaagtagtctcgatgtgtggcgggctaccgacgagctagggagcctcctgagcctgccagccgccggagccccggagccttcactgtgcacctgcctgccaggcactgttgagtatcaggtgccaaccagcctgagggcacattatgatacacccaggtctctctgtctcgctccccgggatcacagcccaccttctcaggggagtcctggcaattcagctgcacgggacagcggcggccaaaccagcgcaggatgtccttctggttggctcggcactcgccgtcggggcctggtaatggaggcgccgcaggggtccgaggcgacacttcctggtcctgcccctggagagccatgggaagccgggggtccccacgccggcccgccacctgcattctttagtgcgtgccctgtttgcggaggactgaaaggcgctgcagccagcgccccaggaccagccacagcccactccggatccccaggccctgtggcagtggattcgcctggaccagaacggcccagaggcgagtcacctacttacgttaacatacccgtcagtcctagcagcagaaagcagctgcactacatggggttggaactgcaggaagcgtccgagggagtcagaggtgccggggcttctctctatgctcagatcgatataatggccaccgaaactgcccatcgggtgggggtcaggcacgcacgagcaagggaggaacagctttctgaactagagcagcgcaaagcagctccacagtag

SEQ ID NO: 185750 - DNA, 768 bp, Artificial Sequence
  Description of Artificial Sequence: Synthetic coding sequence
atgaccgaggccgccctggtggagggccaggtgaagctgcgggacggcaagaagtggaagagccggtggttagttctccggaagcccagcccagttgcagactgtctgctgatgctggtctacaaagacaaatccgaaagaatcaaaggtctgcgagagcgaagtagtcttacactggaggacatttgcggattggaaccaggcctgccttacgaaggattagtacatacattagcaatcgtgtgcctgagccaggctatcatgttgggatttgactcccacgaggcaatgtgcgcttgggacgctagaatcagatatgccctgggagaagtacaccgattccacgttacagtggcccccggcactaagctggagagtggtccggccacgctgcatctgtgtaatgatgttctcgtcctggcgagagatataccccctgccgttaccgggcagtggaagttgtccgaccttagacgttacggagctgtcccgtctggcttcattttcgaggggggaacaagggggtggaggctgttacccgtcctgggaagaggcggagccgaccagttaccagtgcgcctgcaccggcctagacacctgccccaccagggtcccctatgggccgccgcaggaagcacccggcccaagtcccccggaacgttggattgtggcggcgcctgtggtcctggatcccccggcaaccccactgccggcgaggccgcagagccgccactgacatgtggacaggcggggcagtggaggggctag

SEQ ID NO: 185751 - DNA, 1371 bp, Artificial Sequence
  Description of Artificial Sequence: Synthetic coding sequence
atgggctacttccggtgcgcccgggccggcagcttcggccggcggcggaagatggagccgtctacagccgcccgcgcctgggcactattctggctcctgctgcccctccttggcgccgtgtgcgcctctggtccaagaaccctcgtgttactcgacaatttgaacgtcagggaaacccacagtttattttttcggagtcttaaagaccgggggtttgagcttacattcaaaacggccgatgacccgagtctgagcttgataaaatatggggagttcctctacgacaatctgatcatcttttccccctccgtcgaggatttcggcggaaatattaatgtggaaacaatctccgcgtttattgatggaggagggagtgtgttagtcgctgcatcaagcgatatcggggatcctctgcgcgagctgggaagcgaatgcgggatcgaattcgatgaggaaaaaaccgccgtgattgaccaccacaattatgacattagcgacctgggacaacataccctgattgttgccgataccgaaaacctgttgaaggctccaacgattgtgggcaagtcttctctcaaccctatcctgttccgaggtgtgggaatggttgccgatcctgataatccactggttctggatattctgacaggatccagcacatcttactcttttttccccgacaagcccatcactcaataccctcacgctgtgggcaaaaataccttactgattgcaggcttacaggctcgaaacaatgcacgtgtcatattttccggctctctcgactttttcagcgacagtttttttaatagtgcggttcagaaagccgctccgggaagtcaacgttattctcaaactggcaactacgaactggctgtggccctgtccaggtgggtgttcaaagaggaaggcgtgcttagagttggtccagtgtcccaccaccgtgtgggcgaaacagccccaccgaacgcctacacagtcaccgacctagtggaatacagtatcgttatacaacagttatccaacggtaaatgggtcccgtttgacggcgatgacatccaactcgaattcgttaggatcgaccccttcgtgcggacattcttaaagaaaaaagggggcaagtactctgtgcagtttaaactcccagatgtatacggagtgttccagtttaaggtggactataatcggctgggatacacgcacctgtatagctcaacacaggttagcgtgagacctctgcagcatacacagtacgaaagattcataccaagcgcctacccctattacgcttcggctttttcaatgatgttgggtctctttatcttttctattgtcttcctccatatgaaagaaaaggagaaatctgattag

SEQ ID NO: 185752 - DNA, 1260 bp, Artificial Sequence
  Description of Artificial Sequence: Synthetic coding sequence
atgggctacttccggtgcgcccgggccggcagcttcggccggcggagaaaaatggagccatcaactgcagctcgagcctgggccctcttctggctactactgccgttattgggcgcagtgtgtgcctccggccccagaaccctagtcttgctggacaacctgaacgtaagagaaacgcattccctgtttttcaggtccctgaaagactttggaggaaatataaatgtggaaactataagcgcctttattgacggaggcggcagtgtcctggtggcagctagcagtgatatcggcgatccattacgcgagctgggctcagagtgcggcatagagtttgacgaagaaaagactgccgtgattgaccaccataattacgacatttccgacctgggccagcatacactgattgtggcagacaccgagaatctgctgaaggctcctactatcgttggtaaaagctcattgaaccccatcttgtttcgtggcgtgggcatggtggcagacccggataatcctctggtgcttgacatcttaaccggaagcagcactagttactcctttttcccagacaagcccattacacaatatccccatgctgtgggcaagaatactctcctgatagcaggtcttcaagcacgcaacaatgctcgggttattttcagtggatccctagacttctttagtgattccttctttaacagtgcggtccagaaggccgctcctggttcccagcgatatagtcaaactggaaactacgaactggctgttgctctaagtcgctgggtatttaaggaagagggggtgcttagagtgggtccagtgtcccaccaccgtgtgggggagactgccccgcctaatgcctacacagttaccgatctggtggaatattcaattgtaatacagcaattgtcaaatggcaaatgggtacctttcgacggggacgacatacagctggaatttgtcaggattgatccttttgtccggacgtttctaaagaagaaaggaggtaaatacagcgtccagtttaagttgcccgatgtgtatggcgtctttcagttcaaggtcgactataaccgtctcggctatacacacctgtattccagcacacaggtgtccgttaggcctttgcaacacactcaatatgagaggttcatcccatccgcctacccctattacgcttcagctttctctatgatgctgggtctgttcattttttcaatagtgttcctgcatatgaaagagaaggaaaagtctgactag

SEQ ID NO: 185753 - DNA, 279 bp, Artificial Sequence
  Description of Artificial Sequence: Synthetic coding sequence
atgaccaagctggcccagtggctgtggggcctggccatcctgggctctacatgggtggcattaaccacaggggcccttggccttgagctccccctgtcctgccaggaggtgctgtggcccctgcctgcctatttactggttagcgccgggtgttatgctttggggacggtggggtatagggtagctacatttcacgattgtgaggacgctgccagagaactccagagtcagatccaggaggcccgcgcggatttagccaggagaggtctgcggttttag

SEQ ID NO: 185754 - DNA, 369 bp, Artificial Sequence
  Description of Artificial Sequence: Synthetic coding sequence
atgctgagcgtgggcggcctgcggctgagcctggtgcggttcagcttcctcttgctccgtggggcattgcttcctagccttgcagtgaccatgactaagttggcacagtggctgtggggactcgcaattcttggcagtacatgggtagcactcaccacaggcgccctgggtctcgagctgcccctctcctgccaggaggttctttggccattgcctgcctacctcttagtttccgccggctgctatgcacttggcactgttggatatcgagtggccacttttcacgactgtgaggacgccgcacgagagctgcaatcacagatacaggaagccagagctgacctggcccgtcggggcctccggttctag

SEQ ID NO: 185755 - DNA, 279 bp, Artificial Sequence
  Description of Artificial Sequence: Synthetic coding sequence
atgaccaagctggcccagtggctgtggggcctggccatcctgggctccacttgggtcgccttaactaccggagccctcggactggagcttcctctgtcttgccaggaagttctgtggcccctccctgcatacctgctcgtctccgcaggctgctacgcactggggacagtgggatatcgagtggccacatttcacgattgtgaggacgctgccagggagttgcagagccagattcaagaagcaagggcggatctggctcgccggggcctgcgcttttag

SEQ ID NO: 185756 - DNA, 1191 bp, Artificial Sequence
  Description of Artificial Sequence: Synthetic coding sequence
atggacccccggggcaccaagcggggcgccgagaagaccgaggtggccgagcccagaaacaagctcccgcggcccgcgccttccttaccaaccgatcccgcgttgtacagtggacccttcccattttacaggcgaccctccgagctgggctgtttttctcttgacgcacagcggcagtaccatggagacgcacgcgccctgcgctactattcgcctccaccaaccaacggccctggccccaattttgatttacgggacgggtaccccgacagataccagcccagagatgaagaagttcaggaaaggctggatcacttactgtgctggctcttagagcaccgagggcgcctggaaggaggacccgggtggctcgcagaggcaatcgtgacctggcgcggccatctgaccaagctcttgaccacaccttacgagcggcaggaaggatggcagctggccgcctcacggttccagggtactctgtatctctcggaggtagagactccgaacgcaagagcccagcgcctggctcgcccacctttgctgagggagcttatgtacatgggatacaaattcgagcagtatatgtgcgcggataaacccgggtcctctcccgacccatcaggggaggtgaatactaacgtcgcattctgttccgttctgcgcagccgcttggggtcacatcctcttctctttagtggcgaagtggactgcaccgatccccaggcaccctccacccaacccccaacatgttacgtagaactgaagacatcaaaggagatgcattcccctggacaatggagaagcttctacaggcacaagttactgaaatggtgggctcagtccttcttacctggagtccctaatgtagtggcaggctttcggaatcccgacggcttcgtaagttccctcaagacttttccaaccatgaaaatgtttgagtatgttaggaacgacagagacggatggaacccaagtgtgtgcatgaacttctgcgctgctttcctctcattcgcgcaaagtacagtggtgcaggatgacccgaggctcgtgcatctgttctcttgggagcccggcgggcccgtcacggtgagcgtgcaccaggatgctccttacgctttcctgcccatatggtacgttgaggcgatgacgcaagatctgccaagccccccgaaaacacctagtcccaaatag

SEQ ID NO: 185757 - DNA, 1191 bp, Artificial Sequence
  Description of Artificial Sequence: Synthetic coding sequence
atggacccccggggcaccaagcggggcgccgagaagaccgaggtggccgagcctagaaacaagctgccccgtcccgccccttccctcccaaccgatccagccctgtatagtggccctttccccttctacagacggcccagcgaactgggctgcttttcactggacgcccagagacagtatcatggagatgcccgagctcttaggtattattcgccaccccccaccaacggaccaggtccgaactttgacctgcgcgacggttatcccgaccggtaccagcctcgagatgaagaggtgcaagaacgtctggaccacttgctgtgctggctgctggaacatcgtggacgcttagaaggaggtccaggatggctagctgaagctatagtcacgtggcgtggtcacttgactaaattattgacaacaccatacgagcgccaggagggatggcagttggcagcctcacggtttcagggaacattatatttgtctgaggtggaaacccccaatgctcgggcccagcgtctggccaggcctcctttattgcgagaactaatgtacatgggttataagtttgaacagtatatgtgtgcggacaaaccgggttcctcaccagatccgagtggtgaggtgaacaccaatgtggcgttttgttccgtactgcgaagcagactggggtcgcacccgttgctcttttctggtgaagtggattgtacagaccctcaggctccctccacacagccacctacatgttatgtcgaactgaagacttccaaggagatgcactctcccggtcagtggaggtcattctatcggcataagctattaaagtggtgggcacagtctttcctgcctggggtgccaaatgtagtggccggttttcggaatccagatgggttcgtaagttctcttaaaactttccctacaatgaaaatgtttgaatatgttcggaatgacagagatggctggaatccctccgtgtgcatgaatttctgcgcggcctttctcagtttcgctcagtccactgtcgtgcaagacgaccctcggctggtgcatcttttctcttgggagccagggggaccagtcaccgtctctgtccaccaggatgctccgtacgcttttttaccaatctggtacgtggaagcaatgacacaggacctgccctctcctcccaaaacaccctcacccaaatag

SEQ ID NO: 185758 - DNA, 1191 bp, Artificial Sequence
  Description of Artificial Sequence: Synthetic coding sequence
atggacccccggggcaccaagcggggcgccgagaagaccgaggtggctgagcccaggaacaagcttccccgccctgcaccctcactgcccactgatccggccctgtactccggacctttcccattttaccggaggccttcagagctgggttgttttagcctggacgcccagcggcagtaccatggtgacgctcgggccctcagatattacagcccacctcccaccaacggcccaggcccaaattttgatcttcgggatggctacccagacagataccagcctagggacgaggaagtgcaggaacggctggaccacctgctgtgttggctcctggaacaccgcggccgcttggaggggggtcccggttggctggccgaagctattgtgacgtggagaggccacctcacaaagctgctcacgactccctatgaacggcaggagggctggcagttggcggcaagccgattccagggcacattatatctctccgaggttgaaacccccaatgcacgcgcccagcgacttgcgcggccacccctcctgcgcgaactgatgtatatgggatataagtttgagcagtatatgtgcgctgacaaaccagggagctctcccgacccttcaggggaggttaataccaatgttgctttctgcagtgtgctcagatctagactgggcagccatcctctcctgttctctggcgaggtggattgcactgaccctcaagctccctcgacccagcccccaacttgctacgtcgaactcaagacttccaaggagatgcactcacccggccagtggcggtcattttataggcataagcttctgaagtggtgggcccagtcattcctgcctggcgtccccaatgtagttgccgggtttcgcaacccagatggcttcgtgtcctctttaaaaacatttccaactatgaagatgtttgaatatgtcaggaatgacagagacggatggaacccgagtgtgtgcatgaacttctgtgctgcttttttatcttttgcacaaagcaccgtagttcaagacgacccgcggctagttcacttattcagttgggagcctgggggccccgtgactgtctccgtacaccaggatgctccatatgcattcttacccatttggtatgttgaggcaatgacccaggacctgcccagcccaccaaagactcctagccccaagtag

SEQ ID NO: 185759 - DNA, 1191 bp, Artificial Sequence
  Description of Artificial Sequence: Synthetic coding sequence
atggacccccggggcaccaagcggggcgccgagaagaccgaggtggctgaaccacgtaataagctaccccgtccagctcccagtttgccgaccgaccccgctctgtattccggaccctttccattttaccgccgtccaagtgagctggggtgtttcagcctggatgcccaaagacagtatcacggagatgcccgggcattgaggtactattcacccccacccacaaacgggcccggacccaatttcgatctacgcgacggttacccggatagataccaaccccgggacgaggaggtgcaggagcggctcgaccacctcctttgttggttgcttgaacatcgcggccgcctggaagggggccccgggtggcttgcagaagcaatcgtgacttggcgggggcacctgaccaagctgctgaccacgccttatgaacgccaggagggatggcaactggctgccagtaggtttcaggggactctgtacttgtctgaagtcgaaacccccaatgcccgcgcccagaggcttgcaagacccccgcttctgagagagcttatgtacatgggctataagttcgagcaatacatgtgcgccgataagccgggatcctcacccgatcctagcggggaagtgaacaccaatgtggccttttgttccgtactgcgctctcggttgggttcccacccattgcttttttcgggagaagtggattgcacggatccacaggccccctcaacacagcccccaacatgctatgtggaactaaagacgtctaaagagatgcattcacctggacagtggcgatctttttaccggcacaagttgctgaaatggtgggctcagtcttttcttcctggggtgcctaacgtagtggccggattccgcaatcctgacggttttgtcagctctctcaagacttttccaactatgaaaatgttcgaatacgtcaggaacgatcgtgacggctggaatcccagtgtttgtatgaacttctgcgccgcttttctgagttttgctcagtctaccgtggtccaggatgaccctagactggtgcacttgttctcttgggagcctggcggaccagtcactgttagcgttcaccaggatgccccttatgcgttcctacctatatggtacgtagaggccatgacgcaagacctcccatctcccccaaagactccgagccccaagtag

SEQ ID NO: 185760 - DNA, 1191 bp, Artificial Sequence
  Description of Artificial Sequence: Synthetic coding sequence
atggacccccggggcaccaagcggggcgccgagaagaccgaggtggccgagcctcgcaacaagctgccccgtcctgccccctccctcccaacagaccctgcactgtacagcgggccgttcccgttctatagacggccttcagagctggggtgtttcagcttggacgctcagcggcagtatcacggggatgcccgcgccctgcgatactacagccccccccccaccaatggcccgggccctaactttgacctacgggatggctaccctgaccgatatcagccacgtgatgaggaggtgcaggagcggcttgatcacttattgtgttggttgttggagcataggggcagactagagggcggacctggctggctggctgaagctattgtgacctggagggggcacttaacaaagcttctcaccacaccctatgaacgtcaggaagggtggcagctggcggccagccgattccagggcacactctacctgtccgaagttgagacgcctaatgcacgagcgcaacgcctggctaggcccccgctgctccgcgagttgatgtacatgggctataagttcgagcaatacatgtgtgctgataaacctggcagttctcccgacccatctggggaggtcaatacaaatgttgcgttctgcagtgtactgcggagtcgtctgggatcccaccccttactgttcagcggggaagtcgactgtacggatccgcaggcacccagtactcaaccccctacttgttatgtcgagctgaaaaccagcaaagagatgcactcccctgggcagtggcggtctttctatcgccacaagctcctgaaatggtgggcccagagtttcctccctggagttcccaacgtggttgctggcttcagaaaccctgacggtttcgtatcttcacttaagaccttccccaccatgaagatgtttgagtacgtccgcaatgatagggacgggtggaatccatctgtgtgtatgaacttttgcgccgccttcctcagctttgcccagtcgaccgtggtacaggacgacccacgtctggtgcacctgttcagctgggaacccggcggcccagtcacagtgtccgtccatcaagatgccccctacgccttcctgcctatctggtatgttgaggccatgacccaggacctcccaagcccccctaagacaccatctccgaagtag

SEQ ID NO: 185761 - DNA, 1191 bp, Artificial Sequence
  Description of Artificial Sequence: Synthetic coding sequence
atggacccccggggcaccaagcggggcgccgagaagaccgaggtggctgagccacggaacaaacttccaaggcccgctccctcccttcccactgatcccgctctgtatagtggaccctttccgttctaccgacggcctagcgagctggggtgtttctccttggatgcacagcgtcagtaccacggcgatgctcgcgcgctcagatactatagcccaccccctacaaatggacctggacccaatttcgatctcagagatggctatcccgaccggtatcaacctcgggatgaagaggtccaagagagattagatcacctgctctgttggctcctggaacacagaggcaggctcgaaggcggtccagggtggttggctgaggctatagtaacatggcgaggacacttgacgaagctgctcactactccttacgagcgacaagagggctggcaactggcagccagcaggttccagggaaccctgtatctgagcgaggtggagactcctaacgcaagagcccaacgactagcacgtccacccctccttcgggagctgatgtacatggggtataaattcgagcagtacatgtgcgcggataaaccgggaagctcccccgatccttccggggaagttaatactaatgtagccttttgtagtgtactgcgttctagactgggctctcatcccctgctgttttccggagaggtggattgcaccgatccacaggctccttcaacacagcctcccacatgctatgtcgaactgaaaacttctaaggaaatgcactccccaggtcaatggcgatccttttatcgccataaactgctcaaatggtgggctcaatcctttctgcctggcgtaccaaatgtcgtggccggattccgtaatcccgacgggttcgttagcagtctgaaaacattccccacaatgaaaatgtttgaatacgtacggaacgaccgggatggctggaatccctcagtgtgcatgaacttttgcgcggccttccttagcttcgcccagagtacagttgtccaggatgatcccaggctcgttcatcttttttcatgggaacctggcgggccggtgacagttagtgtgcaccaagatgctccttacgcattcctgccaatctggtacgttgaggccatgacccaggacctcccttcccccccgaagactccatctcctaaatag

SEQ ID NO: 185762 - DNA, 1191 bp, Artificial Sequence
  Description of Artificial Sequence: Synthetic coding sequence
atggacccccggggcaccaagcggggcgccgagaagaccgaggtggctgaaccacgcaataagctgcctagacctgcccccagcctccctaccgatccagcactatactcaggcccattcccattctacagacggccttcagaactgggatgtttctcactggatgctcaacggcagtaccacggcgatgcaagagctctgaggtactactcccccccccccacaaatggaccaggtcccaattttgaccttcgtgatggatatcccgatcgttaccaaccccgggacgaagaggtgcaagaaaggcttgaccatctgttgtgctggctccttgagcatcgtgggagacttgagggtggaccaggttggctggccgaagcaatcgtgacctggagaggccatctgactaaactgctcaccacaccctatgagcgtcaagaaggctggcagttagcagcctcgcggttccagggcaccctgtacttatccgaggtagaaacccccaatgccagggcccagcggttagcgagacctccgctgttgcgggagctcatgtatatgggttataagttcgagcagtatatgtgtgccgacaagccagggtcatctcctgacccttctggagaagtgaataccaacgtagccttttgctcagtgctcagaagcagactggggagccaccctctcctcttctccggcgaagtggattgcacggacccacaggcgcccagcactcagcccccaacatgttatgtggagctgaaaacatctaaggaaatgcagtcacccggccagtggaggtccttttaccgtcataagttgctaaagtggtgggcccaatccttcctcccaggtgtccctaatgtagtggcgggattcaggaacccagatggcttcgtttcctcattgaaaacattccctacaatgaagatgttcgaatacgtgcgtaacgatcgggacggctggaatccaagtgtctgcatgaacttttgcgccgcgttcctaagctttgctcagtctactgttgtgcaggatgacccacgcctggtccatctgttctcctgggagccaggcgggccagtaactgtgtccgtacaccaggacgcaccttatgcttttctgccaatctggtacgtggaggcaatgacccaggacctgccgtctccccccaagacaccgtccccaaaatag

SEQ ID NO: 185763 - DNA, 1191 bp, Artificial Sequence
  Description of Artificial Sequence: Synthetic coding sequence
atggacccccggggcaccaagcggggcgccgagaagaccgaggtggctgaaccaagaaataagctcccaaggcccgccccttccctgccgacggatcctgctctgtattccggtccctttccgttctatagacgcccttcagaactcggttgcttctcccttgacgctcagcgtcaataccacggggatgcacgggcgttgaggtactatagccctccaccaacaaacgggccaggacctaatttcgatctcagggatggttacccggatagatatcagcctagagatgaggaggtgcaggagcggctggatcatctcctttgttggctcctggagcatagggggcggcttgaaggtgggcctggttggctcgccgaggcaatagtgacctggcgcggccatctgaccaagctgctcactaccccatatgaacgtcaggagggctggcagctcgctgcttctcggtttcagggaacactttatctgagtgaagtcgagacacctaatgccagggcgcaacggcttgcccgacctcctctgttaagggaacttatgtacatggggtacaaattcgagcagtacatgtgcgcagataagcccggatcgtcaccagacccctccggtgaagttaacaccaacgtcgcattctgctcagtgctgagatcgaggctgggaagtcatccactcctctttagtggggaagtcgactgtactgaccctcaagccccatctacacagcccccgacctgttacgtggaactcaaaacctcaaaagagatgcactcacctggacagtggagatccttttaccgccacaagctgctcaaatggtgggcccagtcgttcctccccggcgtaccgaacgtggtggccggcttcagaaatccagacgggtttgtgagctccctgaagacatttcccacaatgaaaatgttcgagtacgtgcgcaacgaccgagatggatggaatccttccgtttgtatgaatttttgtgcagccttcttgtcattcgcacagtccacggttgtgcaggacgaccccaggctggtacacttgttcagctgggaacctgggggccccgtgaccgtttcagtgcatcaggatgctccttacgcttttctgccaatttggtatgtcgaggctatgactcaagatttgccttctccaccaaagacgcccagccctaagtag

SEQ ID NO: 185764 - DNA, 1191 bp, Artificial Sequence
  Description of Artificial Sequence: Synthetic coding sequence
atggacccccggggcaccaagcggggcgccgagaagaccgaggtggcggagccgaggaacaagctcccccgaccagcaccgagccttccgactgatcccgccctgtacagtggacccttcccattttaccggcgtcccagcgagcttggttgcttctctttagatgcacagagacagtaccatggcgatgcccgcgctctccgctattattcccctccaccaaccaatggccctggcccgaatttcgatcttcgggatggctacccggaccggtaccagccgcgggacgaggaggttcaggagcggctagaccacctgctgtgttggttactggaacacaggggccggctcgagggaggtcccgggtggttggctgaggcgattgttacctggcggggacatctaaccaaactcctgacaacaccatatgagcggcaggaaggctggcaactagccgcaagcagatttcaaggaacgctgtacctgagcgaagtcgaaacacctaacgctagagcacagaggctggccagaccgcccttgctgagagaattgatgtatatgggctacaagttcgagcagtatatgtgcgccgacaaaccaggtagttcgcctgatccatccggcgaggtcaacacgaatgtggcattttgctcagtgctgaggagccgcctcggatcccatccattattattcagcggtgaggtggattgtaccgatcctcaagcccccagtacacaaccaccaacctgttacgtggaattgaagacctccaaagagatgcattcgcctggacagtggcgtagcttttacaggcataagctgttgaaatggtgggcccaatccttcctacccggggttccgaatgtcgtagctggttttcgcaatcctgacggctttgtgtctagcctgaaaacctttccaactatgaagatgtttgaatatgtcagaaacgatcgggatgggtggaaccccagcgtctgcatgaatttctgcgctgcctttctgtccttcgcccagtctacggtggtgcaggacgatccacgcctggtgcacttgttttcatgggagcctggcggccccgtgacagtgagcgtccatcaagacgcgccctatgctttcctccccatttggtacgtggaggcgatgacccaggatctcccctcacctccaaagacccccagcccaaaatag

SEQ ID NO: 185765 - DNA, 1191 bp, Artificial Sequence
  Description of Artificial Sequence: Synthetic coding sequence
atggacccccggggcaccaagcggggcgccgagaagaccgaggtggccgagccacgtaataaactgccacggcccgctccctcgctccctaccgatcctgctctctacagcgggccttttcccttttatcgacgcccttctgagctagggtgcttctcactcgacgctcagcgccagtaccatggtgacgccagggctctaaggtattattccccacctccaactaacggcccaggcccaaatttcgacctgagagacgggtatccggatcggtaccagccccgagatgaggaagtgcaggagaggctagatcacctattatgctggttgttagaacataggggcaggttggaagggggacctggttggctggcagaggcgatagtgacatggcgcggccacctcaccaagttgctgacaaccccttatgaacgccaggagggttggcaactcgccgcctcaagatttcaaggcaccctgtacctatccgaggtggagactcctaatgcaagggcccagcggctggcccgaccccccctgctgagggaacttatgtacatgggttacaagttcgagcagtacatgtgcgccgataaacctggatcctctcccgacccttctggcgaggtcaatacaaacgtggccttttgttcagtactcagatcccgactgggcagccaccccctcctattcagcggggaagtggattgcacggaccctcaggctcccagcactcagccaccaacctgttacgtggagctgaaaacaagtaaggagatgcactcaccaggacagtggcggtctttctatcggcataagctgttgaagtggtgggctcaaagtttcctacccggagttcctaacgtggttgccgggttcagaaatccggacggctttgtctcgtcactgaagacttttcccactatgaagatgttcgaatatgtacgaaatgatagggacggatggaatcctagcgtatgtatgaacttttgcgccgcattcctctctttcgcccagagtaccgtggttcaagatgatcctcgccttgtgcacctgttttcttgggagcctggtggacctgtgactgtgtctgtccatcaggacgcaccgtacgctttcctgcccatttggtatgtggaagccatgacccaggacctgccctcccccccaaaaacaccttcacccaaatag

SEQ ID NO: 185766 - DNA, 1191 bp, Artificial Sequence
  Description of Artificial Sequence: Synthetic coding sequence
atggacccccggggcaccaagcggggcgccgagaagaccgaggtggccgagccccggaataaactacccaggcccgcccctagcttacctaccgaccctgccctttacagcggcccgttccccttctaccgccggccgtccgaactgggatgtttctctctggatgcacagaggcagtatcatggcgatgctagagctctccgttattactctccaccccccaccaacggacctgggccgaacttcgatttgcgagacggataccccgaccggtatcagccccgagacgaggaagtccaggaaagactggaccacctgctgtgctggctgctcgagcacagagggaggctcgaagggggccccgggtggctcgccgaggccattgtgacctggcggggtcaccttactaagcttctgaccactccatatgagaggcaggagggttggcaactggccgcttcgaggttccaggggaccctgtacctttcagaagtggaaacccctaacgcacgcgcccagcggttggcacgaccaccactcttaagagagttgatgtacatgggttacaaatttgagcagtatatgtgcgcagataaacccggctcatccccggacccatctggcgaagttaacaccaatgtcgctttttgctcggttctcaggagcaggctcggcagccatccactccttttctccggagaggtagattgcaccgacccgcaggccccctccactcaaccccccacatgctatgtcgaactaaaaacgtcaaaagaaatgcactcccctggccagtggcggtctttttaccgacacaagcttctgaaatggtgggcgcaaagctttttacccggagtgccaaacgtggtagccggctttagaaaccccgacggcttcgtttcctcccttaagacttttccaaccatgaagatgttcgagtatgtgcggaacgatagagacgggtggaacccttcagtttgcatgaacttctgcgctgcctttctatcatttgcacaatcaactgtggtgcaagacgaccccagactggtgcacttgttctcttgggagccaggaggacccgtcaccgtcagcgtgcatcaggacgccccatacgcatttcttccaatttggtatgtggaggcgatgacgcaggacctgccctcgcctccaaaaaccccctctccaaaatag

SEQ ID NO: 185767 - DNA, 1191 bp, Artificial Sequence
  Description of Artificial Sequence: Synthetic coding sequence
atggacccccggggcaccaagcggggcgccgagaagaccgaggtggcggagcccaggaataagctgcctaggcccgcaccttctctacctacagaccccgcattgtactctgggccatttcctttttatagacggccgtcagaactagggtgtttttctctcgatgcacaacggcagtaccatggggacgctagggccttgaggtattattcacctcccccaaccaatggccctgggccaaacttcgatctgagagacggatatcctgaccgctaccagccgcgcgacgaggaagtccaggagagactggatcacctcctgtgctggttgctcgaacacagaggcaggctcgagggaggccctggttggctggccgaggccattgtgacatggcggggacatttaactaagctgctcaccacaccatatgaaaggcaggaggggtggcagctagcggccagcaggttccaagggacactttatctgtcggaagtcgagacacctaacgcaagagcccagagactggccaggccgcccctactgcgcgaattgatgtatatggggtacaaatttgagcagtacatgtgcgcagacaaaccaggctccagcccagacccatcgggggaggtgaacacgaatgtcgccttctgttcagtattgagatctaggttgggcagtcaccctttgctctttagcggagaggtggattgtacagatccccaggcaccttcaactcagcccccgacatgttacgttgaactcaagacctccaaggagatgcagagccccggccagtggcggagcttttataggcacaagcttttgaaatggtgggctcagagctttctgcccggcgttcctaacgttgttgccggctttaggaatccggatggttttgtgtcgagcctgaaaacctttccaacaatgaaaatgttcgaatacgtacggaacgacagagacgggtggaacccctcggtgtgtatgaacttctgcgccgctttcctttcgttcgctcaatcaaccgtggtgcaggatgacccgcgcttagtgcatctgttttcttgggaacccggaggcccagtcaccgtatctgtccatcaggatgcaccctacgcctttctgcccatatggtacgtcgaagccatgacacaagatctgccctctcctcccaaaacaccttctccaaagtag

SEQ ID NO: 185768 - DNA, 1191 bp, Artificial Sequence
  Description of Artificial Sequence: Synthetic coding sequence
atggacccccggggcaccaagcggggcgccgagaagaccgaggtggcagaaccccggaataaactccccaggccagctccctcccttcccacagacccggcactgtacagcgggcccttccctttctacaggaggccctccgaactggggtgctttagcctcgacgcccaaaggcagtatcatggagatgctcgcgctctgcgatactatagcccaccgccaacaaatggacctgggccaaacttcgatctgagagacgggtaccccgatcgctaccagcctcgcgatgaagaagtgcaggagaggttagatcacctgctttgttggctgctggagcataggggccggctggagggcggtcccggatggctggccgaggccattgtgacatggagaggccaccttactaagctcctcaccaccccctatgagcggcaagagggctggcaactggcggcaagcagatttcagggcaccctgtatctgagcgaggtggagactcctaacgcaagggcccagcgattggctcggccaccccttcttagggagctgatgtacatgggctataagtttgaacagtacatgtgcgctgataaacctggttcttctcctgatcccagcggggaggtcaatacgaacgtggccttctgctctgtcttgaggtctcggttgggcagccacccactgctcttctcgggcgaggtggactgtactgatccacaggcccctagtacacagcctccaacatgctacgtggagctgaaaacctcgaaggaaatgcactcaccaggccaatggaggtccttctaccgacacaaactattaaagtggtgggctcagtcatttctccctggggtgcccaatgtcgtagcagggttcaggaacccggatggattcgtgagctcgctgaagacatttcctaccatgaagatgtttgaatatgtcaggaatgatcgggatgggtggaacccgagcgtctgcatgaatttttgcgccgccttcttaagtttcgcacaatccacagtcgtccaggatgaccctcgtcttgttcacctcttctcttgggaaccggggggccctgtaactgtgagcgtacatcaagacgctccttatgcattcctcccaatctggtacgttgaggctatgacccaggacctgccctctccacccaagacaccatctcccaaatag

SEQ ID NO: 185769 - DNA, 1191 bp, Artificial Sequence
  Description of Artificial Sequence: Synthetic coding sequence
atggacccccggggcaccaagcggggcgccgagaagaccgaggtggcagagcccagaaacaaactacccaggcctgcgccatccctgccgacagatcccgccctgtactccggaccctttccattttaccgccgccccagcgagctgggttgcttttccctggacgctcagaggcagtatcatggcgacgcccgagcgttacggtactattcccctcccccaaccaatgggccaggaccgaacttcgacctcagagatggttaccctgacaggtaccagccacgggatgaggaggtacaagagcgcttagaccacctgctgtgctggcttcttgagcaccggggtagactggagggggggcccggttggctggccgaagccatagtgacatggaggggccatcttacaaaactcttaactaccccttatgagcggcaggagggctggcagttggccgccagtcggttccagggaaccctttacctgtcagaagttgaaacccccaacgccagagcccaacgcctcgcccggcctcccctcctgcgggaactaatgtatatgggatacaagtttgagcaatatatgtgcgctgataaacccggttcttcgcctgacccctctggcgaggttaataccaatgtggctttttgttctgtgttgcggtctcgccttggtagccatcctcttttatttagtggggaagtcgactgtaccgacccgcaggcccctagcacgcagcctcctacatgctacgtggagctcaagacctccaaggaaatgcacagccctgggcaatggcggtctttttacagacacaagctattaaagtggtgggcacagagcttcttgcctggcgtaccaaatgtggtggccgggtttagaaaccccgatggctttgtttccagtctgaagacttttcctacgatgaagatgttcgagtacgtgcgcaacgaccgggatgggtggaatccaagcgtgtgcatgaatttttgtgcggcctttttgtcttttgctcagagcacggttgtccaggacgaccctagactcgtacatctttttagttgggaaccgggcgggccagtcaccgtctccgttcatcaggatgccccttacgcctttctgcccatctggtacgtggaggcaatgactcaagatcttccttcacctcctaaaacccccagcccaaagtag

SEQ ID NO: 185770 - DNA, 1191 bp, Artificial Sequence
  Description of Artificial Sequence: Synthetic coding sequence
atggacccccggggcaccaagcggggcgccgagaagaccgaggtggcagaaccgcgcaacaagcttccccggcccgctccctctctgcctacagacccggcgctgtatagcggccctttcccattttacaggaggccatctgagttgggatgcttctctctcgatgcccagcgccagtatcacggggacgctagagccctccggtactactcaccacctccaacaaatggaccggggcccaactttgatttgagggatggctatccagatcgataccagccaagggacgaagaggttcaggagaggctggatcacctgctatgttggcttctcgagcaccgcgggcgcctagaaggggggccaggatggctggctgaggctattgtcacatggagagggcaccttactaaattgctgaccaccccctatgaacgtcaggaggggtggcaactcgcggccagcaggtttcagggaaccctatatttatccgaggtggaaacacccaatgcacgcgcacagcgcttggctcgccccccactcctgagggagctcatgtacatgggctacaaattcgagcagtacatgtgcgcagataagccagggagctccccagacccaagcggagaggtgaacaccaacgttgcattctgctctgtgcttcgcagccgtctcggcagccaccccctgcttttcagcggtgaagtggattgcacagacccccaggcgccaagcactcagcctccaacgtgttatgtggagctgaagaccagcaaagaaatgcactcaccagggcagtggagatcattctacagacacaaactactcaagtggtgggcccagtcatttcttccaggggtgccaaacgtagtcgcgggattcagaaatcccgacgggtttgtgtcttccttaaagacctttcctacgatgaagatgttcgagtatgtccggaatgatcgggatggatggaatcctagcgtatgcatgaatttctgtgctgcgtttctatcttttgcccagtcgacagtcgtccaagacgaccctaggttagtgcacctttttagctgggaacctggcggaccggtaacggtgtccgttcatcaagacgccccgtatgccttcctacctatttggtacgtggaagccatgacccaggacctgccttccccaccgaaaacccccagccccaaatag

SEQ ID NO: 185771 - DNA, 1191 bp, Artificial Sequence
  Description of Artificial Sequence: Synthetic coding sequence
atggacccccggggcaccaagcggggcgccgagaagaccgaggtggccgaaccacgcaacaagttaccaaggcctgctccttcactaccgacagaccccgccctctactctgggccattccccttctatcggaggccttctgaactgggatgcttttctttagacgcccagcggcagtaccacggggatgctagggccctgcgctactacagcccccccccaacgaatggacctggccccaactttgacttgcgcgacggatacccagacaggtaccagccccgtgatgaggaggttcaagagcgcttggaccacctattatgttggctgcttgagcacaggggcaggctcgagggaggcccagggtggttggccgaggccatcgtaacgtggagaggccatcttactaagctactcaccacgccctacgaacgccaagagggctggcagctagctgcttcccgtttccagggaactctttacctgagtgaggtggagacccctaacgccagagcacagcgactggccaggcctcctctcctgcgcgaattgatgtacatggggtacaagttcgaacagtatatgtgtgccgacaagccgggatctagccccgacccgtctggggaagttaacacaaacgtagcgttttgcagcgtgctcaggtctcggttgggctctcacccattgctcttttcgggagaggttgactgtactgacccacaagcaccctctactcagcctccgacctgttacgttgaactcaagacctccaaagagatgcactcacccggccaatggagatctttttacaggcataagctcctgaaatggtgggcccagagctttctgcctggcgtacctaatgtcgtcgctggtttcagaaatccagacgggtttgtcagcagcctcaagacgttccctactatgaagatgttcgagtacgtgcgcaatgaccgagacggctggaatccttcggtgtgcatgaatttttgtgccgcctttctgagcttcgcgcagagcactgtggtgcaggatgacccaagactcgtgcacctgttctcatgggaacccgggggaccagtgaccgtgtccgtccatcaggatgcaccttacgcattcctgcctatctggtatgtggaagccatgacccaggatttgcctagccctcctaaaaccccaagtccaaagtag

SEQ ID NO: 185772 - DNA, 1191 bp, Artificial Sequence
  Description of Artificial Sequence: Synthetic coding sequence
atggacccccggggcaccaagcggggcgccgagaagaccgaggtggcagagcctagaaacaaactacctcgcccagcccccagcttacccacggatccagctctgtactcaggcccattccccttttatcggcggccatcagaactggggtgtttctccttggatgctcaacggcagtaccacggcgacgccagagctctgcggtattatagtccccctccaaccaatggcccagggccgaacttcgacctgcgggatggatacccagatagataccagccaagagacgaagaagtccaggaaagattagatcatttgctttgctggctactcgagcatcgcggtagattggagggcggaccaggttggctggctgaggcgatcgtgacttggagaggacatctgactaaactgctgacaacaccgtatgagagacaggagggatggcaactggctgcttcacgctttcagggtactctgtacctctccgaggtggagacacctaatgccagagctcagagactggcaagacctcctttgttgagggaattaatgtacatggggtacaagttcgaacagtacatgtgtgctgacaaaccaggatcgagccccgatccaagcggcgaagtgaatacaaacgtcgcattctgcagcgtgctgcgttcccgccttgggtcccatcctctgctcttctccggtgaggtagactgcacggacccacaggctcccagtacccagcctcctacctgctacgtcgagctgaagaccagtaaggagatgcactccccggggcaatggcgatctttttatcgccataagctgctgaagtggtgggcccagtcctttttaccaggcgtacctaacgtggtcgctgggttccgcaacccggatggcttcgtttcttcactgaaaacttttcccacaatgaagatgtttgaatacgtgaggaacgacagagacggctggaatccctctgtgtgtatgaatttctgtgccgcctttctcagcttcgcacaatcgaccgtcgttcaggacgaccctcggcttgtccacctgttctcctgggagcccggaggccctgtcacggtgagtgtgcatcaggacgcaccttatgcctttctgcctatctggtacgttgaggccatgactcaggacctcccaagcccacctaaaacaccaagccccaagtag

SEQ ID NO: 185773 - DNA, 1191 bp, Artificial Sequence
  Description of Artificial Sequence: Synthetic coding sequence
atggacccccggggcaccaagcggggcgccgagaagaccgaggtggctgaacccagaaataagctacccaggccggccccctctttgcctactgatcctgcactgtattctggcccatttccgttctatcggcgaccctcagagttggggtgtttcagtcttgatgcccagcgccaataccacggcgacgctcgggcactgcggtactattctcccccgcccaccaatgggcctggcccgaactttgacctgcgggacggatatccggaccggtatcagccgagggacgaggaagtgcaagaacgcttggatcacttgctgtgttggctcttagaacatagggggaggctagaagggggacccggatggttggccgaagccattgttacctggagaggccacctgacgaaacttctgaccacaccatacgagcggcaagagggatggcaactggctgctagccggtttcagggcaccctttacttatcagaggtggagaccccaaatgcccgtgcccagcgccttgcccgacctcctctactgagagaactgatgtacatgggatacaaatttgagcagtatatgtgcgcagacaaacctggtagctctcctgatcccagtggtgaagttaacactaacgtcgcgttttgttcggtgcttcgcagcagactcgggagtcaccccctgctgttctctggagaggtggactgtacagatcctcaggccccctcaacccagcccccaacatgctacgtggagctgaaaacatctaaggaaatgcaaagtcctgggcagtggagaagtttttaccgccataagctcctgaaatggtgggcccagagctttctgccaggcgtgccaaacgtggtggcaggattccgcaaccctgatggattcgtaagttcacttaaaacctttcccactatgaagatgtttgaatacgtaaggaacgaccgcgatggttggaacccaagcgtgtgtatgaatttttgtgccgcgttcttatcatttgcccagtcaaccgttgtgcaggacgacccccgcctcgtgcacttattctcttgggagcctggcgggccagtcaccgtatctgtccaccaagatgcaccgtatgcatttttaccaatctggtacgtcgaggcaatgacccaggatctgccttcgccacccaaaacccccagccctaagtag

SEQ ID NO: 185774 - DNA, 1443 bp, Artificial Sequence
  Description of Artificial Sequence: Synthetic coding sequence
atgaacgccagcgagttccggcggcggggcaaggagatggtggactatatggccaactacatggagggcatcgaaggccgtcaggtctaccccgacgtcgagcctggatacctgaggcccttaattcccgcagctgcaccccaagagcctgataccttcgaggacatcattaacgatgtggaaaaaattattatgcccggtgtaacccactggcactctccttatttcttcgcctattttcccactgctagctcctatccggctatgctggccgatatgctttgtggtgccatcggctgtatcggcttctcttgggctgcctcaccagcctgcacagagctggagaccgtgatgatggactggttaggaaaaatgctggaacttccaaaggccttcctcaacgaaaaagctggagaggggggaggagtgattcaggggtctgcttcagaggccacactggttgccctcttagcagcgaggactaaggtcattcacaggttacaagctgccagccccgagttgacacaggccgccatcatggaaaagctagtcgcttattcttcagaccaggctcatagctccgtggaacgagccggtctcataggaggggtgaagttgaaggctatcccctctgacggaaactttgccatgagggcatccgccctgcaagaggctttggaaagagataaagcagccggtctgatacccttctttatggttgcaactcttggtaccaccacttgttgcagtttcgataacttgttagaggttggcccaatatgcaataaagaggatatttggctgcatgtagatgccgcttatgctggcagcgccttcatctgccctgaatttcgccatcttctgaacggggttgaatttgcagacagtttcaattttaacccgcacaagtggctcctagtgaattttgactgctcagccatgtgggtgaagaagcgtaccgatctgactggtgcctttcgcctggacccaacgtatctgaagcacagtcaccaggactccggtctgatcacagattatcgccactggcagatcccgctgggacgtagatttagatctctgaaaatgtggtttgtgttccggatgtatggagtcaaaggactgcaggcttatatacgcaagcacgtgcagttgtcgcatgaatttgagtccttagttcggcaggatccccggttcgagatctgcgtggaggtcattttaggcctcgtgtgcttcaggctgaaaggcagtaacaaagtcaatgaagctctcctacagaggatcaactccgctaagaagattcatttggttccctgtcatctgcgtgataaattcgtgctccggtttgccatttgtagtagaaccgtcgagtccgcacacgttcagagagcatgggaacacattaaggagttggccgccgacgtcttacgcgcagaacgggagtag

SEQ ID NO: 185775 - DNA, 96 bp, Artificial Sequence
  Description of Artificial Sequence: Synthetic coding sequence
atgaacgccagcgagttccggcggcggggcaaggagatggtggactacatggccaattatatggaggggatcgaaggcagacaggtctacccatag

SEQ ID NO: 185776 - DNA, 51 bp, Artificial Sequence
  Description of Artificial Sequence: Synthetic coding sequence
atgaacgccagcgagttccggcggcggggcaaggagatggtggactactag

SEQ ID NO: 185777 - DNA, 1443 bp, Artificial Sequence
  Description of Artificial Sequence: Synthetic coding sequence
atgaacgccagcgagttccggcggcggggcaaggagatggtggactacatggccaactacatggaggggatcgagggacgccaggtgtacccagacgttgagcctggatacctccgcccactgattccggcagccgctccgcaggaacccgatacttttgaggatatcattaatgacgtcgagaagatcataatgcctggtgtcacccactggcacagcccctacttttttgcatactttcccactgcctccagttatcccgcgatgttggcagatatgctctgtggtgcaatcggctgtatcgggttctcttgggcggcaagccccgcttgcacagagctggagacagtaatgatggattggcttggcaagatgctcgagctgcccaaggctttcctgaacgaaaaagcaggggagggcggcggcgtgattcaggggtcagcatccgaggcgaccctggtggccctgctggctgccaggacaaaggtcattcatagactgcaagccgcatctcccgaactcacccaagccgccattatggagaaactggttgcttacagtagtgaccaggctcacagtagcgtcgagagagcaggtctcattggcggagtgaagttgaaggcaataccatcagatgggaactttgcaatgcgcgctagcgctctgcaggaggcactcgagcgagacaaggccgccggtttgatacctttcttcatggtggccactttgggcactaccacttgctgttcctttgacaatttgctcgaggtgggtcctatctgcaataaggaggatatctggttgcatgtggacgccgcatacgcgggcagcgcctttatctgtcccgagttccgccacttattgaacggagtggagttcgccgatagcttcaatttcaatccccacaaatggcttcttgtcaattttgactgcagtgctatgtgggtgaagaagcggacggacttgacaggagcattccgccttgatcctacgtacctgaagcactcacaccaagattctggcttgatcaccgactacagacattggcagatccccttgggtagaaggtttcgcagcttaaaaatgtggttcgtctttagaatgtacggagtgaaagggctgcaggcctacattaggaaacacgttcagctctcccacgagtttgaatctttggtccgtcaagacccacggtttgaaatttgcgttgaagtgatcctcgggcttgtatgtttcagattgaaggggtccaataaggtgaacgaagctcttctacagaggattaactcagctaagaagatccatctcgtgccctgccatctaagagataagttcgttttaagatttgctatctgctcccggacggttgaaagcgcgcacgtgcaacgcgcttgggaacatatcaaggagctggcagcagacgttttgagagccgagagagagtag

SEQ ID NO: 185778 - DNA, 1017 bp, Artificial Sequence
  Description of Artificial Sequence: Synthetic coding sequence
atgaacgccagcgagttccggcggcggggcaaggagatggtggactatatggcaaactacatggagggaattgagggacgacaggtgtatcctgacgttgagccaggatatctgagacctctgatacctgcggctgcgccccaggagccagacacctttgaagatattatcaatgacgtcgagaaaattatcatgccaggggtcactcattggcattccccatatttcttcgcctactttcccactgcatcgtcctacccggccatgttagccgacatgctctgcggggcaattggctgcatcggcttcagctgggctgcgtcccctgcctgtaccgaacttgagaccgtgatgatggattggctcgggaagatgctggaattgccaaaagctttcctcaacgaaaaagccggcgaaggcggaggggtgattcagggttccgcgtcagaggctacgctcgttgctttactggccgcacgtaccaaggtgattcaccgcctccaggctgcctctccagaactgacccaggcagccatcatggagaagttggtagcatattcttcagaccaggctcatagttccgttgaacgagcaggccttatcggaggtgtcaagctgaaggcgattccctccgacgggaacttcgctatgagggcatccgccctgcaggaggctttggagagagacaaagccgccggccttattccatttttcatggttgcgacgctcggtacaaccacctgttgcagtttcgacaacctgctcgaagtggggccaatatgtaacaaagaagacatctggctgcacgtagatgcagcctacgctggtagcgcctttatctgtccagagtttagacatttgctgaacggcgtggaattcgctgattcattcaatttcaatcctcataaatggctgctcgttaatttcgactgttctgccatgtggagcagacagcctgtccgaatgcttcggctaaagaagacctgcctggtgagcgctgtggtcagaagaagctag

SEQ ID NO: 185779 - DNA, 1209 bp, Artificial Sequence
  Description of Artificial Sequence: Synthetic coding sequence
atgaacgccagcgagttccggcggcggggcaaggagatggtggactacatggcgaactacatggaaggcattgagggacgtcaagtgtacccagatgtcgagcctggatatctgcgccctctcattcctgctgctgccccccaggaaccggatacgtttgaagacataataaatgatgtcgagaaaattatcatgcctggggggagtgcgtccgaagctaccctggtcgccctgcttgctgcacgtactaaagtcatccatcgccttcaggcagcgtcaccagaactgacgcaggccgcaattatggagaagttggtcgcctatagttctgatcaagcacatagttcagtcgagagggcggggcttatcggaggggtgaagctaaaggctattcctagtgatggaaactttgcgatgcgcgctagcgccctacaagaggccctggaacgggacaaggcagctggcctgatcccattcttcatggtggcgactctagggactaccacctgttgcagtttcgacaatctattggaagttggacccatatgtaataaagaggacatttggctgcacgtggatgccgcttatgccgggtccgccttcatttgcccagaattcagacatcttctcaatggcgttgaatttgccgattccttcaattttaaccctcataagtggctcctggtcaatttcgattgcagcgccatgtgggtgaagaagcgcacagacttgaccggagccttccggctggatcccacctacctcaagcactcacatcaggacagtggcttaatcactgactaccggcactggcagatacccctggggaggcgcttccgcagcctgaagatgtggtttgtttttaggatgtacggggtcaaaggacttcaggcttacatccggaagcatgtgcagctcagccatgaatttgaaagcctggtgagacaggacccacgatttgagatatgcgtggaggtgatcctcggactggtctgtttccgcctcaaagggagcaataaagtgaatgaggccctgctgcaaaggatcaactccgcgaaaaaaattcatttagtgccttgtcacctccgcgacaaatttgtattgcggttcgcaatctgttcccgtacagttgaaagcgctcacgtacagcgggcatgggaacacataaaagagctcgccgcagacgtactgcgcgccgaaagggagtag

SEQ ID NO: 185780 - DNA, 1164 bp, Artificial Sequence
  Description of Artificial Sequence: Synthetic coding sequence
atgaacgccagcgagttccggcggcggggcaaggagatggtggactacatggcaaattatatggagggaattgagggaaggcaagtgtaccccgacgtagagcctggctatctgcgccccctaatccctgccgctgcacctcaggaacctgatacattcgaagatattatcaacgacgtcgaaaagataatcatgccaggggtgactcattggcactctccatacttcttcgcatacttccccaccgctagctcttatcccgccatgctagccgacatgctctgtggagcaatcggatgtattggattcagctgggctgcttcacccgcgtgtacagagctggaaacagtaatgatggattggctcgggaaaatgctggaactgccaaaggccttcttgaacgaaaaagccggtgaggggggcggagtcatccagatggtagctacgctgggtacaactacgtgctgctccttcgacaacctgttggaagtgggcccgatatgtaataaagaagacatctggctccacgtggatgcggcctatgctggctccgccttcatctgtcctgaatttcgtcatctcctgaacggcgtggagtttgccgattccttcaattttaatccccacaaatggcttcttgttaactttgattgctcggcaatgtgggtgaaaaagcgtaccgatctcacaggggcattcagactggacccaacttatctcaaacatagccatcaggactccggattgatcacagattaccggcattggcagatccccctaggcaggcgctttcgaagtctgaagatgtggtttgtcttccggatgtatggggtgaaggggctgcaagcctacattcggaagcacgtccaactgtcacatgaattcgagtccttggttcgacaggatcccagatttgagatttgcgtcgaggttattctcgggctggtgtgctttaggctgaaagggtcaaacaaagtgaatgaggccttactgcagagaattaacagcgctaaaaagatacacctggtcccatgtcacctgagggacaaattcgtgctgcgttttgctatctgctctcggaccgtggaaagcgcacatgtccagcgggcctgggaacacattaaggaactcgccgccgacgttctgcgcgcagagcgggaatag

SEQ ID NO: 185781 - DNA, 735 bp, Artificial Sequence
  Description of Artificial Sequence: Synthetic coding sequence
atgcgggaggccgccttcatgtacagcaccgccgtggccatcttcctggttatcctcgtggctgccctacagggcagcgcacctagggaaagccctctcccttatcacatcccgttggatcctgagggctccctggagttatcatggaacgtgagctatacccaggaggccattcatttccagctcctcgtacggagactgaaagcaggcgttctgtttggaatgagcgatcggggagagttagaaaacgcagatctcgtggtgctgtggacagatggcgatacagcttactttgcagatggcaccgtgcatctcgtgtatggcatactggaagagccattcagaagtctggaggccatcaacggctctggccttcagatggggctgcagagagtccagctattgaaacctaacatcccagagccagagctgccatctgacgcttgtacaatggaagtgcaggcccctaatatacagatccctagccaggaaaccacttactggtgttacattaaggagctgcctaaagggttttcccgccatcatatcatcaagtatgagccgatcgtgacgaaagggaatgaggccctagtgcatcatatggaggtgtttcagtgcgcccctgagatggattcagtgccacacttcagtgggccctgcgattctaaaatgaaacccgaccggttgaactactgtcgtcacgtgctggcggcttgggcactgggtgccaagtag

SEQ ID NO: 185782 - DNA, 1854 bp, Artificial Sequence
  Description of Artificial Sequence: Synthetic coding sequence
atgcccgccctgagccggtgggccagcctgcccggccccagcatgcgcgaagctgcgttcatgtatagcacagccgtggccatctttctagttattctcgtcgccgcccttcagggctctgcgccccgggagagccctcttccatatcacattccactggatcccgagggatctctggagctcagttggaatgtctcgtacacccaggaggccatccactttcagctcttagtgcgacggttaaaggctggcgtcctatttggaatgtcagacaggggcgagttggagaatgctgatctcgttgttctttggactgatggagatacagcatactttgccgatgcttggtccgatcagaagggccagatccacctggatccgcagcaagattaccagctgcttcaggtccagcggactccagaggggcttaccttgttgtttaaacggccctttggtacttgcgatccgaaggattatctgatcgaggatggaactgttcatctcgtctatggcattctggaggagccgttcaggagtttggaagcaattaacgggagcggcctgcagatgggcctgcaaagagtccagctgctgaagcccaatatccccgagcccgagctgccgtccgacgcctgcactatggaagtacaagctcctaatattcaaattcccagtcaggagactacatactggtgctatattaaggagctgcctaagggattttctagacaccacatcataaaatacgagcctatcgtaaccaaggggaatgaagcacttgtgcaccatatggaagtgtttcagtgcgcaccggagatggactctgtgccccattttagtgggccctgtgatagtaaaatgaaaccagatcgcctaaattactgcagacacgtccttgccgcctgggctttgggcgctaaggcattttattatcccgaggaggctggtctcgcattcggagggcctggtagtagccggtacctccgattagaggtgcactaccacaatcctctggtcatcgaaggccgaaatgactcctcgggcatccgcctctactatactgccaaactgcgccgatttaacgctgggattatggagctcgggctcgtgtacacaccagtcatggctatcccacctcgcgagaccgcattcattctcaccgggtattgcaccgacaaatgtacacagttggctctacccccgtccggtatccacatctttgcatcccagttgcatacccatcttacaggtcgcaaagtcgtgaccgttctcgtcagagacggacgggagtgggagattgtcaaccaagataatcactatagtccccatttccaggagatacgcatgctgaagaaagtcgtatcagtacacccaggagatgtcttaataactagctgtacatacaacaccgaggatagggagctggctacagtggggggattcggtatactcgaagagatgtgcgtaaactatgttcactattacccacagactcagttggagttatgcaaaagcgccgtagatgccggcttcctgcagaagtattttcatctgattaataggtttaacaatgaagacgtgtgcacctgtcctcaggcatctgtcagtcagcagtttactagcgtgccgtggaactctttcaatagagacgtccttaaagctctctattccttcgcgccgatctctatgcactgcaataagtccagtgccgttaggttccagggcgagtggaacctccagcccctgcccaaagttatttctactcttgaggagcctacgcctcagtgtcccacttctcaaggcagatcccctgcaggaccgacagtcgtatccattggtggcgggaaaggttag

SEQ ID NO: 185783 - DNA, 1341 bp, Artificial Sequence
  Description of Artificial Sequence: Synthetic coding sequence
atgcggaccctgaacaccagcgccatggacggcaccggcctggtggtggagcgcgatttctctgtgagaatcctgaccgcatgttttctgtcactcctcatactctcaacattgttggggaatacactcgtttgtgctgcagttataagatttcgccacttaagatctaaagttactaattttttcgtgatcagcctggccgtcagcgacctcctcgtggctgtattggtcatgccttggaaggctgtggctgagatcgccggtttctggccttttggctctttttgcaacatctgggtggctttcgatattatgtgtagcaccgcctccatccttaatctgtgtgttattagcgtggacagatactgggccatttccagcccattccggtacgagaggaagatgacacctaaggctgctttcatcctaatctcagtggcctggactctatccgtgctgatctcatttatccctgtccaactcagctggcacaaggccaaacctacctcccccagcgacgggaatgccacctcactggccgagacaattgacaattgcgactccagcctgagtagaacctatgccataagctcgtccgtgatctcgttctacatccccgtggccatcatgatagtcacctacacccgcatctatagaatcgcccaaaaacagatccgccgcatcgccgctctggagagagctgctgtccacgcgaagaactgccaaaccaccaccgggaacggaaagccagtggagtgttctcagcccgaatcaagcttcaagatgagctttaaaagggagactaaggttctgaagacgctctcggtcatcatgggcgtgttcgtgtgttgctggcttccctttttcatcctgaactgtatcctgccgttttgcggctcaggcgaaacccaaccattttgtatcgactccaacacgttcgacgtctttgtgtggttcggatgggccaattcatctctcaatcctatcatctatgcgttcaacgcggacttcaggaaagctttctcaactctccttggttgttaccgcctttgtcctgcaacaaataacgctatcgaaacggtcagcattaataacaatggcgccgccatgttttcatctcatcatgaacccagaggcagtatctctaaagagtgcaatctggtttatctgattcctcatgctgtgggaagcagtgaggatctgaagaaggaggaggccgcaggaattgcacgtcccctggaaaagctgtcaccagctctctctgttattcttgattacgacacagacgtgtcgctggaaaagatccagccaatcacacagaacggacagcacccgacttag

SEQ ID NO: 185784 - DNA, 1341 bp, Artificial Sequence
  Description of Artificial Sequence: Synthetic coding sequence
atgcggaccctgaacaccagcgccatggacggcaccggcctggtggtggagcgggacttcagcgtcaggatcctgacagcttgttttctctcgttgttaatcctgtctacccttctcggcaacactctggtctgcgcagctgtcatacggtttagacatctgcggtccaaagtcaccaattttttcgtgatcagccttgccgtcagcgatcttctggtggcagttctggtgatgccttggaaggcagtggctgaaatcgcaggattctggccatttggtagcttctgtaacatttgggtggcgttcgatataatgtgttccacagcttctatactcaatctgtgcgtgatctctgtcgatcgttattgggccatcagtagtccattcagatatgaacggaagatgactcctaaagccgcattcattttaatcagcgtggcctggactctgtctgtgctcatttcttttattcctgtccaactatcctggcacaaagccaaacctacaagcccctccgatggcaatgctactagcttggctgagactatcgataattgtgattcatctctgtctcgcacctacgccatcagttcaagcgtcatcagtttctatatccccgtagccatcatgattgtgacttatacccggatttacaggattgcacagaagcagattaggaggattgccgctctcgaacgtgccgctgtgcacgccaagaattgtcaaacaactaccggcaacggcaagccagtagaatgctcacagcccgagagctccttcaagatgtccttcaagagagagacaaaagtattgaagacactaagcgtcattatgggggtctttgtgtgctgttggctccccttctttattctcaattgtatcttgccattctgtgggagcggggagacccagccattttgcattgatagtaacacttttgacgtattcgtttggttcggctgggctaatagcagcttgaatccaatcatatacgccttcaatgccgacttccgcaaagcgttctccacattgttgggctgttatcgcctatgccctgccacaaacaacgcgattgaaacagtcagcatcaataataacggcgccgctatgtttagctctcatcatgagccccgaggctctatcagtaaggaatgcaatctcgtgtacctgatcccccacgccgtgggcagctcggaagatctgaagaaagaggaggctgccggcattgctcgtccacttgaaaagctcagcccagctttatcagtcatactagactacgacactgatgtgtcgctggaaaaaattcaacctattactcaaaacggacaacatcctacctag

SEQ ID NO: 185785 - DNA, 1245 bp, Artificial Sequence
  Description of Artificial Sequence: Synthetic coding sequence
atggaccccctgaacctgagctggtacgacgacgacctggagcggcagaattggagccgaccttttaacggcagcgacggtaaggctgaccggccacactacaactattacgcgacgctcctgactctgctgatcgccgtcatcgtcttcggtaacgtgctcgtgtgtatggccgtgtctagggagaaggccctgcagaccactactaactatctcattgtgagccttgccgtggcggacctactggtggctacgttggtcatgccctgggtagtttatcttgaggtcgttggcgaatggaaatttagccggattcattgtgatatctttgtgacgctggatgtgatgatgtgtacagcgagtattctgaatttgtgcgccatcagtattgatagatacaccgctgtggctatgccaatgctgtataacacccggtactcctcaaaaagacgggtgaccgtgatgataagcatagtgtgggtcctcagctttaccatctcctgccctttgctgttcggccttaataatgcggaccaaaatgagtgtatcattgccaaccctgcttttgtggtttacagtagtattgtgagtttttacgttccgttcatagtgactctgttggtatacatcaaaatctatattgtgctgagaaggaggcgtaaaagggtcaacaccaagcgttcttcacgtgcttttcgtgcacatttgcgggcccccctgaaagaggccgcccggcgagctcaagaactcgaaatggagatgctatccagtacctcgcccccagaaaggaccaggtattcccccattcctccctcccatcatcagctgacactgccggacccttcccaccatgggttacattccactcccgactcacccgcaaaacccgaaaagaacggacatgctaaagaccaccctaaaatcgccaaaatcttcgagatccagacgatgcccaacggcaaaacacgaacctccttgaagactatgagccgacgcaagctgtcccagcagaaggagaaaaaagccacccagatgttggctattgtgctcggcgtattcataatctgttggttgccattcttcattactcatattctcaacatccactgcgattgcaacatcccccctgtactgtatagtgcctttacttggcttggatacgtgaactcagcagtaaatccaattatttacaccacttttaacatcgagttcagaaaagcctttctgaagattcttcactgttag

SEQ ID NO: 185786 - DNA, 1338 bp, Artificial Sequence
  Description of Artificial Sequence: Synthetic coding sequence
atggaccccctgaacctgagctggtacgacgacgacctggagcggcaaaactggagccgtccgtttaatggcagtgacggtaaggcggataggccccactacaactactatgctacgctacttacactgttaatcgcagtcatagtgtttgggaatgttctcgtttgtatggccgtgtcacgtgagaaggcattacagacaacaacgaactacctcatcgtatctctggctgtcgccgacctccttgtcgcgacactcgtcatgccctgggtcgtgtaccttgaggtcgtgggggagtggaaattttctcgcattcactgtgatatattcgtcaccctagatgttatgatgtgtacagcatccattctcaatctgtgcgccatctcaatcgaccgctacactgcagttgccatgcctatgttatacaacactcgttactcttctaaacgaagggttacagtaatgattagcatcgtgtgggtgttgtccttcacaatttcctgcccccttctttttggactgaataatgcagatcaaaacgaatgcatcatagccaacccagcttttgtggtgtatagcagcatcgtgtctttctatgtgccatttattgttactttactggtatacattaagatatatatagtcctgaggagaaggcgcaagcgtgtgaatacaaaaaggtcttcccgcgcattccgggcacacctgcgagctcccctgaaaggaaactgcacgcacccagaagatatgaaactgtgtactgtcatcatgaaaagcaatggcagtttccctgttaacaggcggagggtggtgcaggaggctgcacgccgcgcccaggaactggagatggagatgctctcatctacatctcctccagagcgcactcgctactcgcctatccctccatctcaccaccagcttaccctccccgaccctagtcatcacggtttgcattccacccccgatagcccagcaaagccagaaaagaatggacacgcaaaggatcatccaaagatagcaaagatatttgaaatacagacgatgcccaacggcaaaacgcggaccagtctcaagacaatgtctaggcgaaagctgtcccagcagaaggagaaaaaagctacacagatgctggccatcgtgttaggtgtctttataatttgctggctgcctttttttattacccacatcctcaacatccactgcgattgtaatatccctcccgtcctgtattccgcttttacgtggttaggctacgtgaactcagccgtcaatcccatcatttataccactttcaacattgagttcaggaaggcatttctcaaaattttgcactgctag

SEQ ID NO: 185787 - DNA, 1332 bp, Artificial Sequence
  Description of Artificial Sequence: Synthetic coding sequence
atggaccccctgaacctgagctggtacgacgacgacctggagcggcagaactggtctcgacctttcaacggctccgatggcaaggcggacagaccacactacaattattacgctaccctgctcactcttctcatcgctgtgatcgtctttggcaacgtgttggtgtgtatggctgtgtccagggaaaaggcgctgcagactacgactaattatttgatcgtaagtttggccgtggcggatctgctcgtggctactctcgtgatgccttgggtggtctatctcgaggtggttggcgagtggaagttcagccgcatccactgcgacatttttgtgacattagatgtcatgatgtgcacagcttccattctgaacctttgcgccatttcaattgaccggtacactgccgtggcaatgccaatgttgtataacactcggtatagctctaaacgccgggtgactgttatgatctcaattgtgtgggtgctgagttttactattagctgcccgctgctcttcgggctgaacaacgctgatcagaatgagtgcattattgccaacccagcattcgtcgtgtactccagcatcgtgagcttctatgtgccctttatcgtgaccctgctggtatacatcaagatctatattgtccttcgccgtcgccggaagcgcgtaaataccaagcgatcctcacgagcatttagggctcacctgcgtgctcctctcaaaggaaactgcacacaccccgaggatatgaagctgtgtactgtgattatgaagtctaatggctccttcccggtgaatcggagaagagtggaggctgccaggagggcccaagagctggagatggagatgttaagctcaaccagcccacctgagcggaccaggtacagccccatccccccctcccaccaccagctgactcttcctgaccccagtcatcatggcctccattctaccccagattcacctgctaagcccgaaaaaaatggccatgcgaaagatcatcctaagatcgcaaagattttcgagatccagactatgcctaatggaaaaacccgaaccagcttaaaaaccatgtctcggcggaaactgagccaacagaaagaaaagaaggcgacccaaatgctggcaatcgtgctgggggtgtttatcatctgctggttgcccttttttattacacacatcctgaacatccattgtgattgcaatatcccacccgtgctgtatagtgctttcacatggctgggatatgtgaacagcgctgtgaaccccattatctacactacctttaacattgaattcagaaaagccttcctgaagattcttcactgctag

SEQ ID NO: 185788 - DNA, 1338 bp, Artificial Sequence
  Description of Artificial Sequence: Synthetic coding sequence
atggaccccctgaacctgagctggtacgacgacgacctggagcggcagaattggagccgcccatttaacggcagtgatgggaaggccgatcgaccgcactataactactacgcaacactgttgacactgcttatcgccgtgatcgtgttcggaaacgttttggtgtgtatggccgtgtcccgggagaaggcattgcagacaaccaccaactacttgatcgtgtcgttagcagtcgctgacttgctggtcgccacgctggttatgccttgggtggtgtacctcgaagtagtcggggagtggaagtttagcaggattcactgcgacatattcgtaaccctggacgttatgatgtgcactgcatctattttgaatttgtgcgctatcagtatcgaccgctatactgccgttgcgatgccgatgctttacaatactaggtattctagtaagagacgcgtgacagtgatgatctccatcgtgtgggtactaagcttcaccatcagctgtccacttctttttggcctcaacaatgcagaccagaatgagtgcatcattgccaatcccgccttcgttgtttattctagcatcgtgtcattctacgtgccattcatcgtgacccttctggtgtatataaagatttatattgtgctgcgccgacgacgcaaacgggtgaacactaaaagatcatctcgggccttcagggcccacctgcgggcaccccttaagggaaactgcacccaccccgaagacatgaaactttgcactgtgatcatgaaatctaatggttcgttcccagtgaacaggcgtcgggtcgtgcaagaggccgccaggcgcgcacaggagcttgaaatggagatgctgtcttccaccagcccccctgaaagaactcgctattcaccaatcccaccttctcatcaccagcttactctaccggatccttcacaccatggacttcactccaccccagacagccccgcgaagcccgagaagaatggacacgcaaaggatcatcctaagatcgctaagatcttcgagattcagactatgccaaacggaaagacccggactagcctgaagactatgtctcggcgtaaattatctcagcaaaaagagaagaaagcaacccaaatgctggctatcgttctcggagtttttatcatctgttggctccctttctttatcactcacatcctgaatattcactgtgactgcaacattcctcctgtgctgtacagtgcattcacttggttaggttacgtgaactcggccgttaatcctatcatctacacaactttcaatatcgagttccggaaagctttcctgaaaattttacattgctag

SEQ ID NO: 185789 - DNA, 24 bp, Artificial Sequence
  Description of Artificial Sequence: Synthetic coding sequence
atggaccccctgaacctgagctag

SEQ ID NO: 185790 - DNA, 1332 bp, Artificial Sequence
  Description of Artificial Sequence: Synthetic coding sequence
atggaccccctgaacctgagctggtacgacgacgacctggagcggcagaactggtcacgccctttcaatggatctgacggtaaagcggataggcctcattataattactatgccaccttactgaccctcctgatagctgtgatcgtctttggaaacgttttggtgtgcatggcagtgtctagggaaaaagcccttcagacaactacaaactatctcatagtctctcttgctgtggctgacctgctggtggctactctcgtgatgccctgggtggtgtatcttgaggttgttggggagtggaagtttagccggattcattgcgacattttcgtgacactggacgtcatgatgtgtacagcatccattcttaatctttgtgcaatatcaattgatcgctacactgcagtagctatgcccatgctctacaacacacgatattcatccaagcggcgcgtgaccgtaatgatcagcattgtgtgggtcctgtccttcacaatatcttgcccgctgctttttgggctgaataacgccgatcagaacgagtgtatcattgctaatccagcctttgtggtttactcgtcaattgtgtccttttacgtcccattcatagtcactctcctggtttacatcaagatctatattgtgcttagaagaagacgaaagcgcgtgaatactaaaagatccagtcgggccttccgggctcacttgagggctcctctcaaaggtaactgtacccacccggaggatatgaagctctgcactgttatcatgaagtcgaacgggtcatttcctgttaaccgccggagggtagaagccgcaagacgggctcaagaactggaaatggagatgctgtcatctacatcacctcccgagcggactagatactcccctattccaccaagccatcatcagctgactttgcctgatccttcccatcatgggctacattccacgcccgacagtccagcaaagcctgaaaagaacggtcacgccaaagaccatcctaaaatcgcgaaaatcttcgagatccaaaccatgcctaacggcaagactcgaacaagtctgaaaaccatgtctaggaggaaactgagtcagcagaaggagaagaaggccacccagatgttagcaatagtgcttggagtgtttattatttgttggttgccatttttcattacacacatcttgaatatccactgcgactgtaacatcccgcctgttctgtactctgcttttacctggctcggatacgttaattctgccgtgaatcccatcatctatacaacttttaatatcgagttccgcaaggctttcctgaagatccttcattgttag

SEQ ID NO: 185791 - DNA, 534 bp, Artificial Sequence
  Description of Artificial Sequence: Synthetic coding sequence
atggaccccctgaacctgagctggtacgacgacgacctggagcggcagaactggagcagaccattcaacggctctgatggtaaggccgacaggccacactataactactacgctacgctgcttactttgctcatagcggttatcgtttttggaaacgtactggtatgcatggccgtgtcccgtgagaaggcattgcagaccaccacaaattacttgatcgtttctttggctgtggcggacctgctcgtggcgacattggttatgccttgggttgtgtatctggaggtcgtaggggaatggaagttttctaggatccattgcgacatcttcgtgactctagatgtcatgatgtgtactgcatccatcctgaacctatgcgcaatctctatagaccgctatacagccgtggctatgccaatgctttataacactagatactcatctaaacgaagggtcaccgtgatgattagcatcgtgtgggtgttgagttttacaattagttgcccacttctctttggactgaacaacgcctag

SEQ ID NO: 185792 - DNA, 1329 bp, Artificial Sequence
  Description of Artificial Sequence: Synthetic coding sequence
atggaccccctgaacctgagctggtacgacgacgacctggagcggcaaaactggtctagaccattcaatggaagcgatgggaaagccgacaggccccactacaactattatgcaacattgctgactcttctcattgccgttatcgtgttcgggaatgttctggtctgcatggccgtgtcaagggagaaggcactgcaaaccacaacgaactacctgattgtcagtctggcggtagccgatctacttgtcgccaccctcgtgatgccctgggtggtgtatctcgaagttggggaatggaaattctcgaggatccattgtgatatctttgttacactcgacgttatgatgtgcactgctagcatcttaaacctatgtgcgatttccattgatcgctacacagctgtggccatgcctatgttgtacaatacgagatattccagtaaacgacgcgtgactgtaatgataagcatcgtgtgggtgctgagtttcacgattagttgcccactcctgtttggccttaataacgcggaccaaaacgagtgcatcatagctaaccccgcctttgttgtctactctagcatagtctccttttatgtgccattcatcgtgactctcctagtttacattaagatatacattgtcctacggcgtcgtcgaaagcgggtcaataccaaaagaagttctcgggcctttcgcgcacatttaagagccccgttgaaaggcaactgtacccaccctgaggacatgaagctctgcaccgtcattatgaaatccaatggatcattccccgtgaatcggcgcagagtggaggccgcccggcgggctcaagagctcgagatggagatgttgtcctccacctctcctcccgaacgaaccagatattcccctattcctccttcccatcaccagctgactctgcccgacccttcacatcacggtcttcactccacaccagattcacccgctaagcctgagaagaatgggcacgccaaggatcacccaaaaattgctaagatcttcgaaatccagaccatgccaaatgggaaaaccagaacgtccctgaagacaatgtctcgcaggaagttgtcgcagcagaaggagaagaaggcaacgcagatgctagccatagtgctgggggtttttatcatatgttggcttccattttttattactcacatccttaacatccactgcgattgtaacatccctcctgtgctgtatagcgctttcacctggctgggatacgtcaactccgcagttaacccaataatctatactaccttcaatatagaatttagaaaagcctttctgaagatacttcattgctag

SEQ ID NO: 185793 - DNA, 1029 bp, Artificial Sequence
  Description of Artificial Sequence: Synthetic coding sequence
atggccagcctgagccagctgagcggccacctgaactacacctgcggggcggaaaactctacaggagcctcccaagcacggccacacgcctactatgccctgagttattgtgcgcttatcctggcgattgtgttcggaaacggactcgtctgcatggctgtgctcaaggagcgagcgctgcagacaacaacaaactacttagtcgtgtcattagccgtggccgacctgctggtggcaactttagtcatgccctgggtggtctatctggaagtgactggtggggtgtggaactttagccgaatttgctgtgatgtgttcgttacgctggacgtgatgatgtgtacagcgtctatccttaacctatgtgcgatttcaattgacaggtataccgccgtggttatgcccgtgcattaccaacacgggaccggccagagctcctgccgccgcgtggccctcatgatcacggccgtatgggtcctggcctttgcagtttcctgtcctcttctattcggtttcaacaccacgggagaccctactgtgtgcagtatatcaaatcccgactttgtgatttacagttctgtagtctctttttacctgcctttcggcgtaactgttctggtttacgcaaggatatacgtggttctgaagcagcgcagacgtaaacgaatactcactcggcagaactctcagtgcaacagcgtgcggccagggtttccccagcaaaccctgagcccagatcctgcacacctggagctcaagaggtattattcgatctgtcaggacaccgccctgggagggcctggtttccaggagaggggcggggaactaaaacgagaggagaaaacacgaaattctttgtctgcaactagtggagaggaaggcaaccctaatggcggtcactgtgcctgggggctgcactgtttactggcagctctgctgctggatccttgttctcagtaccctttgcccgacatgccacgcgtccccagagctctgcagtgccacgatatggctgggctccgcgagtag

SEQ ID NO: 185794 - DNA, 1104 bp, Artificial Sequence
  Description of Artificial Sequence: Synthetic coding sequence
atggccagcctgagccagctgagcggccacctgaactacacctgcggagctgagaacagcaccggtgcttcacaggcccggccacacgcctattatgccctctcctactgcgcactcatcttagccattgtcttcggcaacggactggtgtgtatggccgtcttaaaggaacgggccttgcaaacgacaaccaactacctggtagtaagcctggcggttgccgatctgctggtggcgacactggtgatgccatgggtcgtgtatttggaggtcacagggggtgtgtggaacttctctaggatctgttgtgatgtatttgtgactctagatgtaatgatgtgcaccgcatcgattttgaatctgtgcgcaatcagcatcgaccgctacaccgctgtggtgatgcccgtgcattatcaacatggaaccgggcagtcctcttgccgaagggtggctcttatgatcacagccgtgtgggtcttagccttcgccgtgtcctgcccactcttgttcggttttaacaccacgggcgatccaactgtgtgctccatctccaaccccgactttgtgatttattcatccgttgtctccttttacctgccattcggggttaccgttttggtatacgctcgaatttacgtcgtcctgaaacagcgcagaagaaaacgcatccttacaagacagaatagtcagtgcaattccgtgcgacccggctttccccagcagactctcagccccgaccccgcgcacctggaattgaagcgctactacagcatatgccaggacaccgctctgggcggcccaggtttccaggagaggggaggcgagctgaaaagagaggagaagacacgcaatagtctgatgcccctgagggaaaagaaggcaacacagatggtcgcaattgtgctgggtgcttttattgtctgctggttacctttttttctgacacatgtgttaaatactcattgccagacctgccatgtgtcgccagaactctactccgcaactacctggctcggctacgtgaacagcgcacttaatccagtgatctacacgacattcaacatcgaatttcgaaaggcatttctcaagattcttagctgctag

SEQ ID NO: 185795 - DNA, 1203 bp, Artificial Sequence
  Description of Artificial Sequence: Synthetic coding sequence
atggccagcctgagccagctgagcggccacctgaactacacctgcggcgctgaaaatagcactggcgcctctcaggcccgaccccacgcgtactacgccctgtcttactgcgccctgattctggccatcgtgttcggtaatggcctggtctgtatggcggtgctgaaggaacgtgctctccagaccactacaaattacttagtggtgtctctggctgtggccgacctcctcgttgctacactagtcatgccgtgggtggtctacctggaggtgactggcggcgtttggaacttttcccgtatatgctgcgatgtgttcgtgactctggacgttatgatgtgcacagcaagcatccttaatttatgtgctatcagtattgatcgctacactgcagtggtcatgcctgtccattatcaacatgggactggacaaagttcatgcagacgtgttgccctgatgatcaccgctgtgtgggtcctggcttttgctgtgtcatgccctctcctttttggattcaacactacaggggacccaacggtatgctcgatttctaaccccgatttcgtgatttatagcagcgtggtgtcattctatttaccattcggggtcacggtactggtatatgcacggatttacgtcgttctgaaacagcgtagaaggaagcggattctgacccgccagaacagtcaatgcaatagtgtgcgacctggattcccccaacagacattgtcacccgatcccgctcaccttgagctaaaaaggtattactcgatatgccaagacacagcccttggcggcccaggcttccaggaacgggggggcgagttgaaacgggaagagaagactagaaacagtctttctcccacaatcgcaccaaagctgtcattggaagtgcgcaaactatcaaacggacgcttgagcacatcacttaagctggggccgcttcaacctcgcggtgtccccttacgcgagaagaaagccacgcagatggtcgctattgtgctcggagcttttatcgtgtgctggctacccttctttcttacccacgtgcttaacacacactgtcagacctgtcatgtgtctcccgaactatactcggccaccacgtggctgggatatgtgaattccgccctgaaccccgttatttacacaacttttaacatcgagtttcgcaaggctttcctaaaaattctcagctgttag

SEQ ID NO: 185796 - DNA, 1203 bp, Artificial Sequence
  Description of Artificial Sequence: Synthetic coding sequence
atggccagcctgagccagctgagcggccacctgaactacacctgcggagccgaaaatagtactggagccagtcaggcccggccccatgcatactatgcgttgtcatattgcgccctcatcctggccattgtgtttggaaacgggctagtttgcatggccgtgctgaaggagagggccctccaaacaactaccaattacctcgttgtgagcctagcggtggcggacttactcgtcgcaaccctggtgatgccctgggtggtctacctggaggtcacaggtggcgtctggaacttctctaggatttgctgtgacgtgtttgtaacactggacgtcatgatgtgcaccgcatccattctgaacctgtgcgcgatctcaatagaccgatacacagccgtcgtcatgcccgtgcattaccagcatggaactggacagtcttcctgcagaagagttgccttaatgatcacagccgtgtgggtcctggcctttgctgtcagctgtccacttctgttcgggttcaatacaacaggtgatcccactgtctgcagcatatctaatccagatttcgttatctatagcagcgtagtgagcttttatctgcctttcggcgtcaccgtgctcgtttatgcacgaatctacgtggttctgaagcagagaagacgaaagcgaattctcacgcggcaaaattcccagtgtaactccgtcaggcccgggttcccacagcagacgctatctcctgatcctgcccacttggagttgaagcggtattactctatctgtcaggacaccgctcttggagggcctggatttcaggagaggggaggagagctgaagagagaggagaagacacgcaactccctaagccctaccattgccccaaagctgagcctcgaagtcaggaaattgagcaacgggcgcctaagtaccagcctgaaattaggccccctgcaacctagaggagtgccactgcgagaaaaaaaggccactcagatggtcgctatagtgttgggagccttcattgtctgctggctgccattttttttgacacacgtgctgaacactcactgtcagacttgccacgtgtcaccagaactgtattccgctactacttggctcggctatgtcaactccgccttgaaccctgtcatctacactactttcaatatcgaattccggaaagctttcctcaagatactctcctgttag

SEQ ID NO: 185797 - DNA, 1203 bp, Artificial Sequence
  Description of Artificial Sequence: Synthetic coding sequence
atggccagcctgagccagctgagcggccacctgaactacacctgcggggccgagaacagcacaggtgccagccaagccagacctcacgcttattacgccctatcctattgcgcactcattctagccatcgtgtttgggaacggactggtgtgtatggctgtgcttaaggagcgcgccctccaaaccactacgaactacctcgtagtgagcttggctgtcgctgatctgctggtggccaccctcgttatgccttgggtggtctacctggaagtcacgggcggcgtttggaatttttcacggatttgctgtgacgtctttgtcacccttgacgtgatgatgtgtaccgcgtcaatcctcaacctttgcgctatttccattgatcgatacacagcagttgtcatgccagtgcactatcagcacggaaccgggcaaagctcgtgcaggagggtggcactgatgatcactgcagtgtgggttctggcatttgccgtgtcatgtccactcctcttcgggttcaatacaactggagacccgactgtttgctctatctccaaccctgactttgtcatatatagctccgtcgtgtcgttttacctgccttttggggtaactgtgctggtgtacgcaaggatctatgtggtgctaaagcagcggcgcaggaaacggattctcacgagacagaatagtcaatgtaacagtgtgcggcccggattcccgcaacagacacttagccctgaccctgcccacttggagctgaagagatactatagtatctgccaagatactgccctcggtggtccaggattccaagagcgggggggagagctaaaacgcgaggaaaaaacgcggaactcacttagcccaaccatagctcctaaactatcactggaagtgcgcaaactctcgaatggcagacttagtaccagtttgaagctggggcccctgcaaccacggggcgttccattgcgcgagaagaaagccacgcagatggtcgcaattgtgctgggcgctttcatcgtttgttggctgcctttcttcctgacccacgttctcaacacacactgtcaaacgtgccatgtctctccggaactatactccgccacaacctggcttggctatgtgaattccgcccttaacccggtaatttacactacattcaacatcgaatttagaaaggcgtttcttaagatcttaagttgctag

SEQ ID NO: 185798 - DNA, 1260 bp, Artificial Sequence
  Description of Artificial Sequence: Synthetic coding sequence
atgggcaaccggagcaccgccgacgccgacggcctgctggccggccgcgggcctgcagcaggcgcatcagctggcgccagtgccgggctggcgggccagggagcagcagctctggttggaggagtactcctgatcggtgctgtcctggccggcaacagcttggtgtgcgtctcagttgccaccgaaagggcattgcagacccctactaacagcttcatcgtctccctggcagcggccgacctgctgctagctctgctggtgcttccactgtttgtatattctgaagttcagggaggggcgtggcttctgagcccacgcctctgtgacgccctgatggccatggacgtcatgctctgcactgcttctatttttaatctttgcgccatctccgtggacagattcgtcgccgttgctgtccccctaaggtataaccgccagggcgggagcagaaggcagctactcctcatcggagcaacctggttgctgagcgcggcagttgcagccccagtcctttgtggcctcaatgatgtgcgcggacgcgatcctgccgtgtgtagactggaggaccgggactatgtggtttactctagtgtgtgtagcttctttctaccatgccctctaatgctgttgctctactgggctacattccgcggtctacaacgatgggaggtggcccgcagagccaagctccatggtagagcaccccgacgaccttctggcccgggtcctccctcccctacacctcctgccccccggctgcctcaagacccgtgtgggcctgactgtgctccccctgcccccggattaccaagaggcccatgcgggcccgactgtgcacccgctgcgcctagtctgccccaggatccttgtggtccagactgtgctcctcctgcccccgggctgccacctgatccctgtggatccaactgcgccccccccgacgccgtgagagcagctgccctgccaccgcagacaccaccacagactcgaagacgtcggagagccaaaatcactggcagggagcgcaaagctatgagagttttgcccgttgtggtaggagccttcctcctttgctggacgcccttcttcgtcgtgcacattacccaggcattgtgtcctgcttgcagcgtccccccacgcctggtttcagccgttacctggctgggatacgtgaactccgctctgaaccccgttatatacactgtcttcaatgctgaatttagaaacgtattccgaaaagctctgcgagcctgttgctag

SEQ ID NO: 185799 - DNA, 1434 bp, Artificial Sequence
  Description of Artificial Sequence: Synthetic coding sequence
atgctgccccccggcagcaacggcaccgcctaccccggccagttcgccttgtatcaacagctcgctcagggaaacgccgtcggggggtctgcaggagctcctccactgggcccgagccaagtggtgaccgcatgtctgctgaccctgctgatcatatggactctgctgggaaacgttcttgtgtgtgcagctatcgtgaggtcaaggcatttgcgagctaacatgacgaacgtattcattgtgtctctggcagtaagcgacctgtttgtggccctcctcgtgatgccttggaaggcagttgcggaagttgccggctactggccatttggcgcgttctgtgatgtttgggtcgcatttgatatcatgtgttcaactgcctccattctgaacctttgcgtgattagcgtggaccgttattgggctatcagccggcccttcagatataagcgcaagatgactcagagaatggccctggtaatggtgggactggcatggaccctatccatcctaatttcattcattccagtacaacttaactggcacagagatcaggctgcctcgtggggcggtctcgacctacctaacaacctcgccaactggacgccctgggaggaagatttctgggaaccggatgtaaacgcagagaactgcgacagcagcctgaaccggacatatgcaatttcctcctcactcattagcttctatatccctgtggccatcatgatagtgacgtacacaagaatttaccggatcgcccaggtgcagattcgacgcatttccagcctagagcgtgccgccgagcatgcacaaagctgtaggtcttccgccgcatgcgcccctgataccagcctacgagcatctatcaagaaggagacaaaggttttgaagactctgagcgttatcatgggagtgtttgtctgttgctggctgccctttttcattcttaattgtatggttccattctgctccggacatccagaagggcccccggccggttttccctgcgtcagtgagactacatttgatgtctttgtctggtttgggtgggctaatagctctctgaatcccgtgatctatgccttcaacgccgatttccaaaaggtcttcgcacaattgctggggtgcagccacttttgttctcgcacaccggttgaaacagttaatatatcaaacgagctgatttcttataaccaggatatcgtttttcacaaggagattgctgctgcctacatccacatgatgccgaacgccgtgactcccggtaatcgcgaggtggacaatgatgaagaggaagggcctttcgataggatgtttcaaatttatcagacttccccagacggggacccagttgcggagagtgtttgggaactcgactgtgaaggagaaatctctttggacaaaatcacaccattcacccccaacgggtttcactag

SEQ ID NO: 185800 - DNA, 438 bp, Artificial Sequence
  Description of Artificial Sequence: Synthetic coding sequence
atggaccccgaggagcaggagctgctgaacgactaccggtaccggagctactcttcagttatcgagaaggccctgcgtaatttcgagtccagcagcgagtgggctgacctaatctcgtccctgggaaagctcaataaggcgctccagtccaacctgcgctactcacttctgcctaggagactgctgatcagcaagagactcgcccagtgtctgcatccagctctgccgtcgggcgtacacctgaaggcgctggagacgtatgagataatctttaagatcgttggaaccaagtggctcgccaaggaccttttcttgtacagttgtggactgttccctctgctagcccacgccgctgtatccgtgagacccgtattactcacgctgtacgagaaatattttctaccacttcagaagcttctcctgccctctctgcaatag

SEQ ID NO: 185801 - DNA, 6897 bp, Artificial Sequence
  Description of Artificial Sequence: Synthetic coding sequence
atggaccccgaggagcaggagctgctgaacgactaccggtaccggtcatacagctctgttatcgaaaaagccctacggaattttgaaagctcctctgaatgggcagacctgatcagtagtcttggcaagctgaacaaggcgctccagtcgaatctgcgctactctcttcttcctcgcaggcttctgattagcaagcgattagcccaatgccttcatccagccctaccatcgggcgttcacctgaaagcccttgagacctacgagatcattttcaaaattgtgggaacaaagtggcttgccaaagacttgtttttgtactcttgtggcttgtttccactgctggcgcacgccgcagtgtctgtcagaccggttctgctgaccctgtacgaaaagtactttctgccccttcagaaactcttactgccaagcctgcaggcctttattgttggtctcctgccagggttagaagagggctcggaaatctcggatcggacagacgcactcctgctacggctaagtttggtagtagggaaggaggtattctacaccgcgctgtgggggtctgtactcgcatcgccgtccatcaggttgccggcatcagtctttgtggtaggacatattaacagagatgctcctgggagggaacagaagtatatgctaggtaccaaccatcagctgacagtgaagagtctccgggcaagtctgctggactccaacgtgctagtgcagcgcaataacctggaaatcgtcctgttcttctttcccttttatacatgtcttgattcaaatgagagggcaatccctttgctgagatcagacatcgtccgaatcctgagtgctgctacccaaactttgctgcggcgggacatgtccctgaatcgaagactgtatgcctggctgctcggctcagacattaagggcaacaccgtcgtgccggagtccgaaatcagcaatagctacgaggaccaaagctcttactttttcgagaagtattcgaaagatctccttgtcgagggactcgcggagattttgcatcagaagttcatcgacgctgacgtggaggagcgtcaccacgcatacttgaagcccttccgcgtgttgataagtcttctggataaacccgaaatcggacctcaggtcgtaggcaatttgtttcttgaagtgattagggcattttactcttattgccgggatgctttaggctcggacctcaaactgtcctatacacagtctggcaacagtcttatatcggcaatcaaggagaatcggaatgcatccgaaatcgtaaaaacagtgaatcttctcatcacaagcctgtcaactgattttctgtgggactatatgactcggtgcttcgaggagtgctttcgccccgtgaaacagcgatacagcgtcaggaactccgtgagcccacctcccacagtatccgagttatgtgcgttgctggtatttctcttagacgtcatacccctcgagctttacagtgaggttcagacacaatatctgccccaagttttgggctgcctcgtccagccgttggctgaagacatggaagctctgtctctgcctgagttgacccacgccctcaaaacttgctttaaagtgctctctaaggtccagatgccaccatcttatctggataccgaatccaccagtggcacctcaagtcccgtaaagggtgagaacggtaaaattatactggagacaaaggctgtgatacccggagacgaggacgctagtttcccgccactcaagtcagaggactcaggaatcgggctttcagcctctagccccgagttatctgagcatcttagagtacctcgtgtgtctttggagagggatgacgtgtggaagaagggagggagcatgcaacggactttcttgtgcattcaggagttaattgcaaatttcgccagcaaaaacatttttggagtccagttgacagccagcggtgaggagtccaaatcagaggagcccgcagggaaacgagacagggatggcactcagtccctggctgccaatgattccagtcgtaagaacagttgggaacctaaaccaatcaccgtgccccagtttaagcaaatgctctcagacctgtttacagcccgaggcagtccttttaagacaaaatcttcagaaagcccctcttcttctcctagttccccagcaaggaagaacggaggcgaatgggacgtggagaaggttgttatcgacctgggggggtcccgtgaggagaggcgggaagcatttgcggccgcttgtcacctgttgcttgattgtgccacattccccgtgtatctaagcgaggaagaaaccgagcagctttgcgcaaccctgttccagctgcccggggctggggacagctcgttcccctcctggctgaagtcattgatgaccatctgttgttgtgtaactgattgttaccttcagaatgttgctatctccactctcctggaagtaatcaaccactctcagagcctggccctagtcattgaggataaaatgaagaggtataagtcaagtggccataatccattctttggaaagctgcagatggtcactgtgccccccattgcacctggtatactcaaagtgattgctgaaaagaccgacttttaccagagagtcgctagagtgctgtggaaccaactgaacaaggaaactcgagaacaccatgtgacatgcgtcgagttattctatcggcttcattgcttagcacctactgctaatatttgcgaagacatcatttgccacgctctactggaccccgacaagggaacccgcctggaggcgctgttccgcttcagtgtaatttggcacctcactcgagaaatacagggcagtagggtcacatcccacaaccgttcctttgaccggagcctgtttgttgtgctggattccttagcgtgcaccgacggtgcaatcggggcggccgcccagggctggctagtgagagcgctttctcttggtgacgtggcccgcatcctggaacccgtgttgctgttgctgctgcagcccaaaacccagagaacctcaattcattgtctgaaacaggagaactccgccgatgacctgcaccgttggttcaacagaaagaaaacatctttccgcgaggcctgtgccgtgcccgagccgcaggagagcggcagcgaggagcatctgccattgagccaattcactacagtggatagggaagcaatttgggcagaagttgagaaagagcccgagaagtaccctctaagaggggagctttctgaggaagaacttccatactacgtggaacttccggatcgcacagcgcatggagccccggacagctccgagcatactgaatccgctgatacttcgagttgtcacaccgactcagagaacacatccagttttagcagcccctcacatgacctccaggagctgagcaatgaagagaactgttgcgcgcccattcctatgggaggccgagcatacccaaaaagatcggccctcctggccgcattccagagcgaaagctttaaggcaggcgccaagctgtcgctggtgcgggtcgacagcgacaaaactcaggcatctgaaagctttagcagtgacgaggaggccgacctggaactgcaggcacttacaacctctaggctcctgaagcaacaaagagagcgccaggaagctgtcgaggcacttttcaaacatattctattatatctgcagccttacgacagtcgaagagtgttgtatgcattttccgttctggaggcagtgcttaagaccaaccccaaagagtttatagaggccgtgagtagaacctccatggatacctccagtaccgctcacctcaacttaatatctaatcttctggccagacaccaggaagcattaattggtcagagtttttacgggaaactacagacccaagtgcctaacgtgtgcccccactccttgctacttgagttgttaacctatctgtgtctcagttttctgagatcctactacccttgttatcttaaagtatcccaccgcgacatcctgggcaatcgcgatgtgcaagtgaagagcgttgaggtactgatcagaattatgatgcaacttgtgagcgtagcaaagtcttccgagggcaagaacgtcgagttcatccatagtcttctacagcggtgtaaagtccaggaattcgtcctgctaagcctgagtgcatccatgtatacgtcccagaaacggtatggactggcgaccgctcaccacggtagggctctgcccgaggattccctgttcgaagagtccctgatcaatctgggccaggaccagatttggtctgaacatcctttgcagatcgaactgctcaagttactccaggtacttatcgtcttagagcatcatctgggaagagctcatgaggaggccgagaatcagcccgatctgtcacgggagtggcagcgagctctgaatttccagcaggccatctctgcacttcagtacgtccagccacaccctcttacctctcaaggactgctggtgtccgccgtggttaggggcttgcaacctgcttacgggtatggaatgcatcccgcctgggtttcattggtgacccactccctgccttacttcggtaaatccctgggttggaccgtcaccccttttgtggtgcagatctgcaagaatctagatgatctcgtaaaacagtatgaaagcgaatctgtcaaactgagtgtctccaccacgtccaaacgtgaaaatatcagtccagactatcctctgacgctcttagaggggctgacaaccattagccatttttgcctgctcgagcaggccaatcagaacaagaaaaccatggccgccggggacccagccaaccttcgaaacgccagaaacgccatccttgaagaattgccccggaccgtgaataccatggctctgctgtggaatgtacttaggaaagaagagacacagaagcggccggtggacctactgggcgcaacgaagggcagctcttcagtatatttcaagactaccaagaccattcggcagaagattttggatttcttgaacccacttactgctcatctcggggtgcagttaacggcggccgtggcagccgtgtggtctagaaaaaaagcccagagacactccaaaatgaagattatccccacggcatccgcaagtcagttgacattggtcgacctagtatgcgctctgtctacgctgcagacggacactctgctgcacctggtgaaagaagtggtgaagaggcctcctcaggtcaagggcggggacgagaagagtccactcgtggatatccccgtgctgcagttctgctatgcctttctccaacgcctccccgttcccgcattacaggagaacttttcttccctgctgggagttctgaaggagagcgtgcagctgaatcttgctccaccaggatactttttactcttgagcatgcttaatgattttgttaccagaacacctaatcttgaaaataagaaggatcagaaggacctccaggagattacgcagaaaatcttagaggccgtgggcaacatcgcagggagcagcttggagcagacatcctggttatctagaaaccttgaagttaaggcacagccgcaagcatccctggaggaatccgatgctgaagaggacctgtacgacgctgcagctgcaagtgccatggtctcaagtagtgctccgagcgtgtattcagtccaggctctcagcttattggccgaagtgctcgcctccttgctagacatggtttataggtcagatgaaaaggagaaagccgtacccctcatctcaaggctgctgtattacgttttcccttatctgcgtaatcactctgcctataacgccccgtcctttagggccggcgcacagttactgagtagcctgtcaggatacgcctacaccaagagggcttggcggaaggaagttctagagctctttctcgacccggccttctttcagatggacacaagctgtgttcactggaagtctatcattgaccaccttctcacccatgaaaagaccatgttcaaggatttaatgaacatgcaatcttcttcgcttaagctgttctcatctttcgagcagaaggctatgctgctgaaacggcaggcatttgcagtcttttcgggtgaactcgatcagtatcacctctacctgccacttatacaagaacgtctaaccgacaacctccgtgtcggccagacttcaatcgtcgcggctcaaatgtttctcttttttagagtgctgctattgaggatctccccgcaacacctgactagtctctggcccattatggtgtccgagctcatacagaccttcacccagttggaggaggatctaaaggacgaagatgaatcattgcgtagcactaataaagtgaaccggacgaaagtgagtgtgccagatgctaacggcccgtctgtgggagagatacctcagtccgaattgatactttacctgtctgcatgcaaatttcttgacaccgcactgtcctttcccccagataaaatgccgctatttcagatctacagatgggcattcattcccgaagtcgataccgagggaccagctttcctctctgatgtggaggagaaccatcaagaatgtaagcctcacaccgtgcggatcctcgagcttctgaagctcaaattcggcgagatcagtagcagtgatgaaatcaccatgaagagcgaatttcccctcctgaggcaacattccgtgagctccataagacaacttatgcccttctttatgaccttaaatggtgcctttaaaacccagcggcaactccctgctgatagccctggaactccattccttgatttccctgtgacagattctccgaggattctgaagcagttggaggagtgtatcgagtacgactttctagagcacccagagtgctag

SEQ ID NO: 185802 - DNA, 792 bp, Artificial Sequence
  Description of Artificial Sequence: Synthetic coding sequence
atgttctacttccactgccccccccagctggagggcaccgccaccttcggaaatcactcgtcaggggattttgacgatggtttccttcgacgaaaacagcggcgtaaccgcacaaccttcaccctacagcagcttgaggccctggaagccgttttcgcccagacacactatcccgatgttttcacccgggaagaattggcaatgaagataaacctgaccgaggctagggtgcaggtatggtttcagaatcggagggcgaaatggcgcaaaactgaaaggggcgcctctgatcaagaacctggcgctaaggagccaatggcagaagtaacccctccacccgtgagaaacatcaactctccccctcctggggaccaggcccggagtaaaaaggaagcccttgaagcccagcaatctttgggaaggacagtgggcccagcaggcccgttcttcccatcttgtctacctggcaccctgctgaatacagctacatacgctcaagcactcagtcacgtcgcctctctgaaaggcggccctctgtgttcctgttgtgtccctgatccaatgggcctgtctttcctaccgacctatggttgtcaatctaaccgaactgcgagcgtagcaacgcttcgcatgaaggccagagagcactctgaggccgtgctgcagtccgctaatcttctcccctctaccagttcctctcccgggcctgtcgctaagccagcgccacccgatggctctcaggaaaagacaagtcccactaaggagcagtcagaagctgagaaaagcgtgtag

SEQ ID NO: 185803 - DNA, 807 bp, Artificial Sequence
  Description of Artificial Sequence: Synthetic coding sequence
atggtgctgatgagctgcgaccagcggctgatcagcctgctgctggtcggaacagccacgttcggaaatcacagctctggcgatttcgacgatggatttctgaggcggaaacagaggcgcaatcggacgacattcacactgcaacagctcgaagcccttgaagcagtgttcgcacagacccactatcccgatgttttcaccagggaggagctcgccatgaagataaacctgaccgaagcgcgtgtgcaggtgtggttccagaacaggagggctaagtggcggaagaccgagcggggagcctctgaccaggagccaggagctaaggagcccatggctgaggtcacccctccacccgtccgaaatattaattccccacctcctggagatcaagctaggagtaagaaagaggctctggaagctcagcagagtcttgggaggaccgtcggtccggcaggcccgttcttcccttcatgcctgccaggcacacttctgaacaccgcgacttacgcacaggcactgtcccatgtggcttcgttgaagggcggtcccctttgctcatgttgcgtgcccgatcctatgggattatctttcctgcccacctatggctgtcagagcaatcgtaccgcttcagtggcgaccctccgcatgaaagcccgggaacacagcgaggctgtcctccagtctgccaacctgcttccatcaacctccagttccccaggcccagttgcaaagccagcaccccctgacggctcacaggagaaaacttctcctaccaaagagcaaagcgaggcagaaaagagcgtatag

SEQ ID NO: 185804 - DNA, 384 bp, Artificial Sequence
  Description of Artificial Sequence: Synthetic coding sequence
atgaagctgaacgtggacggcctgctggtgtacttcccctacgactacatctacccagagcaattcagctatatgagagaactgaaacgaaccctggatgcaaagggacacggggtcttggaaatgccttcagggaccgggaagaccgtgtcactcctggctctcatcatggcttaccaacgagcttatccactggaggtgacaaagctgatctattgttcaaggacagttcctgaaatagagaaggtaattgaggagctgcggaaactgttaaacttttatgaaaaacaggagggcgagaaactcccctttctcgggctcgcgcttagctcgagaaaaaacctgtgtatacatcccgaaacaacttcagcttccacaccctag

SEQ ID NO: 185805 - DNA, 4614 bp, Artificial Sequence
  Description of Artificial Sequence: Synthetic coding sequence
atgggcgagaagctggagctgcggctgaagagccccgtgggcgccgaaccggcagtttatccctggccactccctgtgtatgacaagcatcatgatgcggcccatgaaatcattgagaccattcggtgggtgtgcgaggagattcctgacctgaaactcgccatggagaattatgtgctcattgactacgataccaagtctttcgagtcgatgcagaggttgtgcgataagtacaaccgggcgatagacagtatccatcaactctggaaaggaaccacacagcccatgaaattaaacacaaggccttctacagggcttctgcgtcacatcttgcagcaggtgtacaaccactcagtgacagatcccgagaaactcaacaactacgaacccttctcacctgaagtatatggggagacttctttcgatttagtggctcaaatgattgatgaaatcaaaatgactgatgatgatctgttcgttgatctgggaagtggagtaggccaagtcgtcttgcaggtagccgcagcaacgaactgcaagcaccactacggtgtagaaaaggccgacatccccgcaaaatatgccgagaccatggatagggagtttcgtaagtggatgaagtggtatggcaagaagcacgccgagtacacccttgagagaggtgatttcctctcagaggaatggcgagaaaggattgctaacacttccgttatatttgtgaataactttgccttcggacctgaagtggaccaccagctcaaggaacggtttgccaatatgaaagaaggcgggcgaatcgtttcaagcaaaccctttgccccactgaatttccggatcaactcacggaacttgtccgatatcggtacaattatgagagttgtggaacttagcccactgaagggcagcgtctcatggacagggaagcctgtttcatattatctgcacacaatcgaccgtacgatcctggagaattacttctcatccctgaagaatcccaagttacgcgaagagcaggaagctgccagacggcgtcagcagagggagtctaaatcaaacgctgcaacccctacaaaagggccagagggtaaggtggcgggccctgcggatgcccccatggattccggagccgaagaagagaaggcaggcgcagctacggtcaagaaaccaagccccagcaaggccaggaaaaagaagttgaataagaagggcagaaaaatggcaggccgcaagcgtggccgaccaaagaagatgaacacagctaatcctgaacgtaaaccaaaaaaaaatcagaccgccctggatgctctccacgcacagaccgttagccagacggctgcttcaagtcctcaggacgcctacagaagcccccactcacccttctatcagctgccccccagcgtgcagcgtcactcccccaacccactcctcgtggcacctacacccccagccctgcagaagctactcgagtcattcaagattcagtatttgcagttcctcgcctacactaagacgcctcaatacaaggctagccttcaggagctcctgggacaggaaaaagaaaaaaacgcgcagttactgggcgcagctcagcagctgctttctcattgtcaggctcagaaggaggagattcggaggttgtttcagcagaagttagacgaacttggtgtcaaggcactcacgtacaatgaccttatccaagcacagaaggagatctccgcccacaatcagcaacttcgcgagcaatctgaacagctggagcaagataaccgtgcccttagaggacagtctttacagctgctcaaagcgcgctgtgaggagcttcagctcgactgggcaacattgtcgctcgagaaactgctgaaggagaagcaggccttgaaatcccaaatatcagagaagcagcgacactgtctggagctgcaaatttcgattgtggaactcgagaagtcccagaggcaacaagagctcctgcaactaaaatcatgtgtgcctcctgacgatgccctgagtctccatctgcgcggaaagggggcactgggaagagaactcgagccagacgcctctcgactgcatctggaactggattgtactaagttttctttgcctcatctgagtagcatgtcacctgagctgtctatgaacggtcaagctgctgggtacgagttgtgcggggtcctttctcgaccatcaagcaaacagaatactccacaatatctagcttctccattagaccaagaagtggttccttgcaccccatcccatgttggccggcccagacttgagaaactgagtggactggccgctcccgactatacccgcctctcccctgccaagatcgtcttacggcgacacctatctcaggaccacaccgttcctggccggcctgctgcatctgagctacacagtagggcagagcataccaaggagaacgggttaccttaccaatccccctctgttcccgggagcatgaagctcagtccgcaggaccctcgccctctctctcctggagcactacagcttgctggggaaaaaagttccgaaaaaggcctgcgcgaaagggcctatgggtcctccggggagcttattacctcattaccaattagtatcccgctgagtacggtgcagcccaataaactgcccgtatctatccctcttgccagcgtcgtgctaccttccagagctgagagggcgagaagcaccccttctcccgttctgcagcccagggacccttcatccaccctcgagaagcagatcggggccaacgcacatggcgctgggtcccggtctctggccctggctcctgccggcttcagctacgcaggcagtgtggccataagtggcgccctggccggatcacctgcgtctctgactcctggagccgaaccggcgactctggatgaatcaagcagcagcggctccttatttgctactgtcggaagtcggtcttccaccccacaacatcctctgcttttagctcagccccggaactctttgccggcctcccctgcccaccaattatcaagttccccaagactcggtggggcggcccagggccctttacctgaagctagcaagggggatcttccaagtgactctggtttttcagatcccgagagcgaagctaaacggcgtatcgtcttcaccatcactaccggggccggcagtgctaagcagtctccctcctccaaacactctccgttgaccgctagcgcacgcggtgattgtgtaccatcccacgggcaggacagccgacgcaggggcaggcggaaaagggctagcgcgggcacaccaagcctaagcgcgggagtctctcctaagaggcgggccctgccgtctgttgcaggcctgtttacacagcccagcggatcccctcttaacctgaactcaatggtaagcaatatcaaccaacccctggaaataacagccatctcctcccccgagacttcgctgaagtcatcacccgtgccataccaggaccacgatcagcctcccgtgcttaaaaaagaaaggcccctgtctcaaactaatggggctcactacagcccattgaccagcgacgaggagcccggctcagaagacgagccttccagtgctagaatcgaacggaagattgctacaatatccctggaatccaaatcacctccgaagactttggagaacggtggcgggctcgcaggccgaaaacccgctcccgccggggaacccgtgaactcatccaagtggaagagcactttctcaccaatttctgatatcggcctcgcaaaaagcgcagattcacccctccaggcttcttcggctctctcacagaatagtctctttacttttcgcccagcactggaggagcctagtgccgatgctaagctagcagcgcacccacgcaaggggtttcctggctctctgagcggcgccgacggtctctcccctggtaccaacccagcgaatgggtgcacatttgggggagggctggccgccgacctcagcctccacagttttagcgacggcgcttcactcccccataaagggcccgaggcggctggcttgtcgtcgcccctgagctttccttcccagcgaggtaaggagggctcagacgctaacccatttttgtcgaagaggcagctggacggacttgctgggcttaagggagagggatcccgtggtaaggaggcaggcgaagggggcctgcctctgtgcgggccaaccgacaaaactccgcttcttagtggcaaggccgccaaggctagggaccgagaagtcgatctcaaaaatgggcataatctcttcatcagcgctgcagcggtgccccccggctccctactatccgggcctggtttggcaccggcagcgtcttctgccggtggggctgcctcctcggcgcagactcatagatcattccttggaccattcccgcccggtcctcagtttgcccttggaccgatgagccttcaagccaacctgggttctgtggcgggctcgtctgttttacagagcctcttttctagcgtgcctgcggcagctgggctcgtccatgtttcaagtgctgcaacgcgattgactaattcgcacgctatgggcagtttctccggcgtggctggcgggaccgtcggggggaactag

SEQ ID NO: 185806 - DNA, 1203 bp, Artificial Sequence
  Description of Artificial Sequence: Synthetic coding sequence
atgcggggccggcggggcgaccggatgaccatcaacatccaggagcatatggctataaacgtgtgtcccggtcccatccgtccaattagacaaatcagcgattacttcccacgggggcctggcccagagggcggaggcgggggcggtggtgaggccccagctcacctggtgccgctggctctggcacctcccgcggctctgctgggcgccaccaccccagaagatggcgctgaggtggacagctacgacagtgacgatgccacagctctggggacactggagtttgatctgctgtacgaccgggcttcctgcactctgcattgttcaatcctaagagccaagggcctgaaaccaatggacttcaatggcctcgctgacccgtacgtcaagctgcaccttctccctggagcatgcaaggccaataagctgaagacgaagactcaacggaacaccctaaatcccgtctggaacgaagatcttacgtatagcggaattacagatgatgatattacccacaaggtgctccgcatcgcagtgtgcgatgaggacaaactcagtcacaacgagttcatcggcgaaatacgggttcctctccgtaggcttaaacccagccaaaagaagcactttaacatatgcttggaaagacaagtccccctggcttccccatctagcatgagcgcagccctgcgaggaattagctgctacctcaaggagctcgagcaggccgagcagggccagggcttactagaggaacgagggaggattcttctcagtctgagctattctagcagaagaagaggattacttgttggaattttgaggtgtgcgcatcttgctgccatggacgttaacggctacagcgacccttatgtcaaaacttacttaagaccggatgttgataaaaagagcaaacacaagacatgcgttaaaaaaaagacacttaaccccgagtttaacgaggagttcttctatgagatcgaacttagcactctagcaacaaagacgttagaggtgacagtgtgggactacgatatcgggaaaagcaatgactttataggcggcgtgtcccttggccccggggccagaggcgaagcaaggaaacattggagcgactgtctacagcagccagacgccgcgctggaacgttggcacacacttaccagtgaactgccacctgctgccggtgctttgtctagcgcctag

SEQ ID NO: 185807 - DNA, 927 bp, Artificial Sequence
  Description of Artificial Sequence: Synthetic coding sequence
atgaccctgcggcggcggggcgagaaggccaccatcagcatccaggagcacatggcaatcgacgtatgtcctgggcccattcgccctatcaaacaaattagcgattacttcccgcgtttcccaagaggcttacctcctgacgccggcccgagggctgccgcccctccagacgcgccagccagacctgctgttgccggagcaggtcggagatctcctagcgatggtgctagggaggatgacgaggacgtggaccagctttttggagcctacggcagctctcccgggccttcacccggtccgtcaccagcaaggccacctgctaagccaccggaggacgagccggacgctgatggctacgaatcagacgactgcactgcccttggaacactcgacttctctcttctatatgatcaggagaacaatgccctccattgcacaatcaccaaagcaaaaggtttgaagcctatggaccacaatggcctagcagacccctatgtgaagctacaccttctgccgggtgccagcaaagccaataagctaagaactaagactttgcggaatactctgaacccaacatggaatgagacactcacctactatggcatcaccgatgaggacatgattcgcaagacattaagaatctcagtgtgtgacgaggacaagttccggcataacgagtttataggagagacccgggtgcctctcaagaagctgaagccaaatcacacgaaaaccttctccatttgtttggaaaagcagctgcccgtggataagactgaggataagagtctggaggagcgagggcgcatcctgatcagtctcaagtactcttcccagaagcaggggttgctcgtaggcatcgtccggtgcgcccacctggcggccatggatgccaacggttacagtgatccctatgtaaagacgtag

SEQ ID NO: 185808 - DNA, 927 bp, Artificial Sequence
  Description of Artificial Sequence: Synthetic coding sequence
atgaccctgcggcggcggggcgagaaggccaccatcagcatccaggaacacatggcaatcgacgtgtgtcctggcccaatcagaccaatcaagcagatttccgactattttccccggttcccaagaggtctcccacctgatgccgggccacgagctgctgcccctcccgatgctcccgccagacctgctgtcgccggggctggccgcaggagcccctcggatggcgcaagagaggacgacgaagatgttgatcagctctttggcgcctatggatcatcaccagggccctcccccggaccttcccccgcccgcccgcctgccaaaccacctgaggatgaacccgatgccgatggctacgagtccgatgactgtaccgccctgggaacgttggacttcagccttctttacgatcaggaaaataacgcactccactgtacaattacgaaagctaaaggactaaagccaatggatcacaacggactagccgacccatatgtgaagctccacctactgcctggtgcatctaaggctaacaaattacggaccaaaaccctgcggaacacactgaatcctacttggaacgaaactctgacctactacgggataactgacgaggatatgattcgtaagactctgagaatttctgtctgtgatgaggataaatttcggcacaacgagtttatcggagaaactagagtgcctttgaagaagttgaagccaaaccacactaaaactttcagcatttgtctggaaaagcagttacccgtggataaaaccgaagataaaagcctggaggagcgaggaagaatcttgatatctctgaagtacagcagtcagaaacagggactcctagtcggtatcgtgcgatgcgcccaccttgcagcgatggacgcaaacggatacagtgacccatatgtgaagacatag

SEQ ID NO: 185809 - DNA, 1275 bp, Artificial Sequence
  Description of Artificial Sequence: Synthetic coding sequence
atggccctgcccacccccagcgacagcaccctgcccgccgaggccaggggacgggggcggagaaggcggctggtctggactcccagccagtcggaggccttgcgtgcctgtttcgagcgtaatccctaccccgggatcgccacgagggagagactcgcgcaagctattggaatccccgagccccgggtgcagatctggtttcagaacgaacgtagccggcagctccgacagcatcgccgcgagagccgcccctggccaggacggcgcggtcctcccgaaggaagaaggaaacggacagctgtgacgggatctcagaccgctcttttgttaagagcttttgaaaaggataggttccccgggatagctgcccgggaggaattggcccgggagaccggattaccagagtctaggatccaaatttggtttcagaacaggcgggctcgacatcccggtcaggggggcagagcaccagcgcaggctggtggactgtgctcagctgccccgggcgggggccatccagcaccatcctgggtcgcattcgctcatacaggcgcgtggggtactgggctgcctgctcctcatgtcccctgtgcacccggggccttaccgcagggagccttcgtcagtcaagctgctcgcgctgctcccgcccttcagccaagccaggccgcccctgcagagggcgtgtcacaacctgcaccagccagaggcgacttcgcatacgccgccccagcgcctcctgacggcgcactgtctcaccctcaggctccacgatggccccctcaccctggtaagagccgagaagatagagatcctcaaagggacggactcccgggcccttgtgccgttgcgcagcccggcccagcccaagctggcccacagggacaaggcgtccttgccccaccaactagccagggaagtccttggtggggctggggacgaggacctcaagtggccggcgcagcctgggagccacaggctggtgccgcaccccctccccaacccgcgcccccagatgcctcagcctccgcccgccagggccaaatgcaaggaatcccggctccctctcaggccctgcaggaaccggcgccctggtctgcactgccttgtgggctgctgttggacgagctcctggcttcgcccgagttcctgcagcaagcacagccgctactggaaactgaagcccccggtgagctcgaggcttcagaagaagccgcatctttggaagcccctctctcagaggaggagtatcgcgcactactcgaagaactgtag

SEQ ID NO: 185810 - DNA, 1458 bp, Artificial Sequence
  Description of Artificial Sequence: Synthetic coding sequence
atgaagggctggagcctgcccgcctgcggccccctgcagggccggctggcaggttggttggcagtgcgcgctggcctccttgctgccccagctgcggtacattcccctgcagaggttcacgggtcaccgcctgctagtctctgccccaggccctccgtcaaatttcggcccgggctgacagccatggcactacccacgccaagcgactctacgttgccagctgaagcccgaggtcgaggcagacgtcgcagactcgtgtggaccccaagtcagtcggaagctctacgggcctgctttgaaaggaatccatatcctggaatcgccaccagagaacggcttgcccaagcgattgggattcccgagccccgggttcagatctggttccaaaacgaacgcagccgacagctccggcagcatcggagggagtctcgtccctggcctggccgcagagggcccccagagggcaggcgaaagcggaccgccgtaactgggtcccagacagcactgctgttgcgtgcctttgaaaaagatcggttcccgggcatcgccgcccgagaagaattggctcgggagacgggcctgccagagagccgcatccagatttggttccagaaccgccgtgcgcggcatccagggcaggggggccgcgcccctgcccaggccggaggactatgttcagctgcgcccggcggaggacatccagcaccgtcatgggtcgcttttgcccacacaggggcctggggtactggactgccggcaccccatgtaccttgcgctcctggagcgttacctcagggggcattcgtttcacaggccgccagggccgcccctgccttgcaaccatcacaggcagcacccgcagaaggggtgagtcaacccgcacccgcccgcggagacttcgcctacgcagccccagccccgcctgatggagctctgtcgcatccccaggctccccggtggcccccccaccccgggaaatctcgagaggaccgcgacccacaacgcgatggccttccaggaccgtgtgccgtggcccagcccggcccagcccaggcaggacctcagggacagggcgtgcttgccccgcccacatcccagggcagcccatggtggggttggggccgggggccacaggtcgcaggcgccgcctgggagccacaggctggcgctgctccccccccccagcccgctcctccagacgcatcggcctctgctagacaggggcaaatgcagggtattcccgccccaagccaggcattacaggagcctgctccctggagcgctctaccttgcggactgcttcttgacgagctattggctagtcctgagtttttgcagcaggctcagcctcttcttgagacggaagctcccggtgaacttgaggcttctgaagaggccgcctcgctggaggcaccactgtctgaagaggaataccgggctctactcgaagaattatag

SEQ ID NO: 185811 - DNA, 1326 bp, Artificial Sequence
  Description of Artificial Sequence: Synthetic coding sequence
atgaagaccctgcccctgcacagccactgcaccgagatgcagcggttactgccaaaacttgaaatgctgactttggggtcttctttctgttctctgcagggtgaattttgtcaggcaatggattcatttactacagtcagccacgtgggcatgtgtgaggaaacagacgcatcgtttaacgtctttagccctaagtttcagttcgatagaagccactgtcagagtctgcgattccaccagaatatggagctggacttcgggcactttgacgagcgcgataagacctcaagaaatatgcggggctcccgaatgaacggcctcccaagtcccacacattcagcgcattgttcattctacagaacccggactttacaggcactgtctaatgagaagaaggctaagaaggtcaggttttaccgcaacggtgaccgttatttcaaggggattgtgtatgccgtgagctctgaccgattcagaagctttgatgccctgctggcagatttgacccgatcgcttagcgacaacatcaaccttccacagggagtacgttatatttacacaatcgacggctcaagaaaaattggaagtatggatgagctcgaagaaggcgagagttacgtgtgcagcagtgacaacttctttaaaaaggtcgaatatacaaagaacgtgaatccaaactggtctgtcaacgttaaaacgtctgccaacatgaaggctccacagtccctggctagttccaacagcgcacaagcacgagaaaacaaggatttcgtgcgccccaagctggtcaccatcatccgcagcggcgttaagccaagaaaggctgtccgggtgctgttaaataaaaagacagcccactctttcgagcaggtgctgactgatattaccgaagccatcaaactggagactggcgtggtgaagaagttgtacacgcttgatggaaaacaggttacctgtctgcacgattttttcggcgatgacgacgtcttcattgcatgcggcccagagaagttcaggtatgcccaggacgacttctccctcgacgagaatgagtgccgcgtgatgaagggaaatccatcagctacggctggccccaaggccagccccaccccacagaagaccagtgcaaagtcaccgggacctatgcgaagatctaaatcgcctgcagacagcgcgaacggcacttccagcagccagttgtctacaccaaaatccaaacaatcacctatctctacccccactagcccaggctcacttcgcaagcataaggacctgtacctgcccctcagcctcgacgattcagactccctgggggactccatgtag

SEQ ID NO: 185812 - DNA, 1098 bp, Artificial Sequence
  Description of Artificial Sequence: Synthetic coding sequence
atggagctggacttcggccacttcgacgagcgggacaagaccagccggaacatgcgtggatctagaatgaatgggctgcccagcccaactcatagcgcccactgtagcttctaccgcacccggaccctccaggcgttgagcaacgaaaaaaaagccaagaaagtgcggttctaccgcaacggcgaccggtatttcaagggtattgtctatgcggtgtcctccgacagattcagatcatttgatgcgttgctcgctgatttgactcgttcactcagcgacaacattaatttgccacagggcgtgcgttatatatacaccatcgatgggagccggaagataggctccatggatgaactggaggaaggggagagctatgtctgctcttcagataacttctttaagaaagtcgaatacaccaaaaacgtgaaccctaactggagcgtgaacgtgaaaacgagtgcaaatatgaaggccccacagagcttagcatcttccaactctgcgcaggcacgtgagaataaggactttgtcagacctaaactcgtcacaatcatccggtccggcgttaagccgcggaaggctgtgagagtactgttgaataaaaaaactgctcattcctttgaacaggtactgacagacatcaccgaggctattaaactcgagacaggagtcgtgaaaaagctttacacccttgatggcaaacaagtaacatgcctgcatgacttctttggggatgatgacgtcttcattgcctgcgggccagaaaaatttcggtatgctcaggacgacttcagcctggacgagaatgaatgcagagtcatgaagggcaatccttcagccaccgccggccccaaagcttccccaacaccacaaaagacatcagccaagtctcccggccctatgcgtcgctcgaagagtcccgcagactctgggaatgaccaggatgccaatggtaccagctcatcccagctgagtacacctaaaagtaagcaatcccccatttcaacccccacatcccctggctcgctccgcaaacataaggacctctacctccctctgtcccttgacgactccgacagcctgggtgactcgatgtag

SEQ ID NO: 185813 - DNA, 1098 bp, Artificial Sequence
  Description of Artificial Sequence: Synthetic coding sequence
atggagctggacttcggccacttcgacgagcgggacaagaccagccggaatatgagaggcagtcgcatgaatgggctaccctcgcccacccattccgcccactgtagtttctaccggacacgaacccttcaggccctgagcaatgagaagaaggccaagaaagtacgattctatcggaacggtgatcgatacttcaaaggtattgtctacgccgtgtcttcagaccggttccgaagttttgacgccctgctcgccgacttaaccaggagtcttagtgataatatcaatctgccccaaggtgtcagatacatttataccatagacgggtcccgcaaaataggcagtatggacgaactagaagaaggggagtcctacgtttgtagctctgacaactttttcaaaaaagtcgaatataccaagaatgtgaaccccaattggagcgtcaacgtgaaaacgagcgcaaatatgaaggctccccaaagtctggcttcttccaactccgcacaggcgcgggagaacaaggatttcgtgaggcctaagctggtgacgattatcagatccggggtgaagcctagaaaagccgtccgcgtgttgctgaacaagaagacagcccacagcttcgagcaggtcttgaccgacatcaccgaagcaatcaaattagaaactggcgtagtaaagaaattgtacaccctcgatggaaaacaggttacatgcctgcacgatttttttggcgatgacgatgtgtttatagcctgtggccccgaaaaatttcgctatgcccaagacgatttcagtcttgacgagaacgagtgtcgtgttatgaagggcaatccctcggccactgcagggccgaaagcatcccccactccacagaaaacgtcagcaaaatcaccagggccgatgcggagatcaaagagtcctgctgattccggtaacgaccaggacgccaatggtaccagcagcagccagctatccacccccaaaagcaaacagagccccataagcacaccaacctctccagggagtcttcgtaagcacaaggatctctatcttcccctttctctggatgattcagattctcttggcgattctatgtag

SEQ ID NO: 185814 - DNA, 1317 bp, Artificial Sequence
  Description of Artificial Sequence: Synthetic coding sequence
tgatgcaccgagatgcagcggctgctgcccaagctggagatgctgaccctgggtagctctttctgtagtctacagggggagttttgccaggccatggacagcttcaccaccgtgtctcacgtagggatgtgtgaggaaaccgacgcatccttcaacgtgttttctcccaagttccagttcgataggtcacactgccagagtcttagatttcaccagaacatggaactggatttcgggcatttcgatgagagggacaagactagccgtaatatgagggggtctaggatgaatgggctgccgtcgccgactcactccgcgcactgttctttttataggacccggaccttgcaggcactgtcaaacgagaaaaaagctaagaaagtccgtttctatcgcaatggcgatcgctacttcaagggaatagtgtatgctgtttctagcgatcgttttcgcagctttgacgcactgctcgctgacctgactcggtcactgagtgataacataaatttgccccagggagtgaggtacatttacacgattgacgggagcagaaaaattggatccatggatgagctggaagagggcgagtcctacgtgtgctcctcagataatttctttaaaaaagtagagtataccaagaacgttaatcccaattggagtgtgaatgttaagacctccgcgaatatgaaagccccacagtcactagccagttctaatagtgctcaggctagagagaacaaggacttcgttaggcctaagcttgttactattattcgcagcggcgttaagcccaggaaggcagtgcgggtactactgaacaagaaaacagcacactctttcgaacaggttctgaccgatatcactgaggccattaaattagaaacaggggtcgtgaaaaagttgtataccttagatgggaagcaagtgacatgtcttcatgactttttcggagacgacgatgtcttcatagcctgcggtcctgagaagttcagatacgctcaggatgactttagcttagatgagaacgagtgtcgtgtgatgaagggaaacccttctgccacggctggacctaaggcctcgcctaccccacaaaaaacctctgcaaagtctcccggaccaatgcgccggtccaagtctcctgctgactccggcaacgatcaggacgctaatggtacaagcagttcccaactctctacacccaagtcaaagcagtctcccatatccacccctacgagcccgggtagcctgcggaaacacaaagacctgtacctgcccctatcgctggatgatagcgacagcttaggagattctatgtag

SEQ ID NO: 185815 - DNA, 1083 bp, Artificial Sequence
  Description of Artificial Sequence: Synthetic coding sequence
atggagctggacttcggccacttcgacgagcgggacaagaccagcagaaatatgcggggcagccgtatgaacggtctgccctctcccactcacagcgcacactgctcgttctacagaactcggacactgcaggcattgtctaatgaaaagaaagcaaagaaagtgcggttttaccggaacggagacagatacttcaagggcatagtgtatgccgtctctagtgaccgcttcagatccttcgatgccctgctagctgatctcacccgttcactctccgataatattaatttgccccagggtgtgagatatatttataccatagatgggtcgcgaaagatcggctcaatggatgagctggaggaaggagagtcctacgtgtgtagctccgataactttttcaaaaaagtggagtacaccaaaaatgtcaatccaaactggtctgtcaacgtgaagaccagcgccaatatgaaagcaccacagagcctggcctctagtaactccgcgcaggccagagaaaacaaagatttcgtgcgcccgaaattggtgaccattattaggagcggcgtgaaaccaaggaaagccgttcgggtgctgctcaacaagaaaaccgctcattcctttgagcaagtactgactgatattactgaggcaatcaaactggaaaccggcgtggtgaagaagctatacaccctggacggaaaacaggtcacatgtcttcacgacttcttcggggatgacgatgtgtttatcgcgtgtggccctgagaaatttcgctatgcccaagacgatttcagccttgatgaaaacgagtgtcgagtaatgaaaggaaacccaagcgccaccgccggccctaaagcatcccccaccccccagaagacttccgccaaatctcccggaccgatgcggaggagcaaaagtcccgccgactcagccaatggaacgagctccagccaattgtctacacccaaatccaagcaatcgcccatcagtacccctaccagtcccggatcactgaggaagcacaaggacctgtacttgcctctgtccctggacgacagcgattccctgggcgattctatgtag

SEQ ID NO: 185816 - DNA, 342 bp, Artificial Sequence
  Description of Artificial Sequence: Synthetic coding sequence
atggagctggacttcggccacttcgacgagcgggacaagaccagcagaaacatgaggggttcacgcatgaacggtctaccctcgcccactcactcggctcattgctctttctatcgcacaagaaccttgcaagccctgtctaatgagaagaaggccaagaaggtcaggttctacagaaatggggaccggtacttcaagggcatagtttacgcagtaagctcagacagatttcgcagctttgatgcgttactagccgaccttacacggagcctgtccgacaacattaacttaccacaaggagtgagatacatctatacgatagacggatcaaggaagatctag

SEQ ID NO: 185817 - DNA, 1083 bp, Artificial Sequence
  Description of Artificial Sequence: Synthetic coding sequence
atggagctggacttcggccacttcgacgagcgggacaagaccagccgtaacatgcgcgggagtagaatgaatgggcttcctagtcctactcatagcgcccactgttcattctatagaactagaacccttcaggcactgagtaacgaaaagaaggctaaaaaagtgagattctacaggaatggagatcgttactttaaaggaatcgtgtacgctgtatcaagtgaccggtttaggtcctttgacgcgctgctggcagacctgacaaggagcctttcagacaacatcaatctccctcagggagtgaggtacatctacaccatcgacggctcaaggaagattggatccatggacgaactggaggagggcgaatcttacgtctgcagctccgacaacttcttcaaaaaagttgaatatacaaaaaacgtcaaccccaattggtctgtaaacgtcaagacttcagccaacatgaaagccccgcaaagcttagcctcatcgaactccgctcaagccagggagaacaaagatttcgtgcggccaaagctcgttacgatcatccgttccggtgtcaagccccggaaagcagtccgggtccttctcaataaaaaaactgcccattctttcgaacaggtgctaactgatataacggaagctatcaaacttgagacgggcgtcgtgaagaagctgtacaccttagacgggaagcaggttacttgcctacacgacttctttggagatgatgatgtattcatcgcctgcggtcctgaaaagttccggtacgcccaagacgactttagtttagatgaaaacgagtgccgagtcatgaagggtaacccttccgctacagccgggccgaaggctagtccaaccccccaaaagacctcagcaaagtccccgggtccaatgagaaggagtaaatctccagccgacagcgcgaatgggacttcttcatcacaactcagcacccccaagtcaaaacaaagtcccatttcgacacctacctccccgggatccctccggaaacacaaagatttgtaccttcccttgagtcttgacgatagtgactccctcggggattctatgtag

SEQ ID NO: 185818 - DNA, 1065 bp, Artificial Sequence
  Description of Artificial Sequence: Synthetic coding sequence
atggccaagaccggcgccgaggaccaccgggaggccctgagccagtcctcgcttagcttgttaaccgaagccatggaagtactacagcagagctctccagagggcacccttgacggtaacacagtgaatcccatctataagtacattctcaacgatctgcccagagaatttatgtcaagccaggctaaagccgtgatcaaaaccactgacgactacctgcagtcgcagttcggtcccaatcgccttgtacattctgccgctgtctcagaaggctccgggctgcaggactgttctacacaccaaaccgcttctgaccattcccacgacgagatcagcgatcttgacagctataagagcaatagcaagaacaattcttgtagtatctccgcatcaaagcggaaccggcctgttagcgcccctgttggccagctcagagtcgccgaatttagctccctcaagttccagtctgcacgcaactggcaaaaattgagccagagacacaaactgcagcctcgggtgataaaggtcacggcatataagaacggtagcagaaccgtctttgcacgggtcactgtgcctaccatcacactcttgctggaagagtgtacagaaaagctcaatctgaacatggctgccaggagggttttcctagctgatggaaaggaggccttggagccagaagatatcccgcatgaggccgacgtttatgtctccactggggaacccttcttgaatcctttcaaaaaaattaaggatcacttactgttaatcaagaaggtgacgtggactatgaatgggctgatgctgcctaccgatattaaaaggagaaaaactaagccggttctgtcaattcggatgaagaagctcaccgaaaggacatctgtcagaattttgttctttaaaaatggtatgggtcaggacggtcacgaaataaccgttggaaaggagactatgaagaaggtcctggatacctgtaccatccggatgaaccttaatctgcccgctaggtacttctacgatctgtatggtaggaaaatcgaggacatctccaaggggaaacattag

SEQ ID NO: 185819 - DNA, 690 bp, Artificial Sequence
  Description of Artificial Sequence: Synthetic coding sequence
atgaagatgtggaacaactggggctggtgcggcggccggcggcggggttgtacgaagatcctcagcacaaaaaagggcatccagatgtcgattaagaacaaacaccttattgtcatcccagctttcagccacacgatgagtcagctggactttgacttccactgtgtcttcgtgagcatcgacgaaggaatattcaaagcaggcgccgagcgctctgagacccgaggcgccgctgaggtccaggaagatgaagacacccaggtggaggttcctgttgaccagagacccgctgagatagttgacgaagaagaagacggagaaaaggccaacaaagacgccgagcagaaggaggacttttcaggaatgaacggcgaccttgaggaagaaggcggtagagaagccactgatgcccccgaacaagttgaagagattctggaccacagtgaacagcaggcccgcccagctcgcgtgaatggcggaacagatgaggagaacggagaggagctgcaacaagtgaacaatgaactacagctggtcctggacaaggagaggaagagccagggcgccggcagcggtcaagacgaggctgacgtggacccgcaaagaccacctagacctgaggtcaagataacctctccagaagagaatgagaacaatcaacagaataaggactacgccgcagttgcctag

SEQ ID NO: 185820 - DNA, 1431 bp, Artificial Sequence
  Description of Artificial Sequence: Synthetic coding sequence
atgagcggcagcagcgcccggagcagccacctgagccagcccgtggtcaagtctgttctggtctatcgcaacggagaccccttctatgccggccgccgcgttgtgatccatgagaagaaggtgtcgagttttgaggtattcttaaaggaagtaaccggaggggtccaggctccattcggcgccgtgcgcaacatttacaccccccgaaccggtcaccgtatccggaaactcgaccaaattcagtctgggggaaattacgtcgccggcggccaggaggcctttaagaaactgaattacctggacataggcgagataaagaaaaggcccatggaagttgtaaatacagaggtgaaacccgtcatacattcaagaatcaacgttagtgcgcgcttcaggaagcccttgcaagagccgtgcacgatttttcttattgcaaatggggacctcattaatcctgcttcacgtctccttatcccccgaaaaacactcaaccagtgggatcacgtgctgcagatggtgaccgagaagatcacgctgaggagcggcgctgtccacagattgtataccctagagggcaaactggtagaatcaggtgcggagcttgagaacggtcagttttatgtcgcagtggggcgggacaaatttaaaaagttaccatattcagagctgctctttgacaaatctactatgaggaggcccttcggccagaaagcctcttcgcttccccctatagtggggagccgcaaaagcaaaggaagcggaaacgaccgacactccaaatcaacggtcgggtctagcgataacagcagtccacagccactgaaaagaaagggaaagaaagaggatgtgaacagtgaaaaactcaccaaattgaagcagaacgtgaagcttaagaatagccaggaaacaattccaaacagtgacgaggggatttttaaagccggtgccgagcggagtgagacaagaggagccgccgaggtgcaagaggacgaggatacgcaagtggaagtgccggtggaccagagaccagccgaaatcgtagatgaagaggaagacggggagaaagcaaacaaagatgccgagcagaaagaagatttcagcgggatgaatggagatctggaggaggagggaggtagggaggcaactgacgcgcccgaacaggtcgaagagattctggatcactcagagcagcaggcgaggcctgctcgagtcaacggaggcaccgacgaggagaatggtgaagaactccagcaggtgaataatgagctgcagctggtcctcgataaagagaggaagtcccagggcgccggttctggccaagatgaagctgacgttgacccccagcgcccacctagaccagaagttaagattaccagccctgaggaaaatgagaacaaccagcaaaataaggattacgcagccgtcgcttag

SEQ ID NO: 185821 - DNA, 267 bp, Artificial Sequence
  Description of Artificial Sequence: Synthetic coding sequence
tgagtggtgatccacgagaagaaggtgagcagcttcgaggtgttcctcaaggaagtaacaggtggagtgcaggcaccatttggcgcagtccgaaatatttacacgcccaggacagggcatcgtattcggaagctggaccagattcaaagcggcggcaattatgtggctggcggtcaggaggctttcaaaaaactcaattatctggatataggagagattaaaaagcggcccatggaggttgttaacacagagcttcatgtgctctag

SEQ ID NO: 185822 - DNA, 363 bp, Artificial Sequence
  Description of Artificial Sequence: Synthetic coding sequence
atgagcggcagcagcgcccggagcagccacctgagccagcccgtggtgaagtcggtcttggtttacaggaacggggaccctttctacgccggacgacgcgtggtgattcatgagaaaaaagttagttcctttgaggtattccttaaggaggtgaccggaggagtacaggccccgtttggcgctgtgcgtaatatctacactccaaggactggccacaggatccgaaaacttgatcaaatccagagcgggggcaactacgttgccgggggacaggaggcctttaagaaactgaactatctcgatattggcgaaattaagaaacgccccatggaagttgttaataccgagctccatgtgctgtag

SEQ ID NO: 185823 - DNA, 1947 bp, Artificial Sequence
  Description of Artificial Sequence: Synthetic coding sequence
atgaagaagcccatctgcaagaccaccgagccctacgcccccgtgaggctcagggttctccagaatggcgaaaaaaataaaaatcggagtgtgaccattttagggcccgatatttcacccggccggaagactcaatgcaccgagatcctcaatttaccctctgccgctaggaggctgtacaatgagaaagggaaggaaatttttgctctgaaagacctgcaacgggatgaactggtttatgtctcctgtggtgaactgtggattaatcctgacttaagcatagcacagcagaagaaacaaatattcttgagaaacctcgagagcgatatcgccaagattcagatcttttgttcaacacataagatcgaggccctcgtgctggaagttcaatctgacattgtgagtggcagtaagctggctgtgcacaagcccgttgctatctttggagaagaaaagcaagttaccgagccagaggagaaacagatgcaggaggatcctctcactaccgaaaacgcttcttccgaaatcttagattctcatgtaagggcccatctgagaatgaaggcatgccatacccttcctcgttatgcgtggcaggagacttcccacgatttcgacgaggacgattccctgcctaagaaaacagaaaagggccttttcgagaatgttgagccccagaagaaacattcatgtagccccaagcacagtaaactgcacaagcattgtcatcagcagtttgagtaccgggatggtcagatcatctcacacgccgccccgcagctggtgttgggcgtgcagggccccaatctgagatcaggaatggaggttgtgctcgtggaaaagaagtccgatgggagccaccaaaggtggatccatcaggaagacagtcgcacctttcatttggtatctaaccccgatttagtcctcgccgtgtccatgaccaaaacccgcaatgaagtgtgcggttaccccgtaatagttcagaagtataagccgtacaataatggcgccgcgaatcagaagtggcactacatgaaaaatattaaggcactggtggcctttcattctacagccttagacaaggagatcacctcagctaactacgccggggtgtgtacgagttctgttattaaggaggagaacattgatcagccggggtattgttacttgtccccagatggtaagcgaaagaccatgctgtgcctggcctgcggccagtctatgagaaccgagaaaggactgaagcagctgctgcctggggtgccgtttttatgtattagtgggaccaaaacccagaaaccctttctccaggggcccttcaaggtcatttccgtggcggaagtcgatctatcatgcgacaaagccgaaaaaaccttgagctattaccaggcccgtctgctcagcttaagaatgaaaacgtgtacccaggctgcttcacactcaggcatggctgctacccatcagaaagctgttaagatcatagcctacaaaaacggggatggttaccggaatggcaagctcatcgtcgcaggcaccttcccgatgctactaaccgaatgcactgaacagcttggcctagctagagctgccagcaaggtctatactaaagatggcacaccaatatttaccctcagggatttggtattatgggccctggatgaatcattcctccagcgtgattccgagaagcagaaacaggatgctgctccggtcggcaaagagcaaataatcgtggaaaagaacccacgcatgaaagtgaaaaaccgcctctttgccaagtcagtaaccagcgacagcctggacggtatagacaagtccctactgactcttattttgcgaaaccctatcgccatctgggtctcatgtggagagcctttcttgccacctaacgagtctaggaaaatccgggagacggaactggccaagaaaggtcagaattttggctag

SEQ ID NO: 185824 - DNA, 1365 bp, Artificial Sequence
  Description of Artificial Sequence: Synthetic coding sequence
atgaagaacatcaaggccctggtggccttccacagcaccgccctggataaggagatcacgagtgctaattacgcaggcgtgtgtacaagcagcgtgatcaaagaggagaatatagatcagcccggctactgctatctgagtcccgacggaaagaggaagactatgctgtgcctcgcctgtggccaatcaatgcgaaccgaaaaaggcttaaaacaactcctgcctggggtgcctttcctctgtatcagtgggacaaagacacagaaacccttcctccagggacctttcaaagtcatctctgttgcagaggtggatctgagctgtgacaaagcagagaaaacgttgtcttactaccaagcccgcctacttagcctgcgtatgaagacttgcacccaggccgcatctcactctggtatggcggcgactcaccagaaggctgtaaagattattgcgtataagaatggggacggctataggaacggaaagctcatagtggccggcacattcccaatgctcctcaccgagtgtactgagcaactgggcttggcaagggccgcaagtaaggtgtacaccaaggatgggacgcctatctttaccttacgcgaccttgtcctctgggcgctcgacgaaagtttcctccagagggacagcgagaagcagaagcaagatgcagcccccgtgggcaaggagcagattatagtagaatctatggaagaaaacccccgcatgaaagtaaagaatcgcctgtttgctaagtctgtgacatctgatagccttgacggcatagataaaagcttgcttacattgatcctgcggaaccccatagcaatttgggtctcctgtggagaacctttcctgccacccaacgccctacaaaaggccgagaagctagagaagcagaactggctgaagaaagatagaatcctcgccgacctggacacgatgcggcacaagatgagacagttaaaggggagacgcgtcgctgcttgtcaacctgccactatggtaccaaccaagtcccccgtgcagcctgtagtcgtggaaggcggatggacggaacagacccagcaagaaatcaagctgatggaacttattcgacacaccgaagcccacctgtccgagatacaggagatggagtcaaaaatcaactttcctattgccaccaagcgcatcgcagtgaagccttccaacctgtataagcagccaaacaccaagagagtttggatctatctcaatggcggaagacccgaggatggcacttacgcctggggaaagacaatcagcgaggtgagcctcctttatcttaagacctggattttcatctggagtagaaaggtgttcttttatttcctgatcaccgcgtag

SEQ ID NO: 185825 - DNA, 2190 bp, Artificial Sequence
  Description of Artificial Sequence: Synthetic coding sequence
atgagcttcggccgggacatggagctggagcacttcgacgagcgggataaggctcagcgatatagtcgggggagcagggtaaatggactcccctctccgacccattcagcgcattgtagtttttacagaactcggacactacagaccctcagcagcgagaagaaggcgaagaaggtgcggttctaccgcaacggggaccggtatttcaaaggaatcgtttacgctattagtcccgaccgattcaggtccttcgaggctctcttggcagaccttacccgtaccttgagtgataatgtgaatttgccccagggagtccgaaccatctacacaatagatgggttgaagaaaatctccagcttagaccaactcgtggaaggagaatcttacgtctgtgggagtatagaaccattcaagaagctggaatataccaagaatgttaaccccaactggtctgttaatgtgaagactacaagcgctagtcgggctgtcagttcgctcgcgacggccaagggaagcccctctgaggtgagggagaacaaagattttataaggcctaaactcgtaaccataatccgctcgggagttaagcctagaaaggccgtgcggatcctattaaacaagaagaccgcccattccttcgagcaggtgttaacagatattacagatgctattaaactcgacagtggggtagtgaagaggctgtacacactggatggcaaacaggtaatgtgcctgcaagacttctttggcgacgatgatatctttattgcctgcgggccagagaagtttcgttaccaggatgactttttgctggatgaaagtgagtgtagagtggtcaaaagtacatcctacaccaaaatcgcctcatcgtctaggcggtctaccaccaaaagccccgggccctcccggaggagcaaaagccctgcatctacttcctctgtcaacggaacgcctggctcacaattgtccaccccccggtcagggaagagccccagtccaagtcctacgtctcccggtagcctgcggaaacagcggtcaagccagcacggaggttccagtaccagtctggcaagcactaaggtgtgttcctccatggacgaaaacgacgggcccggcgaggaagtgagcgaagaagggtttcaaatccccgccactattaccgaacgatataaggtcggcaggacgattggtgatggtaattttgccgttgtcaaggaatgcgtggaacgtagtactgcgcgcgagtatgcgctcaagattatcaagaagtctaaatgcaggggtaaagagcatatgatccaaaacgaggtgtctatactgaggcgagtgaagcacccaaatatagtactgttgattgaggagatggacgtacccacagagctgtaccttgtgatggagctcgtgaaaggaggagaccttttcgacgccattacttccaccaataaatataccgagagggatgcatcaggcatgctctacaacctggccagtgcaataaagtaccttcactccctaaacatcgttcacagagatattaaacccgaaaatctgctagtgtacgagcatcaggatggcagcaaatctctgaagttaggtgacttcggtcttgccacaatcgtcgacggccctctctacacagtgtgtggaacacccacatatgttgcgccagagatcatcgccgagaccggctatggcctcaaagtcgatatttgggccgcaggtgtgataacctacattttgctctgtggattcccccctttccgagggagtggggacgatcaagaagtgctcttcgaccagattctgatggggcaagtggactttccttccccgtactgggataacgtctctgacagtgcaaaggagttgatcaccatgatgctactcgtggatgtcgaccagcgcttctctgccgtgcaagtccttgagcatccttgggtgaacgacgatggcctgcctgagaatgagcaccagcttagcgtggctggaaaaatcaagaaacactttaacacagggcccaagccaaatagcaccgcagctggtgttagcgtgatagcacttgatcacggtttcactatcaagcgaagtggtagcctggattattaccaacagcccggcatgtattggatacggccacccctactgataagaagaggccgtttttccgatgaggacgctacgcgcatgtag

SEQ ID NO: 185826 - DNA, 2223 bp, Artificial Sequence
  Description of Artificial Sequence: Synthetic coding sequence
atgagcttcggccgggacatggagctggagcacttcgacgagcgggacaaagcccaaaggtattccagaggcagcagggttaacggcctaccctcccccactcactcggcccactgttcgttctaccgaactcggacattacagacgctctccagtgaaaagaaggccaaaaaagtgcgtttctatagaaatggcgataggtactttaaaggcattgtgtatgcgatctcccctgacagatttcgttcctttgaagccttgttagccgatttaacacgcacgctgagcgataacgtgaacttacctcaaggcgtaaggactatctacaccatcgacgggctgaaaaagatcagctccctcgaccaattggtcgagggagagagctacgtgtgcggaagtatcgagcctttcaaaaagctggagtatactaagaacgtgaatcccaattggagcgtgaacgtaaagacgacctccgcatctagagcggtatcttctcttgcaaccgctaaaggatctccctccgaggtgcgagaaaacaaagactttataaggcccaaattggtgacaatcatccggtccggggttaaacccagaaaggccgtgagaatcctactgaataagaagactgcccactcattcgagcaggttttgactgatataactgacgcaataaaattggattctggagtggtcaagcgcttatatacgctggatggaaagcaggtcatgtgccttcaggatttttttggtgatgacgacattttcattgcttgtggcccagaaaagtttaggtaccaagacgactttctgttggatgaatcagaatgcagagtggttaagagcacctcatataccaagattgcaagttctagtcgtcgctctacaaccaaaagtccaggaccttccagaaggagcaaatcccccgctagcacatccagcgtgaacggcacacccggcagccagctttcgacgcccagaagtggcaaatccccaagcccctcgccaacaagccccgggagcctcaggaaacagcgatcttcccagcatggcggctccagcaccagtcttgcctcgacaaaagtgtgttccagcatggacgagaacgacgggcctggcgaggaggtttcagaagagggttttcagatcccggctacgataaccgaacgctacaaagtagggaggactattggcgatggcaattttgctgtggtgaaagaatgtgttgagagatctactgctcgagagtacgcacttaaaatcattaaaaaaagtaagtgcagagggaaggaacacatgatacaaaatgaagtcagcattcttagaagggtaaaacaccccaatatagttctgctgatcgaggaaatggacgtgcccactgagctgtacctcgtgatggaattagtcaagggcggggatctgtttgacgctatcaccagcaccaacaaatacactgagagagatgcctctggtatgctctataatctggcctccgctatcaaatatttgcacagccttaacatagtgcaccgggacattaaacctgaaaatctgcttgtttatgaacatcaggatgggagtaagagcctaaaactaggcgactttgggctggcgaccatagttgatggcccattatacacagtctgcgggacccccacatacgtcgcgccagagattatagcagaaactggctatggactgaaggtggacatctgggccgccggcgtcatcacttatatcctcctgtgtggctttccacctttccgcgggtctggcgatgatcaggaagtcctgtttgatcagatcctcatggggcaggtagatttccccagcccctattgggacaacgtgagcgatagcgctaaagagctcattaccatgatgcttctggtagatgtggatcaaaggttcagtgctgtccaggtactcgagcacccctgggtcaacgacgatgggctgcctgagaatgagcatcaactatccgtcgccggcaaaatcaagaagcatttcaacacaggacccaagcccaattcaactgctgctggagtatcggtgatagcaaccacggcgctggataaagagaggcaggtgtttcgtcgaagaagaaaccaggacgtgagaagtagatacaaggcgcagcctgcgcccccagagttaaattccgaatccgaagattatagcccctcttcaagcgagaccgtgcgcagcccaaactcacccttctag

SEQ ID NO: 185827 - DNA, 1092 bp, Artificial Sequence
  Description of Artificial Sequence: Synthetic coding sequence
atgagcttcggccgggacatggagctggagcacttcgacgagcgggataaggcgcagcgctatagcagaggttccagggtcaacggactcccctctccaactcacagcgcgcactgtagcttttataggactcggacgcttcagaccttgtcctctgaaaagaaggcaaagaaggtccgtttttacaggaacggggaccgttactttaaagggattgtgtacgccatctcccccgaccgtttccggtctttcgaggccctcctagccgaccttactagaacgctcagcgataatgtcaatctgcctcagggcgtgagaacaatctacactatcgatgggctcaaaaaaattagttctttggatcagctagttgagggcgaaagttacgtgtgcggctcaatcgagccgttcaaaaaacttgagtatactaaaaacgtaaaccccaattggtccgtgaacgttaagaccacgagcgcctctcgagctgtgagcagcttggcgaccgcgaaggggagcccatccgaggttagagaaaataaggacttcattaggccgaagctggtcacgatcatacggtctggagtaaagcctcggaaggctgttagaatactgttgaataagaagaccgcccacagcttcgaacaggtcttaacagacatcaccgatgcaataaagctggattccggtgtggtcaagcggctctacacccttgacgggaaacaggtgatgtgtctgcaggatttctttggggatgatgatatttttattgcttgcgggcctgagaagttccggtatcaagatgactttctgctggatgagtctgagtgcagagttgtaaagtctactagctataccaagatcgctagctcctctaggagaagcacgactaagagtcccggaccatctcgcaggtccaagtcaccagcctccacctccagcgtcaacgggacaccagggtcccagctgtcaactccacgaagcggaaaatccccctccccaagcccaacctcgcccggaagcctgcgtaagcagagggatctctatcggcccctgtcaagtgacgatctcgactcagtgggcgatagcgtttag

SEQ ID NO: 185828 - DNA, 1302 bp, Artificial Sequence
  Description of Artificial Sequence: Synthetic coding sequence
atgctggagctgatcgaggtgaacggcacccccggcagccagctgagtactcctagatctgggaagtcgccaagtccctcccctacctctcccggttccctgcggaaacagcggagctctcagcatggcggttcttccacatctctggcctccactaaggtctgttctagtatggacgaaaacgatgggcccggagaagaggtgtccgaagaaggttttcaaataccggccacaattacagagcgttacaaggtggggaggacaattggtgatggaaattttgccgttgtcaaggagtgtgtggaacgatccacagcccgggagtacgccctcaaaatcattaaaaaaagcaagtgtcgggggaaagagcatatgatacaaaacgaggtttcaattttgaggcgggttaagcaccccaacattgtcctgctcattgaggaaatggatgttccaacagaactttatctggtgatggagcttgtgaagggcggggatttgttcgacgccatcacgagcaccaataaatacactgagcgggatgctagcggtatgctgtataacttggcatccgccattaaatacctgcacagccttaatatagtccatcgtgacattaagcccgaaaaccttctcgtgtacgaacaccaagacgggagtaaatcattgaaactgggcgactttggcctggccactatcgtggatggcccactgtacactgtctgcggaactcccacctacgtcgcccctgagataatcgccgagaccggctatggcctgaaagtcgatatttgggcagccggtgtaattacatatatcctgctttgcggcttcccaccgtttagaggatctggagacgatcaagaggtgctgttcgaccagatattgatgggccaggtggacttccccagcccctattgggacaacgtgagtgactcagcaaaggaacttatcactatgatgctacttgtcgacgtggatcagcggttttccgcagttcaggttctcgagcatccatgggttaacgatgacggactccccgaaaatgagcatcaacttagtgtcgctggcaagattaaaaaacactttaatactggtcccaagcctaattctacggcagcgggtgtgagtgttatcgccaccactgccctggataaagagagacaagtttttaggagaaggcgaaatcaggatgtgcgaagcagatacaaggcacagccagcacccccagagttgaattccgaaagtgaggattattcaccatcttcctctgagactgtgcgctcacctaattcacccttctag

SEQ ID NO: 185829 - DNA, 1266 bp, Artificial Sequence
  Description of Artificial Sequence: Synthetic coding sequence
ctgagcctgatcaagttcaacggcacccccggcagccagctgagcacgcctcggagtggcaagtctccttctccaagccccactagccccggtagcctcagaaagcagcgctcttctcaacatggcggcagttcaacaagcctggcatctaccaaggtttgcagttctatggacgaaaacgatggccctggggaagaggtgtccgaagagggcttccaaatccccgctacaatcaccgagaggtacaaggttgggaggactatcggcgacggcaactttgccgtggtgaaggagtgcgttgagcgctcgaccgcccgggagtacgctctcaagattataaaaaaatcaaagtgcaggggcaaagagcacatgatccaaaatgaagtttccatcctacgacgggtgaaacatcccaatatagtgcttcttatcgaggagatggacgtgccgaccgagctctacctggtgatggaactggtgaaaggtggtgacctctttgacgcaatcaccagcaccaacaaatataccgagagagatgcatctgggatgctgtataacctggcgagcgcgataaagtacctccattcacttaatatcgtgcaccgcgacatcaaacctgagaacctacttgtctatgaacatcaagacgggagcaagtcgctcaaactgggtgacttcggcctcgcgactatagtggacggaccactgtatacagtatgtggtacccccacttacgtcgctcctgagataatcgcagaaacaggctatgggctcaaggtcgatatttgggccgctggtgttataacctatatactcctgtgcgggttccctcccttccggggctctggagacgatcaggaggtgctgtttgatcagattctgatggggcaggtagattttccttccccgtactgggataacgtgagcgactcagctaaagagctgattactatgatgcttctagttgatgttgatcagcggttcagcgcagtacaggttctggagcacccttgggttaatgatgatggactccccgagaacgagcaccagctctccgtggccggaaagatcaaaaaacattttaatacaggtcccaagcctaactccacggccgcgggagtatccgtcatcgccttggatcacgggttcactatcaagaggagcgggagtctggactattaccaacagccagggatgtattggatccgccctccgctgctgattcgaaggggacgattttcggatgaagacgcaactagaatgtag

SEQ ID NO: 185830 - DNA, 1860 bp, Artificial Sequence
  Description of Artificial Sequence: Synthetic coding sequence
atgagcttcggccgggacatggagctggagcacttcgacgagcgggacaaagctcagagatactctaggggtagtcgggtaaatggactgccaagcccaactcattccgctcattgcagcttctacagaactcgaacactccagacattgtcctcggaaaagaaagccaaaaaagtgagattttatcgcaatggggacagatattttaaaggcatcgtttatgcaattagtcccgaccgtttcaggtcattcgaggccttgctcgctgacctgacaaggaccctgtctgacaacgtgaatttacctcagggcgtgcggacaatttacacaatcgatggcttgaagaagatcagttcacttgaccagctcgtggaaggagaatcatacgtgtgcgggtccattgagccttttaagaaacttgaatacacaaagaacgtcaaccccaattggagtgtcaacgtgaaaactacttctgcttcaagagctgtgagcagcttggctacagcgaaggggagtccctccgaggtgcgagagaataaagacttcatacggcccaaactggtgactatcattaggagcggcgtgaagccacggaaggcagtgagaatcctgcttaacaaaaagacagcccattccttcgagcaggtgcttacagatatcacagacgcaattaagttggattccggagtggttaagcgcctctatacattagacgggaagcaggtgatgtgtctgcaggactttttcggtgacgatgacatattcatagcatgcgggcctgagaagttcagataccaggacgacttcttactggacgagtccgaatgtcgcgtcgtgaaatctacatcatataccaaaatcgcctcctcaagccgacgctcaacaaccaagtcaccaggccctagtcgacgctccaaaagcccagctagcacaagctctgttaacggtacacctggttcgcaactttctaccccgcgtagtgggaagagtccctccccctcacctaccagtcctggttcgctcagaaaacagcgtagctcccagcatggcggatcttcaacttcgcttgcttcaaccaaggtgtgtagcagtatggacgagaacgatgggcctggtgaagaagtctcagaggagggttttcagattcctgccactatcacagagcgatataaggtgggccgcaccatcggcgatggaaatttcgctgtcgttaaagagtgtgtcgagaggtccacggctagagagtacgctctgaagatcatcaagaaatccaagtgccggggtaaagagcatatgattcaaaacgaggtcagtattcttagaagggtgaaacatcctaatatcgtgttactgatcgaggagatggacgtgcctacagagctgtacttagtgatggagctggtcaagggaggcgacttgtttgacgctataactagtacaaacaagtatctccattctcttaacattgtgcatagagacataaaaccagagaacctgttggtatacgagcaccaggatggatcgaaatcgctcaaactcggcgattttggactagcaactattgtggacggcccactttacacggtgtgcgggacacctacgtatgtggctcccgaaatcattgcggagactggatatggccttaaggtcgacatatgggcagctggagtgattacctatattctcctgtgtgggttccctcccttccggggcagtggggatgaccaggaagtcctctttgaccagatactgatgggtcaggtggattttcccagtccatattgggacaacgtcagcgatagcgccaaggaactcattacaatgatggcctctcagaaaatgaatattagctgtcaatag

SEQ ID NO: 185831 - DNA, 2301 bp, Artificial Sequence
  Description of Artificial Sequence: Synthetic coding sequence
atggccagcacccggagcatcgagctggagcacttcgaggagcgggataaacggcccagaccgggctcccggcgcggtgcacctagctcatccggaggaagcagttcaagcgggccaaaggggaacgggttgatcccttctcccgctcattcggcacattgcagtttctaccggactagaacacttcaggctctatcttctgagaagaaggcgaagaaagcacgattctaccgtaacggagatcgctatttcaagggattggtgttcgcaataagttctgacagattccgcagcttcgatgctctgctgatcgagctgaccaggtccctgtcggataacgtgaatctcccacagggagtgcgtaccatctacacgatcgatggctctcgcaaagtaacaagtttggatgagctgttggaaggcgagagctatgtctgcgcctctaatgagccctttcggaaggtagattacactaaaaatatcaatccgaactggtccgtgaacatcaaagggggtacatcccgcgcactggccgcagcctcatcagtaaagagcgaagttaaagagagcaaggattttataaagcctaaactggtgactgttattaggtctggagttaaacctcggaaggcagtgcgcatcttgttaaacaaaaaaaccgcccacagcttcgagcaggtattaactgacattaccgaagctataaagttggactccggtgtggtcaagcgtttatgtactctcgacggtaagcaggttacctgcttgcaagacttctttggagacgacgacgtctttattgcatgtggtccggaaaaattcaggtacgcgcaagatgactttgtgcttgaccactctgagtgtcgtgttctgaaatcgagctactctagaagtagcgctgtgaaatacagcggatcaaaatctccaggaccatcacgtcgttctaaaagtccggcttccgtcaacggaacacctagcagccaactcagcaccccaaagtctacaaaaagctcttcaagttccccaacatcccctggaagctttaggggtctgaagcagattagcgctcatggaagaagtagttccaacgtgaacggcgggcctgagcttgacagatgtatcagccctgaaggcgtaaacgggaatcgctgctcagagtcatcgactctgctggagaagtataagattgggaaggtgattggggacggcaatttcgctgtggtgaaagagtgtatcgataggagcaccggcaaggagttcgcactgaaaatcattgataaggctaagtgctgcggtaaggagcacctgattgaaaacgaggtgagcatccttagaagagtgaaacatccaaatatcattatgctggtggaagagatggagacggctactgagttatttttggtaatggaactggtgaagggcggcgacctgtttgatgcgatcactagcagcacgaaatatacggagagagatgggtctgctatggtttacaacctcgcgaacgccctgcggtatcttcacgggctcagcatcgtgcaccgagatattaaacccgagaatctgttagtctgcgagtaccctgacggcaccaagagcttaaaactgggagactttggcctggctacagttgtcgagggcccactatacacagtgtgcggtacacccacttatgtggcaccagagatcatcgcggaaacaggatacggcctgaaagtcgatatctgggccgcaggcgttatcacctacatcctgctctgtggatttccccccttccggagcgagaataacctgcaggaagaccttttcgatcagatccttgcgggcaagctagagttccccgccccatactgggacaacattaccgactctgccaaggagcttatttcccagatgcttcaggtgaatgttgaagctaggtgtaccgcaggacaaattttgtcccacccctgggttagtgacgacgcgtctcaggaaaataacatgcaggcagaggtaaccgggaagctaaagcagcactttaataatgcgttgccaaagcaaaactccacaacaaccggcgtctctgtgatcatgaacacagccctggacaaggagggacagatcttctgcagcaaacactgtcaagacagtggtcggccaggaatggaaccaataagtccagtaccaccatccgttgaagagatccccgtccccggggaagctgtccctgctcccactcctcctgagtctcccacaccccacccacccccagccgcccccggaggggagcgcgcaggcacgtggcggcgccacagagattag

SEQ ID NO: 185832 - DNA, 2352 bp, Artificial Sequence
  Description of Artificial Sequence: Synthetic coding sequence
atggccagcacccggagcatcgagctggagcacttcgaggagcgggataaacgccctcgtcctggaagcaggaggggagccccctcctcaagtggtggatcttcttcctctgggcccaagggcaatggcttaataccaagtcctgcacatagcgcccactgcagtttctatcgcactcgaactctgcaggcactgagttctgagaagaaggcaaagaaggcaaggttctacaggaatggcgatagatactttaaaggtctggtgtttgcaatctcatctgatagatttcggtccttcgacgctctgctcatcgagctgacacgatccctttccgacaacgtcaacctgcctcagggcgttagaaccatttacactattgatggcagtcgtaaagtaacttctttggacgaactgctggagggagaaagctatgtctgtgcttccaatgaacccttcaggaaggtggattacaccaagaatataaatccgaactggtcagttaacatcaagggaggaacctctagggcgctggcagccgcctcaagtgttaagtccgaagtcaaggaatcaaaagattttattaagccaaaactcgtgacggtgattcgtagcggagtaaaaccacggaaagcagttcgtatactgctcaataaaaagaccgcacattcatttgagcaggtcctgacagacattacggaagctataaagttggactctggtgtggtgaagcgcctctgcacactcgatggtaaacaggttacttgcctgcaggacttttttggagatgatgacgtttttatcgcttgtgggcccgagaagttccggtatgcccaggatgatttcgtgctcgaccactctgagtgtcgagtgttaaaaagctcttatagcaggtcatccgcagttaaatacagcgggagtaaatccccaggaccgtcaaggcgtagcaagagccctgctagcgtgaagagaggggggcactacagttctgcctactctacagccaagtctcctgtgaatgggacaccttcgtcgcagctgtcaacgcctaaatccacaaaatcctcatcaagctccccaacgagcccgggatcttttcgaggcctgaaacagatttccgcccacggaagaagcagcagcaatgtgaacggaggtcccgagctcgacagatgtattagccctgagggcgtcaacggtaacagatgttccgaaagctcgacactgctcgagaaatataaaatcggcaaggtcattggcgacggaaatttcgctgttgtcaaagagtgcattgataggtccactggtaaagagttcgctctcaagatcatcgataaggctaaatgctgcggtaaagagcatttgatcgagaacgaagtgtctatcctaaggcgcgtgaagcatcctaacattatcatgctcgtggaagagatggagactgcaacggaattgttcctggtgatggagctggtgaaagggggggatctgttcgacgctattactagctcaaccaaatatactgagcgagacgggtctgctatggtgtacaatctggcaaatgcactgagatacctgcacggcctgtctattgtgcatcgagacattaaacccgaaaatttgctggtctgtgaataccctgacggtaccaagtccctcaaacttggggattttggcctcgccacagttgtcgagggacctttatataccgtgtgcggaacccccacatatgtggcacccgagattattgccgagaccggctatggattgaaagtcgatatctgggctgctggtgtgatcacctatatcttgctgtgcggattccctcccttcaggagcgaaaacaacctccaggaggacttgtttgaccaaatccttgccggtaaactggaattccccgctccttactgggacaatattaccgactccgcgaaggagctgatctcacagatgctgcaggtcaatgtcgaggcccgctgtacagccggacaaattttgtcgcacccctgggtgtccgatgacgcatcccaggagaataatatgcaggccgaggtcaccggcaagttgaaacagcactttaacaatgccctgcctaagcagaatagcaccacaacaggagtctcggtaattatgaataccgccctggataaagaaggccaaattttttgttctaaacactgccaagactcgggacgccccggaatggaaccgatcagccccgtgccaccatctgttgaggagattccagttccgggcgaggccgtccccgcccctaccccacctgaaagccctactccccacccaccaccggccgccccgggaggggaacgcgcagggacttggcgacgccaccgggattag

SEQ ID NO: 185833 - DNA, 2298 bp, Artificial Sequence
  Description of Artificial Sequence: Synthetic coding sequence
atggccagcacccggagcatcgagctggagcacttcgaggagcgggataaacgacctagacctggaagcagacggggcgcgccatcatcaagcggaggctcctcaagctctggcccgaagggcaatgggctcattccatcacccgcccactctgcacactgttctttctatcgtactcggacacttcaggccctatcttcggagaagaaagctaagaaagccagattctataggaacggagatcggtatttcaaaggactggtcttcgccataagctccgatcgctttcggtccttcgacgctcttcttattgagctgacaaggtccctctccgacaacgttaaccttccacagggcgtccgtactatatataccatagacggcagccgaaaagtgacctccctggacgagctcttggaaggagagtcatatgtgtgcgctagtaacgagccctttcgaaaggtggactacacgaagaacatcaacccgaactggagcgtcaatattaagggcggaacatcacgagcattggctgcagcctcttccgtaaaaagcgaagtgaaggaatccaaagactttattaagccgaagctggtgacagttattcgctcaggtgtgaaaccccgtaaggccgtgaggattcttttgaacaagaaaacagctcatagttttgagcaagttctgaccgatatcactgaggcaataaagctcgactctggtgtcgtgaagagactttgcaccctagatggtaagcaggttacgtgcctgcaagatttcttcggcgatgatgatgtgttcatagcgtgtggccctgagaagttcaggtatgctcaagacgactttgtgctcgaccactccgaatgtagagtgttaaagagttcatatagccgatcttcagccgtgaagtatagcgggtccaaatcccctggtccttcccgcaggtccaagtcccctgccagcgtcaatggcacacctagttcacagctatccacaccgaaatccactaaaagcagtagtagttcccctacgtcccccgggtcattccgagggcttaagatcagcgctcacgggcggagctcgtctaatgtcaacgggggccctgaactggaccggtgcataagtccagagggggtgaacggcaatcggtgcagtgagagtagcacacttctggaaaagtacaaaatcggcaaagttatcggggatgggaatttcgcagttgtgaaggagtgcattgatcggtccacaggcaaggaattcgccctgaaaatcatcgataaagcaaagtgctgtggaaaagaacatctgatcgagaatgaagtttccatcctgaggcgcgtgaagcaccctaatatcattatgcttgttgaggaaatggaaaccgcaacggaactgttcctggtgatggaactggtgaaaggcggggacttattcgacgcgattaccagctctacaaaatatactgaacgcgatgggagtgccatggtatacaatctggcgaacgctctgcgctatctgcacggcctgtcaatcgttcacagggacatcaaaccagaaaacctccttgtttgcgaataccctgacggtactaagagcctgaagctcggagacttcggactggccacagtcgtcgaaggaccactttacaccgtctgcgggactcccacctatgtagcccctgagattattgcggaaactgggtacggcctcaaggtcgacatctgggctgccggggtgattacctatatcctgctgtgtggtttccccccttttagatctgaaaacaatctgcaagaggacctcttcgatcagattctggcaggaaaacttgaatttccggctccatattgggataacattactgacagcgccaaggaactaatcagtcagatgcttcaggtcaatgtggaagctcgatgcactgcaggacagatcttgtcacacccctgggtctctgacgatgcaagtcaggaaaacaacatgcaggcagaagtaaccggaaagcttaaacagcacttcaacaacgctctgccaaaacagaacagcaccacaaccggagtttcagtgattatgaacactgccctggacaaggagggccagatcttttgcagcaaacattgccaagactcaggtcggccgggcatggaacccatcagccccgttcctcctagtgtagaggaaattcccgttcctggggaagctgtgcccgcacccactccaccggagagcccaacaccccatcctcctcccgcagcgcctggaggcgagagagccgggacttggcgccgccatagggactag

SEQ ID NO: 185834 - DNA, 1947 bp, Artificial Sequence
  Description of Artificial Sequence: Synthetic coding sequence
atgggcaaggagcccctgaccctgaagagcatccaggtggccgtggaagagctgtatccaaacaaggcacgagctctcacccttgcacaacacagcagagccccctcaccacgcctgagatccagattgttctccaaggccctgaaaggagaccatcgctgcggagagacagaaacacccaagtcctgtagcgaggttgctggctgcaaagcagccatgcgtcaccaggggaagatccccgaagaactatcgctcgacgatcgagcacgtacccagaaaaagtgggggcgcggtaagtgggagcctgagccttcctcgaagccacccagagaggccacattggaagaacgacacgcgagaggcgagaagcacctgggcgtcgagatcgagaaaacatcgggcgagatcattcgatgcgaaaagtgtaaacgggaacgcgaacttcagcaaagccttgaaagagaaagacttagtctgggcacatcggaattagatatgggaaagggcccgatgtatgacgtggaaaagctggtgagaaccagaagctgcaggcgcagtccagaggccaaccccgcgtctggcgaggaagggtggaaaggagactctcatcgttcttctccgaggaacccaactcaggagctccggaggccatcaaaatcaatggataagaaagaggacaggggtcccgaggaccaggaaagtcatgcacaaggtgccgcaaaggcaaaaaaagatctggtcgaagtcctaccagttacagaggaaggacttagggaggtgaagaaggacacacgaccgatgagccggtctaaacacggagggtggttgctgcgtgaacatcaggcggggttcgaaaaattacgacggactaggggcgaagagaaggaggccgagaaggaaaaaaaaccttgcatgtcaggaggtcggaggatgacactgagggacgaccagccagccaagttggaaaaggagcccaaaacccgacccgaagaaaacaaacctgaacggccgtccggccgaaaaccacggcctatggggatcattgccgcaaatgtcgaaaagcattatgagaccggacgagtgatcggcgatggaaattttgctgtagtgaaggagtgcagacatcgggagacccggcaggcatatgcaatgaagatcatcgataaaagtaggcttaagggtaaagaggatatggtggatagcgaaatattaattattcagagcctgagtcaccctaatattgtgaaactgcacgaggtgtatgagacagacatggagatatatctgattttagagtacgtccaaggaggtgatcttttcgacgccattatcgaaagtgtcaaattcccagagccggacgctgctctcatgatcatggacctatgtaaggccctggtgcacatgcacgataaaagcatagtgcacagggaccttaagccagaaaacctgctggtgcagcgaaacgaagacaaatcaaccacactgaagctcgctgactttggccttgctaaacacgtagtgaggcccattttcactgtttgcggaacacctacatacgtagcacccgagattctgtccgaaaaaggatacggccttgaggttgacatgtgggctgcaggcgttattctttacatcctgctgtgcggctttcccccttttaggtccccagagcgcgaccaagatgaattgtttaacattatccaactgggccacttcgaattcctacctccatattgggataacatcagcgacgctgccaaagacctcgtctctcgcctgctcgtagtagacccgaagaagcggtataccgcacatcaggttttacagcacccatggattgagacagctggcaaaacaaatactgttaaacgtcaaaaacaggtctctccctcctctgaggggcactttcgctctcaacacaaacgggttgtggagcaagtgtcatag

SEQ ID NO: 185835 - DNA, 1122 bp, Artificial Sequence
  Description of Artificial Sequence: Synthetic coding sequence
atgcccaacgacgaggccttcagcaagcccagcacccccagcgaggcacctcatgcacccggagtgcccccccagggtagagccggaggcttcgggaaggcctccggagccctggtgggagctgcaagcggctcctcagccgggggatcgagtcgaggtggcgggagcggctccggcgcctcggatctcggggctggaagcaagaagagcccgcgcctcccaaaatgtgcaaggtgcagaaaccacgggtacgcctcaccattgaaaggacacaagcgtttctgcatgtggcgtgattgccagtgcaagaaatgtaatttgatcgccgaacggcagcgcgtgatggccgctcaagtggcactacgccgccagcaggcccaggaagaggagctcggcatctcacatcccatccctctgcccagcgccgcagagctgctggttaagcgcgaaaataatgggtctaacccttgcttaatgaccgagtgctcaggcacttcccagcctcctccggcatccgtgccgacaactgcggctagcgaaggtcggatggtgattcaggacattccagccgtcaccagtcgtggccacgtcgagaacactcccgacttggtctccgatagcacctactacagtagtttttaccagccttctctcttcccatattacaacaacctctataattgccctcagtacagtatggcccttgccgctgacagcgcaagcggcgaggtgggtaatccactaggggggtctccggtgaagaatagcttgcgaggtcttcccgggccgtacgtgcccgggcagactgggaatcagtggcagatgaagaatatggagaatagacacgccatgagctcccagtataggatgcattcatattatccacctcccagctacctcggccagtctgtgccccaatttttcacgtttgaagatgcgcctagctaccccgaggcacgggcctcagtcttctctcctccatccagtcaggactcaggcctggtgagcctgtcttccagcagccccatttccaataaatcaaccaaagcggtgttagaatgcgagcctgcctccgagccaagcagctttacggtcacaccagtcatcgaggaagacgagtag

SEQ ID NO: 185836 - DNA, 525 bp, Artificial Sequence
  Description of Artificial Sequence: Synthetic coding sequence
atgcccaacgacgaggccttcagcaagcccagcacccccagcgaggcaccacatgcccctggagtgccaccacagggacgagctggcggctttggcaaggcatcaggcgctctggtgggagctgctagtggttcatctgcgggaggaagctcacgtgggggtggctctggttccggtgcctctgatttaggtgcgggctccaaaaagagcccccggctgccaaagtgcgcacggtgtcgcaatcacgggtacgcctcacctttgaaaggtcacaagcgattctgcatgtggcgggattgccaatgtaaaaaatgtaacctgatcgcagaacggcaacgggtcatggctgcccaggtgggcgcaggggtgagagaacccggatttagtttatccttctttttcttttttttttttagatggtctctggcacgcctgcccagattgcagtgctcaggtgccatcttagcccactgcaattccgcgtccagggtacaggctatactcctgccccagccccccaaatag

SEQ ID NO: 185837 - DNA, 681 bp, Artificial Sequence
  Description of Artificial Sequence: Synthetic coding sequence
atggccgacccccaggccggcagcgccgccggcgactgggagatcgatgtagaatctctcgaactcgaggaagatgtgtgtggcgctcccagatccaccccccccggcccaagtcctccgcctgccgacggggactgcgaggatgacgaggacgacgacggagtggacgaagatgcagaggaggagggggacggcgaggaagctggggcttcaccaggaatgcctggccagccagagcagcgcggagggccccaaccccgaccccccttagccccgcaggcatctcccgctggcaccggacctagggagaggtgtacccctgccggcggtggcgccgagccaaggaagctgtccagaaccccgaagtgcgcccgttgccgtaaccatggggtggtgtcatgcttaaaggggcataagagattctgtcggtggagggactgccagtgcgctaactgcctgttagttgtggagcgacaaagagtcatggctgcccaggtcgccttgaggagacaacaagcaacagaggataaaaaggggctgagtggtaagcagaacaatttcgagaggaaagccgtttaccaacggcaggtgcgagcaccttcactgctggcgaaaagcatcctggaggtgttgttaggcctattttactcctattacgtgtatattatgaaccacttgtag

SEQ ID NO: 185838 - DNA, 1686 bp, Artificial Sequence
  Description of Artificial Sequence: Synthetic coding sequence
atggccgacccccaggccggcagcgccgccggcgactgggagatcgatgtggaatccttggaactagaggaggatgtgtgtggtgcccctcgttccacaccacccgggcccagcccccctcccgccgatggcgattgtgaagatgacgaagacgacgacggagtggacgaggatgcagaggaagaaggtgatggggaggaggcaggagcaagtccaggcatgcctggccagcccgagcaaagaggcggtccccagccccgccccccccttgctccccaagctagccccgcagggacaggaccacgagaacgatgcacccccgctggggggggcgcagagccccgtaagcttagtaggactccgaagtgcgcccggtgcaggaatcacggcgtggtttcatgccttaagggacacaagaggttctgccgctggcgggactgccagtgtgctaattgcctgttggtagtggaacgtcagcgcgtcatggcagcccaggtggccttgcggcggcaacaggccaccgaagataaaaagggtctcagcggaaagcaaaacaatttcgagcgcaaagctgtataccagcgtcaagtcagagctccatctctcttagccaaatccatcctggagggataccgccctattcctgcagaaacctacgtcggaggaactttccccttgcccccgcccgtgtctgacagaatgagaaagcggagagcattcgccgacaaggaactggaaaacatcatgctggagcgggaatataaggaaagggagatgctcgagaccagtcaggccgccgccctttttcttcctaatagaatggtgcccggacccgattataatagctacaaatctgcttactcacccagccccgtggagcctccctccaaagacttctgtaactttctccctacatgcctggaccttactatgcagtactctggttctggcaacatggaactgatctcgtccaacgtgagtgtagccaccacatatcgacaatatcctttgagctctaggttccttgtgtggcccaagtgtggccctatttccgacacccttctttatcagcagtgcctcctcaacgccaccactagcgtgcaagcgcttaagcccggagctagttgggacttgaagggtgccagagttcaggatggtctgtctgcggagcaagacatgatgccttctaagctggagggctctctggtcctgccacatacccctgaaatccagaccactaggtccgacttacaagggcaccaggctgtgccagagcggtctgccttttccccacctagacgaaacttctctccaatcgtcgatacggattccctcgcagcgcagggccatgtgcttaccaaaattagcaaggagaacacgaggcaccccctccctttgagacataacccatttcacagtttatttcagcagaccctcaccgataagtccggccccgagctgaagacaccatttgtaaaagaagctttcgaggagactcctaagaagcatcgggaatgtcttgtgaaggataaccagaagtacacatttaccatcgaccgctgtgcgaaggacctgtttgtggcgaagcaggtgggcacaaaactgtctgttaacgaacctctctcattttccgttgagagcatactgaaaaggccttcctcagcaattacaagagtttcccaatag

SEQ ID NO: 185839 - DNA, 1686 bp, Artificial Sequence
  Description of Artificial Sequence: Synthetic coding sequence
atggccgacccccaggccggcagcgccgccggcgactgggagatcgatgtcgagagtctggagttggaagaggatgtctgcggagccccccgatcaacgccaccaggcccctccccccctcctgctgacggagattgtgaggacgatgaggacgacgatggagtggacgaagacgcggaggaggaaggcgatggcgaagaagctggagcctcaccgggcatgccaggccaacccgagcagagagggggtccacagccccgcccgcctctggctcctcaagcgagccccgccgggacagggcccagggagagatgcacaccggctggagggggagcagagcctaggaagctgtctcgaactccaaagtgtgcgcggtgtaggaatcatggggtcgtaagttgcctgaagggccacaaacgtttttgcagatggcgcgactgtcagtgtgccaactgtctgctggtggtcgaacgacagcgggtcatggctgcccaggtcgccctgcggagacagcaagccacggaggacaaaaaaggcctgagcgggaaacagaacaattttgagcgaaaagcagtctaccaaagacaggtgcgggcccccagcctgctcgcaaagagcattctggaaggttatcggcctataccggcggagacgtatgtgggcggaaccttcccactgccaccaccagtttctgaccggatgcgcaagcgccgggcattcgcggataaagaattggagaatattatgctggaaagggagtacaaagaacgggaaatgctggagacttcccaggccgcggccctgttcttgcccaatcgaatggtgccgggacccgattacaacagctacaaatctgcttattccccttcgcccgtcgaacctccatctaaggatttctgcaattttttgcctacctgtctcgacctgactatgcaatattcagggtccgggaacatggagctgatctcgagcaacgtatcagtggctactacatatcgccagtatccgctctcatcccggtttttggtgtggcctaaatgcggaccaattagcgatacgctactataccagcaatgtcttctgaacgccacgacctccgtccaggctctgaagcccggcgccagctgggatttgaagggcgcccgcgtccaagacggcctgtccgccgaacaagatatgatgccatccaagctggaaggaagcctggtcttacctcacacgcctgaaattcaaacaacacgcagcgacctgcagggtcaccaggccgttcccgagcgtagcgcattttctccaccgcgccgtaatttcagccccattgtcgacaccgatagcctagcagcccaaggccatgtcctcacaaagatatcgaaagagaacactcggcaccccctccctctgcgccacaaccctttccacagtctgttccagcagaccctgacagacaaaagcggccctgagcttaaaacccctttcgtgaaggaggcctttgaagagactcctaaaaagcaccgcgaatgcttagtaaaagacaatcagaagtatacatttaccattgatagatgtgctaaagacttattcgtagccaaacaagtggggacaaaactctcagtgaacgagcctctaagcttctctgtggaatcaatcctgaaacgaccgtcatcagccattacgcgagtcagccagtag

SEQ ID NO: 185840 - DNA, 1686 bp, Artificial Sequence
  Description of Artificial Sequence: Synthetic coding sequence
atggccgacccccaggccggcagcgccgccggcgactgggagatcgatgtcgaatccttggagctggaggaggacgtatgtggagccccccgaagcacgccccccggcccaagtccccccccggccgatggggactgcgaggatgatgaagatgatgatggggtcgatgaggatgccgaagaggagggcgatggagaggaggccggtgcctcccccgggatgcctggacagccagaacagcggggcggcccgcagccccggcctcctcttgcgccccaggcaagccccgccggcacagggccaagggaaagatgtacaccagccgggggcggtgctgagccccggaaactaagtcggacccctaaatgtgcacggtgcaggaaccacggtgtggtgagttgtttgaaaggtcataagcggttttgccgctggcgggattgccagtgtgctaattgtttattagtggtggagcggcagcgagtgatggccgcccaggtggccttacgtagacagcaagctactgaagacaaaaaagggttgtcggggaaacagaacaacttcgagaggaaagcggtgtatcagaggcaggtcagggctccatctttactggccaagtcgattttggagggctatcgccccatcccggccgagacatacgtagggggcacattcccgctcccacctcccgtgtccgaccggatgagaaaaaggcgcgcctttgctgataaggagttggagaatattatgctggaaagggagtacaaggagagagagatgctggaaacaagccaggccgccgcattatttctgcccaaccggatggtccctggccctgactataacagctataagtcagcctattctccctcaccagtggagccgccatccaaagatttctgcaactttctccctacatgtcttgacttaacaatgcagtactctgggtccggaaatatggagttgatctccagcaatgtgagcgtggctactacttaccggcagtaccctctgtcgagtcggttcttggtgtggccaaaatgtggcccaatatccgacacgttgttataccagcagtgcctcctgaatgcgacgaccagcgtccaagctcttaaaccaggtgcctcctgggacctgaagggagcccgggtccaagacggactgtccgctgagcaggacatgatgccttcaaagctggaaggcagcctcgtcctcccccacacgcctgaaattcaaacgactcgttcggacctgcagggccatcaggctgtgccagagcggtccgcgtttagccctcctaggaggaatttctctccaatcgtcgatacagacagcctggccgcccaggggcacgtgttgaccaagatctcaaaagaaaacacaagacatcccttgccactgcggcataaccccttccactccctcttccagcagaccctcactgacaagagtggacccgagcttaagacgccttttgtgaaggaggccttcgaagagaccccaaagaaacatcgggagtgtctggtaaaggataaccagaagtatacatttacaatagacagatgcgcaaaagacctgtttgtggccaaacaagtgggaaccaaactgagcgtgaatgaaccattatcattttctgtggagtccattctgaagagaccatcttccgcaataaccagggtgtcccagtag

SEQ ID NO: 185841 - DNA, 681 bp, Artificial Sequence
  Description of Artificial Sequence: Synthetic coding sequence
atggccgacccccaggccggcagcgccgccggcgactgggagatcgacgtggaatctctggaattggaggaagatgtgtgtggagccccacggtcaacaccaccaggccccagccccccacccgctgatggggattgcgaggacgacgaagacgatgacggcgttgatgaggatgcagaagaggaaggggatggcgaggaagctggggcctctcccgggatgcccgggcagcctgaacagagaggaggaccacagccccgtccgccgctggctccacaggcctctcctgccggaacaggaccacgagagcggtgcacccccgcaggcggcggagccgaacctaggaaattgagtagaactcccaaatgcgctagatgccgtaatcacggcgtggtgtcctgcctgaagggccacaagcggttctgtagatggagggactgtcagtgcgccaactgcctcctcgtggtggaacgccagagagtaatggccgcgcaggtggcattacgaagacaacaggctaccgaagacaaaaaagggctgtctgggaaacagaacaatttcgaacgcaaggcagtatatcaaagacaagtgcgggcccccagcctcctagctaagtccatcttggaggtgctgctcgggctattctactcatactacgtttatattatgaaccacctctag

SEQ ID NO: 185842 - DNA, 681 bp, Artificial Sequence
  Description of Artificial Sequence: Synthetic coding sequence
atggccgacccccaggccggcagcgccgccggcgactgggagatcgacgtggagtcgcttgagctggaagaggacgtttgtggggctccacgtagcaccccacctgggccttccccaccacccgctgacggagattgcgaggacgatgaggacgacgacggcgttgatgaagatgccgaagaagagggtgacggagaagaagccggggcgtcaccaggcatgcccggacagccagagcagcggggaggaccccagcctcgaccacctctggctccccaggcgtctccggcgggcacagggccgagagagcggtgtacaccagctggcggaggtgctgagcctagaaagctgtctcggaccccaaaatgtgcccgctgtcgcaatcacggagtggtcagttgtcttaagggacataagaggttctgcagatggagagactgccaatgtgcaaattgtcttctcgtggtggagcggcagagagtcatggctgcccaggtggccctcaggagacagcaggccacagaggacaagaagggcctgtctggaaagcagaacaatttcgagaggaaagcagtgtatcagaggcaggtgcgggcaccctcactgctggccaaaagcatactggaggtcttacttggactgttttatagttactacgtgtatattatgaaccacctgtag

SEQ ID NO: 185843 - DNA, 6039 bp, Artificial Sequence
  Description of Artificial Sequence: Synthetic coding sequence
atgtggatcctggccctgagcctgttccagagcttcgccaacgtgttctccgaggatctgcattcaagcctgtactttgtgaatgcttccctccaggaggttgtctttgcttctacgaccggaaccctggtgccctgtcctgccgccggcatcccccccgtgactcttcgttggtacctcgccaccggagaagagatctatgacgtgccagggattaggcatgtgcaccctaacggcacactgcagatatttccattccctccaagtagcttcagcactttaatccacgacaatacatactactgtaccgctgaaaatcccagcggcaagataaggagccaggatgttcatataaaagcagtgctccgcgagccttataccgttcgtgtggaagaccaaaagaccatgaggggtaatgtcgccgtgttcaaatgcattatcccatcttcggtggaagcatatattaccgttgttagctgggagaaagatactgtcagcttagtatccggaagccggttccttatcacatccactggggccctgtacatcaaggacgtccagaatgaagatggattgtataattacaggtgcatcaccagacatcgatataccggcgagacgcggcaatccaactcagcccgcctttttgtgagcgatcccgcgaactccgcaccaagcatccttgatgggttcgatcacagaaaggccatggcaggacagagagtggagctgccttgcaaagcgctcggccatcctgagccagattataggtggctcaaggataacatgcccttggagctctctggtcgcttccagaaaacggtgactgggctgctgatcgagaatatccgaccctccgacagtggaagttatgtgtgtgaggttagtaatcgctacggcacagccaaagtaattgggagactgtacgtgaaacaacctttaaaagcgacaattagtccacggaaagtgaagtcatctgtagggtcacaggtctccctaagctgcagtgtcactgggaccgaagaccaggagctttcttggtatcgtaatggcgagattctgaaccctggcaaaaatgtcaggatcaccgggataaatcacgaaaatctcatcatggatcacatggttaagagcgatggaggagcataccagtgcttcgtacggaaggataagctgagtgcgcaagattacgttcaagtagtgctagaagatggcactccaaaaattatctctgccttttccgaaaaagtagtctcccccgcagaaccagtttctctgatgtgcaatgtaaaagggacccccctgccaactatcacctggacactggacgatgaccccattttgaaagggggcagtcataggatctcccaaatgatcacaagcgagggaaacgttgtttcatacctcaacatttcgagctcccaggttcgtgatggcggagtgtacaggtgcactgccaacaacagtgccggggtcgtcctctaccaggccaggatcaacgtcaggggtccagctagcattaggccaatgaagaacattaccgccattgctggccgggatacatacattcattgccgtgtgatcgggtatccctactattctatcaaatggtataaaaacagcaatctattgccgttcaatcatagacaggttgcctttgagaacaacggtaccttaaagcttagcgacgtgcagaaggaagttgacgagggagaatacacatgcaacgtcctcgtgcaacctcaactgtccacgagtcagagtgtgcacgtcactgtcaaggttcccccatttatccagccctttgagtttcctagattcagcatcggacaaagggtgtttatcccgtgtgtagttgtgtccggtgatcttcccatcaccatcacatggcagaaggatgggagaccaatcccaggcagcttgggtgtgacgattgacaacatagacttcaccagcagcctccgtatctccaatctctctcttatgcacaatggcaattatacttgtatcgcacgcaacgaagccgccgcagttgaacatcagtcccaactgattgtgagagtccctccaaaatttgtggtgcagccacgggatcaagatggtatctacggtaaagcggtgatactgaactgttccgcagaaggctaccccgtccccactatcgtgtggaaattcagcaaaggggctggcgtgccccaattccagcctatcgcactgaatggccgcatccaggtcctctccaatgggagcctgctgataaagcatgtggttgaagaggattcaggctattacctgtgcaaagtgtctaacgacgtcggtgctgacgtgtctaaatcaatgtacctgacagtcaaaattcctgccatgatcacatcttatccaaatacgaccctcgctacacagggtcaaaaaaaggaaatgtcctgtaccgcgcatggggaaaagcctattatcgtccgatgggaaaaagaagacagaatcattaacccagaaatggccagatacctggttagtaccaaggaagtgggcgaggaggtgatatcgactcttcagatactccccacggtccgcgaagactctggcttcttctcatgtcacgcaatcaatagttacggcgaagaccggggcataatacagctcacggttcaggagcccccagatccacctgagattgagatcaaggacgtcaaagcacgcactattactctgcgttggacgatggggtttgacggaaatagccctatcaccggctatgacattgaatgcaaaaataaatcagacagttgggactctgctcagcgcacgaaggacgtgtcccctcagttaaacagcgcgaccattatagatatacaccctagttctacttactctatcagaatgtacgccaagaacagaattgggaaaagcgaaccctccaatgagctgactataaccgctgatgaggcggctcctgacggtcctcctcaggaggtgcacttagagccgatttcttcacagagcatccgcgttacttggaaggctcctaagaagcacctccagaatggaataatccgcgggtaccagatcgggtatagggaatacagcacaggaggaaacttccagttcaatatcatttcggtggacacgagcggcgacagtgaggtttataccctggacaacttaaataaattcacacagtacggcctggtggttcaggcgtgtaaccgcgctgggaccggaccctccagtcaggaaattattacaacaacactggaggacgttccctcctaccccccagagaacgtccaggccattgctacatcgcccgaatccattagtatcagctggagcacgctctccaaggaggcactcaatggcatcctgcagggcttccgtgtgatttattgggctaacctgatggatggggagctgggggaaattaaaaacattactactactcagccatccctggagcttgatgggttggagaagtacacgaattatagcattcaagtgctcgcgttcacacgtgctggagacggcgttcgaagcgagcaaattttcacccgaacgaaggaagatgttccagggcctccagcaggcgtcaaagccgccgccgcatcagcttcaatggtttttgtgtcctggttgcctcctctgaagttaaacggtataatccggaaatacaccgtgttctgctcccatccctacccgacagtgatcagcgagtttgaggcttctcctgattcttttagctacagaattccaaatctgtcacgcaacaggcagtacagtgtctgggttgtagctgtaaccagtgctggaaggggcaactcatccgagatcattactgtggaaccccttgccaaagcgccagcacgcatcctgactttcagtggcactgtgactacaccctggatgaaagacattgttctcccctgcaaagctgttggtgatccaagtcccgccgtgaagtggatgaaggactctaacggaaccccatcactcgtaacgatcgatggtcgaaggagcatcttctccaatggaagctttatcattagaaccgtaaaggccgaagactcagggtactattcctgcatagccaacaataattggggatcggatgagattattcttaacctacaagtccaggtgccacctgaccaacctaggctgacggttagcaagaccacctcaagcagtattacgcttagctggctacctggcgacaatggaggttcgtctattaggggatacatcttacaatactcagaagataactctgaacagtggggcagctttcctatatcgccttccgaacgcagttatcgccttgagaatctgaagtgcggaacttggtataagtttactctcaccgcccagaacggcgtggggccagggcgcatcagcgagattattgaggccaagaccctcggaaaagagccccaattcagtaaagagcaagagctgttcgcctctatcaatacgaccagagtcagactgaatttgatcggctggaatgacggcggctgtcctatcacctcatttaccctagaatatcgtcctttcggaaccaccgtctggaccactgcccaacgcacaagcctcagcaaatcttacatcttatacgacctccaagaggcaacctggtacgaactgcagatgagagtgtgcaactcggccggatgtgcagaaaaacaagccaacttcgctacactcaattatgatggctctacaattcctcctctgattaagtctgtcgtccaaaatgaggaagggttgacaactaacgagggcttgaaaatgctggtgacaatctcatgtatactggtgggtgtgctgttactgttcgttctactgcttgttgtccggcgacgacgcagagaacagagactgaaacggttgcgagatgcgaagtctctagctgagatgctgatgagcaaaaacacaagaacgagcgacactctgagcaaacaacaacagaccttgcgtatgcatatagacatcccccgggcccagctgctcatcgaggagcgagataccatggaaacaatagatgatcgctccacagttctgttaaccgatgcggactttggggaggctgctaaacagaagtcgctaaccgtaacccacactgtgcactaccagtccgtgtctcaagccaccgggccgctggttgatgtgtcagacgctcggccaggaaccaatcccacgacgcgtcggaatgccaaggcaggtcctacagcgcgcaataggtacgcttcccaatggaccctgaatcgacctcaccccaccatctcagcccacactctcacaacagactggcgactgcctacacccagggccgcgggcagtgtggataaggaatccgacagttattctgttagtccctcccaggacacagatcgggccagatctagtatggtctcaaccgagtccgcgagcagcacctacgaagagctggcccgggcatatgaacacgcaaagatggaggagcaacttcgccatgccaaatttacaatcaccgagtgcttcatcagtgacacctcttcggagcagctgaccgcaggaaccaatgagtatacagacagtttaacaagctcaacccctagcgaatctggaatctgtagattcacagcatccccacctaagccgcaggatggtggccgggttatgaatatggccgtcccaaaagcacaccggcccggagacctgattcatttgcccccttatctgagaatggacttcctacttaatagaggcggcccgggcacaagtcgagatctctcactgggccaagcttgcttggagccccagaaatccagaacactgaagcggccaactgtgctggagcctattcccatggaggcagcttcgtctgctagcagcaccagggaaggacaaagctggcaacccggggccgttgctacactgccccaaagggagggagctgaactcggccaggccgctaaaatgagttcctctcaagagtcccttctagattctaggggtcatctcaagggtaacaacccatacgcaaagtcctatactctcgtttag

SEQ ID NO: 185844 - DNA, 6342 bp, Artificial Sequence
  Description of Artificial Sequence: Synthetic coding sequence
atgaccggcgccggcgagccccggcgggaggagccccccccccagcctagtgcaggtctaaggagtcgcgagtcaggtgcaccctctgctggcggttgggaaagagctgaacggggcagaggcgccgccgcccggcctgctacaggaccgccacctagaaggataggtcctctgtatggcatgtggctggtcaccttccttctgctgcttgattccctccataaagcgagacccgaagacgtcgggacttcgctatattttgtcaatgacagtcttcagcaggtcacattctcctcttccgtgggggtggtggtcccctgtccggccgcgggatccccttctgccgcgttgcggtggtacctggctactggagacgacatatacgacgtaccccatatccgccatgtgcatgcaaatggcactctccaactgtaccccttttcaccatccgcatttaattcattcattcatgataacgactatttctgcacagccgagaacgctgccgggaagatcaggtctccaaatatccgcgtaaaagctgtgttcagagagccctacactgtgagggtggaggaccaacggtcaatgagaggaaacgtcgctgtgtttaaatgcttgatcccctctagcgtccaggaatacgtgagtgtggtgtcctgggagaaagatacagtgtcaataatccctgagcataggttttttatcacataccacgggggcctttatatctccgatgtgcaaaaagaagacgctctgtcgacctataggtgtataacaaaacacaagtatagtggcgaaacacgccagtccaacggcgctcgccttagtgttacagacccagcagaatctatccccacgattctggacggattccattcacaagaagtgtgggctgggcacaccgtggagcttccctgtaccgctagcggataccctatcccagccattcggtggctgaaggatggaagaccactgcctgccgatagcagatggactaaacggattacggggctcacaatttcggatcttaggaccgaagacagtggtacctacatctgcgaagtgacaaatacatttggttctgcagaagccaccgggattctaatggttatcgaccccctgcacgtaacactgacaccaaaaaaactcaaaactggcattgggagcaccgttattttgtcttgcgcactgaccgggtcaccagagtttacaatccgctggtacagaaatacggaactcgttctccccgacgaggcaatttccatccggggattaagtaacgaaaccctgctcattaccagcgcccagaaaagccactctggtgcttatcagtgtttcgctaccaggaaggcacagacagcccaggatttcgcaattattgccctcgaggatggaacccctcgcattgtctcatctttctcagagaaggtggtcaaccccggcgagcagttctcgcttatgtgcgctgctaagggtgccccaccacctacagtgacctgggcactggatgacgagccaatcgttcgagacggctcacacaggaccaatcaatacacgatgagcgacggcacaactatttcccacatgaacgtgactggtccccaaatccgagatggaggagtgtaccgatgtaccgctcggaacctggtaggaagcgccgagtaccaggcaagaatcaatgtgcgcggtccccccagcatccgagccatgcggaacattactgccgtggccggccgagatactctcattaattgccgcgtcataggatacccctattactccataaagtggtacaaggatgcactgctgttgccagataaccatcgccaggtggtcttcgagaacggtacacttaaactgacagacgtccagaagggcatggatgagggcgagtacctctgctctgtgctgatccagcctcagctatcaatctctcagtccgtgcatgtggccgtgaaggtccctcctctcatccagccatttgagttcccacccgccagtataggacagctcctgtacatcccctgcgtggtgagctctggcgatatgcccatacgcatcacctggcgcaaagacggccaggtcatcatttctggatccggcgttaccattgaaagcaaagagtttatgagctccttgcagatatcaagcgtgtccctgaagcacaacggcaattatacctgtattgcgagcaatgctgcagcgaccgtgtctagggaaaggcagctgattgtccgagttccacccaggtttgtcgtacagccaaacaatcaggacggtatatacgggaaggccggcgtgctgaactgctcggtggatggctaccccccccctaaagtgatgtggaagcacgctaaaggatctggtaacccccagcagtaccaccccgtgccccttaccggacgaattcagatcctaccgaatagctcccttctgattcggcacgtgctcgaggaggatatcggctattatctgtgccaggctagcaatggtgttggtacggacataagcaaatctatgttcctcacggtcaagatacccgccatgattaccagccatcccaacaccactatcgccatcaaggggcatgccaaggagctgaattgcactgcacgcggggagcggccaatcattatcaggtgggaaaaaggcgacaccgtgatcgatcccgatagagtaatgcggtacgcgatcgccaccaaggacaatggcgacgaggtcgtgagcaccctgaagcttaagcctgcagaccggggggattccgtgttcttctcctgtcacgctatcaattcctacggtgaagatcgcgggcttattcagctcactgtccaggagccccctgacccccccgagctcgagatccgcgaagtcaaggctaggtcaatgaatctgcggtggacacagcgattcgacggaaacagcattataaccgggtttgacatcgagtataaaaacaagagcgacagctgggactttaagcaaagtacacgaaacatctctcccacgataaaccaggcaaacatagtcgacctgcaccctgcctcggtttactccatccggatgtactcattcaacaaaattggacgcagcgagccatccaaggagctgacaatcagcaccgaggaggcagcccctgacggaccccctatggacgtgacattgcagcctgtcacgagccaatccatacaagtgacttggaaggcccctaagaaggaacttcagaatggtgtgattcgaggttaccaaatcggctacagagaaaattctcctggaagcaacgggcaatacagtatagtggaaatgaaagcaacaggcgactccgaagtatatacgctggataacttgaagaaattcgcacagtatggagtcgtagtccaggcttttaacagggccgggaccgggcccagcagcagtgaaatcaatgctacaactcttgaagatgtgcctagccaaccacctgagaacgtgcgtgcgttatctattacttcagacgtggctgttatctcgtggagtgaacctcctcgcagcactctgaacggagtactcaagggctaccgggtgattttttggagcctgtacgtggacggcgagtggggcgaaatgcaaaatattacaactacccgggaaagggtcgagctgcgtgggatggagaaattcacaaattattctgtacaggtgcttgcgtatactcaggctggggacggtgttagaagctccgtactgtatatccaaacaaaagaagatgtgcctgggccccccgcgggcattaaagccgtgcctagctcagcatcttctgtcgtggttagttggctgcccccaaccaaacccaacggagtgattagaaaatacacgattttctgttcctcacccggttcggggcagccagctccatctgagtacgagacctctcctgaacagcttttctatcgcatcgcgcaccttaacagagggcagcagtatctgttgtgggtagcggcagtgacgagtgcaggtcgtggaaactcgagcgagaaggtcactatcgagcccgctggtaaagcccccgccaaaatcatctcatttggcgggaccgtgaccaccccttggatgaaggatgtcaggctgccttgtaatagtgtgggagatcccgcaccagccgtgaaatggaccaaggacagtgaagattcagcgataccagtaagtatggatggacacaggttgattcacaccaatggaacgctgctgctccgagctgtgaaggctgaggacagcggctactatacttgtaccgccaccaacaccggagggttcgatactatcatagtgaatctccttgttcaggtcccccccgatcagcctaggttgactgtgagtaagacttccgcatcttcaataacgctgacgtggatccctggtgacaacgggggcagttctatcagagggttcgtactgcagtactccgttgacaattcagaagagtggaaagatgtgttcatatcctcatccgagcggtcattcaaattggactcactgaaatgtggaacgtggtacaaagtgaagctcgctgccaaaaactctgtcggcagcgggcgcatcagtgagatcatcgaggcaaagactcacggtcgagagcctagttttagtaaggaccagcacctgtttacccatattaactccacacatgcacgattgaacctccagggttggaataacgggggatgcccaatcactgccattgtgctggagtatagacctaagggcacatgggcttggcaaggactgagagcaaatagcagcggcgaagtgtttctcacagaactgagggaggccacttggtatgagctgcggatgagagcctgtaacagcgccggctgtggcaatgagactgcccagttcgctaccctggattatgatggctcgaccatccctcccataaagtccgcccagggggaaggcgatgatgtgaagaagctattcaccattggatgccctgtcattctggccacacttggggtggccctgctatttatcgtccggaaaaaaaggaaggaaaagaggttaaaacgcttacgcgacgcaaaatcactggcagaaatgttgattagcaaaaacaaccggtcctttgataccccggtcaaaggcccaccccagggaccgagacttcacatcgacatccctagggtgcaactgcttatcgaggacaaagagggtattaaacagttgggagatgataaggccacaatccccgtcacagatgctgagttctctcaggctgtgaaccctcagtcattttgcactggagtaagtctgcatcaccccactctcatacagtccaccgggcccttaatcgatatgtccgacattaggcctggaactaatcctgttagtcgcaaaaatgttaaaagcgctcattctacccgcaaccgctactcctctcagtggaccctaacaaaatgtcaggcttcaactccagcccgcacactgacatcggattggcgcaccgttggcagccagcacggcgtaaccgtgactgaatccgatagctatagcgcaagcctgagccaggatacagacaagggcagaaacagtatggtttcaacagagtccgcgagtagcacctacgaagagctggccagggcttatgagcatgctaaattggaagaacaactacagcatgctaaattcgagatcaccgagtgcttcatttctgattcgtcttctgaccagatgactacaggcacaaatgaaaacgccgatagtatgaccagtatgtctactccttccgagcccgggatctgtcgttttaccgcgtctcctccaaagccccaggatgcagaccgtgggaagaacgtggccgtcccaatcccccatagggctaataaaagcgattactgcaatttgcctctctatgccaaatctgaagccttcttccggaaggccgatggccgagagccctgtcctgtcgtcccacctagggaggcaagcattcgcaacctggcgaggacttaccatacacaggcgagacatctgacccttgaccctgctagtaaatcactcggacttcctcatccaggtgcacccgcagccgcgtcaaccgcgactctgccccagcggacattggcaatgccagcaccaccagccggcactgcaccgcctgcaccggggcccacccccgccgaaccacctaccgcaccatcggcagccccccctgcacccagcaccgaaccccccagggcaggtggtccacacaccaaaatgggcggatctcgagatagtctcctggaaatgagcacaagcggcgtgggacgttcacaaaagcaaggcgccggcgcatatagtaaatcctatactctggtgtag

SEQ ID NO: 185845 - DNA, 5463 bp, Artificial Sequence
  Description of Artificial Sequence: Synthetic coding sequence
atgctgccctactgggccggccacaccgtggagctgccctgcaccgccagtgggtatcctattcctgccattaggtggctcaaggatggacgcccgctaccagcagattctcgatggacgaagcggatcacagggctcactatcagtgacctccgcactgaagacagcggaacatacatttgtgaagtgacaaacactttcggatcagctgaagcaacagggatactgatggtgattgacccattgcatgtgactctgaccccaaagaaattaaaaacaggtataggcagtaccgtcatcctcagctgtgcactgacgggatcacccgagtttaccattaggtggtatagaaatactgaactcgtgttgcccgacgaggcaatttccattagaggtctgagcaatgagacactgctcataacatccgctcagaaatctcatagcggagcataccagtgctttgccacccgtaaggcgcagaccgcccaagacttcgccatcatcgccttggaggatggtaccccacggatcgttagctcgttttcagagaaagtcgtgaaccctggggagcagttttccctgatgtgtgccgccaagggcgctcccccaccaactgtgacttgggccctcgacgatgagcccattgttcgtgacggaagccaccgcaccaaccaatacacaatgtctgacggcaccacaattagccatatgaatgtgacgggaccacagatacgcgacggaggcgtctaccgatgtacagcgcgtaacttagtgggtagtgcagaatatcaggcccggatcaatgttcgagggcccccctctatccgcgccatgcgtaacataacagcagtggccggccgggatacgcttatcaattgccgcgtgattggatacccctactacagtatcaaatggtacaaagacgcattacttcttcccgacaatcacagacaagtggtttttgaaaatggaactctgaaactgacagacgtccagaagggaatggatgagggggagtatctgtgctccgtgttgattcagcctcaacttagtataagccagagtgtccacgttgccgtaaaagtgcccccactgatccaaccattcgaattcccccccgcaagtattggacaactcctctacattccttgcgtggtgtctagcggtgacatgcccataagaatcacatggcggaaagacgggcaggtcattatctccggctctggagtaactattgagagcaaagagttcatgagctcactgcagatcagttccgtgagcttaaaacacaatggcaactacacatgtatcgcctccaacgccgcagctactgtgagtagggagaggcaactgattgtgagggttcctccgcgcttcgtggtgcagcccaataaccaggacggcatctatggaaaggccggtgtcctgaactgttcggttgatgggtatcccccgccgaaggttatgtggaagcacgctaaaggctccggaaatccacagcaataccatccggtgccgctcaccgggaggatccagatcttgccgaactcttcccttctgattaggcacgtgctggaggaagatatcggctactatctgtgccaggcctctaacggcgttggcactgacatcagtaaatccatgttcctaaccgtcaagattcccgctatgatcacctcacaccccaacaccacaatagccatcaagggacacgctaaggagctgaattgcaccgctcgcggagagcggcccattataatccgttgggaaaagggcgacacagtgatcgacccggatcgcgttatgagatacgcaatcgcgacaaaggataacggcgacgaggtcgtgtccacactgaagctgaagccagccgatagaggggatagtgttttcttttcatgccacgccataaactcttacggcgaggatcgagggctgatccagctcactgtgcaagaaccaccagatcctcccgagttggagattagagaggtgaaagcccggagcatgaacctgagatggacacaacgctttgacggcaactccattataacaggatttgatatcgagtataaaaacaaaagcgacagttgggactttaaacagtcgacccgcaacatctctccgactatcaatcaggccaacatcgtagaccttcaccccgcctcagtctactccattcggatgtactccttcaataagatcggaagaagcgagccctcgaaggagttaacaatctctactgaggaggcggccccagacgggcctcccatggacgttacccttcagccggttacatctcagtccatacaagtgacttggaaggcaccaaagaaagaactgcaaaacggagtcataagagggtaccaaataggctatcgggaaaattctccaggtagtaacggccagtattccattgttgaaatgaaggccacaggcgattccgaggtctacacactggacaatctgaagaaattcgctcagtacggcgtggtggtccaggcttttaacagagctggtacagggccttctagttccgaaatcaacgctaccacactggaagatgtaccaagccagcccccagaaaatgtgcgggccctatctattacttccgatgtggcagtgatatcctggtccgagcctccgaggtccacattgaacggtgtgctgaaaggctaccgggtgatcttctggagtctatatgtggacggcgaatggggagaaatgcagaatattacaaccaccagagaaagagtcgaactgcgtggaatggagaagtttacaaactactccgtccaggtgctggcctacacccaggctggtgacggagtgagaagcagcgtcctctatatccagaccaaggaagacgtgccgggacctccagctggaatcaaggcagtgccttcatctgcgagcagcgttgtggtgagctggctcccaccgactaaacccaacggggttataagaaagtatacaattttctgttccagccctgggtccggacaacctgcccctagcgagtatgagacctccccagagcagttgttctatagaattgctcacctgaaccgggggcagcaatatttattgtgggtcgcagcggtgacgagcgccgggagaggcaatagcagtgagaaggtcaccattgagcccgcaggcaaagccccagctaagataatatcgttcggaggaactgtgaccacgccttggatgaaggacgtgcggctgccttgtaactcggtcggcgacccagcgcctgccgtgaagtggacaaaagactctgaagattcggccatcccagtaagcatggacggccaccggttaatccacactaatggaacactcctattaagggccgtgaaagccgaagattcaggatactatacctgcacggccaccaatacaggtgggtttgacacaattatcgttaacttgcttgtgcaggtgcctccggatcagcccagactgacagtgagtaaaaccagtgcgtcaagcatcaccctcacttggattcccggggataacggcggttcctctatccgcggttttgtgctgcaatacagcgtggacaactccgaggagtggaaggacgtctttatctcatccagcgaacggtcctttaaactggattccttaaaatgcgggacctggtacaaggtaaagttggctgccaaaaatagtgttgggtcgggccgcatctcagaaatcattgaggctaaaactcacgggcgcgaacccagcttcagcaaagaccaacatctctttacccacatcaattccacacacgcccgcctcaacctccagggctggaacaacggcggatgccccattaccgctattgtcctggaataccgacccaagggcacatgggcttggcagggacttagagctaactcctccggcgaagtctttctgacagagctgagagaggctacctggtacgaactccgaatgagggcctgcaacagcgcggggtgcgggaacgagacggcccagttcgctacactggactacgatgggtcaactatcccccctatcaaaagcgctcagggcgaaggggacgacgtgaagaagctctttactatcggctgcccagtgatcctggcaaccctcggagtcgcactgctgtttatagtaaggaagaaacggaaggaaaagagactaaaacggcttcgggatgccaagtcactggccgagatgctgatttctaagaacaaccgcagcttcgacactccagtgaaagggcctccgcagggacctcgactccacatcgacatacccagggtccaactgttgattgaggataaagaggggatcaagcagttaggggacgacaaggcgacaattcctgtcacagatgccgaatttagccaagcagtgaacccgcaaagcttttgcacaggggtgagcctacaccatccaactctgattcagagtaccggccctcttattgacatgagcgacatccgacctgggaccaatccggtatctagaaagaatgtgaaaagcgcacattcaacgagaaatcggtactctagccaatggaccctgaccaaatgtcaggcttccactcctgcccgtactctaacttctgattggcgcactgtaggaagccagcatggtgttactgtcaccgagtcggactcctactcagcttcgttaagccaagatacagacaaggggcgtaactcgatggtctctaccgagtcagcgtcgagcacctatgaagagcttgcacgggcctatgagcatgccaaactggaggagcagctccaacacgccaagtttgaaataacagagtgcttcataagtgacagttctagtgatcagatgacaacaggcacaaacgaaaacgcggatagcatgaccagtatgtcgacacccagcgaacccggaatttgtagatttaccgcttccccgccaaaaccccaggatgccgataggggcaagaacgtcgcggtgcctataccacaccgcgctaacaaatccgactactgcaacctgcccctgtatgcgaagtccgaagccttcttccgaaaagcagatggccgcgagccgtgtcctgttgtacccccccgggaggcctcaatccgtaacttggccaggacataccacacccaagctcgccatcttaccctagatcccgcctccaagagcctcgggcttccacatccaggggcccccgccgctgcttcgaccgcaaccctgcctcagcgcactctcgccatgcctgctcctcctgccggcaccgccccacccgcacccggtcccacacctgctgaaccaccgacagccccctctgctgcgccgccagcaccgtcaactgaacctcctagagccggggggcctcacaccaagatgggcgggagtcgggattccctcctggagatgtccacctcaggggtggggcggtcccaaaagcagggagccggcgcatactctaagtcctatacactggtctag

SEQ ID NO: 185846 - DNA, 762 bp, Artificial Sequence
  Description of Artificial Sequence: Synthetic coding sequence
atggagggcaccgtgaacctgcagctgagcgccaagagcgtgggcgtgtttgaagcattttataacagtgtgaagccgatccagatcattaactccaccatcgagatggtgaagcctggcaagttcccaagcggtaagaccgagatccctttcgaattccctctacacctgaagggtaacaaggtcctgtatgagacctaccacggcgttttcgtgaatatccagtatacgctgagatgcgacatgaagcgcagcctgctcgccaaggaccttaccaaaacatgtgaatttattgtgcactcggctcctcagaaggggaaattcaccccatcccctgtggacttcacgattaccccagagaccttacagaacgtaaaggagcgggcactattgccaaagtttctgctgaggacctcccagctcaataaattgtgtcaccatgcggcgaccaatggtagagccggagggggcgaactgggttccaggcaccagaagcgcggcgcggcagccggcgctagaggggacgtgagggtttgccggtatgccagggacgctacagaaatccagaatatacagattgctgatggggacgtctgccggggcttgtctgtccctatctatatggtcttccccagattgttcacctgcccgacattggaaaccacgaactttaaagtggagttcgaggtgaatattgttgtgctcctccacccagatcatctcataactgagaattttccgctcaagctgtgcaggatttag

SEQ ID NO: 185847 - DNA, 894 bp, Artificial Sequence
  Description of Artificial Sequence: Synthetic coding sequence
atgggcaccgccctggacatcaagatcaagcgggccaacaaggtgtaccacgcaggggaagtcctgagcggtgtggtcgtaattagcagcaaggactccgtacagcaccagggcgtctcactgacgatggaaggaactgttaatctgcagctgagtgctaaatcagttggggtcttcgaggctttttataattcggtcaagccaatccagattatcaattcaacaatcgagatggtgaagccagggaaatttccaagcggcaagactgagattcccttcgaattcccgttacacttgaaaggcaataaagtgctctacgagacttatcacggggtatttgtcaatatccagtataccctaaggtgcgatatgaagcgcagcctgctggctaaagacctgactaagacttgtgaattcatcgtccacagtgccccccagaagggcaaattcaccccctcaccagttgactttaccattactccagagacactgcagaatgttaaggaacgagctttactaccgaaatttcttttgaggggtcaccttaactctacaaactgcgtcatcacgcagcccctgacaggagagcttgtcgtcgaaagctcagaggccgccatcaggagcgtggagctgcagctggtccgggtcgaaacctgcgggtgcgcagaaggctacgcaagagacgctacagagattcagaatatccagatagcagacggagatgtatgtaggggcctgagtgtccctatttacatggttttcccccgcctttttacgtgccctacactggagacaacgaacttcaaggtggagtttgaagtaaatattgtcgtgttattgcaccccgaccacctaattacggagaactttccgctcaaactgtgtagaatttag

SEQ ID NO: 185848 - DNA, 519 bp, Artificial Sequence
  Description of Artificial Sequence: Synthetic coding sequence
atgggcaccgccctggacatcaagatcaagcgggccaacaaggtgtaccacgcaggtccccagaaggggaagtttacaccctctcccgtggatttcacgatcacccctgagaccctacaaaacgttaaggagagagccctccttccaaagtttttgttgaggggccatctgaatagtactaattgcgtgattacccagccactaaccggagagctggttgttgagtcttccgaggctgccattcgctcagtggagctccaactggtgcgcgtggagacctgcggatgtgccgagggctatgctcgggacgccaccgagatccagaatatccagatcgcagacggagatgtatgccggggactgtccgtccctatctacatggtgtttccccgcctcttcacctgccccactttggagacaactaactttaaggtggaatttgaagtgaacattgttgtgctgctccatcctgatcatctgatcactgaaaactttcctcttaaactgtgtagaatctag

SEQ ID NO: 185849 - DNA, 813 bp, Artificial Sequence
  Description of Artificial Sequence: Synthetic coding sequence
atgggcaccgccctggacatcaagatcaagcgggccaacaaggtgtatcacgccggggaggttctctctggtgtagtggttatctcctccaaggacagcgtgcagcatcagggcgtgtctctgacaatggagggcactgtaaaccttcagttgagtgccaagtcagtgggcgtctttgaggccttttacaattctgttaagccaattcagatcataaatagcactattgagatggtgaagcccgggaagttcccaagcgggaagactgagataccatttgaattcccattgcacctaaagggaaacaaagtcctgtacgaaacgtatcatggcgtgttcgtaaatatccagcctcagaagggcaagttcaccccctcccccgtggatttcaccattactcctgaaacattgcaaaatgtgaaggagagggcccttctgccaaagtttttactcagggggcacctgaactcaaccaactgtgtgataacacagcccttaactggcgagcttgtggtggaatcaagcgaggccgccatcagaagcgtggagctccagttagtacgcgtcgaaacatgtgggtgcgccgagggctatgcccgagacgccaccgagatccagaatatacagatcgccgacggggatgtatgccgtgggctgagcgtcccaatttacatggtgtttcctagactgtttacatgccctacgctggaaactacaaattttaaggtggagttcgaggtgaatattgtagtgctcttgcatcccgaccatctcattacagagaacttccctcttaagctgtgccggatctag

SEQ ID NO: 185850 - DNA, 663 bp, Artificial Sequence
  Description of Artificial Sequence: Synthetic coding sequence
atgggcaccgccctggacatcaagatcaagcgggccaacaaggtgtatcatgcaggtgaggtgctctccggagtggtggtgatatcatccaaggacagcgtgcaacaccagggagtgagtctgacaatggaggggaccgttaacctgcagctctctgctaaaagcgtcggggtgttcgaggccttttacaacagcgttaaacctcagaagggtaagttcacaccttctccagttgattttacgatcacccccgagacactgcagaatgtcaaggagagggccctcctccctaaattcctgttgcggggacatctgaattctaccaactgcgtgatcactcagccattaactggagaactggtggtagaaagtagcgaagccgccattagaagcgttgaattgcagttggtgcgcgtcgagacttgtggctgtgccgaggggtacgcgcgcgatgccaccgaaattcagaatatccagatcgcagacggggacgtgtgtagaggcctcagcgtgcccatctatatggtcttcccccgactgtttacatgccccacactggagaccaccaacttcaaggtggaatttgaggtcaatatcgtcgtgttattacaccctgatcacctcattaccgaaaactttccattaaaactttgcaggatttag

SEQ ID NO: 185851 - DNA, 357 bp, Artificial Sequence
  Description of Artificial Sequence: Synthetic coding sequence
atgagcctgatcatcctgacccgggacgacgagccccggatcttcacccccgactccgatgctgcttcccctgcattgcattctacatcccctctaccagatcctgccagtgcctcgcccctacatcgcgaggagaagatcctcccaaaggtatgtaacatcgtctcctgtctgagcttcagcctgcccgcttcaccaactgacagcggactggccagtcccacaatcattaccagggaaggccagcagttctgggccaaatgcctgatctggaagtatcaactatacttacatggcctgcacaaaaagagcgatggaagaagagacaaacagatctctgcctcccctagcacctag

SEQ ID NO: 185852 - DNA, 573 bp, Artificial Sequence
  Description of Artificial Sequence: Synthetic coding sequence
atggagcccgaggccgccgccggcgcccggaaggcccggggccgggggtgtcattgtccaggtgacgccccatggcgtccaccacctcccagaggacccgagtcaccagcaccctggcgtccctggatacagacaccaggcgacgctgaactaacgcgaaccggcaggcctttggaaccacgggccgaccaacacactttcggcagcaagggggccttcggattccagcaccctgtgagggtgtacctgccaatgtctaaacgccaggagtaccttcgttcctctggggagcaggtcttggcttcttttcctgtccaggccacgatcgatttctacgatgatgaatcaaccgagagcgctagcgaagcagaggagccagaggaagggccaccacctctccacctgctaccccaggaggtaggcggtagacaggaaaacggcccaggaggaaaaggcagggaccaggggataaaccagggtcagcggagcagcggcggcggagatcattggggcgaggggcccctgccccaaggagtgtccagtaggggggggaagtgctcatcatcaaagtag

SEQ ID NO: 185853 - DNA, 294 bp, Artificial Sequence
  Description of Artificial Sequence: Synthetic coding sequence
atgaaggagcccggccccaacttcgtgaccgtgcggaagggcctgcattctttcaagatggcctttgtcaagcaccttctcctcttcctgtctccaaggctggagtgttcagggtctataacagatcattgcagcttacatctccccgtgcaggagatcttaatgtcccagcctcctgaacagctcggcctgcagactaacctgggtaatcaggagtcctccggaatgatgaagctatttatgccccggcccaaagttctagcccagtatgagagcattcaattcatgccctag

SEQ ID NO: 185854 - DNA, 276 bp, Artificial Sequence
  Description of Artificial Sequence: Synthetic coding sequence
atgaaggagcccggccccaacttcgtgaccgtgcggaagggcctgcatagtttcaaaatggcctttgtgaaacatctactcctcgaatgtagtggctccatcacagaccattgctcactacacttaccagtgcaggagattctgatgtcacagccaccagagcagttgggactgcaaaccaaccttggtaaccaggaaagcagtggcatgatgaagttgttcatgccccgtccgaaagttctggcacagtatgagtcaatccagtttatgccctag

SEQ ID NO: 185855 - DNA, 531 bp, Artificial Sequence
  Description of Artificial Sequence: Synthetic coding sequence
atggccagcagcagcggcaacgacgacgacctgaccatcccccgggccgcaattaacaaaatgataaaggaaactcttcccaacgtgcgggtcgccaacgacgccagagaactcgtagttaactgctgcacagaattcatccacttaataagcagcgaggccaacgagatctgcaacaagagcgagaagaagactattagcccagagcatgtgattcaagcattggaaagtctaggatttggaagttacatttctgaagttaaagaggtactccaagagtgcaagaccgtcgctctgaagcgcaggaaagcttcatcccgtctagaaaacttgggaatacccgaggaagaactattgaggcagcagcaagagctatttgccaaggccagacagcagcaggcggagcttgcccaacaagagtggctccagatgcaacaggccgctcagcaggcccagctagcggccgcaagcgctagcgcctccaaccaagccggctccagtcaggatgaggaggacgatgatgatatttag

SEQ ID NO: 185856 - DNA, 531 bp, Artificial Sequence
  Description of Artificial Sequence: Synthetic coding sequence
atggccagcagcagcggcaacgacgacgacctgaccatcccccgggctgcaataaacaagatgatcaaggagactctccctaacgtccgggtggccaatgatgcccgcgagctggtggtcaattgctgtaccgaatttatccacctcatttcgagcgaggccaatgaaatctgtaacaagtccgagaagaaaactattagtccagaacatgttatccaggccttggagagtctaggctttggttcttacatctcagaagtgaaggaagtcctgcaggagtgcaaaactgtggccctgaagcggaggaaggcgagcagccgtctggagaacctcggcattccagaggaggagctgttacgtcagcagcaggaacttttcgccaaagcccgccagcaacaggcagagctggcacagcaagaatggttacaaatgcaacaagccgcccagcaagcgcagctcgccgcagccagcgcaagtgctagtaaccaggccggttcttctcaagacgaggaggacgacgatgacatctag

SEQ ID NO: 185857 - DNA, 1470 bp, Artificial Sequence
  Description of Artificial Sequence: Synthetic coding sequence
atggagagcatgttcagcagccccgccgaggccgccctgcagcgggagaccggcgtgcctgggctcctcacacccttgccagatctcgacggagtctacgagctcgaacgggtcgcagggttcgtcagggacctgggctgcgaacgtgtagcactacagtttcctgatcagttactgggggacgccgtagccgtcgccgcgcgattggaagaaaccaccgggtccaagatgttcatcctcggggatacagcctatggatcctgctgcgtggatgtattgggtgccgagcaggctggtgcacaggcactgatccacttcggaccagcgtgccttagccctccagccagacctcttccagtggccttcgtgttgcgtcagcggagcgtcgctctcgagctgtgcgtgaaagcctttgaggcccagaatcctgatcctaaggcacccgtcgttctcctgagcgagccggcttgcgcacatgctctcgaggcactggctaccctgctgagacccaggtatctggacctcctggtgagctccccagctttcccacaaccagtgggatctctctctccagagccaatgcctctggagaggttcggcagaagatttccactcgcacccgggcggaggctcgaggaatacggggccttttacgtggggggctctaaggcaagtccggatcctgaccttgaccccgacctctcccgcttactgttgggctgggctccgggtcaacctttttcgagctgttgtcccgacaccggcaagacgcaggatgaaggggcaagagctggacgactgcgcgccaggagacgctatttggttgaacgggcccgagatgctagggtggttggcctgctggctggcacattaggcgtcgcacagcacagagaggccctggcccatctgcgaaacctgacgcaggccgctgggaaaagaagttacgtcttggcgctgggacgccctactccagctaagctggccaatttccccgaggtagacgtgtttgtgctcttggcatgcccactgggggctctcgcaccacagctctctggaagctttttccagccgatcctggccccctgtgagctcgaagcagcctgtaatcctgcctggcccccaccaggcttggctccacatctcacgcattacgcagaccttcttccagggagcccctttcatgtcgcgttgcctccacctgaatctgagctttgggaaactcctgacgtaagtctcatcactggcgatcttaggccccctccagcttggaagtcgtcaaacgatcacggatctttggccctgaccccgaggccccagttggaattagctgagagtagcccggctgctagctttctgagtagccggtcatggcagggattagagccaagactcggtcagacacccgtgaccgaggccgtgtcggggcggaggggtattgccattgcctatgaggatgaaggctcaggttag

SEQ ID NO: 185858 - DNA, 786 bp, Artificial Sequence
  Description of Artificial Sequence: Synthetic coding sequence
atggagagcatgttcagcagccccgccgaggccgccctgcagcgggaaacaggagttcctggtctgttaacccctctgccggatcttgatggagtgtacgagcttgaaagggtcgccggctttgttagagacctgggttgcgaacgcgtggcgctgcaatttcctgaccagctgctcggcgacgccgttgctgttgctgcccggctggaggaaaccaccggatcaaagatgtttattttgggcgacactgcttatggatcctgctgcgtggatgtgttaggggcagagcaggccggagcccaagcacttatacacttcggacccgcttgtctgtctcctcctgctcggcctctgccagtggctttcgtcttgaggcaaagaagtgttgcacttgagctctgcgtgaaggcattcgaagcgcagaatcctgaccccaaggctccagtcgtgctactgtcagagccggcctgcgcccatgctctgggcagccctttccacgttgccctgccccctcccgagagtgaactgtgggaaacaccagacgtttcattaataaccggggacctgcgaccaccaccagcctggaagtcaagtaacgatcacggaagcttagccttgaccccccggccccagctcgagctagccgaaagcagcccggcagcaagctttctcagcagtcgcagttggcagggcctggagcctagacttggccagacaccagttaccgaagcagtttcagggcgccggggaatcgcaattgcttacgaggacgaaggctccgggtag

SEQ ID NO: 185859 - DNA, 1065 bp, Artificial Sequence
  Description of Artificial Sequence: Synthetic coding sequence
atgctgtggctgtggctgcacgactggcggcggcggcagggccagcgatgcagcttttgggttacgcaacccactgcggaagcactcgccaccctgctaaggcccagatacctggacctgttagtctctagtcccgccttcccgcagccggttggatcgctcagccctgagccaatgcccctggagagatttggaaggcgatttcccctggcccccggtcgacgactggaagagtacggagctttttatgttgggggaagtaaggcctcccctgatccagatctggatccagatctatccagactgctactggggtgggcccctggtcaacccttcagcagctgttgtccagacaccggcaaaacacaggatgagggagctcgggcgggcagactgcgcgctaggaggcggtatcttgtggagcgtgctagagacgctcgggtcgtgggacttcttgcaggaacactgggggttgcccagcacagggaagcactggcccacttacggaacctgacccaagctgcaggcaagcggtcctacgtgctggcactcggacgccctactccagcaaagctcgccaacttccccgaggtcgacgtgttcgtgctgctagcctgtcctttaggcgccctcgcaccacaattaagcggctccttttttcaacccatcttggccccttgtgaactggaagcagcctgcaacccggcctggccccctcctggcctggccccacacctgacccactacgccgatcttcttccaggctcgcccttccacgttgctcttccccctccagagagtgaattatgggagaccccagatgtgtcgctcattacgggcgatctccgacctccacctgcatggaaatccagcaacgaccatggcagcctggcactcacgcctcgcccgcaactcgaactagccgagagctcacccgcagccagttttctgtctagtagatcctggcaagggttggaaccccggctcgggcagacccccgtgactgaagcagtctctggccgccgaggtattgcaattgcatacgaagacgaggggagtggctag

SEQ ID NO: 185860 - DNA, 174 bp, Artificial Sequence
  Description of Artificial Sequence: Synthetic coding sequence
atggccgtgttccacgacgaggtggagatcgaggacttccagtacgacgaagactcagagacgtatttctacccctgcccatgcggagacaatttctcaatcaccaaggaccagttcgtgtgcggtgagaccgttccagctccttctgcaaacaaagaattggttaaatgctag

SEQ ID NO: 185861 - DNA, 249 bp, Artificial Sequence
  Description of Artificial Sequence: Synthetic coding sequence
atggccgtgttccacgacgaggtggagatcgaggacttccagtacgacgaggactctgagacttacttttacccctgcccttgtggcgacaacttcagcatcacaaaagaggatctcgaaaacggggaagatgttgccacttgcccctcttgctccctcattataaaggtgatttacgataaagaccagtttgtgtgcggggaaaccgtccctgctccaagcgcaaacaaggagctggtgaagtgctag

SEQ ID NO: 185862 - DNA, 855 bp, Artificial Sequence
  Description of Artificial Sequence: Synthetic coding sequence
atgctgtacctgatcggcctgggcctgggcgacgccaaggacatcacagtcaaaggattggaagtcgtacgccggtgctcccgggtctacttggaagcttacacttctgttttaaccgttggcaaggaggccttggaggagttttacgggagaaaactggtcgtggcagatcgtgaggaggttgagcaggaggccgacaacattctgaaggatgccgatattagtgatgtcgcctttcttgttgtgggcgaccctttcggtgcaacaacgcactcagacctggtactgcgggcaacaaaattagggataccttatagagttattcacaatgcaagcattatgaatgcagtggggtgttgtggcctgcagctgtacaaattcggtgaaaccgtgtcaatagtcttttggactgatacctggaggcctgaatctttctttgacaaggtgaagaagaacaggcagaacgggatgcacactctgtgtctcctggacatcaaagtgaaggaacagtccctcgagaatcttattaagggccggaagatatacgaacctcctcgctacatgtcggttaaccaggccgcccagcagcttctggaaatagttcaaaatcagcgaattagaggggaagagcccgtgactgaagagactctgtgtgtcgggttggcccgcgtcggcgcagacgaccagaagatagccgcagggactctgcgacagatgtgcactgtggatctgggagagcccctgcacagcctcatcattactggcgggagtatccatcccatggagatggagatgctgagtttgttttcgattccggagaattcaagtgaatcccaaagcattaacggtctgtag

SEQ ID NO: 185863 - DNA, 858 bp, Artificial Sequence
  Description of Artificial Sequence: Synthetic coding sequence
atgctgtacctgatcggcctgggcctgggcgacgccaaggacatcacagtgaagggattagaggtcgttcggaggtgctctagagtgtaccttgaggcttatacttccgtattaaccgtgggaaaggaggctctggaagagttctacgggcggaagcttgttgtcgcagacagggaagaagttgagcaggaagccgacaacatcctgaaagacgccgacatctccgatgtggccttcttggtggtgggggatccatttggcgccacaacgcactcagaccttgttctgcgggccaccaaactgggtattccatacagggtcatccacaacgccagcatcatgaatgccgtgggctgctgcgggctacaactgtacaaatttggtgagacggtaagcatcgtcttttggaccgatacctggcggccagagagctttttcgataaggttaaaaaaaataggcagaacggcatgcatacgctgtgtcttctggatatcaaagtcaaggagcaatctctcgaaaatctcataaaggggaggaaaatctacgaaccccctcggtacatgagcgtcaaccaggctgcacagcagctcctggaaatagttcagaaccagcggatcaggggagaggaacccgcagtgaccgaagagaccctctgtgtcggcctggccagagtcggtgccgacgatcagaagatcgccgccggcacgctccgacagatgtgtacggtggacctcggcgagcccctgcactctttaatcataaccggtggttcaatacatccaatggaaatggagatgttgagccttttttcgattcctgaaaattcctccgagtctcaaagcatcaatggtttgtag

SEQ ID NO: 185864 - DNA, 705 bp, Artificial Sequence
  Description of Artificial Sequence: Synthetic coding sequence
atgctgtacctgatcggcctgggcctgggcgacgccaaggacatcacggtcaaaggtctcgaggtggttcgccggtgttcccgggtatatctggaagcatacaccagcgtgctaacagtggggaaagaagctcttgaggagttctatggcagaaagctggtagtggccgatcgggaggaagtggagcaggaagccgacaacatcctaaaagacgctgatatatccgacgtggcgtttctcgtagtaggcgatcctaccgatacatggcggcctgaatcgtttttcgacaaggtgaagaagaacagacagaatggaatgcataccctctgtttgctcgacattaaggtgaaagaacagagcctggaaaatctcattaagggacgcaaaatctacgagccaccccggtatatgtcagttaatcaggcagcccaacagcttctggaaatcgtgcagaatcagaggatcaggggggaggaaccagccgtcactgaagagacactgtgcgtgggcctggcgagagtcggagctgatgaccagaaaatcgcggctggtacgctgcgtcagatgtgcacagtggacctcggcgagccgctccatagcctcatcatcaccggagggtctattcatcctatggagatggaaatgctgtcccttttttcaatccccgagaactcttcggaatctcaatctatcaacggactttag

SEQ ID NO: 185865 - DNA, 141 bp, Artificial Sequence
  Description of Artificial Sequence: Synthetic coding sequence
atgtgcaccgtggacctgggcgagcccctgcacagcctgatcatcactggcggtagcatccatcccatggagatggagatgctcagtttattctccattcctgagaacagctccgagagccagtccatcaacggactgtag

SEQ ID NO: 185866 - DNA, 855 bp, Artificial Sequence
  Description of Artificial Sequence: Synthetic coding sequence
atgctgtacctgatcggcctgggcctgggcgacgccaaggacatcaccgtgaagggtcttgaggttgtcagaaggtgctcgagagtgtacctggaggcatataccagcgtgcttaccgtaggcaaggaggccttggaggagttctatgggcggaagcttgtggtggcagaccgggaagaggttgaacaggaagcagataatatccttaaagatgcagacatatcagacgtggcctttcttgtggtcggcgacccgtttggcgctaccacacattctgacctggtgcttagggcgaccaaacttgggatcccttaccgggtgattcacaatgcgagcataatgaacgccgtgggctgctgtggactgcagtatatctcccttgaacgtcagttccttctgttttttgggcaaacgctgggccccgagtcgtttttcgataaagtgaagaagaacaggcagaacgggatgcatacactgtgcctgctcgacatcaaagttaaagagcaatcccttgagaatctgattaaagggcggaaaatctatgagccccccagatacatgagcgtgaatcaggcggcccagcagctgctcgagatcgtgcaaaatcagaggattagaggcgaggaacctgctgtcactgaggagactctgtgcgtgggcctcgcccgcgttggggccgacgatcagaagatcgctgcaggaaccctgcgccagatgtgtaccgtggatctgggggaaccccttcacagccttataatcaccgggggttcaatccatcccatggagatggaaatgctcagtctattctcgatccctgagaatagctcggagtcccagagcattaatggactgtag

SEQ ID NO: 185867 - DNA, 858 bp, Artificial Sequence
  Description of Artificial Sequence: Synthetic coding sequence
atgctgtacctgatcggcctgggcctgggcgacgccaaggacatcaccgtgaagggcctggaggtggtcagacgctgtagcagagtctacttggaggcctatacatcggttctgacggtcgggaaggaggctcttgaggaattctatgggcggaagctcgttgtggccgacagagaggaggtggagcaggaagcagataatattttaaaggacgctgacatttctgatgtcgccttcctcgtcgtcggcgacccctttggagccaccacccattcagacctggtactgcgagccaccaagctcggcataccttacagagtcatacataacgcatcaatcatgaatgcagtcggttgctgcggactacagctctacaaattcggggaaacagtctctatcgtgttctggaccgacacatggcggcccgaaagcttcttcgataaagtgaagaaaaataggcagaatggcatgcacaccctctgtttgttggatataaaggtaaaggaacagtccttggaaaatctcatcaagggacggaagatttatgagcccccccggtacatgtccgtgaaccaggctgctcagcagttgttggagatcgttcaaaatcagcgcatccgaggcgaggagccagcagtgactgaagaaactctctgcgtgggccttgccagagtgggcgcggatgatcagaaaattgccgcggggaccttaaggcagatgtgcactgtggatctcggggagcctctgcatagtctcattataacgggggggagcatccatcctatggagatggagatgctgtccttgttttcaatacccgaaaacagttctgagtctcagagcatcaatggcctgtag

SEQ ID NO: 185868 - DNA, 2028 bp, Artificial Sequence
  Description of Artificial Sequence: Synthetic coding sequence
atggagggccggcccccccccgagggccggccccccccccggccccgtaccggtcgggcgcctcgaggaagaagacgcgccgtctttgctgctgttcttcattggagtcatattacccacctgttcgaaaatgaccggcacttctctcatctttctaccttagagcgagagatggccttccgtacagagatggggctctactattcttattttaaaaccatcgttgaggcaccgagttttctgaatggcgtgtggatgattatgaatgacaaacttacagagtatcctctggtgattaacaccctgaaacggttcaacctgtacccagaagtcatccttgcctcctggtaccgaatctatacaaaaattatggatctcataggtattcaaactaagatatgctggactgtcacccgcggcgagggcctgtccccgatcgaaagctgtgaggggctcggagatcccgcatgcttttacgtggccgtcattttcattcttaacggcctgatgatggctttgtttttcatctacggcacctacctgtcaggatcccggcttggtggcctagtgaccgtgctgtgttttttcttcaatcatggagagtgcactagagttatgtggacacccccacttcgggagtcattcagctacccctttctggtcttgcaaatgcttctggtaacgcacatcctaagggccactaagttatatcgtgggagcctgatcgccctctgcatctctaacgtgttcttcatgcttccttggcagtttgcacagtttgtcctgctgacccaaatcgcatccctgtttgctgtgtatgtagttggatacattgatatttgcaaactccggaaaataatctacatccacatgattagtctagctctgtgcttcgtgctgatgtttggtaattccatgcttctgacaagctattacgcaagctcgctggttatcatttggggaatcttagccatgaaacctcactttctcaaaattaacgtgtccgaactgtccctgtgggtaatacagggctgcttctggctgttcgggacagttatcctgaagtacctcaccagtaaaatttttggaatcgctgatgatgcacatatcggcaatctcctgacatctaaattcttctcttacaaggattttgacacccttctgtacacatgcgcagctgagttcgacttcatggaaaaagaaactcctctccgttatacaaagacactcctgctgccagtcgttctagtcgtgttcgtggcaatcgtgcgcaaaattatatcagacatgtggggcgtgttggctaagcagcagacacatgtgagaaaacaccagtttgaccacggcgagctggtctaccacgctctgcaactattggcctacaccgcattgggtattctgattatgagattgaagctgttccttacaccccatatgtgcgttatggcatcgctgatttgtagtcgacagctttttggctggctgttctgcaaagtgcaccccggagcaattgtctttgctattctggccgccatgtcgatccagggctctgctaacttgcagacccagtggaacatagtgggcgaattttcaaatctgccacaggaggagctgattgagtggattaaatacagcaccaaaccagatgcagtcttcgccggcgcgatgcctacaatggcatctgttaagctctctgccctgcgacccatcgtgaaccatccacattatgaggacgctggactgcgcgccagaactaaaatcgtgtattccatgtattctaggaaggccgcggaggaggtcaaaagagaactgattaagctgaaggtgaactattacatcctcgaggagtcatggtgtgtgcggcgctctaagcccggatgcagcatgccagaaatttgggatgtggaagaccccgccaacgccggaaaaaccccattatgtaacctcctggtgaaggacagtaaaccccactttacaactgtctttcaaaatagcgtgtataaagtgcttgaagtggttaaagagtag

SEQ ID NO: 185869 - DNA, 258 bp, Artificial Sequence
  Description of Artificial Sequence: Synthetic coding sequence
atgtacagccggaaggccgccgaggaggtgaagcgggagctgatcaaactgaaagtcaactactacatcctggaggaaagttggtgcgtccggaggtctaagcccgggtgctctatgcccgagatctgggacgtcgaggatccagcaaacgcaggcaagaccccgctgtgcaaccttctggtcaaggactccaagcctcactttaccaccgtatttcagaattcagtgtacaaagtgctggaggtcgtcaaggaatag

SEQ ID NO: 185870 - DNA, 2277 bp, Artificial Sequence
  Description of Artificial Sequence: Synthetic coding sequence
atgcggaagcagggcgtgagcagcaagcggctgcagagcagcggccgcagccaaagtaagggtaggaggggtgcctcgctggctcgagaacccgaagtggaagaggaaatggagaagagtgctctcggagggggaaaacttccccgcggctcgtggcgctcttctcctggcaggatccaatcccttaaggagaggaagggtctcgagcttgaggtcgtggctaagactttcctactcgggcccttccaattcgtcaggaatagcttggcacagcttagagaaaaagtccaggagcttcaggctagaaggttttcctcccgtaccacactcggaattgccgtattcgtcgcaattctgcactggctgcatttggttacgctgttcgagaacgaccggcacttcagccatctttcctccctggaaagagaaatgacctttcgcaccgagatgggcctgtactacagttattttaagaccattatcgaagcacccagcttcctcgaaggtctctggatgatcatgaacgatagactgacagaataccccctgatcattaacgccattaagagattccacctttatcccgaggtgatcatcgcgagttggtattgcactttcatgggtatcatgaatttattcggtctcgaaacgaaaacatgctggaatgtgaccagaatcgaaccactgaacgaggtgcagagttgcgagggcctcggtgaccctgcatgcttctacgtaggagtaatatttatactgaatgggcttatgatgggccttttctttatgtatggagcatatctgtcaggcactcaattgggcgggcttatcaccgtgctttgttttttcttcaaccacggggaggccacaagggtgatgtggacccctcctctgcgggagtcgtttagctacccttttttggtactgcagatgtgtattctaacgcttatcttaagaaccagcagtaacgatagacgccctttcattgccctttgcctttcgaatgttgcctttatgctaccttggcagtttgcacagttcattctgtttacacaaatcgcatccctctttcctatgtatgtcgtagggtacatcgagccttctaagtttcagaaaattatctacatgaacatgatatccgtgaccctgagttttatcctaatgttcgggaatagcatgtatttgtcgagttattacagctcctcactgctgatgacctgggctattatcctgaaacgaaacgaaatccagaagctgggcgtgtccaagctgaacttttggctcattcaaggctcagcttggtggtgtggaacgattattttgaagttcctaacatctaagatcttgggagtttccgaccacatacgcctgagcgacctgatcgctgcgcgtatactgcgttatacagactttgacaccctaatctacacctgcgcaccagagttcgacttcatggagaaagccacgccattgcgatacactaaaacgctcctgctgcctgtcgtaatggtgattacatgttttatcttcaagaaaactgtccgcgatatcagttacgtgttggccaccaacatatatctgcgcaagcaactgctggagcatagcgagctagcttttcacaccctgcagctgctcgtcttcacagcccttgcaattctgattatgcggttgaaaatgttcctgaccccccacatgtgcgtgatggcgtcactgatttgttccagacagctgttcggctggctatttcgacgggtcagattcgagaaagtgatcttcggaatcttgacggtgatgtccattcagggctatgctaacctgagaaaccagtggtcaattatcggtgagttcaataacctcccacaggaggagctcctccagtggattaagtacagcacaacctcagacgccgtcttcgcaggcgccatgcctacaatggcaagcatcaagctgtccacactgcacccaatcgtgaaccaccctcactatgaagacgctgatctccgagcaaggaccaagattgtatacagcacctatagtcgcaagagcgccaaggaggtcagggataaactcttagaactgcatgtcaattactatgtactcgaggaggcctggtgtgtcgttaggacaaagccaggctgtagcatgctcgaaatctgggacgtagaggacccttccaacgccgcaaacccaccactctgttccgtcctgctggaagacgctaggccatactttaccaccgtgttccagaactccgtctatcgggtgctcaaggtgaactag

SEQ ID NO: 185871 - DNA, 618 bp, Artificial Sequence
  Description of Artificial Sequence: Synthetic coding sequence
atgcggctgaagatgttcctgaccccccacatgtgcgtgatggcctctctcatctgtagcaggcagctatttggctggctgttccgccgagtacgtttcgagaaagtcatctttggtatactaacagtgatgtcaatacaaggctatgcgaaccttaggaatcagtggagcatcataggcgaattcaataacctcccccaggaggaactgctgcagtggatcaagtatagcaccacatccgacgccgtctttgccggggccatgcctacaatggcctccattaaactgtccacattgcaccccatagtaaaccacccgcattatgaggatgctgaccttcgtgcccgaaccaaaatcgtgtacagtacctacagccgcaaatcagctaaggaagtgagggacaagctcttagagctgcatgtgaactattatgtcttagaggaggcatggtgtgttgtcagaacgaaacccggttgtagcatgctggagatttgggacgttgaggacccatctaacgccgcaaatcctcccttatgttccgttctcctcgaagatgcgagaccctacttcactacggtctttcagaactcagtgtaccgagtcctgaaggtgaactag

SEQ ID NO: 185872 - DNA, 273 bp, Artificial Sequence
  Description of Artificial Sequence: Synthetic coding sequence
atgcggaagcagggcgtgagcagcaagcggctgcagagcagcggccggagccagtcaaagggcaggagaggagccagtcttgctcgcgaaccggaggtcgaagaggaaatggagaaaagtgcgcttggagggggcaaactccctcggggatcatggcgctctagccccgggaggatccagtcacttaaggagaggaaaggattagaactggaggttgtggctaagaccttcctgctgggaccttttcagtttgtgcggaattcacttgcttag

SEQ ID NO: 185873 - DNA, 1629 bp, Artificial Sequence
  Description of Artificial Sequence: Synthetic coding sequence
atgatgagcatccggcagcggcgggagatccgggccaccgaggtgagtgaagatttccccgcccaggaggaaaacgtgaaactggaaaacaagttgccttccgggtgtacatctcgaaggctgtggaagattttaagcctgaccattggagggaccatcgctttgtgtattgggctccttacaagtgtgtacctggcaactctccacgagaatgatctgtggttttccaatataaaagaagtggaaagagaaatctccttcaggacggagtgcggcttgtattattcttactacaagcagatgttgcaagcaccgacactcgtacagggattccacggcctgatatacgacaacaaaacagagagcatgaagactatcaacctgctgcaacgtatgaatatttaccaagaggtatttctgtcaatcctgtaccgagtcctcccaattcaaaaatatctcgaacccgtttatttctacatctacactttatttggccttcaagccatttatgtcactgccttgtatattaccagttggctgttgtccgggacttggctatctggactcctggctgctttttggtacgtcactaatagaatagatactactagagtggaatttacgatccctctcagggaaaattgggcacttcctttcttcgcgattcagatcgccgcgatcacttacttcctgaggccgaatctccaacccctgtctgaacgtctgacactcctggccattttcatatcaaccttcctgttctcactgacttggcagtttaatcagtttatgatgctcatgcaggctctggttctgttcacccttgattcacttgatatgctcccagctgttaaagcaacatggctttatggaatccaaatcacttctctcctgctggtctgcatcctgcagtttttcaactcaatgattctgggttccttactgatctcatttaacttgagcgtgttcatcgccagaaagctccagaagaatctcaaaactgggagttttctcaatcgactgggaaagttacttctgcacctcttcatggtcttgtgcctgacattgtttcttaataatatcataaaaaaaatactgaaccttaaatctgatgagcatatcttcaagttccttaaggcgaaattcggcttaggcgcaacccgcgacttcgatgccaacttgtacttgtgcgaagaggccttcggcttattaccatttaacacatttggacgactcagtgataccctgcttttctatgcctatatatttgtcctcagcatcacagtgattgtcgccttcgtcgtggcttttcacaacctcagcgacagtacgaatcaacagtccgtggggaaaatggagaaaggtacagttgaccttaaacccgaaactgcttataacctgattcacaccattctgttcggttttctggccctgtctaccatgagaatgaagtacctgtggacatctcacatgtgtgtgtttgcctcctttggcctttgctctccagaaatttgggagcttttactgaagtccgtccacctttacaatcccaaacgcatctgcattatgagatactcagtgcctattttaattctgctgtatctatgctataagaaccaaaagtcctag

SEQ ID NO: 185874 - DNA, 2151 bp, Artificial Sequence
  Description of Artificial Sequence: Synthetic coding sequence
atgatgagcatccggcagcggcgggagatccgggccaccgaggtgtccgaggacttcccagcccaggaagagaatgttaagttggagaataagttgccctcgggctgcacttcacgccggctttggaagatcctttcgcttactatcggcggaaccatagctctctgcattgggctcctgacgtcagtttatctagctacactgcatgagaatgatctgtggttctctaacattaaagaggtcgagagagaaatctctttcaggactgagtgcgggctgtattattcctactacaagcagatgctgcaggcgcctactcttgtacaggggtttcacggcctaatctatgacaacaaaacagagtccatgaagaccattaacctgctgcagcgcatgaatatctatcaggaagtcttcctctccatcctttatcgggtgctgcccatccaaaagtatcttgaacctgtgtacttctacatttacacactgttcgggctgcaggccatctacgtgacagcgctttacattacgtcctggcttttgagcgggacctggctttctggattactggctgctttttggtacgtaactaacaggatcgacaccacccgggtcgaattcacaataccattaagggagaactgggcgctccccttttttgccatccagattgccgctattacgtactttttgcgcccaaatcttcagcctttatcggagcgattaacacttttggccatatttatctctacattcctgttttctctcacatggcagttcaatcagtttatgatgctgatgcaggcccttgtgctgttcacgctggactccctggacatgttgcccgcagttaaagccacatggctgtacggtatccagatcacatccttgctgctggtgtgcatcttgcagttcttcaacagtatgatcctggggtctcttctcattagcttcaacttgtcagtcttcatcgcacggaagctacaaaaaaacctgaagacaggaagttttctcaaccggctggggaaactacttcttcatctgttcatggttctgtgtctgactctcttcctgaataatatcatcaagaagatacttaacctgaaatccgacgaacacatcttcaaattcctgaaagccaaattcggactgggagccacccgagatttcgacgccaacttatacctatgcgaggaggccttcggactgttacctttcaatacttttggacgactctcagacacattgcttttctatgcctatatattcgtcctctctataactgttatcgtggcattcgtagtagcattccataacttatctgatagcaccaatcaacagtccgtcggcaaaatggaaaaaggcaccgtcgatttaaagcccgagaccgcctataacctgattcatacaatactctttggattcttagccttgagtactatgaggatgaagtacttgtggacctctcatatgtgtgtattcgcctcatttggcctttgcagtcccgagatctgggaacttctactaaagtcagttcatctatacaaccccaaaaggatttgcattatgcgatatagcgtgcccatactgatcctgctatacctgtgttataaattctggcctggcatgatggacgaactgagcgagttaagggagttctatgacccagataccgtggaactgatgaattggattaactctaataccccaagaaaagcagtgttcgctggatccatgcagttgctggctggcgttaagctgtgcaccgggaggacactcacaaatcaccctcattacgaggatagctccctgagggaacgcacacgtgccgtctatcagatctacgcgaagagagcaccggaggaagtgcatgcccttctcagatccttcggaacagattatgttattctggaggacagcatttgctatgaaagacgtcacaggaggggctgtcgcctgcgcgatctcctggacatcgcgaacggacacatgatggatggtccaggggaaaatgatcccgacctcaaacctgcggatcatcctcgcttttgcgaggaaataaagaggaatctgcctccgtacgtggcatacttcacgcgcgtcttccagaataagacttttcacgtgtataaattatctagaaacaagtag

SEQ ID NO: 185875 - DNA, 342 bp, Artificial Sequence
  Description of Artificial Sequence: Synthetic coding sequence
atgatgagcatccggcagcggcgggagatccgggccaccgaggtgtccgaggactttcctgctcaggaggagaacgttaaattggagaacaagctacctagtggatgtacatcaaggcgcctgtggaagattctgagtttgaccatcggtgggacccttccatttgcgctggacttcctacatctatccactctgcctaggtacatgaaaatgatctacgggttcctgattttgaggaagtggagcgagaagagccactctgagcagagcgtggcttgcattactccaacgaccagtcgttgctgccggctgcaaccatcctgtaaagttttcatggcctag

SEQ ID NO: 185876 - DNA, 2151 bp, Artificial Sequence
  Description of Artificial Sequence: Synthetic coding sequence
atgatgagcatccggcagcggcgggagatccgggccaccgaggtgtcggaagacttccccgcgcaggaggagaatgtaaagctggagaacaagcttccatccggctgcacctccaggagactgtggaagatcttaagtcttactattggtggcactatcgccctctgcataggtttgctgacctcagtatacttagctaccctgcacgaaaacgatttgtggttttcgaacatcaaggaagtggagcgggaaatttcttttcgcaccgagtgtggcctgtactactcgtactataagcagatgctgcaggctcccactctagttcaggggttccacggtctcatctacgacaacaagacagagtctatgaaaacaattaatctgctgcagagaatgaacatctaccaggaggtctttctgagcattctataccgtgtgctcccaattcaaaaatatctggagcccgtgtatttctatatttatacactttttggtctccaggccatatacgtgacagccctgtacattacttcctggctgctcagcggaacctggctgtctgggctccttgcagcattttggtatgtcacaaacagaatagacaccacgcgtgtggagttcaccattcccctccgcgaaaattgggccctccccttctttgccatccaaatcgcggcaatcacttatttcctgcggcctaacctgcaaccgctaagcgagaggcttactctgttggccatttttatttccaccttcctcttttcgctgacctggcagttcaatcagtttatgatgctcatgcaggctctggtactgtttaccctggactcactggatatgttgccggccgttaaggcaacttggctgtacggaatccaaataaccagcctgttgctcgtctgcattttacagtttttcaatagtatgatcctcgggtccctgcttattagctttaatttgagcgtcttcattgcccgcaagctacagaaaaacttaaagacagggagctttcttaatcggcttggtaaacttcttctgcatttgtttatggttttatgtcttacactatttctgaataatattatcaaaaagatcctcaacctcaaaagtgacgagcacatatttaaattcctcaaggccaaattcggtctcggggctacgagagatttcgacgcaaacctgtacctttgcgaggaagcattcggcttgctgccatttaataccttcgggcggctgagtgatactctcctcttttacgcctatatcttcgtcctaagtattacagtaatagtggcctttgtggtcgcttttcataatctgagcgacagcacaaaccagcaatccgtgggaaaaatggagaagggtacagtagatctgaagccagaaaccgcgtataacctcattcatacaatcctgttcggatttctcgccttgtccactatgaggatgaaatacctctggacaagccatatgtgcgtctttgcatcatttgggctctgttcccccgagatctgggagctgctgctcaaatctgtccacctttacaacccaaaacgcatatgtattatgagatactctgtgccaattcttatcctgctgtacctatgttacaaattctggccaggcatgatggacgagctttccgagctcagggaattctacgatcccgacactgtcgagctcatgaattggattaactctaacacaccaaggaaggcagtgttcgcgggcagcatgcagcttctggctggtgtgaaactctgtacaggtcggacgctgacgaatcacccccattacgaggattccagcctgcgtgaacgtacccgggctgtatatcaaatatatgcaaagagagcccccgaggaggtgcatgcattattgaggtcatttggaacagactacgtgattctggaggacagtatatgctacgagcgtcgacaccggaggggctgtcggctgagggatctgctggatattgcaaacgggcacatgatggatggacctggcgagaacgacccggacctcaaaccagctgatcatccaagattttgcgaagaaataaagcggaatctgcccccctatgtcgcgtacttcacgcgtgtcttccagaacaagacttttcatgtgtacaagttgtccaggaataagtag

SEQ ID NO: 185877 - DNA, 2172 bp, Artificial Sequence
  Description of Artificial Sequence: Synthetic coding sequence
atggccgaggaggagggcccccccgtggagctgcggcagcggaagaaaccaaagtcttcagagaataaggaatctgccaaggaggagaaaatctccgatatcccaatccctgagagggctcccaagcatgttctgtttcagaggtttgccaagatatttatagggtgtttggccgcggttacaagtggtatgatgtacgccctgtatctctcggcctaccatgaacggaagttttggttctcaaataggcaggaattggagagggaaattacatttcagggcgattctgcaatctattattcctattacaaggacatgctgaaagcccccagcttcgaacgcggcgtctatgagcttacccacaataataaaaccgtcagtctgaagacgatcaatgcggtacagcagatgtctctgtaccccgagctcattgcttccattttgtatcaggccactggatctaatgaaattatagagcccgtgtatttctatatcggtatcgtgttcgggttgcagggtatatacgtaaccgccctgttcgttacttcttggcttatgtcaggcacatggttggcaggcatgttgaccgtcgcctggttcgtgataaatagggttgataccactaggatcgagtacagcattcccctgcgagaaaactgggccttaccttactttgcctgccagatcgccgcccttaccgggtacctgaaatcaaacctgaacacgtatggcgagcggttttgctatcttcttatgtccgccagcacatatacctttatgatgatgtgggagtacagccattacctgctcttcctgcaggccatctctctctttcttctggacaccttttcagtcgagcagagcgataaagtatacgaagtttacaagatctacatcttctccctgttcttgggatatctgctgcaattcgagaaccccgccctcctggtgagtcctctgttaagtctggtcgcagccctgatgctggctaaatgtctccagttaaacgtcaagaaagggagcttcgtcgctaaaataataaaggtcatcaacttctaccttgtgtgtactctcaccattaccttgaatattataatgaaaatgttcgtgccacacaaagagaatggccatatgctcaagtttctagaggtgaagttcggactgaatatgaccaagaatttcactatgaactggctgctatgtcaggagtccttgcaggcccctagccaggatttcttcctccggctcacccagtcaagcctcctgcccttttacattctggtcctgattatctgcttcttgagtatgctacaagttatctttcgacgaatcaacgggaagtctctcaaagagacagtaaccctcgaagatggccgaattggagagcgccccgagataatatatcacgtgatccatacgattctgcttggctctctcgctatggtcattgagggattgaagtatatttggatcccctacgtctgcatgctcgccgcatttggtgtgtgcagcccagagctttggatgacgctgtttaaatggttgcgcctcaggacagtgcatccgatattgcttgcgcttattctcagcatggccgtacccaccattatcgggctgagcctctggaaggaattcttccctagactcatgacagaactgatggagctgcaggaattttatgaccctgataccgtggaactgatgacctggatcaaaaggcaagccccagttgcggccgtgtttgcggggagtcctcagctgatgggtgctatcaagctctgcacgggttggatggtgacttcactaccactctacaacgacgatgacctgctcaaaagaaatgagaatatctatcagatctacagcaagcgcagcgccgaagacatatataagattctaacgtcatataaggccaactatctgattgtggaagatgccatttgtaatgaagtgggtccaatgcgtggatgtagggtcaaggacttgctagatattgccaatgggcacatggtctgtgaggaaggagacaaactaacctactcgaagtatggcaggttctgtcatgaagtcaagattaactactcaccatacgtgaactacttcacccgcgtgtactggaaccgaagctatttcgtctacaaaatcaacaccgtgatatccttccaatcatag

SEQ ID NO: 185878 - DNA, 300 bp, Artificial Sequence
  Description of Artificial Sequence: Synthetic coding sequence
atggagcccgagcagatgctggagggccagacccaggtggccgagaatccccactcagaatacgggttaaccgacaatgtggagaggatcgtggagaacgaaaagataaatgccgaaaagtcttctaaacaaaaggtcgacctccagtccctgccaacacgggcctatctcgaccagaccgtcgtccccattttattgcagggcctcgctgtgctagccaaagagagaccgcctaatccaatcgagttcctggcgtcctacctgttgaaaaacaaggcccagttcgaggaccgcaattag

SEQ ID NO: 185879 - DNA, 300 bp, Artificial Sequence
  Description of Artificial Sequence: Synthetic coding sequence
atggagcccgagcagatgctggagggccagacccaggtggccgagaatcctcactcggagtacgggctgaccgacaacgttgaacggattgtggagaatgagaagatcaacgcggagaaatctagtaagcagaaggtggatttgcaatctcttccaacaagagcttacttagaccaaactgtggtcccaatactgctgcaaggtctggccgtgctggccaaagagcgacccccgaatcccatcgaattcctggcttcttatcttttgaaaaataaagcccagttcgaagaccgcaattag

SEQ ID NO: 185880 - DNA, 1956 bp, Artificial Sequence
  Description of Artificial Sequence: Synthetic coding sequence
atggccggccacccctggcacggcaccgccgccctggccagcagccaggcctggcgcgacggcagagaacgccaggcactggtgtcctgtcgggccctttatacctacgaggacggctctgacgatctcaaactggctgcctctggggaagggggtctccaggagctcagcggccatttcgaaaatcagaaggtgatgtacggattttgttctgtgaaagacagccaggcagctcttccaaagtatgtgctcataaattgggttggcgaggacgttcctgacgcacgtaagtgtgcttgcgcctcacacgtagccaaagtggctgaattctttcaaggcgtggatgtgatcgtcaatgcttcctccgtggaggacatcgatgccggtgccattggccagagacttagcaacggcttggctagactgtcctctcctgttctccaccggctgcggctgagagaggacgaaaatgcagagccagtagggactacataccagaaaacggatgctgcggtggaaatgaagcgcattaatagggagcagttttgggaacaggccaaaaaggaggaagagctcagaaaggaggaggaacggaaaaaagccttggacgagcgtctgaggtttgagcaagaaagaatggagcaggaaagacaggaacaagaggagagggaaagacgctatagggaaagagaacagcagatcgaggaacatcgccggaaacaacagactcttgaggctgaggaggctaagaggcgtttgaaggaacagtcgatcttcggcgatcatagagacgaagaagaagagactcacatgaagaaaagcgaaagtgaggtggaagaagctgctgctataatcgcgcaacgcccagacaacccacgcgagtttttcaaacaacaggaacgcgtggccagtgcctccgctggatcatgcgacgtcccatccccattcaaccaccggcctgggtcacatttggatagccaccgaagaatggcccctacaccaatccccaccaggagcccatccgactctagcacagcttccacgccggtcgccgagcagatcgaacgggccctagacgaagtcaccagttcccagccaccacccctgccaccaccgcccccccctgctcaggagacccaggaaccatcacccatacttgactcagaagaaactcgggcggccgccccgcaagcttgggcagggcccatggaagaaccgcctcaggcccaggcacccccccgggggccaggctcccctgccgaagatctaatgttcatggaatcagcggagcaggcagtgctggccgcccccgttgagccggctactgccgacgcgaccgaaatccacgacgctgccgacaccatcgaaactgacacggccactgcagacaccaccgttgcaaataatgtgcctccagcggctacgtccctgatcgatttgtggccagggaatggggagggcgccagcacactccagggcgagccccgggcacccacacctcctagtggcaccgaagtaacactcgctgaggtgcctttactagatgaggttgccccagagcccctccttcctgccggggagggatgcgccaccctgctgaacttcgacgagctgccagagccccccgccaccttctgtgatccggaggaagtggagggggagtcactggccgctccccaaacacccacactcccctcggcactagaggaactggagcaggaacaggaacctgagccccaccttctcacgaacggggaaactacacagaaggaagggacccaggccagcgaggggtatttcagccagtcccaggaggaggagtttgcccaatccgaagaactgtgcgccaaggccccccctcccgtcttctataataaaccacctgagatcgatataacatgctgggatgccgaccccgttccagaggaagaagaaggctttgaggggggggattag

SEQ ID NO: 185881 - DNA, 1950 bp, Artificial Sequence
  Description of Artificial Sequence: Synthetic coding sequence
atggccggcgtgagcttcagcggccaccggctggagctgctggccgcatacgaggaagtcatccgagaggaaagtgctgccgattgggccctgtatacctatgaggatggcagcgatgatctgaaacttgccgccagcggcgagggaggtttgcaagaactttctggacactttgagaaccagaaggtgatgtacggattttgctcagtaaaggactcccaggctgccctgccgaagtatgtcctgattaattgggttggggaagacgtgcccgacgcacgaaaatgtgcttgcgcatcgcacgtcgctaaggtcgcagaatttttccagggtgtagacgtgatcgtgaacgcgtctagcgtggaggacatcgacgcgggggcgatcggacagcgactgtcaaacggcctggcacgccttagcagccctgtgcttcatagactccgacttcgggaggacgagaacgccgagccggtgggcactacctaccagaagacagacgcagccgtcgagatgaaaagaatcaaccgggagcagttttgggagcaggcgaagaaagaggaagagctacgaaaagaggaggagagaaaaaaggccctggacgagagattgcggttcgagcaagaaaggatggagcaggagcggcaggagcaagaggagcgggaaagaaggtacagggagcgtgagcaacaaattgaggaacaccgtcggaaacagcagacgctggaggccgaggaagctaagcgtaggctgaaggagcagagcatcttcggcgatcacagggacgaggaagaagagacacacatgaaaaagtccgagagcgaagtggaggaagcagctgcaatcatcgctcagcgacccgataacccgcgcgagttctttaagcagcaagaacgcgtggcatccgcatcagcgggtagttgtgatgttcctagcccgttcaaccaccgtccaggctctcacctagatagccatcgtcggatggcccctacaccgattccaaccagaagccccagcgacagcagtaccgcaagcacaccagtggctgagcagatagaacgggccttggacgaagttacttcaagtcagcctcctcctctccctcctccacctcccccggcccaggaaacacaggagccctcgcctatcctggattcagaagagacacgagccgctgctccgcaggcatgggccggcccaatggaagaaccgcctcaggcacaggcaccccctcgtgggcccggcagccccgcagaagatctaatgtttatggagtcagccgagcaggcagtgctagcagcccctgtggaacctgcaacagcagatgccacagaaatacacgatgccgcagatacgatcgagacagacactgctaccgccgacacaacagtggctaataacgtgcctccagctgcaaccagcctcatcgacctttggccaggtaacggcgaaggagcatccacattgcagggcgaaccaagggctcccacccccccttccggaacagaagtcacccttgccgaggtgcctctcctggacgaagtcgcgcctgaaccattgctgcctgcgggagagggatgtgctacactccttaattttgatgaactgcccgaacctccagccaccttctgcgatcccgaagaggtcgaaggggaatcactggcggctccgcagaccccaaccctcccctccgccctagaggaacttgaacaagagcaggagccagaaccccacctcctcacaaatggcgagaccacgcagaaagagggcacacaggcctcagagggctacttttcccagtcccaagaagaagagttcgcccagtccgaggagctgtgtgctaaggctcccccaccagtcttctacaataaaccccccgagatagatattacctgctgggatgctgaccccgtgcctgaagaagaagaaggcttcgaaggaggggactag

SEQ ID NO: 185882 - DNA, 1146 bp, Artificial Sequence
  Description of Artificial Sequence: Synthetic coding sequence
atgaagaagagcgagagcgaggtggaggaggccgccgccatcatcgcccagcggcctgacaatccccgggaattcttcaagcaacaggaacgagtggcatctgcaagcgccggcagctgcgatgtgccaagtccctttaaccacagaccgggcagccaccttgacagtcaccgcagaatggcccccacccccatccccaccagatctccaagtgactcttccactgcatcaacacctgtggccgaacagattgaacgagccctcgatgaagttacgtcgagccaacctcctccactgcctcccccgccccctccggcccaggagacgcaagaacccagccctatactggattccgaggagacccgcgccgccgctccccaggcttgggctgggcccatggaagagcctccacaggctcaagccccccctcgcggcccgggttctcccgccgaagacctgatgttcatggaatctgccgagcaggccgtcttggctgcccctgttgagccagcaaccgcagacgccacagaaatccatgatgccgctgacaccatcgaaacggacacagcgacagccgataccacagtggccaataacgtgcccccagccgctacatccctgatcgatctctggcccgggaatggcgaaggggccagcactcttcagggcgaaccacgggcccccacgccaccttcgggaacagaggtcaccctagcagaggtaccactcctcgatgaggtagcaccagagccactgcttcccgccggggagggatgcgcaacactgttgaattttgacgagcttcctgagccacccgccacattttgtgaccctgaagaggtagaaggggagagcctcgccgccccccagacgcccacactgccgtctgccctcgaagaattagaacaagaacaggaacccgaaccccaccttctgacaaacggcgaaacaacgcagaaggaaggcactcaagcttctgagggctatttctcccagagccaagaggaagagtttgcacagagcgaggagctctgcgcgaaggctcctcctcctgtattttataataaaccaccagagattgacatcacatgctgggacgcagatccagtgcctgaggaggaagaaggtttcgaaggaggtgactag

SEQ ID NO: 185883 - DNA, 954 bp, Artificial Sequence
  Description of Artificial Sequence: Synthetic coding sequence
atggccggcgtgagcttcagcggccaccggctggagctgctggccgcgtatgaagaggtcatcagggaggagtctgcggccgattgggcactttacacatacgaggatgggtctgacgatcttaagctggcagctagcgggggcgggctgcaggagctgagcggccacttcgagaaccagaaggtcatgtatggcttctgtagcgtcaaagattcgcaggccgcactgccaaaatacgtgttgatcaactgggtgggcgaggatgtccccgatgctaggaagtgtgcttgtgccagtcacgtggccaaagttgctgagttttttcaaggagtggacgtgatcgtgaatgctagcagcgtggaagatatcgatgccggcgcgataggacagaggctcagcaacggacttgcacgcctgagctctccagtcctccatcgtctgcggcttcgtgaggacgagaatgccgaaccggttggaaccacataccagaagacggacgctgctgtcgagatgaaacggatcaatcgcgagcaattctgggagcaggcaaagaaagaagaggagttgcgcaaagaagaggagcgcaagaaagccctagacgaacgcctgcgttttgagcaggaaaggatggagcaagaacggcaggaacaagaagagagagaaagacgttacagagaaagagaacaacagatcgaagagcaccgaaggaagcagcaaactctcgaggctgaggaggctaagcgccgactgaaagagcagagcatattcggagatcacagggatgaagaagaggagacgcacatgaagaaatctgagtccgaagtggaggaggctgcggctatcatcgcacagagacctgataacccaagagagtttttcaagcagcaggaaagagtggcatctgccagcgcgggtagttgtgatgttccatccccttttaatcacagaccttag

SEQ ID NO: 185884 - DNA, 375 bp, Artificial Sequence
  Description of Artificial Sequence: Synthetic coding sequence
atggccggcgtgagcttcagcggccaccggctggagctgctggccgcttatgaggaggtcatccgagaggagtctgctgcggactgggccctctacacatatgaagatggcagtgacgatctcaagctggccgcgtccggggagggtggactccaggagctgtcaggccacttcgagaaccagaaggtcatgtatggattttgctcagtcaaagatagtcaggccgcattgccaaagtatgtgttaatcaactgggtgggcgaggatgtgccagatgctcgaaaatgtgcttgtgcatcacatgtagcaaaagtcgcagagtttttccagggagttgacgtaattgtgaatgcctcttccgtcgaggacatttag

SEQ ID NO: 185885 - DNA, 3900 bp, Artificial Sequence
  Description of Artificial Sequence: Synthetic coding sequence
caccggatgagcttccaccccggccggggctgcccccggggccggggtggccacggcgcacgcccatccgcccctagctttagaccacaaaatttgcgcctgctccacccacagcagccccctgtgcagtaccagtatgaacctccttccgcaccttccactactttttccaatagccctgcacctaacttcctccctccacggccagatttcgtcccatttcccccacctatgcctccgtccgcccaaggccccctgccaccttgtcccatacggccccctttccctaaccatcaaatgcggcacccctttcccgtccctccttgcttcccaccaatgcccccaccaatgccctgtcctaataaccccccagtgccgggagcgccccccggacagggaacgttccctttcatgatgcctcccccaagcatgcctcatcctccgccaccccccgtgatgcctcagcaggtcaactaccaataccctcccggctattctcatcataacttcccgcctccttccttcaacagctttcagaataacccatcttctttcctcccaagcgcaaacaactcctcaagcccacatttccgccatctcccgccttatccactacctaaggcaccgagcgaacgcagaagtccagagcggctgaagcattatgacgatcaccgtcaccgcgaccacagtcacggaagaggggaacggcatcgttctctggatagaagagagagaggccgctccccggataggaggagacaggatagccgatatcgctctgattatgaccgcggacgaactccaagccgccacaggagctatgaacgatctagcagatccccctcaagagaaaagaagagggcccggtgggaagaggagaaggatagatggtctgacaaccaaagttccggtaaggacaaaaactacaccagcattaaggagaaagagcctgaggagaccatgccagacaaaaatgaggaggaagaagaggagctacttaagccagtgtggatacgctgtacccacagtgaaaactattacagctccgacccgatggaccaagtcggcgattcaaccgttgtggggacttccaggctaagagacctttatgacaaattcgaggaagagcttggctctagacaggagaaggctaaggccgctcggcctccttgggagcccccgaagacaaagctggacgaagacctggagagctcttcagagagtgaatgtgaaagcgatgaggactctacatgttcatctagctcagattccgaagtctttgatgtcattgccgaaatcaagaggaaaaaggcacaccccgacaggctgcatgacgaattatggtacaacgacccgggccagatgaacgatgggcctctttgcaagtgcagcgcaaaggcacgacgaactggtattaggcatagtatctaccccggggaggaggccatcaagccatgccgaccaatgactaacaatgctgggaggctgtttcattatagaatcactgtttcccccccaactaactttctgacagacaggcctaccgtaatagagtacgatgaccacgaatacatattcgaggggttctccatgtttgcacatgcccctctgacaaacattcccttgtgtaaagttatccgctttaatatagactataccatccattttatcgaggaaatgatgcccgagaatttctgtgtgaagggacttgaactgttcagcctgttcctgttccgtgacatcttagagctctatgactggaatctcaagggccccctttttgaagactcacctccttgttgcccccggtttcactttatgcctagattcgttagattcttgcccgacggggggaaagaggtgctgagcatgcaccaaatcctgctatatttactgcgatgttccaaggctttggtgcccgaggaggagattgccaacatgctccagtgggaggaactcgaatggcaaaaatatgccgaggaatgtaagggtatgatagtaaccaacccgggtaccaaaccctcatctgtgcgaatcgaccagctggacagggaacagtttaaccccgacgttattacttttcccataatcgtgcactttgggatccgccctgcccagctgagctacgccggagaccctcagtatcagaaactgtggaaatcctatgtgaaattgcgacacctgctggctaacagccctaaggtgaagcagactgacaagcagaagttagcgcaaagagaagaggccctgcagaagatccgccagaaaaacactatgagaagggaggttacagtggagttgagctcccagggcttttggaaaaccggaataaggtccgatgtgtgtcaacacgccatgatgctccccgtactgacacaccacattagataccaccagtgcttgatgcaccttgacaaattgattggctacacctttcaggacagatgcctcctgcagttggctatgacacacccatctcaccacttgaattttggaatgaatcccgatcacgcgcgcaatagcctgagtaactgtggaattaggcaaccgaaatatggcgaccggaaggtccatcacatgcacatgcgcaagaagggaattaatacactgatcaacattatgtctagacttgggcaggacgaccctaccccctcccgcatcaaccataatgaaaggttggaatttctgggcgacgctgtggtggaattccttactagtgtccacctctactatctgttccccagccttgaagagggtgggctggctacgtacaggaccgccattgtacagaatcagcatttagcgatgttggctaaaaaactcgagctggatcggtttatgctatacgcccacggaccagacctgtgccgagaatccgatctgagacatgccatggccaactgtttcgaagccctcatcggcgccgtctatcttgaggggagtctggaggaggccaagcagctgttcggcaggctgctatttaacgatcccgacctccgggaggtgtggctcaactaccctctgcaccctctccaattacaagagccgaacacagatcgccagctaatcgaaacttctccagtgctccagaaactgacagagtttgaagaggctatcggcgtgatttttacccacgtaagattattggctagagctttcaccctacgaacggttggatttaaccatctcacactgggccacaatcagcgcatggaattccttggagactcgattatgcagctcgttgctactgagtacctgtttatccacttcccagaccatcatgagggccacctaaccctgctccggtcttcactggtgaataacagaactcaagcaaaggttgcggaggaactaggcatgcaggagtatgctatcacgaatgacaaaaccaagagacccgtggccctcaggactaagacactggccgacttgctggaaagcttcattgccgctctgtacatagacaaggacctggagtatgtccacacatttatgaatgtatgttttttcccgcgtcttaaggaatttatcctaaatcaggactggaatgaccctaaatcgcaactccagcaatgttgcctgaccctgagaaccgaggggaaggagcctgacatcccactctataagacattacagactgtgggaccatctcacgcacggacttacaccgtcgctgtatacttcaagggcgagcggataggatgtgggaaaggtccttctatacagcaggcagagatgggagctgccatggatgctctcgaaaagtacaacttcccacaaatggcacatcaaaaacggttcatcgagcggaagtacagacaggaattaaaggagatgagatgggaaagagaacatcaagaacgcgaaccagacgagaccgaggatatcaagaaatag

SEQ ID NO: 185886 - DNA, 4125 bp, Artificial Sequence
  Description of Artificial Sequence: Synthetic coding sequence
atgatgcagggcaacacctgccaccggatgagcttccaccccggcaggggctgcccacgcggtcgtggcgggcacggggcacgtcccagtgccccttcattccgccctcagaacctccgactcctgcacccccagcagccccccgttcagtaccagtacgagccgccaagcgccccgtctacgaccttcagtaattctccggctcctaacttcttgccccccaggcccgactttgttccatttcctcctccaatgccacctagtgctcagggcccactcccaccctgcccaatacgaccacctttcccaaatcatcagatgcgccacccattccccgtccccccctgctttccccctatgcctccccctatgccgtgcccgaacaacccacccgtgcccggggcacctccaggccagggaacgttcccttttatgatgccaccaccctcaatgccgcacccaccgcccccccccgtaatgccccagcaggtgaattaccagtatcctccgggctatagtcatcacaactttcctcctccctcttttaacagcttccagaataacccatcgtcttttctgccgtctgcgaacaactcttcatcaccgcacttccgtcatctgcccccttatccacttccaaaggcaccttctgagcggagaagcccggagaggctaaagcactacgacgaccaccgccaccgggaccactctcatgggagaggcgaacgacatagaagtcttgataggcgagagcgagggagatcccctgacagacggcgccaagattccagatataggtcagattacgacagagggcgcactccctcccgtcacagaagctatgaacggtctagagaaagagaacgggagcgccacaggcaccgagataataggcggtccccctcactggaacgcagttataagaaagagtataagagaagcggaagaagttacggattatccgtcgtccctgagccagcaggttgcactcccgaattgcccggagagatcattaagaatactgactcttgggcaccccccctcgaaatagtaaatcaccgaagtccgtcccgagaaaaaaaacgggcacgatgggaggaagagaaagatcggtggagcgataaccaatctagcgggaaagataagaactatacgtcaataaaagagaaggaacctgaagagaccatgccagataaaaatgaggaggaggaagaggagctgctgaaaccagtgtggattcggtgcacacactctgaaaattactatagctcagacccaatggatcaggtgggggactctaccgtggttggaacaagccggctacgagacctatatgataagttcgaggaggaactcgggtccagacaggagaaagccaaggcggccagaccgccttgggagccacctaaaacaaaactcgatgaggacctggagtcctcatcagagtcagagtgtgagagtgacgaagatagcacatgcagctcctcttccgatagcgaggtcttcgacgtaatcgctgaaattaaaagaaaaaaagcccatcccgataggctccatgacgaactgtggtacaatgatcctggccagatgaacgacgggccactctgcaagtgcagtgccaaagctcgccggactggtatccggcactccatttaccccggggaagaggccattaagccttgtcgaccgatgacgaataatgcgggacgtctctttcactatcggataaccgttagtccgcccactaacttcctgactgatagaccaaccgttatcgaatacgacgatcacgagtatatattcgagggatttagcatgttcgctcacgcaccattgacaaacattccactctgcaaggttattaggtttaatatcgattacacgatccacttcatcgaagaaatgatgcccgaaaacttttgtgtcaagggcctggaactcttcagcctgttcctgttcagggacattctggagttgtacgactggaacctgaagggccctctgtttgaggattccccaccatgttgtccccgctttcatttcatgccccggttcgtaaggttcctaccggatggaggcaaagaagtgctctccatgcaccagattctcttgtacctccttcgttgttccaaggccctggtgccggaggaagagatcgctaacatgcttcagtgggaagagctggaatggcagaaatatgcagaggagtgcaaaggcatgatcgtgactaatccaggtacaaagccctccagtgtgcggatcgatcagctcgatcgggagcaatttaatcctgacgtgattacgttccctataatcgtccatttcggcatacgtccagcccaactgagctacgccggagatcctcagtaccagaaactgtggaaaagttacgtcaagctgcgacaccttctcgccaattccccgaaagtaaaacagaccgataagcaaaagctcgcccaacgtgaggaagctcttcaaaagatcagacagaagaacactatgcgcagggaagtgaccgttgaattgagctcacagggcttctggaaaacaggcattaggtctgacgtgtgccaacatgcaatgatgctgcccgtcttgacacatcatatccggtaccaccagtgcttaatgcatctggacaagctgattggctacacattccaagatcgctgcttacttcaactcgctatgactcacccctctcatcatctgaactttggcatgaaccctgaccatgcccgtaactcattgtcaaattgcggcatccgtcagccaaaatatggcgatcgcaaggttcaccatatgcacatgcgtaagaaggggattaataccttaataaatataatgagtcgtctcggtcaggacgaccctaccccttcacgaatcaatcacaacgagagattagaatttctgggggacgctgttgtggaattcttgactagcgtccatctatattatctattcccttctctggaggaaggtggcttggcgacatatcgcaccgccatcgtgcagaatcagcatctggcgatgctggcaaaaaagttggagctggacaggtttatgctttacgcccatggccccgacttgtgccgcgaatcagacttgagacacgctatggccaattgttttgaagctttgattggggccgtatatctggaaggcagcctggaggaggccaagcagctgtttggcaggctgctattcaatgacccggacctcagggaagtttggctgaattatcccttgcaccctctccaacttcaggaaccaaatacagataggcagctcattgaaacctctccggtcctccagaagctgactgagtttgaggaagcaatcggcgtgatttttacgcacgttagactgctggccagagcctttacccttagaaccgtgggttttaatcaccttactcttggacacaaccaacgcatggaattcctcggggattccataatgcagctagtcgccacagagtatctgttcatccattttcccgatcaccacgagggtcacctgacgctgcttcggtccagcctggtgaacaacagaacacaggccaaagtggcggaagagctgggaatgcaggaatatgctattacaaatgacaaaaccaagaggccagtggccctccggacaaagacccttgctgacctccttgagtctttcattgccgccctctacattgacaaagacttggaatatgtacatactttcatgaacgtatgcttcttcccccgcttgaaagagttcatacttaatcaagactggaacgacccaaagtcgcaacttcagcaatgctgcttgactctgcgaaccgaaggcaaggaaccagatatcccattatataaaacactgcagacggtcggacccagccacgcacgaacctatactgtggcagtctatttcaagggcgaaagaattggctgcggaaaagggcctagtatccagcaagccgaaatgggggccgctatggatgccctcgagaagtacaattttccacagatggcccaccagaagagattcatcgagcgaaagtaccgccaggagctcaaggagatgaggtgggaaagagagcaccaagagcgagagcctgacgagaccgaagatattaaaaaatag

SEQ ID NO: 185887 - DNA, 3558 bp, Artificial Sequence
  Description of Artificial Sequence: Synthetic coding sequence
caccggatgagcttccaccccggccggggctgcccccggggccggggtgggcacggggctcgaccttcggctccttctttcaggcctcagaacctccgcttattacacccgcagcaacccccggtacagtatcagtatgagcccccctctgctccatctactacattcagtaatagccctgccccaaatttccttccaccgcgacccgactttgttccatttcccccgcctatgccaccaagtgctcaaggcccattgcccccgtgccccattaggcccccatttcctaaccaccagatgcggcacccatttcccgtccctccctgctttccgcctatgcctccaccaatgccttgtccaaacaacccacccgtacccggggccccccccggccaaggcaccttccctttcatgatgcctcctcctagtatgcctcacccacccccacccccagtgatgccccaacaggtcaattatcagtaccctcctggctatagtcatcataacttcccccccccgtcctttaattcttttcagaataacccttccagcttcttgccttccgctaacaacagtagctcaccccacttccgccacctcccgccgtacccactgcctaaagctccatctgaaagaaggtcgccagaacggctgaagcactacgacgaccatcggcatcgggaccactcgcacggaaggggcgagcggcaccgatctctggaccgcagagagaggggccggtcccccgacagacgcaggcaggatagtaggtataggtctgattatgacagaggtcgtaccccttcaaggcaccggtcatatgaaagatctagggaacgagaacgggaaaggcatagacaccgcgacaaccggcgcagcccaagcctggagcgctcttacaagaaggagtacaagcgctctggctccaggtccccttcacgcgaaaaaaagcgggccaggtgggaggaagaaaaagatagatggagcgataaccagtcctccggtaaagacaagaactacacgagcattaaagaaaaagaacccgaagaaaccatgccggataaaaacgaagaagaagaggaggaactgctcaagcccgtctggatcaggtgcacccactcagaaaattactattccagcgacccaatggaccaagtgggcgactcaactgtcgtcggaacaagccgactgcgagacctgtacgacaaatttgaggaagaactgggctcgcgccaagagaaggccaaggcagctcggcccccatgggagccgccaaaaaccaaactggatgaggacctcgaatcctcttctgagtctgagtgtgagagtgatgaggactccacatgctctagcagcagcgactccgaggtcttcgacgtcatcgctgaaattaagagaaagaaggcccaccccgatagactgcacgacgagctctggtataatgatccggggcagatgaacgacggccccttgtgtaagtgctctgctaaggcaaggcgaacagggatacggcacagtatttatcctggcgaagaggcaattaagccctgtaggcccatgacaaataacgcaggccgtctgtttcactataggatcaccgtgagcccgcccactaactttctcaccgataggccaactgtgattgaatatgacgaccacgaatacatcttcgaaggattctcaatgtttgcacacgctcccctcacaaatattcccctgtgtaaagtgatccgttttaatattgattacactatccattttatcgaagagatgatgccagagaacttttgcgtaaagggcctagaactgttttccctgtttctgtttagggatattctggaattatacgactggaacctcaaggggcctctttttgaagacagtcccccttgctgcccacggttccacttcatgcctagatttgttagatttttacccgatggcggcaaggaagtgctgagtatgcatcagatccttctctatcttcttcgctgcagcaaggctctggtaccggaggaagaaatcgccaatatgctgcagtgggaggagcttgaatggcagaaatatgctgaggaatgtaaggggatgattgtcactaaccccgggacaaagccttctagcgttcgaatagaccagctggacagggaacagtttaatcctgacgtgattactttccctatcattgtacactttggcatccggccagctcagctgtcttacgctggagatcctcagtatcaaaagttgtggaaaagctacgtgaaactcagacatcttttggctaactcccccaaggttaagcaaaccgataagcagaaactcgctcagcgcgaagaggcactgcagaagattcgacagaaaaataccatgaggagggaagtaaccgtggagcttagttctcagggcttctggaagaccgggatcagatctgatgtgtgccagcacgccatgatgttgcctgtgctgacacaccacatcaggtatcaccagtgtctgatgcacctcgacaagctgatcggctatactttccaggacaggtgtctgttacagctggccatgacacacccctcccatcaccttaacttcggtatgaatcccgaccacgcccggaattccttgagtaattgtggcattcggcagcccaagtacggagaccgcaaagtccatcacatgcacatgagaaagaagggaatcaacactctgatcaacataatgagtcggctggggcaagatgaccctacaccttccaggatcaaccataatgagagactggagtttctcggtgatgccgtggtcgagtttctgacttcagtgcacctctactatctgttcccaagtttggaggagggaggtttggccacctaccgaaccgcaatcgttcagaatcagcacctggctatgcttgctaagaaactggagctggaccggttcatgctgtatgcccatggtccagacctttgccgcgaatctgacctgcggcacgccatggccaattgttttgaagccctgatcggagccgtgtatctggaaggctcactcgaagaggccaagcaactattcggacgcctgctgttcaatgatcccgaccttagggaagtgtggctgaattacccactgcaccccctgcaattacaggaaccgaacactgacaggcagctaattgaaactagtcccgtccttcagaaactgacagagttcgaagaagcaatcggcgtaatctttacgcatgtcagactgttagccagagcctttacactccggacggtgggcttcaatcatctgaccctcggccacaaccagaggatggagttcctcggagatagtatcatgcagctcgtggccactgagtatttattcatccacttccccgaccatcacgagggccaccttacgttgcttaggtccagcctcgtgaataacaggactcaggccaaagtcgcagaggaacttggcatgcaggagtggtccatctacctgctcagcaactgtgattgctgcctcctcagaccaagcctggtctttttacagaccatgaacgaagtctgctcactgaagtag

SEQ ID NO: 185888 - DNA, 4014 bp, Artificial Sequence
  Description of Artificial Sequence: Synthetic coding sequence
atgatgcagggcaacacctgccaccggatgagcttccaccccggccgcggatgccccagaggtcgaggggggcacggggccagaccgagtgccccaagctttagaccacagaacctgcgactgctgcatcctcagcagcccccggtacaatatcaatatgagcccccgagcgcaccaagtacgacattctcaaacagccccgccccaaatttcctgccacctaggcctgattttgtccccttcccaccccctatgcctccctccgcccagggacctcttcctccctgcccgattagacccccattcccaaatcaccaaatgcgccaccccttcccagtgccaccctgcttccctccgatgcctccgccaatgccgtgtccaaacaatccgccagtaccaggggccccaccgggacagggtacctttccattcatgatgccaccgccatcaatgccgcacccaccccccccgccggttatgccgcagcaggtgaattaccagtaccctcccggttactctcaccataacttccctccccctagcttcaactcttttcagaacaatcctagctcatttttgccctccgctaataattcttcaagtccccacttccgacacttacccccttacccactccccaaggctccttctgagagacgtagtccagagaggctgaagcactacgatgaccacaggcatcgggaccacagccatggacggggagagcgtcaccgcagtttggaccggagagagagaggacgaagcccggatagacgaaggcaagatagccggtatcggtcagactacgatagggggaggactccctccaggcacaggtcttatgagcgttctagggaaagggaacgagagcggcacaggcacagggacaaccggagatcaccatccctcgagaggtcctacaagaaggaatacaagcggagcggttcccgttcaccatctagagagaagaagcgcgctcggtgggaggaggaaaaggatcggtggagtgataatcagtcttcaggcaaagataagaattacacctcgattaaggagaaggagccggaggagacaatgcctgacaagaatgaggaagaagaggaagagctgttgaaacccgtgtggatacgctgcacgcactccgaaaactattactcctctgaccccatggaccaggtgggcgattccacagtggtgggaacttccagacttcgtgatctctatgataagttcgaagaggagcttggctcccgccaggagaaggcaaaagccgccagacccccatgggaaccaccgaagacaaagctggacgaggatctggaatcgtcctctgaaagtgagtgcgaatcagacgaggatagtacatgcagttccagttctgattctgaagtattcgacgtgatcgccgagatcaagagaaagaaggcccacccagaccgtctgcatgacgaactctggtacaatgacccgggacaaatgaacgacggccctctttgtaaatgctcagccaaggcccgacgaacggggatccgacactcaatatacccaggcgaggaggcgattaagccgtgtcgccccatgactaataacgccggtcgcttgttccactaccggatcacagtttcacctccgactaatttcctaaccgataggccaacagtgatcgaatacgacgatcacgagtacatctttgaaggcttcagcatgtttgcacacgctccgcttaccaatatcccactctgtaaggttattcggttcaacattgactacacgatccactttatagaagaaatgatgcctgagaatttttgcgttaagggtcttgagttgtttagtttgtttctctttagggacatcctagaactgtatgactggaacctgaaaggacccctgttcgaggactcccccccgtgctgtcctagattccatttcatgcctaggtttgttcggttccttcctgacggaggtaaggaagtcctctcgatgcatcagatccttctctatctgctgaggtgtagtaaggctctcgtcccagaggaggagatcgctaatatgttacaatgggaggagctggagtggcaaaaatacgccgaggagtgcaagggtatgattgtcaccaatccaggtaccaagccttcatctgtaaggatcgaccagttggatcgggagcagttcaaccctgatgttatcactttcccgatcattgtgcactttggcatccggccagctcagctgtcatatgccggcgatcctcaataccagaaattgtggaagtcctacgtgaagcttcggcacctcctcgctaacagccccaaggtgaagcagaccgacaagcagaagctggcccagagggaagaggcattgcagaaaattagacagaagaacaccatgcgaagagaggtgactgtcgaactgagttcacaggggttctggaaaacagggatacgctcggatgtgtgtcagcacgctatgatgctgcctgtgctcactcaccacatcaggtaccatcaatgccttatgcacctcgacaaattaataggatacacgttccaggacagatgcttactgcagttagctatgactcatccctctcatcaccttaacttcgggatgaacccagaccacgctcggaatagcctgtcaaattgcgggattcgacagccaaaatatggagaccgcaaggtacaccatatgcatatgcgtaagaaagggattaatactctgatcaacattatgtcccgcctgggacaggacgaccccaccccctcacggattaatcataacgagaggctggaatttttaggagatgcggtcgtcgaattcctgacctcagtgcatctgtactatttgttccccagtcttgaggagggaggtcttgcgacgtatagaacggcaattgtccagaatcagcacctggccatgcttgctaaaaaactagagctggaccgtttcatgctgtatgcacacggcccagatctctgtcgggagtccgatcttcggcacgctatggctaactgctttgaggctctgatcggagccgtatacctggaaggcagccttgaagaggcgaaacagctgttcggacggttattgtttaacgaccctgatctgagagaagtgtggctgaattaccctctccacccactgcagttacaggagccaaatacagatagacagctcatcgaaaccagtccagtgctacagaaactcaccgagtttgaggaagctatcggcgttatcttcactcatgtgagacttctagcgagggctttcaccctacgaaccgtgggatttaaccatctgaccctgggccacaatcagcggatggaattcttaggtgattcaattatgcagctcgtggcaaccgagtacctgtttattcacttcccagaccaccacgagggccacttgactcttctgcgttcttccttggtgaataataggacccaagccaaggtggccgaggaactcggtatgcaagagtatgccatcaccaacgacaaaaccaagaggccagtggcccttaggacaaagacattggctgatctcctggaaagctttatcgctgcactttatattgataaagacttggaatatgttcacactttcatgaatgtgtgtttcttcccaagactgaaagagttcatcctgaaccaggactggaacgatcccaagagtcagctccagcagtgctgccttactctgagaacagagggtaaagaacccgatatcccgctgtacaagaccctgcagacagtcgggcccagccacgccagaacctatactgtggcggtctacttcaaaggagagcggatcggctgcggcaagggccccagtattcagcaggctgaaatgggtgctgccatggatgcattggagaagtacaatttcccacagatggcccaccaaaagcgctttattgaaaggaaatataggcaagagttaaaggaaatgcggtgggaaagggagcatcaggagcgggaaccggacgaaacagaggatataaagaaatag

SEQ ID NO: 185889 - DNA, 606 bp, Artificial Sequence
  Description of Artificial Sequence: Synthetic coding sequence
atgatgcagggcaacacctgccaccggatgagcttccaccccggccgaggatgcccgaggggaagaggtggtcatggtgcccggccatccgccccatccttccggcctcagaacctaagactgctccacccacagcagcccccagtccaatatcagtatgagcctccatctgcaccgtcaacaaccttctctaactcgccagcaccaaacttcttgccaccgaggcccgatttcgttccttttcccccacccatgcctccctcagcccagggacctttgcctccttgtccaatcaggcccccctttcctaaccaccaaatgagacacccgttcccagtacccccgtgcttcccaccaatgccccccccaatgccatgccccaacaatccaccagttccaggtgctcccccgggacagggtacctttcctttcatgatgcccccaccttctatgccacacccaccacccccgccagtgatgccgcagcaagtgaattatcagtaccccccgggatatagccatcacaacttccctcctccctcttttaattcattccagaacaatcctagctcatttctgccatcagcaaataatagctcctcttag

SEQ ID NO: 185890 - DNA, 4125 bp, Artificial Sequence
  Description of Artificial Sequence: Synthetic coding sequence
atgatgcagggcaacacctgccaccggatgagcttccaccccggcagaggttgtcctcgtgggaggggagggcatggggcacggccatctgctccttcttttcggcctcaaaacctgagactgttgcatcctcagcagcctccggtgcagtaccagtacgaaccgcccagtgccccaagtacaacctttagcaactcccccgcgcctaacttcttgccaccaagacccgatttcgtgccatttccgccacctatgcctccttcggcgcaggggcctttgcccccgtgcccaattagaccacctttcccaaatcatcagatgcgccaccccttccccgtgccaccatgttttcctcccatgccaccacctatgccttgtccgaataatcccccagttcctggcgctccccccggccaaggcacctttcccttcatgatgcctcccccttcaatgcctcacccaccaccccccccggtgatgccacagcaagtgaattatcagtacccgcctggatacagccatcataatttccccccacccagcttcaactcgttccaaaataatccctcttcttttctgcctagtgctaataacagctcgtctccacatttccggcacctccctccttaccctctccctaaggcccctagtgagcggcgctccccggagcgattgaagcactatgacgatcatcggcaccgggatcacagccatggacgcggagagcgtcacagatccctggaccgcagagaacgcggaaggtctcctgaccgacgacgccaagactcacgatataggtccgactacgataggggacgcactccaagtcgccaccgctcctacgagagatcccgcgagcgagagcgggagaggcatagacatcgcgataacagacggtctccgtccctggagagaagctacaaaaaggagtataaacgctctggacgctcctacggactaagcgtcgtccccgagcccgccggttgcacccctgaattgcccggagaaatcattaagaacactgactcctgggcccctcccctggaaatcgtgaatcacaggtcaccctcccgcgagaagaaaagggctcgatgggaggaagagaaagatcgttggtcagataatcagtcttcagggaaagacaagaattatacctcgataaaggagaaagagcccgaagaaacaatgccagacaaaaacgaggaggaggaggaagaactgttgaaaccggtgtggatccgatgcactcattctgagaactattacagctctgatccgatggaccaggtaggagattcaacagtggtggggacatctagactccgggatctttacgacaagtttgaggaggaactggggtcccgccaagagaaggctaaagcggcaaggccgccctgggagccccccaagaccaagttggacgaggatttggagagcagctctgagtccgaatgtgagtcagacgaggacagcacatgtagctcctcaagtgattccgaggtcttcgacgtgatcgctgaaatcaaaaggaaaaaagcgcacccagatcgtctccacgatgagctctggtataatgacccaggccagatgaacgacggccccctttgcaagtgttcagctaaggctcgaaggacaggcattcggcattcaatctaccccggtgaggaagctatcaaaccctgtaggcctatgacaaacaatgccgggcgcctgttccattacaggattacagtatctcctcctactaacttcctcaccgatagacctacggtgatcgaatacgacgatcacgagtatatcttcgagggatttagcatgtttgcacacgctcctctgactaatattcctctctgcaaagtgatccgttttaacattgactacaccatacattttatagaagaaatgatgccagagaatttttgcgtaaagggactggaactgttcagtctattcctgttcagggacatactggaactgtacgactggaacctgaagggtccactgttcgaagactcaccaccttgttgccctaggttccatttcatgccacgattcgtgcgctttttgcccgatggcggtaaagaagtgctaagcatgcatcagatactcctgtatcttctccgctgttctaaagccctagtacccgaggaggagattgccaacatgcttcaatgggaggagctggaatggcagaagtacgccgaggaatgcaaaggtatgatcgttaccaaccctggcacgaaaccatcatccgtgcgcattgaccagctggaccgggaacagtttaaccctgacgtgattacgttccccatcatagtgcacttcggtatacgtccagctcaactgagttacgccggagaccctcagtaccagaagctgtggaaatcatacgttaagctccggcacctgctggcaaacagccccaaggttaagcagacggacaagcagaaattggcgcaaagggaggaggctctccagaaaattcggcagaaaaatacaatgcgtagggaagtaaccgtcgaattgtcaagccaaggattttggaagacgggaatcaggtccgatgtgtgccagcacgccatgatgctgcccgttttgactcaccacatcaggtatcatcagtgcttgatgcatctggataagcttattggatacacgttccaggaccgctgtctgctgcagctcgccatgacccacccttcccaccacttgaattttggtatgaatccagaccacgctaggaattcattaagcaattgtggaatcaggcaacccaagtatggcgaccggaaagtgcaccacatgcacatgagaaagaaggggatcaacaccttaatcaatattatgagcagactggggcaggatgatccaaccccttcccggattaaccacaacgaacgattggaattcctgggcgatgcagtggtggagttcctgacttccgtgcacctctattacctgtttccatcacttgaggaagggggcctggccacttaccgaaccgcgatcgttcagaaccagcatctagcaatgctagcaaagaaacttgagctggatagatttatgctgtacgcacacgggccagatctgtgtagggagagcgatctgaggcacgcgatggcaaactgtttcgaagctctgattggcgccgtttaccttgagggatcactggaggaggctaagcaactttttggtcgcttgctttttaatgacccagacctgcgggaggtctggctgaattacccacttcaccctctgcagctgcaggaacctaatactgataggcaacttatcgaaacatctccggtcctgcagaagctaaccgaattcgaggaggctatcggtgtcatttttacccacgttcgcctacttgcgcgcgcttttacgctacgaacagtcgggtttaaccacctgacattggggcataaccaacggatggaatttttaggagacagtattatgcagcttgtggccacagaatatctgtttattcactttccagatcaccacgagggccatctgactctgcttcggtcttctctggtcaataacagaacacaggccaaggtggcagaagagttgggcatgcaggagtatgctatcaccaacgataaaacaaagagaccagtggcactccggaccaagacactggccgatctgctggaatccttcatcgcggcgctgtatatcgataaagacctggagtatgtgcacaccttcatgaatgtctgctttttccccaggctgaaagagttcattctgaaccaagattggaacgaccccaaatctcagcttcagcagtgctgcctgaccttaaggactgagggaaaagaaccagacatccctctgtacaagactctgcagaccgtggggccatcccacgccagaacttataccgttgctgtgtattttaaaggggaacgaatcgggtgtggaaaaggcccgtcaattcagcaggccgaaatgggtgctgccatggatgcattagaaaagtacaactttccacagatggcacatcaaaaacgcttcatcgagaggaaataccggcaagaattgaaggaaatgagatgggagagggaacaccaggaacgggagcccgatgagacagaggatatcaaaaagtag

SEQ ID NO: 185891 - DNA, 630 bp, Artificial Sequence
  Description of Artificial Sequence: Synthetic coding sequence
atgaaggccgtggtgcagcgggtgacccgggccagcgtgaccgtggggggcgaacagatttcggccattggccgaggcatttgtgtgctcctcggaatcagccttgaagacacccagaaggaactggagcacatggtccgcaagattctgaacctccgcgtattcgaggacgagtctggcaaacactggagcaagtccgttatggacaagcaatacgaaatactctgtgtatctcagttcacactgcagtgcgtgctgaagggcaataagcctgacttccacctggcaatgccgaccgagcaggctgaaggtttctataacagcttcctagaacagctcagaaagacataccggccagaacttatcaaagatggcaagtttggggcctacatgcaagtccacattcagaacgacggtccagtgacaatagaactggaaagccccgctccaggtaccgccacatccgatccaaagcaattgtccaagctggaaaagcagcagcagcgaaaagaaaagacccgggctaagggtccgagcgagagcagcaaggaaagaaatacacctcgaaaggaagatagaagtgcttcttcgggtgcagaaggcgacgtcagctcggagagagaaccgtag

SEQ ID NO: 185892 - DNA, 843 bp, Artificial Sequence
  Description of Artificial Sequence: Synthetic coding sequence
atgggccgggccgagctgctggagggcaagatgagcacccaggacccctcagatctttggagcagatctgatggagaagctgagctcctccaggatctgggttggtatcatggcaacctcacaaggcacgccgctgaagccctgctgctgagcaatggctgcgacgggtcctacctgctgcgggacagcaatgaaactaccggactgtattcacttagcgtgcgggcaaaagacagcgttaaacactttcacgtggagtatactggatattcctttaagttcgggtttaacgagttttcctctctcaaagatttcgtgaagcattttgctaatcagccattgatcgggtctgaaacaggaacattgatggttcttaagcatccttacccccgcaaagtagaggagccgtctatatatgaatccgtgagggtccatactgcaatgcaaactggccgcacagaggacgacctggttcctaccgcaccatcactgggcactaaagaggggtatttgaccaaacagggaggactcgtcaagacctggaagacccggtggttcacactgcaccgcaatgagctaaaatattttaaagatcagatgagcccagagcctattcggatcttagacttgaccgagtgttcggcagttcaatttgactacagccaagagagggtcaattgcttctgtctagtcttcccctttcgaactttttacttatgtgccaaaaccggcgtcgaagcggatgagtggataaaaatcctcaggtggaagctcagtcagatccgaaagcagctgaatcagggagaggggacaatccggtctaggagctttatttttaaatag

SEQ ID NO: 185893 - DNA, 4656 bp, Artificial Sequence
  Description of Artificial Sequence: Synthetic coding sequence
atgggcttctgcctggccctggcctggaccctgctggtgggcgcctggacccccttgggggcccaaaacccgatcagctgggaggtgcagaggttcgacggatggtacaataatctcatggagcacaggtgggggtcaaagggcagtaggctccagagattagtgccagcaagttacgccgacggagtgtaccagcccctcggagagccacatctccccaatccgcgtgacctgagcaacacgataagcagggggcccgccggcctggcttccttacggaacagaaccgttttgggagtgttcttcggctaccacgttcttagcgacctggtgtcagtggagactcctggctgccccgccgaatttctaaatatccggatcccccctggcgaccctatgttcgatccagaccagcgcggtgatgtggtgctacctttccagcggtcaaggtgggatcccgagaccggacgttctccatcaaatccccgagaccctgctaaccaggtgacgggctggttagatggctccgcgatttatggatcttctcactcgtggtctgacgcccttcggagtttttcacgaggccagctggcaagcggccctgatcccgccttcccaagggattcccagaaccctttgctgatgtgggcagccccggatccggctacaggacagaatgggccaagagggctgtatgcgttcggggccgaaaggggcaatcgtgagccttttctgcaggcactagggcttctatggttccgctatcataacctgtgggcccagcggctcgcaaggcagcacccggactgggaagacgaagagctatttcagcacgctcggaagcgggtgatagccacttatcaaaacatagcagtctacgagtggctccccagctttctgcaaaagaccctcccagaatacaccggatatcgcccttttcttgacccaagtataagtagcgagtttgtggctgcatccgaacagttcctgtctacaatggtgccaccaggcgtttacatgcgaaacgccagctgtcatttccagggagttatcaataggaattcttcagtatctcgcgccctgcgggtgtgcaactcctactggtcccgcgagcacccatctctccaatccgcggaggacgtcgacgctctgctgttaggtatggcatcccagattgctgaaagagaagaccatgtgctcgtggaggacgttagagacttctggcccggtcccctgaagttttctcgaactgatcacctggcctcttgtcttcagcgcggaagagatctcggtctgccaagctacaccaaagcacgggcggccctggggttgagcccaataacaagatggcaggatatcaatccagctcttagccgcagtaatgacacagtgctggaagcaacagctgctctatacaaccaggacctctcatggctcgagttgctccccgggggacttctggaaagccaccgggatcctggccctttgttcagcaccatcgttttagaacaatttgttcgccttcgagacggagatcgttactggtttgagaacacgcggaacgggttgtttagtaagaaagaaatcgaggaaattcgcaacacgactttacaagacgtgctggtggccgtgatcaatattgaccctagcgcccttcagcccaacgtatttgtctggcacaagggagatccttgccctcagccaagacagctgagtaccgaagggctacccgcctgtgcaccctcagtggtacgtgattacttcgaagggagtgggttcgggtttggggtcacaatagggaccctatgttgctttccgctcgttagccttttgtcagcctggattgtggcccggctgcggatgcggaattttaagcgcctgcaggggcaggaccggcagtccatcgtcagcgagaaacttgtcggtggaatggaggctctggagtggcaaggccataaggagccttgtcggccagtgttggtctatctgcagccaggacaaattcgcgtggtcgacgggcggctcacagtgctccggacaattcagctgcagcctccacagaaagtaaatttcgtgctctctagcaaccgcggaaggagaacgctgttactgaagatacctaaagagtatgatctggtacttctgttcaacctcgaggaggagcgccaagccttggtggaaaatctcaggggtgccctcaaagagtccgggctctcgattcaggagtgggagttgcgagagcaggaactcatgagggccgccgtcacccgcgagcagcgccgccacctgctggagacattcttccgacatctgttttcacaagtgcttgatatcaaccaggccgacgctggcactttacctctcgactcatcacagaaggtcagagaggcgcttacttgcgagctctccagagccgaatttgcggagagcctgggcctcaagccccaggacatgttcgtggaaagcatgttttccctggcagacaaagacggcaatggctacctatcctttcgtgagttcctggatatccttgttgtcttcatgaagggcagtcccgaggagaagagtagattgatgttcagaatgtacgacttcgacggcaacggcctcattagtaaagatgagtttatcaggatgttgcgctcatttatcgaaattagcaacaactgcctgtcaaaggcgcagttggctgaggtagtggagtcaatgtttcgagaatccggcttccaagacaaagaggaactaacatgggaggatttccactttatgctgagagatcacaatagcgagctgcggttcacacagttatgcgtgaaaggcgtggaggtccccgaggtcatcaaagacctgtgccgccgagctagttacattagtcaggacatgatctgcccctctcctagagtctcagctcgctgctctaggagcgatattgaaacagaattgaccccacagcgattacagtgcccaatggacactgatcctccccaggaaatccggcgcagatttggcaagaaagtgacttcatttcagcccctgctcttcacagaggcccatcgagagaagtttcagagaagctgtttacaccagaccgtgcagcaattcaagcggttcatcgaaaactaccgacgccacattggatgcgtggcagtgttctacgcaatcgccgggggtctgttccttgagagggcttactactacgccttcgccgcccaccacaccggaattaccgacactacccgggtgggaattatcctgagcaggggcaccgcagcctcgatctcattcatgttctcttacatcttgctcaccatgtgtcgtaatcttattacattcctcagagagacttttctcaaccgttatgtgccctttgacgcagctgtggacttccaccggttaatcgctagtactgctatagtactcaccgtacttcactctgtggggcacgtcgtgaacgtgtatctctttagtatctccccgttgtctgtcctgtcttgccttttcccaggtttgtttcatgacgacggctccgagcttccccaaaagtactactggtggttcttccagactgtcccagggctcactggcgttgttttgctgcttatcttagcaattatgtacgtgtttgcctctcatcactttcgacgtagatcattcagaggtttttggctcacccaccacttgtacatactgttgtacgtgcttctgattatccacgggtctttcgcactcatccagctgcctaggtttcatatcttctttttagtacctgccataatttatggtggggacaagctggtgtccctatcgagaaaaaaggtcgagatatcagtggtgaaagctgagctcctgccctctggcgtcacacacctccggtttcagcggccccagggattcgaatataagtcgggacaatgggtgcgtatcgcatgtttggcactgggcactactgaatatcacccatttacgctgacctcagcaccccatgaggacaccctgtcgcttcatatccgcgctgcaggcccatggactacccggttgcgggaaatttacagtgcccccacgggcgaccggtgtgcaagatatccaaagctgtacctcgacggccctttcggcgagggccaccaggaatggcacaaattcgaggtgagcgtgctagtcggagggggaatcggcgtaactcccttcgcttcaatcctcaaagacctggtgttcaagtcctccgtctcttgccaggttttctgcaagaaaatttacttcatctgggtgaccaggactcaaagacagttcgaatggctggccgacataatccgcgaggtggaggagaatgatcaccaggatttagtgtcagttcacatctatataacccagttagcagagaaattcgacctccgtactaccatgctatacatctgcgagcgacatttccaaaaggtgttgaaccgatccctcttcaccggccttaggtccattacgcacttcgggagacctcccttcgagccatttttcaattcactgcaggaggtgcaccctcaggtgaggaaaattggagttttctcctgcggccccccgggtatgaccaaaaacgtcgagaaggcatgtcagcttattaataggcaggaccgcacccatttctctcatcattacgagaatttctag

SEQ ID NO: 185894 - DNA, 4656 bp, Artificial Sequence
  Description of Artificial Sequence: Synthetic coding sequence
atgggcttctgcctggccctggcctggaccctgctggtgggcgcctggacacccctaggtgcccagaacccaattagctgggaggttcagagattcgatggttggtacaacaatcttatggagcaccgttggggcagcaaagggtctagactacagcggctggtacctgcttcttatgcggacggcgtgtaccagcctttgggtgagcctcatcttcctaacccaagggatctcagtaataccatcagccgcgggcctgctggcttggcttccctccgcaatcggacggtgctgggggtcttttttggctatcatgtactgtctgatttggtgagcgtggagacccccggctgccctgctgagtttctcaatataagaatccctccaggagatcctatgtttgacccagaccaaagaggcgacgtagtcctgcccttccaaaggagcaggtgggaccccgaaactggacgatcgccctctaatccacgggaccccgctaatcaggtcacgggctggttggacgggtccgctatatatggaagctcgcactcatggtctgacgccctccgaagtttttcccgaggccagttggcatcaggaccagatccagccttcccccgagactcacagaacccacttctcatgtgggcagctcccgaccccgcgaccggacagaacgggccaaggggattgtatgccttcggcgccgagcgaggtaatcgggagcctttcctgcaggcacttgggcttttgtggtttcgctatcacaatctctgggcccaaaggctggctcgccagcaccctgactgggaagacgaggaactatttcaacatgccagaaagagagtgatagcaacttaccaaaacattgcagtgtatgaatggcttccttctttcttacagaaaacattaccggagtacaccggatacagaccatttctggacccctcgatcagcagtgagttcgtggcggcaagcgagcagttcctaagtactatggttcctcccggtgtctacatgagaaacgcctcttgccattttcagggggtgatcaatagaaacagcagcgtgtctcgcgctcttcgggtgtgtaactcatattggtcaagagagcatccgtcgctgcagagtgctgaagatgtggatgccctgcttctgggaatggcctcccagatcgctgaacgggaggatcatgtgctagtagaagatgtccgtgatttttggcccggccccttgaagttttctagaacagaccatttggctagctgtctgcagcgcgggagagacctcggcctgccctcttacaccaaggctagagccgccctgggcctttcaccaataacgagatggcaggatattaatcccgcgttgtcccggtcaaatgacacagttctagaggctactgctgcgctatataatcaggatctgagttggttggagctcctgccaggcggactactggaatctcatcgtgacccaggtccgctgttcagcactatcgttctagagcagttcgtgagactgagagatggagatcgctattggtttgagaacacccgcaacgggctgttttcgaagaaagagattgaggagataagaaacactacactgcaggacgttctcgtggcggtgatcaacattgacccctctgccctccagcctaacgtctttgtgtggcataaaggcgacccgtgcccccagcccagacagcttagcacggaggggctgcccgcatgcgcccctagcgttgtgagggattactttgaggggagcggctttggcttcggagtgacaataggcacattgtgctgctttcctcttgttagcctgctgagtgcctggattgtggccagactgcggatgaggaactttaaacgcctccagggacaggatagacagtcaattgtgtcagaaaagttggtgggggggatggaagcattagaatggcaagggcataaagagccatgccgccccgtgcttgtatacttgcaaccaggacagatccgagtggtggacgggcgcctgactgtgctgaggactatccaactccagcccccccagaaggtgaattttgttctgtcatccaacaggggacgccgcaccctgctcttgaagatcccaaaagagtatgacctggtgctgctgtttaacctggaggaagaaaggcaggcgctcgtggaaaatctccgaggggctctgaaagaaagtggtttgtccattcaggagtgggaactgagggagcaagagctgatgcgggccgccgttacccgagaacagcgccgccacctgctggagacgttctttagacacttatttagtcaggtcctggatattaatcaggccgacgcgggtactctgcccctggatagttctcagaaggttcgggaagctctgacctgtgaattgtccagagccgagttcgccgaatccctcggcttaaaaccccaagacatgttcgttgagagcatgttcagtttggccgacaaagatggtaacggatatctgtcattccgggagtttcttgacatactggtggtgtttatgaaaggatcaccggaagaaaaatccagactaatgtttcgtatgtacgacttcgatgggaacgggttgatcagcaaagacgagttcattcgtatgctccgaagctttattgagattagtaataattgtctgagcaaagcacagctggcggaggtcgtagaaagtatgtttagagagtccgggttccaggacaaagaggaattgacctgggaggatttccactttatgcttagggatcacaactctgaactgaggttcacccagctgtgcgtgaagggagtcgaggtacctgaggtgatcaaggatctatgcagaagagccagctatatcagccaggacatgatctgtccctcccctagagtctcagcccgctgctccaggtccgacattgaaactgaactcactccccagaggcttcagtgcccgatggatacagaccctccccaggaaataaggcggagatttggaaaaaaggttacgtctttccagcctctgttattcacagaagcccacagggagaaattccaaagaagttgcttgcaccagacagtgcaacagttcaaacgttttattgagaactatcgccggcatataggctgcgtagccgtcttttacgcaatagcaggcggcctgtttctggaacgggcttactactacgcctttgccgctcatcacaccggaataacagatacaactagggtcggtatcatcctgtctcgtggtacggcagcctctatttcttttatgttttcatatattctgctgaccatgtgccgtaatttaatcacttttcttcgcgagacgtttttgaacagatacgttccgttcgatgcggctgtcgattttcatcggttaatcgcaagtaccgcaattgtgctgacagtgctgcactccgtcggacatgtcgtcaacgtctatctgttctctatttctccactcagtgtcctgagctgtctgtttcccgggttgttccatgacgacggctctgagctgccccagaagtattattggtggtttttccagaccgtccccggccttacaggggtggtgctgctcctcattctcgctatcatgtacgtcttcgctagccaccacttcaggaggcgttcattccgcgggttctggctgacgcaccatctctatatcctgttatatgtgctgctgattattcatgggtcctttgctctgatccaactcccgaggttccacatctttttcctggtacctgctattatctatggaggcgacaagctggtctccctgagccgtaaaaaggttgagatcagcgtggtgaaagccgaactcttaccctcgggtgtgacacatctacgctttcagcggccacagggatttgagtacaagagcggtcagtgggttcggatcgcatgtttggcgcttgggaccacagagtaccatcctttcacgctcacttctgctcctcatgaggatacgctctctcttcatatacgcgctgcgggaccatggactacaagacttagagagatctatagcgcccccactggagatcggtgtgcaagatatcccaagctttacctagatgggccattcggggagggccaccaagagtggcacaaattcgaggtttccgtcctggtgggcggggggatcggcgttactccttttgcgagcatactgaaggatctggtgttcaaaagttctgtctcctgccaggtgttttgcaagaaaatctacttcatctgggtaactagaacccaacgccagtttgagtggctagccgacataattcgcgaggttgaagaaaatgaccaccaggaccttgtgagtgttcacatatatataacccaactagccgaaaaatttgatctccgaactaccatgctctacatttgcgaacggcatttccagaaggtgctgaatcgatcactgtttacaggtctccgcagcattacccactttggacgcccccccttcgaaccgttttttaatagtctgcaggaggttcatcctcaggtcagaaagattggggttttttcttgtggtcccccgggcatgaccaagaacgtggaaaaagcttgccaacttattaatcggcaggataggacacacttttcccaccattatgagaacttttag

SEQ ID NO: 185895 - DNA, 4656 bp, Artificial Sequence
  Description of Artificial Sequence: Synthetic coding sequence
atgggcttctgcctggccctggcctggaccctgctggtgggcgcctggacgcccctgggggcccaaaatcctatctcctgggaggtgcaacggtttgatggatggtataacaacctaatggagcataggtggggcagtaagggatcacgcctgcaaaggctcgtacccgcctcatacgccgacggcgtctaccagccactaggggagccccacctgccaaaccctcgagacctttctaacacaatcagcaggggtcctgctggattagcctcactcagaaaccgaaccgtgctgggagtttttttcgggtatcacgttctgtcagacttggtttcagttgagacaccagggtgccctgccgaattcctaaacatacgaatcccacccggcgatcccatgtttgaccccgatcaaagaggggacgttgtgttgccgttccagcgctcccgctgggaccctgagactggcaggtcccctagcaatccgagggaccctgcaaatcaggttacagggtggctcgacggcagcgctatatacggctcatcccacagttggtcagatgcactgcgttcattctctcgggggcagctggcgtcagggccagaccccgcattcccaagggatagtcagaatcccttactgatgtgggccgctccggatccagctactggacagaacgggccgagagggttatacgcctttggggctgaaagaggcaaccgagagcccttcttgcaggccttgggtttattgtggttcagatatcataatctgtgggcccagcgtttggcaagacaacacccagactgggaggacgaagagctctttcagcatgcccgcaagcgggtgatagcaacctaccagaacattgcagtttatgaatggctgccctcatttttacagaagaccctccctgagtacaccggctacagacctttcttagacccttccatcagttccgaattcgtggccgctagtgagcaatttttgtcaaccatggtgcctcctggcgtgtatatgagaaacgcttcttgccactttcagggagtcataaacaggaattccagcgtgtctcgggcactgcgggtgtgtaacagctattggagccgagaacatccttcccttcaatccgcagaagacgtggatgccttgctccttggtatggcctcccaaatcgccgaaagggaagatcacgtgcttgttgaagatgtacgagacttctggcctgggcctcttaaattctccagaaccgaccatttggcaagttgcctccagcgcggaagagatctcggattaccttcatacacgaaagccagagccgcactagggctgagcccaatcacaagatggcaagacatcaatccggccctctcccgtagcaacgacacggtcctcgaggcgactgccgcgctctataatcaggacctgagctggctggagctgcttccgggggggctcctggagtctcaccgtgaccctggaccactcttttcgaccattgtgctcgagcagtttgttcgcttgcgtgacggagacagatactggttcgagaatacacgcaacgggttgttctccaagaaagagatcgaggaaatccgcaacacaactctgcaggacgttctggtggctgtcattaacattgacccatcagcgctgcagccaaacgtttttgtgtggcacaagggcgatccttgtccacagccacgccaactaagcacggagggcctgcctgcttgcgccccatccgtggtgcgtgattatttcgaaggttcgggttttgggttcggcgtaaccattggaacactgtgttgctttccgctggtgagcttattatccgcttggatcgtggctcgactgcgaatgcggaatttcaagcggctccaggggcaggatcgacagtccatcgtctccgaaaaactcgttggaggcatggaggcacttgagtggcaaggtcataaagagccctgtcgccctgtgctagtttacctgcagcctggccagattcgcgtggtggacgggcgcctgacagtcctgcggactatacagctgcagccccctcaaaaggtaaattttgtcctgtcttcaaataggggccgtcgtacccttctgctgaagatccccaaggagtacgatcttgtgctactctttaacctggaagaagaaaggcaagcccttgtggaaaatctccggggtgctctgaaagaatccggtttaagtatccaggagtgggaacttcgggagcaagagctaatgagagcagccgtcacccgggaacagcgtcgacacctcctggagactttttttcgtcatttgttttctcaagtcctggatatcaatcaggccgatgcaggtacccttcctcttgactctagtcagaaggtgagggaagccctaacgtgcgaacttagccgggccgaattcgcagaatcacttggtctgaaaccgcaggacatgttcgtggagagcatgttcagtttagcagataaagacgggaacggctacctgtctttcagagagttcttggatatcctcgtagtgttcatgaagggatcaccggaggagaagagccggcttatgttcagaatgtatgattttgacggaaacgggttgatcagtaaggacgaattcatccggatgctgagatcattcatcgaaatatccaacaactgtctctcgaaggcccagctggctgaggtggtcgaaagcatgtttcgagagtcaggattccaggataaggaagaacttacatgggaggactttcacttcatgcttagggaccataattcagagctgaggttcacccagctttgtgtgaagggggtcgaggtacccgaggtgattaaagatctatgtcgtagagcctcttatatttcccaggacatgatctgcccaagtcccagagtgtccgcacgctgtagccgatcagacatagagactgaattaacccctcagagactacagtgccccatggacacggatccaccccaggaaataaggcgccggtttggaaagaaagtgaccagtttccagccgttgctgttcacagaagcccatcgcgagaagttccagcggtcgtgtttgcaccagaccgtccaacagttcaagcggttcatcgagaactaccggcgacacattgggtgtgttgcggtcttctacgcgattgccgggggcctgtttctggagagagcgtactattacgctttcgcagcccatcatacaggaataacagacaccactcgcgtcggaattattttgtctcgaggcacggcggccagtatcagctttatgttcagctacattctgctgactatgtgtcggaatctgatcacctttctgagggagaccttcttgaataggtatgtgcccttcgatgctgccgttgattttcaccgtttgattgcgtccacagctattgtcttgactgtgctacatagtgtgggccatgtagtaaatgtctacctcttttccataagtccactcagcgttctttcgtgtcttttccctggtctgttccacgatgatggctctgagcttccccagaagtattactggtggttctttcagactgtgccaggactgaccggagttgttttgctgctcattctcgcaataatgtacgtatttgcttcacatcacttcaggcgaagaagcttccgtggattctggctaacacaccacctctatatcctcctctatgtgctgttgattatccatgggtcgttcgctctaatacagctccctaggtttcacatattctttctcgtacccgcgatcatctatggcggtgataagctggtctctctcagccgaaaaaaggttgagatttctgtcgtgaaggctgaactcctaccctctggggtaactcacctgagatttcagcgcccacaaggcttcgaatacaaatctgggcaatgggtccggatcgcatgcttggctctggggactacagagtatcatccctttacactcacctcagccccccacgaggacaccttatcattacacatccgtgcggctggtccttggaccacaaggctgcgcgaaatttattctgctccgactggtgaccggtgtgcacgctatcctaagttgtatctcgacgggccatttggtgagggccaccaagaatggcataaattcgaggtgagtgtgttggtgggcgggggaataggggttaccccttttgccagcatcctgaaagatctggtgtttaaaagcagcgtgagctgtcaggttttctgcaaaaagatttactttatatgggtcacgcgcacgcagcggcaatttgagtggttggctgacatcatacgcgaggtagaagagaatgaccaccaggacctggtcagcgtacatatttatataacacagcttgccgaaaaattcgatctacgtacgactatgctgtacatctgtgaaagacacttccaaaaggttctgaaccgtagtctgttcaccggcctgcggtccatcacccattttggccgtccaccgttcgagccattcttcaattctctacaggaggtacacccacaggtccgcaagatcggtgtattctcctgtggccctcctgggatgacaaaaaacgtggagaaggcttgccaactgattaacagacaggataggactcacttctctcaccactatgagaacttctag

SEQ ID NO: 185896 - DNA, 132 bp, Artificial Sequence
  Description of Artificial Sequence: Synthetic coding sequence
atgggcttctgcctggccctggcctggaccctgctggtgggcgcctggactcctctaggtgcccagaacccaatatcctgggaagtgcaacgatttgacggatggtataacaacctgatggagcatagatag

SEQ ID NO: 185897 - DNA, 3594 bp, Artificial Sequence
  Description of Artificial Sequence: Synthetic coding sequence
atgtggatgcactgctgctgggcctggcccccccggagccagagcgaaagaactatgtgctggctgaagatgtgcggcgtctctctcagactgagtctccaagttgtcaactcctggcccctcggtcgcgggtcagctggcctgcctgaaccggatttctggcccggacctcttaagttcagccggactgaccatctagcaagttgtttacagagaggaagagaccttgggctcccaagctacaccaaggctagagctgccctgggcctgtctccaattacacgctggcaggacataaaccctgctctgtcccggagcaatgatactgttctcgaggccactgctgctctctacaaccaggatctgtcctggctggaactgctgcccggggggctcctcgaaagccatagggacccagggccgcttttctctactattgtgctggagcaattcgttcggttgagagacggagaccgatactggttcgagaacacaagaaatgggttgttctctaagaaagaaatcgaggagatacgaaataccactctgcaggatgtcctggttgcggttattaacatcgacccttctgcactccagcccaatgtctttgtttggcataaaggcgatccctgcccacagccccgtcagctaagtactgaaggactcccggcctgtgccccgtctgtcgtacgagactactttgagggatccggctttgggtttggtgtcaccatcggcaccctgtgttgttttcccctggtgtctcttctgtctgcatggatcgttgcccggcttaggatgcgcaattttaaacgcctacaaggacaggatcgtcagagcattgtgtccgagaagttggtgggaggcatggaggcactggagtggcagggtcacaaagaaccatgccgccccgttttggtgtacctccaaccaggtcagatccgggtggtagacggtagactgacagttcttcggaccattcagctgcagcctccacagaaagtaaactttgtgctgtcctcgaacaggggacgacgtacccttcttcttaaaattcccaaggaatacgatctagtccttcttttcaacctagaagaggaacggcaggcactggtcgaaaatttgagaggagctctcaaggaatccggcctctccatacaagaatgggaactccgggagcaggaactgatgagggccgctgtgacccgcgagcagcgtcgccatctgctcgaaaccttctttagacatctttttagccaggtgctagacatcaaccaggccgacgcagggacgctgccattggatagcagccagaaggtgagagaggccttaacctgcgaactgtctcgtgccgaattcgccgaaagtctcggcttgaaaccgcaagacatgtttgtagagtcgatgttctctctggccgacaaggacggaaatggatacttgtctttccgggagtttcttgatattctggtagtattcatgaagggctcccccgaagaaaaatctcgcctcatgttccgtatgtatgatttcgatggaaatggcctgatttctaaggatgagtttattcggatgctgcgaagcttcatagagatctcaaacaattgcctgtcgaaagcccagttagctgaggttgtggaatctatgttccgtgagagcggattccaagacaaagaggaactgacttgggaggattttcattttatgctcagggatcataacagcgagctgaggtttacgcaactgtgtgttaaaggtgtcgaagtccctgaggtgatcaaggatttatgtcggcgggcttcctacatctctcaggacatgatctgtccatcaccaagagttagtgctcgttgctcaaggtccgatatcgagacagaactcactccgcagagactgcaatgtcctatggacaccgacccaccacaggagatccggcgtagatttggaaagaaagtcacctcctttcagcctctgctgtttaccgaagcccatagagagaaattccaaaggagttgcttacaccagactgtacaacaattcaagcggtttatcgagaattaccgtcggcacatcggctgcgtcgctgttttttatgccattgcaggcggactgtttctggaaagggcctactactatgcttttgccgcgcaccacaccgggataaccgacacaacacgcgtcggcattattttgagtagggggactgctgccagtatttcttttatgttcagttatattcttctaacaatgtgtaggaacctaatcacattcttgcgcgaaaccttcttgaatcgctacgtgccgtttgatgccgccgtcgactttcaccgtctaatcgctagcactgccatagttttgaccgttctccacagcgtcggacatgtggttaacgtataccttttctctatctcccctttgtcagttctctcatgcctgttccccggcctctttcatgatgatgggagtgagctgcctcagaaatactactggtggtttttccaaaccgtgcccggcctcactggcgtcgtgttgctgctgattttggctatcatgtatgtttttgccagccatcactttcgcagaaggagtttccggggcttctggctgactcatcatctgtacatcctgttgtacgtgctgctgattatccacggtagttttgccctgattcaactcccccgctttcacattttctttctggtgccagccatcatttacgggggtgacaaactggtctccttgagccgcaagaaagtggagatcagtgtggtaaaagccgaactgttgccctcaggagttacgcacctgaggtttcaaagaccccagggtttcgagtacaaaagtgggcaatgggtacggattgcctgtctcgcgctaggcacaacagaatatcacccctttacgctgacaagcgcaccccatgaagatacgctgagtctgcacatccgagccgctggcccctggactactcgcctgcgcgaaatctactctgctcctaccggagatcgttgcgcgaggtatcctaagctctacctggacggcccttttggggaaggacatcaggagtggcacaagtttgaggtgtcggttttggttgggggcggaataggagtaacacccttcgcctccatcctgaaggatctggtgtttaagtcttctgtcagttgtcaggttttctgtaagaaaatctattttatatgggtgactcgaacccagcgccaattcgagtggcttgcagatattatcagggaagtcgaggagaatgaccaccaggacctcgtttccgtgcatatatatatcacccaactggcggaaaaattcgacctacggaccaccatgttgtacatttgtgaacgccacttccagaaggtcctgaaccgatctttattcaccggcttgcggagtatcacacattttggacgcccgccctttgaacccttttttaatagtcttcaagaggtccacccccaggtcaggaagataggagtgttcagttgcgggccaccaggaatgaccaagaatgtggagaaggcctgccagttgatcaacagacaggacagaacccacttcagtcaccattacgagaatttctag

SEQ ID NO: 185898 - DNA, 4647 bp, Artificial Sequence
  Description of Artificial Sequence: Synthetic coding sequence
atgctgcgggcccggcccgaggccctgatgctgctgggcgccctgttaactggctccctgggtccctcaggtaaccaagatgccctatccttaccttgggaggtacaacgatatgatggctggtttaacaaccttcgccatcacgaacgcggcgccgtcggctgtcgccttcaacggcgcgttcctgctaattatgccgacggagtctaccaagctctcgaagagccccaactccccaatccccgccgtctgtccaatgctgccacacgggggattgcagggctcccctccctccacaatcgcaccgtattgggcgttttctttgggtaccacgtgttgagtgatgttgttagtgtggagacccctggctgccctgcagagttcctgaacatccgcattccaccaggggaccccgtcttcgaccctgatcagcgcggggacgtggtcctgccttttcagaggagtcgctgggacccagaaactggccggtccccgtctaacccccgggatctggctaatcaggtgaccggatggctggacggttccgcaatctatggcagctcccattcatggtctgacgctctgagaagtttcagcggtggccagttagcatctggaccagacccagccttcccacgcgattcccaaaatccccttctgatgtgggcggccccagaccccgccacaggccagaacggcccccggggtctgtacgcatttggcgccgagagagggaatcgggaaccttttctccaagcactcgggttgctctggttccgctaccacaatttgtgggcccagcgactggccaggcagcaccctgattgggaagatgaagagttgttccagcacgccaggaagagggtaatcgccacctatcagaacattgcagtttatgagtggctcccgtctttcctccagaaaaccctgcctgagtacactggctaccgacctttcttggacccaagcatttctccagagttcgtggtggcctcagagcagttcttttcaaccatggtcccacccggagtgtacatgcgcaatgcaagttgccactttaggaaggtactcaacaaaggatttcagtcctcacaggctttgcgagtgtgcaataactattggatcagagagaaccctaatctgaattccacacaggaggttaatgagctcctcctcggcatggcctcgcagatctcagagctagaggataacattgttgtggaagatctcagggactactggccgggccctggaaaattcagcaggaccgattacgtggcctcttcaatccagcgaggtagggatatgggactgccatcctacagccaggctctgttggcattcggcctcgatatccctagaaactggtctgatctgaatcctaacgtggaccctcaggttctggaagcaactgcggctctctataatcaggacctctctcagctagagcttctgttgggcggattgctcgaatctcatggggaccccggccctctgtttagcgctatcgtccttgaccagtttgtccggctgcgcgacggagatagatactggttcgagaacacacggaatggattgtttagcaaaaaggaaattgaggacatcagaaacactacattgcgcgacgtgttagtcgctgttatcaacattgacccgtccgccctgcagcctaatgtcttcgtctggcacaagggcgcaccatgcccccagcccaaacagcttaccacggacgggctgccccagtgcgctcccctgactgttctcgatttctttgaaggctcttccccaggattcgcaatcacaatcatcgctctctgctgcctgcccttagtgagcctgttgctgagcggtgtggtcgcttatttccgcggacgtgagcataaaaaactccaaaaaaagctcaaggaatcagtgaagaaggaggcggccaaagacggggtccctgcgatggagtggccagggcctaaagaaagaagttcacctatcattattcagcttctgtctgatcggtgtctgcaggtattaaacagacatcttaccgtgctgagagtagttcagctgcagcctttacagcaggttaaccttattctttcaaataaccgtggatgcagaactctattgctgaaaatacccaaggaatatgatctcgttttgctcttttcctcggaagaggaacgtggtgcatttgttcagcagttatgggacttctgcgtccgttgggccctgggcctgcacgttgccgagatgtccgagaaagaacttttccgcaaagcagttacaaagcagcaacgcgagcggatccttgagattttcttccggcatctcttcgctcaagtccttgacataaaccaagctgacgccggcactcttcctctcgattcttctcagaaggtaagggaggccctgacctgcgagctgtctcgagcagagttcgctgagagcttaggcctgaagcctcaggatatgttcgtcgagtcgatgttctcattggccgataaagatggaaatgggtacctgtcgtttcgagaattccttgatatactggtggtcttcatgaagggttcccctgaggataaaagtcggctgatgttcacaatgtatgaccttgacgagaacggatttctatccaaggacgagttttttaccatgatgcggagttttatcgaaattagcaataactgccttagcaaagcccagctggctgaagttgtagagtccatgttccgggagagcgggttccaagataaagaggaactcacatgggaggacttccattttatgctgagggaccacgattccgagctgcggttcacccagctgtgtgtgaaggggggtggtggaggggggaacggcattagagatatttttaagcagaacatatcctgccgggtgagttttatcactcgtacccccggggaacgctcgcaccctcaaggcttgggaccacctgcacctgaagcacccgaactcggaggacctgggctaaagaagcgcttcggaaaaaaggcagccgtccctacacctagactttacacagaagccctgcaggaaaaaatgcaacgcgggttcttagcccagaagctacaacagtataagcgcttcgtcgaaaattaccggcggcacatcgtctgcgtggctatcttcagtgcgatctgcgttggtgtattcgctgaccgggcatactactacgggtttgcctcgcccccatctgatatcgcccaaacgacactggtaggtatcatcttgtcccgcgggactgctgctagcgtgagcttcatgttcagttacattttactgaccatgtgcagaaatctgattacttttctgagagagacctttcttaacaggtacgtgccattcgatgctgctgtggattttcatcggtggatcgccatggctgctgtggtactggcaatcctgcattcagcagggcacgccgtgaatgtatacatttttagcgtgtcccctctgagtcttttggcctgcatcttcccaaatgttttcgttaacgatggtagtaagctgcctcagaaattttattggtggtttttccagacagtgccagggatgacaggagtcttgctgcttttggtactggcaatcatgtatgtatttgcctcccaccatttcagacgcagatcttttcggggtttctggctgacacatcacttgtatatactgctttatgcgctgctgattatccatggcagctacgccctcattcagctccctaccttccacatttactttctggtgcccgctatcatctacggaggggataagctagtctctctcagccgcaagaaagttgagatttccgtcgtcaaggcagaactgcttccttcgggagtgacgtatttacaattccagcggccacaggggtttgaatacaaatccggacaatgggtgcgtatcgcatgcttggcgctggggaccaccgaataccatccattcacactcacgtcagcaccccacgaggacacactctctctgcacataagagccgtgggcccatggacaacccgcttgcgagagatttattctagcccgaaaggtaatggctgcgcgggctatccaaagctatatctcgacggcccttttggcgaggggcatcaggagtggcataaatttgaggtaagtgtgctggtgggcggggggatcggagtcacccccttcgcaagcatcctaaaagatcttgtttttaaatcctcacttggatcacagatgctatgcaaaaagatctatttcatctgggtgacccgcactcagcggcagtttgagtggcttgctgatattattcaggaagtggaggagaacgatcaccaggatctagtctccgtacatatctatgtgactcagctcgcagagaagtttgatctccggaccacaatgttgtacatctgcgagaggcatttccagaaggttctgaacagaagcctgtttaccggactacgctctatcacacacttcggtcgtcctccctttgagcctttcttcaactctctacaggaagtgcacccccaagttcgcaaaatcggcgtattttcctgcggcccccctggcatgacaaaaaacgtggagaaagcctgccaattggtcaacagacaggaccgggcccactttatgcaccattatgaaaatttctag

SEQ ID NO: 185899 - DNA, 1452 bp, Artificial Sequence
  Description of Artificial Sequence: Synthetic coding sequence
atggccaccctgggccacaccttccccttctacgccggccccaagcccacatttcctatggatactacgctggcttctatcatcatgatttttttaacagctttagccaccttcatagttatcctccccggcatccgtgggaagacccgactgttttggttattgcgggtcgtcacttctctcttcatcggagctgccatcctagcagtgaatttctccagtgagtggagcgttggccaggtgtcaaccaacacatcctataaggctttttcctcagagtggatatccgctgacatcggattacaggtcggactcggcggcgtcaacattactctcaccggcactcccgtccaacaactgaacgaaacgatcaattacaacgaggagttcacttggcggctaggagagaattacgccgaggaatatgctaaagctctcgaaaagggcctccctgaccccgtgctttacctggctgagaagttcactccaagaagcccttgtggcttgtaccgccagtacaggctggccgggcactatacaagcgccatgctgtgggtggccttcctgtgctggctcttggccaatgtgatgctatccatgcctgtattggtgtatggaggatatatgttgttggcaaccggcatcttccagctgctggcgctcctgtttttctctatggcaaccagcctgacttcgccctgccccttacatctgggtgcctcggtcctgcacacccaccatggcccagcattttggatcaccctgactacggggctgctctgtgtgctcttgggcctcgccatggccgtggcgcaccgtatgcagcctcatcgtctgaaggcatttttcaatcagagcgtagacgaggaccccatgctggaatggtcgccggaggaaggtggcctgttgagccctcggtatagaagcatggcagattcccccaagtcacaagatatacctctgtccgaggcatcaagcacaaaagcctactacaggccgcggagactgtctttagttcctgccgacgtgcgcggccttgctcccgcggcgctttcagcactcccaggcgccctattggcccaggcgtggcgggccctgttacctggcctccgctgccctaaagctggcaaggaatctagactgggacctccacactctccttggagatttggacctgagggatgtgaggagcgttgggcagaacatactggggattcacccagacccttgcgcggccggggcacgggcagactttggcggtggggctccaaagagcgacgggcctgcggggttcgagctatgttgcccaggcttgtgtccaactccggcttgaagcgcccaagttgcttagacctgcccaagtgctgggactataggcgcgatgctcgcgctttttttcatctgctagagccaacaccctgcgttacaagccggcacacacccttgatctag

SEQ ID NO: 185900 - DNA, 1317 bp, Artificial Sequence
  Description of Artificial Sequence: Synthetic coding sequence
atggccaccctgggccacaccttccccttctacgccggccccaagcctacctttcccatggacacgacacttgcttctatcatcatgatttttcttacagcactggccaccttcattgtgatactgccagggattcgaggcaagacgcgactcttctggcttctcagagtcgttacttcgctgttcattggcgcagcaatcctggggactcccgtccagcagctgaatgagaccattaactacaatgaggaatttacttggcggcttggcgagaattacgcagaggagtacgcaaaagcgctcgagaaagggttgccagatccagtcctctatctggcagaaaagttcacacctaggtccccctgcggcctgtatcggcagtaccggctagctgggcactatacttcagcaatgctgtgggtggcgtttctatgttggctgttggccaacgtgatgctctctatgcctgtcctcgtctatggagggtacatgctcctggccaccggcatctttcaactgctcgctttgttattcttctccatggctacctccctcactagtccctgtcccttgcacctcggagcttcagtgctacatactcaccatggccccgcattctggattaccttgacaaccggtttgttgtgcgtacttctggggctggcaatggctgtggcccacagaatgcagccccaccggctaaaggcctttttcaatcagtccgtcgatgaggatcctatgttggaatggagtccagaggagggcggactgctgtcacctaggtaccgctcaatggccgattcgcctaagagccaagacataccattgtctgaagcctcttctactaaggcctactataggcctcgaaggctctctctggtaccagctgatgttaggggcctcgcgcctgcagcactgagtgccttgcccggagctctcctcgcacaggcttggagggcactcctccccggtttgcggtgtcccaaagcagggaaagaaagtcgtctcggaccacctcatagcccttggcgctttggcccggaaggctgcgaggaacgctgggccgagcacacaggtgactccccacgccccttacgaggacgaggcacagggagactgtggagatgggggtccaaggagcgacgtgcctgcggggtgcgggctatgttgccgcggttagtctcaaattccggactgaagagaccgtcttgcctggatttacctaaatgctgggactatcgccgggatgcaagagctttcttccacctgctagaacccacgccttgcgtcactagtcggcatacgcccttaatctag

SEQ ID NO: 185901 - DNA, 234 bp, Artificial Sequence
  Description of Artificial Sequence: Synthetic coding sequence
atggccaccctgggccacaccttccccttctacgccggccccaagccaacctttcccatggatacgaccctggcatctatcatcatgatcttcctgacagctttggcaacgttcatcgtaattttgccaggtatccggggaaaaacacggctgttctggttgctaagagttgtgactagcctattcataggtgctgctatcctgggcacccctgtgcagcagctgaacgagtag

SEQ ID NO: 185902 - DNA, 219 bp, Artificial Sequence
  Description of Artificial Sequence: Synthetic coding sequence
atggccaccctgggccacaccttccccttctacgccggccccaagcccacttttcctatggataccaccctggcgtccatcatcatgatcttcctgacagctctggctacattcatcgtgatcctgcccggcatccgtgggaaaacccgcctgttttggctcctgagggtggttacgagcctgtttatcggcgctgctatacttgctgtgaacttctag

SEQ ID NO: 185903 - DNA, 897 bp, Artificial Sequence
  Description of Artificial Sequence: Synthetic coding sequence
atggccaccctgggccacaccttccccttctacgccggccccaagccaacgtttcccatggataccaccctcgccagcatcatcatgatttttttgacggccctggcaactttcattgtgatcttgccggggatcaggggaaaaactcgcctgttctggcttttgagggtcgtaacctccttattcattggtgctgccatactgggtactcctgtccagcagctcaacgaaacgatcaattacaacgaggagtttacctggagattgggtgaaaattatgcagaggaatacgccaaagccctggagaaagggctgcccgatccagtcctatatctggctgagaagttcactccccgatcaccttgcggtctgtatcggcaataccgtctcgccggtcactacacttccgccatgctatgggtagcgttcctttgctggttactggcgaatgtgatgttgtccatgcctgtgctggtgtacggtgggtacatgctgctggccaccgggatattccagctgttggctttgctgttcttttccatggccacctctctgacttctccatgccccctgcacctgggcgcatcagtgctgcacactcaccatgggcctgccttctggattaccctaaccactggcctactttgcgtcctactcggactggccatggctgtcgctcatcggatgcagcctcaccggctaaaagccttctttaaccagagcgtggatgaagacccaatgctcgaatggagtccggaggaaggcgggctcctgtctccccgataccggtccatggccgatagccccaaatctcaggacatcccgctgagcgaggcttcaagcaccaaagcatactgcaaagaggcacacccgaaagacccagattgtgcactgtag

SEQ ID NO: 185904 - DNA, 42 bp, Artificial Sequence; identical to SEQ ID NO: 79710
  Description of Artificial Sequence: Synthetic coding sequence

SEQ ID NO: 185905 - DNA, 897 bp, Artificial Sequence
  Description of Artificial Sequence: Synthetic coding sequence
atggccaccctgggccacaccttccccttctacgccggccccaagccaacattccccatggacactacattggcaagtataataatgatctttcttacagccctggccactttcattgtgatccttcccggtattcgaggtaaaacaaggctgttttggctgctgcgtgtggtgacgtcgctgttcattggagctgctatattaggcacacctgtccagcagttaaacgaaacaatcaattataacgaggagttcacttggaggctgggagaaaattatgcagaagaatatgctaaggccttggaaaagggtctacctgacccagtcctctacctagccgagaagtttaccccaagatctccctgtggtctttacagacagtataggctggcaggccattatacgtccgcgatgttatgggtagctttcttatgttggcttttagcgaacgtgatgctgagcatgccagttcttgtgtacggtggatatatgctcttggcaactggtatctttcagctgctggctttgctttttttttcgatggctacctccctgacctcgccctgccctttgcacctgggtgcttcagtgctccatacacaccacggccctgcattctggatcacgttgactactggcctgctctgcgttctactcggtctcgctatggcggtggcccacaggatgcagccccatcggttgaaagcattctttaatcagtctgttgacgaagacccaatgctggaatggtcccctgaggaaggaggactactgtctccacggtatagatcaatggccgatagcccgaagagccaggatatccccttaagtgaagcatctagtactaaagcctactgcaaagaggcacatcccaaagaccccgactgcgcactctag

SEQ ID NO: 185906 - DNA, 1452 bp, Artificial Sequence
  Description of Artificial Sequence: Synthetic coding sequence
atggccaccctgggccacaccttccccttctacgccggccccaagcctaccttccccatggatacgacactggctagcattattatgatctttctaactgctttagccacatttatcgtcatactcccaggtatcagagggaaaacgcggctgttctggctgttacgggtggtgacatctctgttcataggagctgccatcctggcagttaacttcagcagtgaatggagcgttggccaggtaagtacgaataccagctacaaggcattcagctcagagtggatttccgcagatattgggctccaggtggggctgggcggggtgaatatcaccctgactggcactcctgttcagcaactgaacgagacaatcaattacaacgaggagtttacatggcgccttggagagaattacgcagaagagtacgccaaagctcttgagaaggggctcccagatcccgtgttgtatcttgcagaaaagttcacacccaggtctccgtgcggtctctatagacaatacagactggccgggcattacacatctgccatgctttgggtagcttttctgtgttggctactggccaatgtgatgctctccatgccagtattggtctatgggggctatatgctcctggctaccggtatctttcaactgttagcactgttatttttcagcatggcgacctcacttacgagcccatgcccattgcatctcggggcaagtgtcttgcatacacatcacggcccagctttttggatcacactgactaccggcttactgtgcgtcctgctgggcttggcgatggccgtcgcacatcgaatgcagcctcatcggttgaaggccttctttaatcagagcgttgatgaggatcccatgttagagtggtctcctgaggaaggcggactcctgtctccccggtacaggagtatggctgacagtcctaaatctcaagatattcccctgtctgaggcctcttcaaccaaagcatactatcgccctcgacgattgagtctcgtgcccgcagatgtcaggggtctggcaccagcggccctgtccgccttgcctggagcgctgctcgcccaggcatggcgtgccttgctgccaggcctgcgctgccctaaagccgggaaggagagcagactaggtcctccccactccccttggagattcggacccgaaggatgcgaagaaagatgggctgagcacacgggcgactcaccacgcccactgcgcggcagggggaccggacggttgtggcgctgggggtcaaaggagaggagagcttgtggagtgcgggctatgctgcctcgactagtatctaattctggcctgaaacgtcccagctgcctggacctgccaaagtgctgggattacaggcgagacgccagagccttctttcacctcttggagcccaccccttgtgttacttcccgtcataccccattaatttag

SEQ ID NO: 185907 - DNA, 219 bp, Artificial Sequence
  Description of Artificial Sequence: Synthetic coding sequence
atggccaccctgggccacaccttccccttctacgccggccccaagccaacctttcccatggatactaccctggcgagtatcattatgatctttctcacagctctggcaacctttattgtaattcttcctggaatccgtgggaaaacaagacttttctggctgttacgcgtcgtgacttccctgtttatcggcgctgcaatccttgggacccccgtgtag

SEQ ID NO: 185908 - DNA, 51 bp, Artificial Sequence
  Description of Artificial Sequence: Synthetic coding sequence
atggccaccctgggccacaccttccccttctacgccggccccaagccatag

SEQ ID NO: 185909 - DNA, 366 bp, Artificial Sequence
  Description of Artificial Sequence: Synthetic coding sequence
atggccaccctgggccacaccttccccttctacgccggccccaagcccacgtttcctatggacaccactctcgcgtctatcattatgattttccttactgctttagccactttcatcgtgatactgccgggcatccgcgggaaaaccaggctgttctggctccttcgggtggttacaagcctgttcataggtgccgctattctagccgtgaatttctcatctgaatggtcagtgggccaggtgagcaccaatacttcttacaaagctttctcttcggaatggatcagtgctgatattggactccaggtagggttggggggcgtcaatatcactctgacagggactccagtgcagcagctgaattag

SEQ ID NO: 185910 - DNA, 1032 bp, Artificial Sequence
  Description of Artificial Sequence: Synthetic coding sequence
atggccaccctgggccacaccttccccttctacgccggccccaagcccactttcccaatggacaccacactggcatccatcatcatgatctttctcacagcgctggccacattcatcgttatccttcctggcatcaggggaaaaaccaggttgttctggctgttaagggtagttacttccttgtttatcggcgccgcaatcttggctgtcaattttagttccgaatggagcgtgggtcaggtttcgaccaacacctcttacaaggcctttagtagcgagtggatctcggctgatatcggtcttcaggttggccttggtggagtcaatatcaccttgaccggcacccctgtgcaacagctcaatgaaaccatcaactataatgaggaattcacatggaggctgggggaaaattacgccgaggaatatgctaaggctttagagaaaggactccccgatcccgtcctgtatctggctgagaagtttaccccccgaagcccctgtggcctctaccggcagtaccgactggctggccattacacgagcgctatgctgtgggtcgcgttcctgtgttggctgcttgccaatgtgatgctttccatgccagtcttagtgtacgggggctacatgctgctggctaccggaatttttcaattgctggccctactgttcttttcaatggctacctccttgacttcaccttgtccccttcatctgggcgcctccgtgttacacacccatcacggcccggctttctggatcactctcacaaccggcctgttgtgtgtcctgttaggattggctatggcagtggctcatcgcatgcagccacaccgcctcaaagcttttttcaaccagtcagtagatgaagaccccatgctggagtggtcacctgaagaggggggcctcttgtctccaagataccgatccatggcggacagccccaaatcccaggacatccccctcagtgaagcatcttccacaaaggcatactgcaaggaagcccatcccaaagacccagactgcgcactttag

SEQ ID NO: 185911 - DNA, 963 bp, Artificial Sequence
  Description of Artificial Sequence: Synthetic coding sequence
atgaccctgtggaacggcgtgctgcccttctacccccagccccggcacgccgctggcttttctgtgccccttctcatagtgatccttgtgttcttggctctggccgctagcttcttactgattcttccagggatccggggacacagccgatggttctggctggttagggtcttactttcactgttcattggggctgagatcgtggcagtacacttttccgccgagtggttcgtcgggactgtgaacacaaacacaagctataaagccttctctgctgcccgagtgactgcgcgagtccggctgctggtcggtctggaggggatcaatattaccctgactggtacaccggtgcaccaactgaatgagacaattgactacaacgaacaattcacctggcgccttaaggagaattatgccgccgagtacgctaacgcccttgagaagggcctgccggaccccgtcctgtatctcgcagagaaatttacacccagcagcccctgcggcctgtatcaccagtaccacctggcggggcactatgcaagcgccaccctgtgggtagctttttgtttttggctgttgtctaacgtgcttctcagcacccctgccccattgtatggcggcctggctctgctgactacgggggccttcgctctctttggggtttttgctctcgcttcaatcagctccgtgcctctgtgcccactgagactcgggtcatcggccttaactacacaatacggtgccgctttctgggtgacccttgctactggcgtgctgtgtctatttctggggggggctgtggtctctctccaatacgtacgtccaagcgctctacgcaccctgctggaccagagtgcaaaggattgtagtcaggagcgtggcgggagcccactgatcctcggggacccattgcacaagcaggccgctctccccgatctgaaatgtattaccacaaatctgtag

SEQ ID NO: 185912 - DNA, 1767 bp, Artificial Sequence
  Description of Artificial Sequence: Synthetic coding sequence
atggagggcgacggcgtgccctggggcagcgagcccgtgagcggccccggtcctggtgggggggggatgatccgcgagctctgccgaggatttggcagatataggcgttatctaggccggctgagacaaaatctcagggagacacaaaagttcttccgcgacattaagtgcagtcataaccatacttgtttgagcagcctcaccggcggtggtggggcagagagggggccagccggagacgtagcggagacaggtcttcaggctgggcaactgagctgtatctcctttccacccaaagaggagaaatatctgcagcagatcgttgactgtctcccatgcatcctcatcctgggtcaggactgcaatgttaagtgccagcttcttaacttacttttgggggtgcaagtgcttcccaccaccaagctgggctctgaagaatcatgcaagcttcggcgattgcggtttacgtatgggacacagacccgcgtatcactggctcttccaggccagtatgagttggtgcacaccctggttgctcaccagggcaattgggagacgatccccgaagaagatctggaggtgcaggagaacaacgaggatgccgcacacgtgcttgccgaattagaagtgactatgcatcacgccctgctgcaggaggtcgacgtagttgtggccccatgtcaggggctccgccccaccgtcgatgtcctgggagatctggtcaacgacttcctgccggtgatcacctatgccttgcacaaggatgagttatctgagagagatgagcaagagctacaggagattagaaaatacttttcttttccagtctttttttttaaggtgcccaagcttggcagtgagatcattgactccagcacacgcaggatggaatctgagaggagcccactgtaccgtcaattaatcgacctcgggtacctttcaagtagccactggaactgcggcgctccgggtcaggacactaaggctcagtcaatgctggtagaacagtctgagaagctgaggcacctgtctaccttcagccatcaggtgttgcaaaccagattagtggacgcagccaaggcgctgaacctcgtacattgccactgcctggacatcttcattaaccaggctttcgacatgcaaagagaccttcaaatcactcccaaacgcctcgagtacacaaggaagaaggaaaatgagctgtacgaaagcctgatgaacatcgccaaccgaaaacaggaggagatgaaggatatgatagtggagacactaaatacaatgaaggaggaactcttggatgacgccacaaatatggagttcaaagacgtcattgtacctgaaaacggagagccaatcacagatctcgggttttgcaagcccgaggctatgatgagcggtagtattgtggggacacctatccacatggctccagagctattcacaggcaagtacgataactctgtggacgtttacgcctttgggatcctgttttggtacatctgttctggaagcgtcaagctacccgaggccttcgaaaggtgtgcgagcaaagatcacttgtggaataatgtgagacgtggcgcgagacccgagcggctccccgtgttcgacgaagagtgttggcagctaatggaagcatgttgggacggggaccccctcaagcgcccacttctcgggatcgtgcaacccatgcttcaggggatcatgaacaggctctgcaagtctaatagtgagcagccgaaccgtggacttgacgactcgacctag

SEQ ID NO: 185913 - DNA, 2655 bp, Artificial Sequence
  Description of Artificial Sequence: Synthetic coding sequence
atggagggcgacggcgtgccctggggcagcgagcccgtgagcggccccggcccggggggtggcggcatgattagagaactgtgtagggggttcggtcgataccggcgttatctcggcaggcttcgccaaaacctcagagagactcagaagttctttcgcgatataaagtgctcccacaaccatacatgcctctccagcctaactgggggagggggcgccgagagagggcccgcgggggatgtggccgagaccggactgcaggccggacagctgtcttgtatctctttcccccctaaagaggagaaatacctgcagcagattgttgactgccttccatgtatactcattctgggacaagactgtaatgtcaaatgccagctgctgaatctgttgctgggggttcaggtcttgccgacaacgaagctggggagtgaggaaagctgtaaactgcgccgactgagatttacctatggtacccagacccgcgtcagtctggcccttcctgggcagtatgagctggtccacacactcgtcgcccaccaaggtaattgggaaactatccctgaagaagatctggaggtccaggaaaataacgaggacgccgcccacgtcctggctgaactggaggtgaccatgcaccacgccctgcttcaggaggtagacgtagttgtggctccgtgccaagggctgcgtccgacagttgacgtcctgggtgacctcgtcaacgatttcctgcccgtgattacctacgcactgcataaggacgagctgagcgaacgtgacgagcaggagctgcaggagattagaaagtacttctcctttccagtgtttttttttaaagtgcctaaattgggctctgaaatcattgattcaagtacgcggcggatggagtccgaacggtctccgctataccgtcagctgatagacctcggatatctgtcatccagccactggaattgtggggcccctggccaggatactaaggctcaatcaatgctggtggagcaaagcgagaaactccgccacctgtctacgttctcgcatcaagtgctgcagacccgcctggtggatgcggcaaaggcgcttaacttggtgcactgccattgcctggatattttcatcaatcaagccttcgatatgcaacgggacttacagattacaccgaaacgcctcgagtacactcgcaagaaggagaatgagctctacgaaagtttaatgaatatcgcgaatcggaagcaggaggagatgaaagatatgatcgtggaaactctgaacactatgaaagaagagctcctggatgacgcaacaaatatggagttcaaagatgtgattgtccctgaaaacggggaacctgttggcacccgtgagatcaaatgctgcataagacagattcaggagctgatcatttctcgactgaaccaggccgttgctaacaaactgatctcctcagtcgactacctgagggaatctttcgtgggtactttagaaagatgtttgcagtcccttgaaaaatcacaggacgtctccgttcatattacttctaactacctgaagcagattctgaatgccgcttaccatgtggaagtgacatttcactcgggttctagcgttactcggatgctttgggagcagatcaagcagataattcagagaattacctgggtctccccaccagcaattaccttggagtggaagaggaaagtggcacaggaggccatcgaatctctctccgcaagcaagctcgcaaagagcatctgcagtcagttccgtacccggctcaacagttctcacgaggccttcgccgcttccctgcgacagctcgaagcagggcactctggccgtctggagaagaccgaggacctctggttgcgggtgcgcaaggaccatgctccgaggttggcccggttgagtttggagagctgcagtcttcaggatgtcctcctccaccgaaagccgaagctggggcaggagctggggaggggccagtacggtgtggtctatctgtgtgacaactggggagggcatttcccttgcgccctgaaaagtgtcgtgccgccagacgagaaacactggaatgatctcgccctggagttccactatatgaggagtttacctaaacacgagcgacttgtcgatctgcatggcagcgtaatcgattataattacggaggcggatccagcatcgccgttctgttaatcatggagcggctgcatagggatctgtatactggtttgaaagccggcttgactctcgagacccgcctgcagatcgcattagatgttgtagaaggaattaggttcctccacagccagggactcgtacatcgggacatcaagctcaaaaatgtcctcttggataagcagaatagggccaagataacggacctcggattttgcaagccggaggctatgatgagtggttcaatcgtgggcacaccgatccacatggctcctgaactttttacgggagctcgtccagagcgcctccctgtttttgatgaagaatgttggcagttgatggaagcctgctgggacggcgacccgctgaaacggccgctgctgggtatagtccaacctatgttgcagggtattatgaaccgcctgtgcaaaagcaatagtgagcaacccaaccgcggcttagatgactcaacttag

SEQ ID NO: 185914 - DNA, 2790 bp, Artificial Sequence
  Description of Artificial Sequence: Synthetic coding sequence
atggagggcgacggcgtgccctggggcagcgagcccgtgagcggccctggaccaggaggcggaggcatgatacgggaactgtgccgaggattcggcagatacagacggtacctgggacggctgcgccagaatctccgcgagacacagaagttctttcgggatatcaagtgctctcacaaccatacctgtctctcgagtctgactggggggggaggggctgagcgaggacccgcgggcgatgtagccgagacaggccttcaagcgggccagctcagctgcattagcttccccccaaaggaagagaaatacttgcagcaaatcgtagattgtctgccctgcattctgatactgggtcaggactgcaatgtcaagtgccagcttctgaatcttctgctgggagtgcaggtacttcccactacgaaactggggtccgaagagtcctgcaagctacgccgccttagattcacttacggcactcagacaagggtgagcttggcactgccaggacagtacgagctcgttcatacattggtggctcaccaggggaactgggaaacaatccccgaggaggacctggaggtgcaagagaacaacgaggacgctgctcacgtcctggccgaattggaagttaccatgcatcacgccttgctgcaggaggtggacgtcgtggttgctccctgtcaaggcctgcgtccaacagttgacgtgctgggcgacctggtgaatgactttcttccagtcattacctatgcgttgcataaggatgagctcagcgaacgcgatgagcaggaattgcaggagataaggaaatacttttcgtttccagttttcttcttcaaggtgccaaaattaggaagcgagataatagactcaagtaccagacggatggagtccgagaggtcccctctgtaccggcagttgattgatcttgggtatctgagttcttctcactggaactgcggtgctccaggacaagatactaaagcccaaagcatgctggtggagcagtcggagaagttacgtcacctcagcacatttagccaccaggtgctgcaaactcgtctggtggatgccgccaaagctttgaatcttgtgcactgtcactgtctcgacattttcattaatcaggctttcgacatgcagcgcgacctgcaaatcaccccaaagagattagaatatacaaggaaaaaggagaacgaactgtatgagtccctcatgaatatcgctaaccgaaagcaagaagaaatgaaggatatgatcgtggagactctaaataccatgaaggaggaactccttgatgacgcgactaacatggagtttaaagacgtcattgtgccagaaaatggggaacctgttggaacccgcgagataaagtgttgcattcgccaaatccaagagttgataatcagcagactgaaccaggcagttgccaataaactgatctcatctgtagattatctgcgggaaagctttgtggggactctggaaaggtgtttacagagccttgagaagagccaggatgtctcggtacatataaccagcaactacctcaaacaaattttgaacgcagcctaccacgtggaggtgaccttccattccggatccagtgtgactcgcatgctctgggagcaaattaagcagatcatacaaagaatcacctgggtctcaccaccagcaataacattggaatggaagagaaaggtagcccaggaagccatcgaatcactgtccgctagtaagttagccaagagcatctgctctcagtttcgcaccaggttaaacagttctcacgaggccttcgcagcaagcctacggcagttagaggctgggcactctggaagactcgaaaagacagaggacttatggctgagggttcgcaaggaccacgcaccaagactggcccggttgtccctggaatcctgttcattgcaggacgttttgctccatcggaagccaaaactgggccaggaactcggccggggccagtatggcgttgtctatctgtgtgataattggggaggacatttcccttgtgcgctgaagtcagttgtcccgcctgatgagaagcactggaatgatctggctttggagttccattacatgcgtagcttgcccaagcacgaaagactggttgatctccatggatctgttatcgactacaactacggggggggatccagcatagctgtgctccttatcatggaacgtttgcatagggacctttatacgggcctaaaggctggacttaccctggagactcgcttgcagatagcgctggatgttgtggaaggtatccgatttctgcactcccaagggctggttcacagggatatcaagctcaagaacgtgctgctagataagcagaatagggctaagattaccgatttaggattttgcaagcccgaagccatgatgtctggctctatcgtcggtacacccattcacatggcaccggagctattcacaggaaagtacgataactctgtggatgtatacgcatttggcatactcttttggtacatctgttccggttctgtcaaactaccagaggctttcgagcgttgcgcatccaaggatcatctgtggaataacgtgcggcgtggcgcccgacccgagagactccccgtgttcgacgaggagtgctggcagctgatggaggcctgttgggacggagacccgctgaagagaccattgctggggatcgtgcagcctatgttgcaaggaatcatgaatagactctgcaaatccaacagcgaacagccaaacagggggcttgacgactccacgtag

SEQ ID NO: 185915 - DNA, 1104 bp, Artificial Sequence
  Description of Artificial Sequence: Synthetic coding sequence
atggtgatggaggtgggcaccctggacgccggcggcctgcgggccctgctgggggaacgcgctgcccagtgccttctcctggattgtcgaagtttcttcgccttcaatgccggacatattgctggctctgtgaatgtgagattttctactattgtgaggcgacgagctaagggggctatggggttagagcacattgtacctaacgctgaactgcggggacgcctgctagccggagcataccatgcggttgtcctcctagacgaacggtccgccgcgctcgacggcgccaagagggatgggacactggcactggctgccggcgcgctgtgcagggaggcacgcgccgcccaagtgttcttcctaaaaggcggttacgaagccttcagcgcctcgtgtccagagctctgcagcaaacagtccaccccgatgggcctatcgctgcctctgagcacgtccgttcccgattccgctgagagcgggtgcagctcgtgctcgactccactttatgatcaaggtgggcctgttgagatcctgccatttttataccttgggtcagcttaccacgcaagtcgcaaagacatgctcgacgccctgggtataaccgcccttattaacgtgtctgccaactgtccaaatcattttgagggtcactaccagtataagtccatccctgtcgaagacaaccacaaagccgatatcagcagttggttcaacgaggctatcgattttatcgacagtattaaaaatgctggagggcgcgtgttcgtacactgccaggctggtatttctcgcagcgctacaatttgccttgcctaccttatgagaacaaatcgagtaaagctggacgaggcattcgagtttgtcaagcagcggcgttctattatttcccccaatttttcatttatggggcagctccttcaattcgagtcccaggtgttagctccacactgtagcgcagaggcgggatcccctgcaatggcagtgctcgaccgcggcactagcactacaaccgtgttcaacttccctgtgagcatccctgtacacagtactaattctgcattatcttacctccaatcacccatcacgacctccccttcatgttag

SEQ ID NO: 185916 - DNA, 909 bp, Artificial Sequence
  Description of Artificial Sequence: Synthetic coding sequence
atggtgatggaggtgggcaccctggacgccggcggcctgcgggccctcctgggcgaacgtgcagcacagtgtttactgctggactgccggagtttctttgcattcaacgctggccacatagccggaagcgtgaacgttagattctcagcagcacaggtcttttttctgaaaggtggatatgaggccttcagcgctagttgtcctgaactctgttctaagcaatctactcccatgggattgagtctccccttgtccacttcagtgcccgactctgccgagagtggctgctcatcatgctcaactccactgtatgaccagggtggaccagtggagatacttccattcctgtatttggggagcgcctatcacgcctcccggaaagacatgctcgatgccctgggtattacagcattaattaatgtgagtgctaactgccctaaccatttcgagggccactatcaatataagagcatacctgtggaggataatcacaaggctgacatttcctcatggttcaacgaagctatagacttcattgattcgatcaagaatgcggggggtagagtctttgtgcattgccaggctgggatttcgcgtagtgccacaatctgtttagcctaccttatgagaaccaaccgagtgaaactggacgaagcttttgagttcgtgaaacagaggcgcagtatcatctcacccaatttctcattcatggggcaactgcttcagtttgagtcccaggtgttggcgcctcattgtagcgcggaagcggggagccccgctatggcggtgctggacagaggcacctccacaaccaccgtgttcaattttcccgtcagcattccggtccacagcaccaactccgccctgtcctacctgcagtctcctatcactacgtctccctcatgttag

SEQ ID NO: 185917 - DNA, 1023 bp, Artificial Sequence
  Description of Artificial Sequence: Synthetic coding sequence
atggtgatggaggtgggcaccctggacgccggcggcctgcgggccctcttaggcgaacgagcagcccagtgtctgctgctggattgtaggtctttcttcgcatttaacgccggccatattgccggaagcgtcaatgtaaggtttagcactatcgtgcgacgccgcgctaagggggccatgggcttagaacatatcgtgccgaacgcgaagcgagatgggactctggcgctggcggcgggtgccctatgccgcgaggcgcgggccgcccaggttttttttcttaaaggcggttatgaggctttctccgccagctgcccggagctttgctccaagcagtctacgcctatgggtttatccctgcctctgtcgacttcagtccccgactccgccgaatctggttgtagcagttgcagcactcccctgtacgaccagggtggcccggtagaaatacttccctttttgtatctgggatctgcctatcacgctagtagaaaggatatgctcgacgccttagggatcacagcgctaataaacgtaagtgcaaattgtccgaaccacttcgaaggccattatcagtataagagcatccccgtggaagataatcataaagccgacatttcttcctggttcaacgaggcaatcgatttcattgatagtatcaagaatgcgggaggtcgggtgttcgtgcactgccaagcaggcatctcccggtccgcaaccatatgcctcgcttacctcatgcgcaccaatcgagtgaagcttgatgaagcttttgagtttgtgaaacagagaagatcgatcatttcaccaaacttttctttcatgggtcagctgctccagttcgagagtcaggtcttggctccccattgcagcgccgaagccggctccccagcgatggccgtgcttgatagaggaaccagcacgactacggtctttaacttccccgtgagcatccctgtccatagcacgaacagcgccctgtcatatttgcagagcccgatcacaacctcaccaagttgctag

SEQ ID NO: 185918 - DNA, 1134 bp, Artificial Sequence
  Description of Artificial Sequence: Synthetic coding sequence
atgcggaacagcgagaccctggagcggggcgtgggcggctgccgggtctttagttgccttggatcttatcctggaattgaaggcgcaggtctcgcactcctggccgatctcgcccttggtgggcggctactcggtacacatatgagtcagtggcaccacccccggtccggatggggccgtcgcagagatttcagcgggcgctcctcagccaagaagaaaggcggcaatcatatcccagagcgatggaaagattacctgccagtggggcagcgtatgcctgggaccagatttattgcttttaaagtgcctcttcagaaatccttcgagaagaaactagccccagaggagtgcttctcgcccctggaccttttcaacaagatacgcgaacagaatgaggagctgggtcttatcatcgacctgacttatacacagaggtactacaaacccgaagaccttccagaaaccgtgccatatctcaaaatatttacggtcggacaccaggtgcccgatgacgaaaccatattcaaattcaagcacgctgttaacggctttctgaaggaaaacaaggacaacgataagctcatcggtgtccactgcactcacggcctgaaccgaacaggctacctgatctgccggtatctcatcgacgtggagggtgtgaggcccgatgatgctatcgaactgttcaacaggtgcaggggtcattgtctcgagcgtcagaactatatcgaggatctgcagaacggccctattcgcaagaactggaacagcagcgtgccccgctcctcagactttgaagactccgcgcatttgatgcagcctgtccacaacaaacccgtgaaacaaggcccgcgttataacctgcaccagatccagggacatagcgccccaagacattttcacacccagacgcagagcctgcagcagagcgtgcggaagttttcagaaaatccacacgtatatcagcgtcaccatctgcctccacccggtccccctggtgaggattactcccacagacgatacagctggaatgtgaaacctaacgctagccgggctgcccaggacaggaggcgctggtatccttacaattacagcaggcttagttatcctgcatgctgggagtggacccaatag

SEQ ID NO: 185919 - DNA, 681 bp, Artificial Sequence
  Description of Artificial Sequence: Synthetic coding sequence
atgagccagtggcaccacccccggagcggctggggccggcggcgggatttctctgggcgctctagcgctaagaagaaaggcgggaaccacatccctgagcgttggaaagactacctgcccgtgggacagagaatgcctggtactcggttcatagccttcaaagtcccccttcagaagagtttcgagaaaaaactcgcccccgaagagtgcttttctccactagacctgttcaacaaaatccgagaacagaatgaggaacttggcttgatcatcgatttgacctacactcagagatactacaagcctgaggatttacctgaaacagttccatacctgaagatcttcacagtgggccatcaggtccctgacgacgaaacaatttttaagttcaaacacgcagtaaatggcttcctcaaggaaaacaaggacaacgacaagttgatcggggtgcactgtacccatgggctcaatcggaccggctacttaatctgccggcgcagcctagccttgtctccccgtctcgagtgttccgggacaatctctacccatagcaaattctgctttccgggtagcaggagatccccagcaagtgcgagccaagtggccgggacaacaggcgctagacatcatgctcgtctgatattctgtatatttagccgagacgtcgtgtccccatgctag

SEQ ID NO: 185920 - DNA, 822 bp, Artificial Sequence
  Description of Artificial Sequence: Synthetic coding sequence
atgcggaacagcgagaccctggagcggggcgtgggcggctgccgggtgtttagctgccttggatcatatccaggtatagaaggagccggcctggccctgctagctgacctagctttgggcggacggcttctgggcacccacatgtcgcagtggcaccacccgcggtcgggctgggggaggcggcgggacttttctggccggagctccgctaaaaagaaaggggggaaccatattccagaacggtggaaggattacttgcctgtcgggcagcggatgcccgggactagattcattgcgtttaaggtgcctctccagaagtctttcgaaaagaagctggcacccgaggagtgctttagccctctcgacctgttcaataagattcgcgagcagaacgaggagctgggattaatcattgatttaacttacacacagcggtattacaagcccgaggacctccctgagacagtgccctatctgaagatattcacagttgggcaccaggtgcctgacgacgaaaccatcttcaagtttaaacatgctgtcaatggttttctaaaagagaataaggacaatgacaaactgatcggggtgcactgtacccatggtctgaatcggacgggttatctcatttgtcgtagatcgcttgctttgagtccgaggcttgaatgtagtggcactatcagcactcacagcaaattttgctttccaggcagccgccgatcccctgcctcagcttctcaggtggcagggaccaccggtgcccgtcatcatgccagactaatcttctgcatattctcccgcgacgtagtgtcaccttgttag

SEQ ID NO: 185921 - DNA, 597 bp, Artificial Sequence
  Description of Artificial Sequence: Synthetic coding sequence
atggacagcctgcagaagcaggacctgcggcggcccaagatccacggcgccgtacaggcaagcccttatcaaccacctactctagcgagcctgcagcgactgctttgggtgcggcaggccgctacgttgaaccatatcgacgaggtttggcctagtctctttctgggcgacgcttacgcagccagagacaaatcgaaactgattcagcttggaattacccatgtagtgaatgccgctgcagggaagttccaggtcgatactggcgccaagttctaccgcggcatgtctcttgaatactacggcattgaagccgacgacaatcctttttttgacctatctgtatacttcctgccagttgccagatacattcgggccgccttgtcagtgccccagggccgggtgctggtgcactgtgccatgggcgtgtctcgcagcgcaacccttgttctggctttcctgatgatctgcgagaacatgaccctcgtagaagcaatccagacagtacaagcccacagaaacatttgcccgaactcaggctttctacggcagttgcaggtcctggacaatcggctcggccgcgagaccggcagattctag

SEQ ID NO: 185922 - DNA, 747 bp, Artificial Sequence
  Description of Artificial Sequence: Synthetic coding sequence
atggccgagaccagcctgcccgagctgggcggcgaggacaaggccacaccctgcccgtccatcttggagcttgaggaactcttgagagccgggaaatcttcttgtagcagggtcgacgaagtttggccgaacctgtttatcggagacgctatggatagcctgcagaaacaggatctcaggagacctaaaatccacggagccgtacaggcctcaccctaccaaccacccaccctggcaagcctccagaggctcctgtgggtccggcaagccgctactcttaaccacattgatgaggtgtggccctccctgttcctgggggacgcctacgcagcccgggataaatctaaactgattcagctgggcattacacatgtggtgaatgctgctgcaggcaagtttcaggtagataccggcgccaaattctaccgcggcatgtccctggagtactatggtatcgaggctgacgataaccccttcttcgacctgtccgtctatttcttacctgtggcccgctacattcgcgccgccctttccgtgcctcaggggcgagtgctggttcactgcgctatgggtgtcagccgctctgcaacgctggttctggcctttctgatgatctgcgaaaacatgacattggtggaggccatccagaccgtacaagctcataggaacatttgccctaattcaggcttcctgagacagttgcaagtccttgacaatagattggggcgcgaaacagggcggttctag

SEQ ID NO: 185923 - DNA, 567 bp, Artificial Sequence
  Description of Artificial Sequence: Synthetic coding sequence
atggccgagaccagcctgcccgagctgggcggcgaggacaaggccaccccttgtccttctatcctggaattggaggaattgctacgggccggcaaaagctcctgcagcagggttgatgaagtctggcctaacctattcattggtgacgcagccaccgcaaacaatcgttttgagctgtggaaattgggaatcactcatgtcctgaacgctgcccataaaggactgtactgccaaggaggacccgacttttacggttcttctgtgtcctatctcggagtccccgctcacgacttacctgactttgatatctcagcctatttttcaagcgccgctgattttattcaccgtgcgctcaacacccccggggctaaggtgctagttcactgtgtggtgggtgtcagccgtagtgccacgctggtgctcgcatacttaatgcttcaccagcgattgtctctccggcaggccgtaataacggtcaggcaacataggtgggttttccctaaccgaggctttctccaccagctgtgtcgcctagatcagcagctacggggggctggacagtcttag

SEQ ID NO: 185924 - DNA, 876 bp, Artificial Sequence
  Description of Artificial Sequence: Synthetic coding sequence
atgggcctgtgccacttcgccaccctggccctgatcctgctggtgctcctggaagcactggcacaggcagatacacagaagatggtggaagcccagcggggcgtgggccctcgcgcctgttactcaatatggctactcctggcacctacaccgccactgagccactgcctccagtctcctcagaaacagcaccaggtgtgtggcgaccggcggctgaaggcgtcatctacaaattgccccagcgagaaatgcaccgcttgggccagatactctcacagaatggattctctgcagaaacaagacctccgcaggcctaagatacacggggccgtacaagcttccccttaccagcctccaaccctcgcctcgttacagagactgttgtgggttagacaagccgccacccttaatcacattgatgaagtctggccatcactcttcctcggcgatgcatacgcggccagggacaaaagcaagttgatccagctcgggattactcatgtggtgaatgcggcagcaggtaagtttcaggtcgatacgggcgctaaattctatagaggcatgtccctggagtactacggcatcgaggccgacgacaaccctttcttcgacctcagcgtttactttctgccagtggcccggtacattagggccgccctttctgtcccacagggccgggttctcgtccactgtgcaatgggagtgtccaggtctgcaacattggtgcttgcctttttgatgatttgcgaaaatatgacgctcgtcgaggccatccaaacagtgcaagcccaccgcaatatctgtcctaattccggattcttgcgccagcttcaggtcctggacaatcgcctgggacgagagaccggtcgcttctag

SEQ ID NO: 185925 - DNA, 597 bp, Artificial Sequence
  Description of Artificial Sequence: Synthetic coding sequence
atggacagcctgcagaagcaggacctgcggcggcccaagatccacggcgctgttcaggcatccccataccagccacccactttagcttctctacagaggctgttatgggtcaggcaagctgctacgttaaaccatatcgacgaggtgtggcccagcctgtttctgggtgatgcctacgcggcgcgggacaaaagcaaactcatccagctggggatcacccacgtcgtgaacgcggccgccggcaaattccaggtcgacactggagccaagttctatcgggggatgtctctcgagtactacggtatagaagcagatgacaatccatttttcgacttatcagtttattttttgcctgtcgcgagatacattcgcgccgctctaagcgtccctcagggacgggtgctggtgcattgcgccatgggcgtctcccgttccgcaaccctggtgctggcattcctgatgatatgtgagaacatgaccctagttgaagcgattcagacggttcaggcacacaggaatatctgcccaaactccgggtttttaaggcagttgcaggtgctggataacagactgggcagggaaactggacgcttttag

SEQ ID NO: 185926 - DNA, 984 bp, Artificial Sequence
  Description of Artificial Sequence: Synthetic coding sequence
atgggcctgccccagccccggctgcccgcccccgccctgcaggccggcccagcaactgcagggtgtcggcccgaattgcgtggccagtcttggtctcttcttccagctatggggctttgtcacttcgccactcttgccctgatcctgctggtcttattggaggctctggcccaggccgatacgcagaaaatggtggaagcccagcgaggtgttggccctcgggcctgctattccatctggctcctgctcgccccaaccccgccactgagtcattgcctgcaatctcctcaaaagcagcaccaggtgtgtggcgacaggagattgaaagcctcgtcgacaaattgccctagtgaaaagtgtaccgcatgggcaagatatagccacagaatggattccctgcaaaaacaggatttgagaaggcctaagatccacggtgccgtgcaagcctctccttaccagccccccacccttgcgtccctgcagaggctgctgtgggtcaggcaggctgccacactcaaccacatagacgaggtgtggcccagtttgtttctcggggatgcctacgcagccagagataaaagtaagctgatccagttgggtattactcacgttgtaaacgccgcagcgggtaagtttcaagtggatacaggcgcaaaattctaccgcggcatgtcactggagtattatggtatcgaagcagatgacaacccattttttgatctgtctgtatactttctccccgtagcccgctatattcgggccgccttgtccgtgccacagggtcgggttctggtgcactgcgccatgggcgtttcccgcagtgcgacactagtgctggccttcctgatgatttgcgaaaacatgaccttagttgaagccattcaaacagtccaagcacaccggaacatttgtccaaactctgggttcctgcggcagcttcaagtgcttgataacaggctgggccgcgaaacaggacgcttctag

SEQ ID NO: 185927 - DNA, 597 bp, Artificial Sequence
  Description of Artificial Sequence: Synthetic coding sequence
atgagcagccggggccacagcaccctgccccggaccctgatggcccccagaatgattagcgaaggagatattggtggcattgcgcagatcacgtccagcctgttccttgggaggggatctgtagcatccaatcgacacctccttcaggcccgaggcatcacgtgcattgttaacgctacaattgagatccccaattttaactggccacagtttgagtacgtgaaggtgccattggccgatatgcctcatgctcccattggactgtacttcgatacagttgctgataagatccactctgtcagtcgcaagcatggagccaccttagtacattgtgcggccggagtcagccggtccgccacactctgtatagcatatctaatgaaattccataatgtttgcctgctggaagcttacaactgggttaaagctcgccgccctgtgattaggcctaacgtcgggttttggcggcagctgatcgattacgaacgccaattgttcggcaaatctactgtcaaaatggttcagaccccgtacggcattgtcccggacgtgtacgagaaggaatcaagacacctgatgccatattggggaatttag

SEQ ID NO: 185928 - DNA, 597 bp, Artificial Sequence
  Description of Artificial Sequence: Synthetic coding sequence
atgagcagccggggccacagcaccctgccccggaccctgatggccccacgaatgataagcgaaggcgatataggaggaatagctcagattactagctctctgtttctgggtcgggggtccgtcgcatctaatagacacctgctgcaagctcgcggaataacctgtattgttaacgccaccatagaaatcccgaacttcaattggccgcaatttgagtacgttaaggtgcccctggcggacatgccccacgctcctatcgggctttacttcgacacagtcgccgataagatccacagcgtcagccgcaagcatggggctactcttgtgcactgcgctgccggagtctcccggtctgctactttatgcattgcttacttaatgaaatttcataatgtatgtttactggaggcctacaactgggtgaaggctcgtcgcccagtcattaggcctaatgttggcttctggcggcagttaattgactatgagaggcaattatttggtaagtccacagtcaagatggtgcagacaccatacggtattgtgccagatgtctatgaaaaggagagcagacacctcatgccctattggggaatctag

SEQ ID NO: 185929 - DNA, 945 bp, Artificial Sequence
  Description of Artificial Sequence: Synthetic coding sequence
atgggcctggaggccgcccgggagctggagtgcgccgccctgggcaccctactgagggaccccagagaggccgaacgcacgctattgctggattgccgtcctttcctagcgttctgccggcgccacgttagggcggcccgtccagttccttggaacgccctgctgcggcgacgcgctcgaggtccccctgcagctgtgttagcctgtctactgcctgacagggcgctgcgcactaggctagtcaggggcgagttggcgagggctgtcgtcctggacgaaggttccgccagtgtggctgaattgcgaccagattcccctgcccatgtacttctcgctgctttgctgcacgaaacacgcgccggccctacggcagtatatttcctccgaggaggctttgacgggttccagggctgctgccccgatctatgctcagaggctcccgcacctgctttaccccccacaggtgacaaaactagtcgatcagattcccgcgcccctgtatacgaccagggcggccctgtggaaattttgccttacctgttcttgggtagttgttcccacagttccgatttacaaggactccaagcgtgtggcatcaccgcagtgctgaacgtgtccgcctcttgccccaaccacttcgagggactgttccgctacaagtcaatccccgtcgaggataaccagatggtcgagatttccgcctggtttcaggaagccatagggttcatcgactgggtgaagaacagcggggggcgtgtactggttcactgccaggcaggaattagtagatccgccaccatctgcctggcctatcttatgcagtcaagacgagtgaggctggacgaggcatttgactttgtaaaacagagacgtggcgttatttccccgaactttagctttatgggtcagcttctacagtttgagacgcaggtactgtgccactag

SEQ ID NO: 185930 - DNA, 288 bp, Artificial Sequence
  Description of Artificial Sequence: Synthetic coding sequence
atggccgccgcccggctgtgcctgagcctgctgctgctgagcacctgcgtcgctttattactgcagcctcttctgggagcacaaggcgctcccctggaaccggtgtaccctggcgataacgccacacctgagcagatggcccagtacgcggctgacctgcggagatatataaacatgctcacaaggcccagatacgggaagaggcacaaggaagataccctcgctttcagcgagtggggttctccccatgctgctgtacccagggaactgagcccgttggatctgtag

SEQ ID NO: 185931 - DNA, 435 bp, Artificial Sequence
  Description of Artificial Sequence: Synthetic coding sequence
atgagcgtggcccaggacatccccaagctgcagaagctgggcatcactcacgtgctgaacgcagcagaggggcgcagctttatgcatgtgaatactaatgctaacttttacaaagattccggaatcacgtatcttggcatcaaagccaatgacactcaggagttcaacttgagcgcgtacttcgagcgtgccgccgacttcatcgaccaggcactggcccaaaagaatggacgagtactggtccactgcagagaggggtattcccggtcgcctacgctggtgattgcctatctgatgatgaggcagaaaatggacgtgaagagcgctctgagcatcgtgaggcagaacagagaaatcggccccaatgatggattcctggctcaactgtgtcagctgaacgaccggctggctaaggaggggaagctgaaaccttag

SEQ ID NO: 185932 - DNA, 1185 bp, Artificial Sequence
  Description of Artificial Sequence: Synthetic coding sequence
atggtgaccatggaggagctgcgggagatggactgcagcgtgctgaaacggcttatgaatagagacgaaaacggagggggcgccggcggttccgggtcacacggtacgctgggccttccatccggtgggaagtgtcttctccttgactgccgacccttcctggcccatagcgccggctatattctggggtcagtgaatgttcgttgcaacaccatcgtgagacgccgggctaaaggaagcgtgagcttggaacaaatccttcctgccgaagaggaagtaagggctagactcaggtcagggctgtattcagcagttatagtatacgatgaaagaagcccaagagccgaatcactaagagaggactctacagtttcattagtagtccaggccctgcgccggaacgctgagagaactgatatttgcttactcaagggagggtatgagcgcttctcaagcgaatatcccgagttttgttccaaaaccaaagcacttgctgcgattcctccgcctgttcctcctagcgccaccgaacctctggatcttgggtgctcttcgtgtgggacccctctacacgaccagggaggacctgtggagatattgccttttctctacctgggcagcgcgtaccacgctgctcgcagggacatgctggatgccctgggcattaccgctctcttaaatgtcagttccgactgccctaatcatttcgaggggcattatcagtataagtgcattccagtggaggacaatcacaaagctgacatctcctcctggtttatggaagccattgagtatatcgacgcagtgaaggactgtcggggcagagttctcgtccactgccaagccgggatctcacgatccgccacaatctgtctggcatacttaatgatgaaaaagagagtccggctcgaggaggctttcgaatttgtaaagcagcggcggagtatcataagccccaacttcagctttatgggccaactcttacagtttgaatcgcaggtcttggcaactagctgtgccgcagaggctgctagccctagtggaccacttcgggaacggggaaagacaccggccacacccacaagccagttcgtatttagctttcctgtctctgtgggggtacatagtgctccatcctcacttccctacttgcacagcccgatcaccaccagcccaagttgttag

SEQ ID NO: 185933 - DNA, 912 bp, Artificial Sequence
  Description of Artificial Sequence: Synthetic coding sequence
atgggccggaaggtgcacagcaacggcagccagttcgccgagcacagcaggagtcctaggcgtacaggccgcgattgcaaacccgtgagggcccccagcatggctttaggcgtaagccagcttgctggaagatccaggtgcttgtgctcggagagtcaaggaggctacgagagattctcctcggagtatccggagttttgttcaaagaccaaagctctcgctgctatcccgccccccgtgcctccatctgctactgagcctttagacttgggttgttcttcatgtgggacgccattacatgaccagggcggtcctgtcgagattctgccattcctctacctgggcagcgcctatcacgctgcccgacgggacatgctggacgccttgggcataaccgcccttctgaacgtctcatcagactgccccaatcactttgagggtcattaccagtacaaatgcatccccgttgaggataatcataaagctgatatttcatcctggttcatggaggcaatcgagtacatagatgccgtgaaggattgccggggcagggttctggtgcactgtcaagctgggatttcgcgctctgcaactatctgcttagcatacctcatgatgaagaagagggtccgccttgaagaggcatttgagttcgtcaagcagagaagatccattatttcaccaaacttcagtttcatgggacagctcttgcagttcgaatcacaggtgctggcaaccagctgcgccgctgaagccgcttcgccttcgggccccctgagggaacgagggaagactccggctaccccgactagtcagtttgtcttttcgtttccagtgtccgttggagtgcacagtgctcctagttcccttccctacctgcacagtcccattactacgagtccgtcttgttag

SEQ ID NO: 185934 - DNA, 1155 bp, Artificial Sequence
  Description of Artificial Sequence: Synthetic coding sequence
atgaaggtgaccagcctggacggccggcagctgcggaagatgctgaggaaagaggctgccgcacgctgcgtggtcctggactgtcgaccctacctggccttcgcagcatcaaacgtacggggttcgctgaatgtcaacctaaactctgtggtgctcaggcgagcccggggaggcgccgtcagcgcacgatacgtattgccagacgaagccgcccgtgctaggctactgcaagagggaggcggtggtgttgctgccgtggtggtgctggaccaaggtagtaggcactggcagaaactacgggaggagagcgcagctagggtagtgttgacctcgttgctggcttgcctgcccgccggccctcgcgtgtattttttaaagggtggctacgagactttctactctgaataccccgagtgttgcgttgacgtgaagccaatcagtcaggaaaagatcgaatctgagcgggccctgattagtcagtgcggcaagccagttgtgaacgttagctaccggccagcatatgatcagggcggtccagtcgagatactcccgttcctctacctgggatctgcatatcatgccagcaagtgcgagttcttggccaaccttcacattaccgccttactcaacgtgagccggaggaccagcgaagcttgcgctactcatctgcattacaagtggatacctgttgaggattcccacactgcagatatttcatcccattttcaggaggcaatcgattttattgattgcgtcagggaaaagggcgggaaggtgcttgttcattgcgaggcagggatatctaggtccccaacaatctgcatggcatatctcatgaagactaagcagtttcgcttgaaggaggcctttgactacatcaagcaacgccgatccatggtgtccccaaattttgggtttatgggacaactgttgcagtacgagtcagaaattttaccatctactccgaacccccagccccctagctgccagggcgaagcagcaggttcctcccttattggccatttgcagaccctctctccggacatgcagggtgcttactgcacctttcctgcaagtgtcctcgctcctgtccctacccacagtaccgtatctgagctcagtagatctccagtggctactgccacctcttgctag

SEQ ID NO: 185935 - DNA, 1107 bp, Artificial Sequence
  Description of Artificial Sequence: Synthetic coding sequence
atgccctgcaagagcgccgagtggctgcaggaggagctggaggccaggggaggagcgtccctcttattgttggactgtcggccacacgaattgttcgagtcctcccacatcgaaactgccatcaaccttgcaatacccgggttgatgctgagacggctgcgaaaagggaatctacccattaggagcatcatcccaaaccatgctgacaaggaacgcttcgcgacacggtgcaaggctgcaacggttctgctctacgacgaggcaacagcagagtggcagccggaacctggagcacccgccagcgtgctcgggctgctgctgcagaagctccgcgatgatggctgtcaagcttactacttgcagggcggctttaataagttccagaccgagtacagcgagcactgcgagactaatgttgactcttcaagttccccctcaagctcgccgcccactagtgtcctggggctcggcggtttaaggatctcctccgattgctccgatggtgagtctgaccgggagctgccctcttccgcgacggaatctgacggcagcccagtccctagcagtcaacctgccttccccgttcaaatactcccctatttatacctcgggtgtgccaaggattccaccaacctcgatgttcttgggaagtacgggatcaaatatattcttaatgtgaccccaaacctgcctaatgcttttgaacatggcggggaatttacatataaacagattcctatcagcgaccattggtcacaaaaccttagccagttttttcccgaagcaatctctttcatcgatgaggctcgctccaagaaatgcggtgtcctggtgcactgcctggcagggatctcaaggtcagtgacagtgacggtggcatacctgatgcagaagatgaatttgagcttaaacgacgcctacgatttcgtaaagcgcaaaaaaagtaacatctctcctaacttcaattttatgggtcaactcttggacttcgagaggacacttggcttgagctctccttgcgacaatcacgcctcttccgagcagttgtatttcagcaccccaactaatcataatctttttccactgaatacactggaatctacctag

SEQ ID NO: 185936 - DNA, 1260 bp, Artificial Sequence
  Description of Artificial Sequence: Synthetic coding sequence
atgaagaaccagctgcggggcccccccgcccgggcccacatgagcacgtctggggctgccgccgcgggaggaacccgcgccgggtcggagcctggagctggatctggcagcggggccggaacaggtgccggcgcggctacgggggctggcgccatgccctgtaagtccgccgagtggctgcaagaggagcttgaggcaagaggcggtgcctcactcctcttgcttgactgtagacctcacgagctattcgagagcagccacattgaaaccgctataaacctagcgatccctggtcttatgctgcgccgcctccggaaaggcaaccttccgattagaagtattatcccaaaccacgccgataaagagcgattcgctactcgctgtaaggctgccacagtgctcctctacgacgaagcgacagccgagtggcagccggagccaggcgcccctgccagcgtgctgggactgctgctgcagaagctaagggacgacgggtgtcaagcctactatctgcaaggaggattcaacaagttccagactgagtattcagagcattgcgaaaccaatgtcgatagcagctcctctccatcgagcagcccgcccacgagcgtgttggggctgggcggcttgcggatttcttccgattgctctgatggcgagagcgaccgggaacttccatcctccgctactgaatcagacggttcccctgttccttcaagccagcctgcctttccagtgcagatcctgccctatctgtacctaggatgcgccaaagattcgactaatctggatgtgctggggaagtatgggattaagtacatcctgaacgtgaccccgaatttgcccaacgcttttgagcacgggggcgagtttacctacaagcagattcccattagcgatcactggagtcaaaacttgagccagttttttccggaagcgatctctttcattgatgaggcgagaagtaagaagtgtggagtcctcgtgcactgtcttgctggtattagccggtccgtgacagtcactgtggcgtatctgatgcaaaagatgaacctgagcctgaacgacgcatacgactttgtcaaacgaaaaaagtcaaatatttctccaaacttcaatttcatgggccaactgcttgacttcgaacgcacattgggcctgtccagtccctgcgacaatcacgccagctctgaacagttgtatttctccacccctacgaatcacaatctctttcctctgaacactcttgagtccacgtag

SEQ ID NO: 185937 - DNA, 1878 bp, Artificial Sequence
  Description of Artificial Sequence: Synthetic coding sequence
atggccggcgaccggctgccccggaaggtgatggacgccaagaagcttgcctcactgctccgcggtggcccaggcggaccgttggttatcgactctaggtctttcgttgagtataattcatggcacgttctctcaagcgtgaacatttgttgttcaaagctggtcaagaggcgtctccaacagggcaaagtaaccattgccgaattaatccagccagccgccagatcacaggtggaagccaccgagccccaggacgttgtcgtctacgatcagagcactcgggatgcctccgtgctggcagctgacagcttcctctccatcttgctatctaagctggatgggtgttttgattcagtcgccatactaacagggggctttgcaaccttcagctcatgcttccctgggctctgtgaaggtaaacccgctgccctgctccctatgagtctcagtcagccctgcctaccagtgccgtctgtggggctcacccgcattctcccgcacctctaccttggcagtcagaaggacgtcctgaataaggatctgatgacccaaaacggcatctcctacgtgctcaatgcctctaactcctgtccaaagcccgacttcatctgcgagagcaggtttatgcgagtgcctattaatgacaattattgcgaaaaactacttccatggctcgacaagagtattgagtttattgataaagcaaagttaagctcctgtcaggtgatcgtgcactgcctggccggcatttctcgcagcgccaccattgccattgcctatattatgaagaccatgggcatgagcagcgatgatgcatatcgtttcgtcaaagataggcggccatcaatctccccgaacttcaacttcctcggtcagttgctggagtacgagagaagtttgaagctgctagctgccctgcagggggatcctggcactcctagcggcacccccgaacctccgccttcacctgctgccggggctccactgccaaggctccctccacctacctctgagtccgctgctaccgggaacgcagccgctcgtgaggggggactcagcgccggcggggaacctccggcaccaccaacacctccggccacttccgccctccagcagggattgcgcggtctgcacctgagcagcgatagactgcaagatactaacagactcaaaagatcctttagcctcgatattaaatccgcttatgcccctagcaggcgcccagatgggcctggtccccccgatccaggcgaggcaccgaaattgtgcaagcttgattctccaagcggcgccgcccttggtctctccagcccatctcctgattctccagatgctgccccagaggcccgcccccgcccgagaagaagacctagaccgcctgccggcagccctgcgagatcaccagcacattccctaggcctcaacttcggagacgccgcccggcagaccccaaggcatggactcagcgccttatccgccccagggctccctggacccggccagcctgctgggccaggcgcatgggctcctccactagattcgcccggaactcccagccccgatggcccgtggtgcttctcccctgaaggagcccagggagccggcggggtccttttcgcaccgtttggacgggcaggggctcccggaccggggggaggctcagatctgaggcgccgagaggctgctagggctgagcctcgggatgctaggacaggctggccggaggagcctgcccctgagacacaatttaaacggagaagctgtcagatggaattcgaggagggaatggtcgaaggacgcgccagaggggaagaactcgccgccttaggaaagcaggcgtcctttagtggctcggttgaggttatcgaggttagttag

SEQ ID NO: 185938 - DNA, 1878 bp, Artificial Sequence
  Description of Artificial Sequence: Synthetic coding sequence
atggccggcgaccggctgccccggaaggtgatggacgccaagaagttggcatccttgttgcgtgggggccccggcggaccccttgtgatcgatagccgctcatttgttgaatacaatagttggcatgtactgagttctgtgaacatttgctgttccaaactggtgaagcgcaggctacagcagggaaaggtcactattgcagagttgatacagccagcagcccgatcacaggtggaggcaactgaaccccaggacgtcgtagtgtatgaccagagtactcgggacgctagtgtgcttgcagctgactcgttcttgtcaatcctgctctccaaactggatggttgcttcgattctgttgctattctgaccgggggctttgctacctttagcagctgctttccgggcctgtgcgaaggcaaacctgccgccttgctgcccatgagcctctctcagccctgcttaccggtcccctccgtggggcttacacggattctgccccatttatacctcggctcccagaaggatgtgctcaataaagatttaatgactcagaacggcattagttatgtgctgaacgcctcgaatagttgccccaaacctgatttcatctgcgagtctcgatttatgagggtgcccataaacgacaactactgtgaaaaactgctgccatggctggacaagagtatcgaatttatcgacaaggcaaagttgtcatcctgccaggtaattgtgcactgtctggccggaatctctcgctctgccacaatcgccatcgcttacatcatgaaaacaatgggcatgagttcagacgacgcttacaggttcgtcaaggaccggcgaccgtccataagccctaacttcaattttctgggccagttattagaatacgaacgttccctcaaactgctggcagcactacaaggagatccaggcacgccctctgggacaccggagcctccaccctccccagcagcgggggctcctctgccgcggctaccgcctccgacatctgaatccgctgccacaggcaacgctgcagcgcgcgaagggggcctgtccgcaggtggggaacctcctgcgccacctacccccccagcaacctcagccctgcaacagggcctgagaggtttacatcttagtagtgaccgtctgcaggacaccaataggctgaaaaggagcttctctctcgatatcaaatctgcctacgccccctctaggcggcccgacggaccaggcccacctgaccccggtgaggcccccaagctgtgcaagttagactctcctagtggcgccgccctgggcctttcaagtccgtcgcctgactcgcccgacgccgcacccgaagcacggccacgccccagacgacgcccacgccccccagccggatcacctgctagaagccccgctcacagtctagggttgaacttcggtgatgcagcaagacaaacacccagacacggcctcagtgctctgagtgctccaggcctgcctggcccaggtcagccagcaggccccggggcctgggctcctcctcttgacagcccaggaacaccctctcccgacggtccctggtgcttttctccggagggcgcccagggggccgggggtgtgctgtttgccccctttggtagagctggagcacccggacctggcggggggtctgacctgcggcgtagggaggctgcccgagctgagccgcgagacgccaggaccggctggcccgaagaacctgctcccgaaacacagttcaagaggcggtcatgccagatggagttcgaagagggcatggtggagggacgggccagaggcgaggaattagccgcattgggtaagcaggcttctttcagcgggtctgtggaggtcatcgaagtatcttag

SEQ ID NO: 185939 - DNA, 1626 bp, Artificial Sequence
  Description of Artificial Sequence: Synthetic coding sequence
atgcacaccggcggcgagaccagcgcctgcaagcccagcagcgtgcggcttgcacctagctttagttttcatgccgctggtctgcagatggctggacagatgcctcacagccatcaatatagcgatcggagacagccgaatattagtgaccagcaggtgagcgccctgtcttattccgaccagattcagcaacctctgactaatcaggtgatgcctgatatcgttatgctgcagcgtcggatgccacagacattccgggatccagccaccgcgcccctgcggaaactgagcgtcgatctcatcaagacctataagcacatcaacgaggtctattacgccaagaaaaaaaggcggcaccagcagggccaaggtgacgattcgagtcataagaaggagaggaaagtctacaacgacggttacgacgacgataactacgattacatcgttaaaaacggggagaagtggatggatcgctacgaaattgatagccttattggcaagggatcttttggccaggtggtgaaggcttacgatcgcgtggagcaagagtgggttgccattaagattattaaaaacaagaaagctttcctgaatcaggctcagattgaagtccgcctactcgagttaatgaataaacacgacacagaaatgaagtattacattgttcacttgaaacggcattttatgtttagaaaccacctgtgtcttgtgtttgaaatgctgtcgtataacctctatgacctgttgcgcaacactaatttcaggggtgtgagcctgaatctgacgcgcaaattcgcacagcaaatgtgtactgcgctcctgttcctggcgacccccgaactgagtatcatacactgcgatttaaagcctgagaacatcctgttgtgtaatcctaaacgtagtgctatcaaaatcgtagattttggcagcagctgtcaactcggacagagaatttaccagtacatccaaagcaggttttaccggagccccgaggtcctccttgggatgccttacgacctggcgatcgacatgtggtctctgggatgcatcctggtggagatgcacacaggcgaacctctcttctccggggcgaatgaggtggaccagatgaataaaatcgtcgaggtgcttggcataccacccgcacatattctagaccaggcccctaaggcaaggaagttcttcgaaaagctgcctgacggaacctggaacctaaaaaaaacaaaagatggcaaacgtgagtataaaccaccagggacccgaaagttgcacaatatacttggggtggaaactggaggccctggaggaagaagggctggagaatccggacacactgtggccgactacctgaagttcaaagacttgattctgcgcatgctggactatgacccaaaaactcggattcagccttactatgccctgcagcactcattttttaagaagaccgctgacgagggaacaaatacatcgaattcagtgtctacttccccagctatggaacaaagtcagagctccggcaccacaagcagcactagcagctcctcagttgtagagcagcactggatgccaggagcgtttcgaatgaccgtgtcctttaccctggaggttcatgatgtgcctgtctag

SEQ ID NO: 185940 - DNA, 1755 bp, Artificial Sequence
  Description of Artificial Sequence: Synthetic coding sequence
atgcacaccggcggcgagaccagcgcctgcaagcccagcagcgtgcgcttggcaccctctttcagcttccatgccgccgggttacagatggccgggcagatgcctcactcacaccagtactccgataggagacagccaaacataagcgaccaacaggtgtccgccctaagttattctgatcagattcagcagcctcttacaaaccaggttatgccagatatcgtgatgctccagcgcagaatgccgcagacatttcgggaccctgctactgcaccactccggaaactgtccgttgacctcattaaaacatacaagcacattaacgaggtgtactatgcgaaaaaaaagagaagacatcagcaggggcagggcgacgattccagccacaagaaagagcggaaagtatacaatgacggatacgatgatgataattacgattacatcgtcaagaatggagagaagtggatggacagatatgagattgacagcttgataggcaagggctcattcggccaggtggtaaaggcttatgaccgggtcgaacaggagtgggttgccattaaaattattaagaataagaaagccttccttaaccaagcccaaatcgaggtgaggttgcttgaactgatgaacaaacacgataccgagatgaagtattatatcgtgcatttaaagaggcacttcatgtttcggaatcatttgtgtctcgtgttcgagatgttgtcttataacttatacgatcttctaagaaacaccaattttagaggcgtgtccctcaacttaacacgcaagttcgctcaacagatgtgcaccgcacttcttttcctcgcaacgcctgagctctcaatcatacattgtgacttgaaacctgaaaacattctgctttgcaatccaaagaggagtgcaatcaaaatcgtagatttcgggagctcgtgccagctaggccagagaatctatcagtacattcaaagccggttctatagatcaccggaggttctgctggggatgccctacgatctggcaatcgatatgtggagcctggggtgcattcttgtggaaatgcacactggtgagcctctgttctccggggccaacgaggtcgatcagatgaacaaaatagtagaggttctcggcattcccccggcacacatcctcgatcaggctccaaaggcccgcaagttctttgagaagctcccagatggcacatggaacttaaaaaagaccaaggacggcaagcgggagtataaaccacctggcacgcgcaagttacacaacatcttgggtgtcgagaccggaggacctggcggcaggagagctggagagtccggacacactgttgccgactaccttaaatttaaggaccttatcttgcgtatgcttgactacgatccaaaaacccgaatccagccttattacgcactccagcacagcttttttaagaagaccgccgacgagggcactaatacatcaaattcggtttcgacatctcctgccatggagcagtcccagagctctggtaccacttccagcacctcatctagtagcggcggctcctcagggacgtcaaattctggtcgggcgcgcagtgaccccacccaccagcaccgacactctggcgggcactttactgccgccgttcaggccatggattgcgagacacactctccacaggtttcttcccacgtagtgcacctgcttgtgagtcccgctatcctgagatggtcttccacaggatgccaggtgcccctggagtag

SEQ ID NO: 185941 - DNA, 2265 bp, Artificial Sequence
  Description of Artificial Sequence: Synthetic coding sequence
atgcacaccggcggcgagaccagcgcctgcaagcccagcagcgtgcgactcgccccttctttcagctttcatgcagctgggcttcaaatggccggacaaatgccacacagccaccagtattctgataggagacagcctaacatctccgaccagcaggtatccgctttgtcctactcagaccagattcaacagcctttaactaaccaacgtagaatgccacagacttttcgcgaccctgcgaccgccccgctgaggaagctgagtgtggatctgatcaaaacatacaagcatatcaatgaggtttattacgcaaaaaaaaagaggcggcatcagcaaggtcagggggacgatagctcccacaagaaggaacgcaaggtatataacgacggttatgacgacgacaactatgattatattgttaagaatggggaaaagtggatggatcggtatgagatagacagcctgatcgggaaagggtcttttggccaggtggttaaagcttatgatagggtggagcaggagtgggtggccattaaaataatcaaaaacaagaaagctttcttaaatcaggcacaaatcgaagtcaggttactggagctcatgaataagcatgacacggagatgaagtactacatagttcacctgaagcgccactttatgttcaggaaccacctgtgcttggtgtttgagatgttaagctacaatctctatgacttactgaggaacaccaatttccggggggtcagtctgaacctaaccaggaaatttgcacagcaaatgtgcacagcattgctgtttctagcaacccctgaattatctattatccactgtgacttgaaaccagaaaatatcctgttgtgcaacccaaagcgctcggctattaagattgttgacttcggcagttcttgccagctcggtcagcgaatttaccagtacattcagtccagattttaccgcagtcccgaagttttgctcggcatgccttacgacttggctattgacatgtggtcgttggggtgcatccttgtggagatgcacaccggagagcccctgttctcaggcgccaacgaggtcgaccagatgaataagattgtggaggtgcttgggatcccgcccgcgcacatcctggaccaagcaccaaaggcacgcaagtttttcgagaaactgccggatggcacgtggaatttgaaaaagacaaaagacggcaagcgggagtataaaccacctggaacccgcaaactacacaacatcctcggcgtagaaacaggtgggcctggcggccgtcgtgctggtgaatcaggacataccgtggccgattatttgaagttcaaagacctgatcctgagaatgctcgattacgacccaaaaactaggatccagccctattacgcattgcagcactctttctttaaaaaaaccgccgatgaagggacgaatactagtaattcagttagcacaagcccagctatggagcagtcacaatcgtcaggcacgacttcctccacgtcatcttcctccggcggtagctctgggacatcaaatagtgggcgcgccagatccgaccctacgcaccagcaccgacacagcggcggacacttcacagccgcagtgcaggccatggactgcgagacccacagcccacaagtacgtcaacagtttccagctcctcttgggtggagtggaaccgaggcacctacccaggtcaccgtggaaacccatccagtccaggaaactacttttcatgtagctccccaacagaatgccttacatcaccaccatggcaacagcagccaccatcatcaccaccatcaccaccaccaccatcatcacgggcagcaggcacttggaaatagaacaagaccaagggtgtacaattccccaaccaactctagctcgacccaggactccatggaggttggccatagccaccacagcatgacatctttgtctagttctaccacctcaagctctactagtagctcaagcaccggcaatcaaggaaatcaagcttaccagaatcgacctgtcgccgcgaatacattagattttggccaaaacggggccatggacgtgaacctaactgtatactccaatccaagacaagagacaggcatagctggtcatccaacctatcagttctcagctaacactggacctgcccattacatgacagaaggacacctcactatgaggcagggtgctgatagagaagagtcaccgatgaccggagtttgtgtgcaacagtccccagtcgcttctagctag

SEQ ID NO: 185942 - DNA, 1590 bp, Artificial Sequence
  Description of Artificial Sequence: Synthetic coding sequence
atgcacaccggcggcgagaccagcgcctgcaagcccagcagcgtgagattagctcctagcttctcttttcacgccgctggtcttcaaatggcaggccagatgcctcactcgcaccagtactccgacagacggcagccaaacatctcagaccagcaggtgtccgccctgagctactccgaccaaatacagcagccgctgactaatcaggtgatgcctgatatcgtgatgctccagagacggatgccccaaacattccgcgatcccgctaccgctcctctgcgtaaattatccgtggacctgatcaaaacctacaagcatatcaacgaagtgtactatgcgaagaagaagaggagacatcagcaggggcagggtgacgattcttcgcacaaaaaagagcgtaaggtgtataacgatggttacgacgatgacaattatgattatatagtgaaaaacggagagaagtggatggatcgctatgagattgatagtttgatagggaagggcagttttggacaggtagtgaaagcttatgaccgggtagagcaggaatgggtagcaattaaaattattaagaataaaaaggcttttctcaatcaggctcaaatcgaagtgcggttgctggagctcatgaataaacatgatactgaaatgaaatattacatcgtgcacttgaaacgtcatttcatgtttcgcaaccatctgtgtttagtgttcgagatgctgtcttacaatctgtacgacctgctgcgcaatactaacttcaggggagtgagtctcaatctgacgaggaagttcgcccaacagatgtgcactgcactgctgtttcttgcgacacccgaactgagtatcatacactgtgacttgaaacccgaaaacatcctgctgtgcaatccaaaacgttcggctatcaagatcgtggattttgggagctcatgtcagctcggccagcggatctaccaatatatacagtcacggttttatcggtctcctgaggtattgctcggaatgccgtatgacctggcgatcgatatgtggtcactgggctgtatcctggtggaaatgcataccggggaacctctgttcagcggcgctaacgaggtagatcaaatgaataaaatagtggaggttctgggcattcctcctgcgcacattctagatcaggctccgaaggccagaaagttttttgagaagctgccagatgggacttggaatcttaaaaagaccaaggatggtaagagagaatataaacctccaggtacccgcaagcttcataacattctgggagttgagacagggggccctgggggcagacgtgctggtgaaagcggccacaccgtggcagattatttgaaattcaaagaccttatcctacggatgttagactatgatcccaaaacgaggatccagccttattacgctctccagcattcattcttcaaaaaaactgccgatgaaggaaccaacacctccaactccgtgtccacttcaccggccatggagcagtctcaaagtagtggcacaacatcaagtacctcttcaagctcaggagcaagcgctatttcctgcagcagctggctagtaagacactag

SEQ ID NO: 185943 - DNA, 2292 bp, Artificial Sequence
  Description of Artificial Sequence: Synthetic coding sequence
atgcacaccggcggcgagaccagcgcctgcaagcccagcagcgtgagactggcaccttcgttcagctttcacgctgccggccttcagatggcaggccagatgccccactcgcatcagtactctgacaggaggcagccaaatattagcgatcagcaggtgtctgcgttgtcttactccgatcagattcagcagcctctgaccaaccaggtgatgcctgacatcgtgatgctgcagaggcggatgccccagactttcagagatcctgccacagctcctctacgcaagctgagtgtggatctgatcaaaacctataagcatattaatgaggtctattatgccaagaaaaagcgtaggcatcaacagggccagggcgatgactccagtcataagaaggagcgcaaggtgtataacgacggctacgatgacgacaactacgattatatcgtcaagaatggggagaagtggatggaccgctacgagatcgattctttgattgggaaaggctcattcggacaggtcgtgaaagcttacgacagagtggagcaagagtgggtggcgatcaagattatcaaaaataaaaaggccttcctgaatcaggcacagattgaggtccgccttctcgaactaatgaacaaacatgacaccgaaatgaagtactacatcgttcacctcaagcgtcattttatgttcagaaaccacctctgtctcgtctttgaaatgctgagttataatctgtacgatctgctgagaaacacaaatttcaggggcgtgagtctaaacctgaccaggaaattcgcgcagcagatgtgtaccgccctcctgtttttggctacgccagagctgtctattattcactgtgacctcaagcccgagaatatcttgctctgcaacccaaagagatcagccataaaaatcgtagacttcggctcctcttgccagctgggacagcgaatctatcagtacatccagagcaggttttatagatcacccgaggtacttctcggcatgccttacgatctagctatcgacatgtggtctctgggttgcatattagtggaaatgcacacaggtgaacctctgtttagtggagcaaacgaagtggaccagatgaacaagattgtcgaggtactaggaatcccacccgcacacattctggaccaggcaccgaaggcgcgaaaattctttgagaagctacccgacggcacttggaacctcaagaagactaaggatggcaagcgggaatataaaccaccaggaacaagaaagcttcacaatatcctcggagtggaaactggcggtccaggcgggaggcgggccggcgaaagcggccataccgtcgctgactacttaaaattcaaagatctcattcttaggatgttggattacgaccccaagactagaatccaaccttactacgcattacagcactcatttttcaaaaagacagccgatgagggcacaaacaccagcaactccgtctcaacctcaccagcaatggaacagtctcagagctcagggactaccagctccacttcgagctctagcggcggatcgagtggcacttccaattccgggcgagccagatctgaccctacacatcagcatcggcactcaggagggcatttcaccgccgcagtccaggccatggattgtgaaacccatagtccccaagtccgccagcagtttcctgcccccttggggtggtctgggactgaggcgccaactcaggtcacagtagagacccaccctgtccaggaaaccacattccatgttgctcctcagcagaatgccttacaccaccaccacgggaactcgagccaccatcatcaccatcatcaccatcaccaccatcaccacggccagcaggcacttggcaacagaacaaggcctcgtgtgtacaatagcccaacgaattcttcttcaactcaggactcaatggaagtaggtcactcccatcactctatgaccagtctgtcatcaagtactacttcctcaagcacgtccagcagttcaacaggaaaccagggaaaccaggcctatcagaatcggcctgtggccgccaataccctagatttcggacagaacggcgcaatggacgtgaacttgacggtatattccaatccgcgtcaggaaaccggtattgcagggcaccccacctaccaattttcggccaacacaggccctgcacactatatgactgagggacaccttaccatgagacagggcgccgatcgggaggagtcccccatgaccggcgtctgtgtgcagcagtctcctgtcgcttcctcctag

SEQ ID NO: 185944 - DNA, 396 bp, Artificial Sequence
  Description of Artificial Sequence: Synthetic coding sequence
atgcacaccggcggcgagaccagcgcctgcaagcccagcagcgtgaggctggccccatccttctcttttcacgcagccggattgcagatggcgggacaaatgccccatagtcaccagtacagtgaccgtcgacagccaaacatttctgatcagcaggtctcagccctctcatactcggatcagatacaacaacctttaaccaaccaggtgatgcctgacattgtgatgttacagcgccgtatgcctcagactttcagggatcccgccaccgccccactgcgaaaattgagcgtggatttaattaagacttacaaacatataaatgaggtgtactacgccaaaaagaaaagaaggcatcaacagggacagggagacgattcatcccataaaaagtag

SEQ ID NO: 185945 - DNA, 1755 bp, Artificial Sequence
  Description of Artificial Sequence: Synthetic coding sequence
atgcacaccggcggcgagaccagcgcctgcaagcccagcagcgtgagactcgctccttctttctcattccatgctgccggcttgcaaatggcaggacagatgccccatagtcatcagtactcagaccgccgccaaccgaacattagtgaccaacaggtctccgcactgagttattctgatcaaattcagcagccactcacgaaccaggtaatgcccgatattgtcatgctgcagaggcgaatgccacagacatttcgagaccccgctactgcacccctgcgtaagttaagcgttgatctgataaaaacttataagcacatcaatgaggtctattacgccaaaaaaaagaggcgtcaccaacagggtcagggggacgattcaagccataaaaaagagcgaaaagtctataatgacgggtatgatgatgataactacgactatatcgtaaagaacggggagaaatggatggaccgctacgagatagatagtttgatcggcaagggatctttcggacaggtggtaaaggcatatgaccgggtcgagcaggaatgggtcgccatcaagatcataaaaaacaagaaagcatttctcaaccaagcacagattgaggtgagacttttagagctgatgaacaagcacgacaccgagatgaaatattatatagtacacttaaagcgccactttatgttcagaaatcacttatgtttggtgtttgagatgctatcctacaacctttacgatctgctgcgaaatacaaattttcgcggggtgtcgctgaatctgaccaggaaattcgcccagcagatgtgcacagccctgctttttttggctacgcccgaactgtcaattattcactgcgacttgaaacctgaaaatatcctgctgtgtaatcctaaacgcagcgcaataaagatcgtggatttcggctcatcatgtcagctgggccagcgtatttaccagtacatccagagtaggttctatcggtctcctgaggtcctgctgggtatgccatacgacctggcaattgacatgtggagccttggttgtatcctagtagagatgcatactggggagccgttattcagcggggccaacgaagtggaccagatgaacaagattgtggaagtcctgggtataccacctgctcatatattggaccaggctcccaaggcccgtaaattctttgaaaagctacccgacgggacctggaatttgaaaaagacaaaagatggcaaacgcgagtacaagcccccaggtacccgcaaattgcataacattctcggcgtggagaccggaggacccggtgggaggcgagcgggcgagtcaggccatactgtcgcagactatcttaagtttaaagatctaatcctgcgaatgctggattacgatccaaagacccggatccagccctattacgccctgcaacactcgtttttcaaaaaaacggccgatgaggggaccaacacttctaattccgtctctacctcaccagctatggaacagtcacagtccagcggcaccaccagcagcacgtcaagctctagcggaggaagttctggcacctccaactccggacgggcccgcagcgatcccacgcaccagcacaggcacagtgggggacacttcaccgccgcggtgcaagcaatggactgcgaaacccactcgccccaggtgagcagtcatgtggtccacttgttagttagtccagctatactgcggtggtcaagcacgggctgtcaggtgcctctggaatag

SEQ ID NO: 185946 - DNA, 141 bp, Artificial Sequence
  Description of Artificial Sequence: Synthetic coding sequence
atgcacaccggcggcgagaccagcgcctgcaagcccagcagcgtgcgcttagccccaagtttttccttccacgccgccggcctgcagatggccggtcagatgccgcattctcatcagtatagcgatcgcagacagccttag

SEQ ID NO: 185947 - DNA, 1608 bp, Artificial Sequence
  Description of Artificial Sequence: Synthetic coding sequence
atgttccggaaccacctgtgcctggtgttcgagatgctgagctacaacctgtacgatttgctccgcaatacgaacttccgcggagtcagcttgaatctgacccgaaagtttgcccagcagatgtgcaccgccctgttgttcctggctacacccgagctgagtattattcactgcgacttaaaacccgagaacatcctcctgtgtaaccccaagcgatcagcaatcaagatcgtagactttggctcctcttgtcagctgggtcaacgcatataccagtacatccaaagcaggttttacaggtcccctgaagtgttgttaggaatgccatacgacctagcaatcgacatgtggagcctgggctgcatacttgtggaaatgcatactggcgaacctctgttctccggggcaaatgaagtggatcagatgaataagattgtggaagtgctgggaatacctcccgctcatatcctcgatcaggcccccaaagcacggaagttctttgagaaacttcctgacggcacatggaacctgaaaaagactaaagatggcaaacgggagtacaagcccccaggcacgcgcaagttgcacaacattttaggcgtcgagacaggtggcccggggggccggcgagcgggggagagcggccacacggtggccgactacttgaaatttaaagatcttatcttgcggatgttagactatgatcctaaaactaggatccagccctattacgccctgcagcactcattctttaaaaagacagcagatgaaggtaccaacacaagcaactctgtgtccacctcaccagccatggagcagagccagagcagcggcaccacttcatcaaccagctcttcttccggcggcagcagcggtaccagtaattctggccgagccaggtctgaccccacacatcagcatagacactctggaggacactttacagctgccgtgcaggcaatggactgtgaaacccacagtccacaagtgcggcagcagttccccgctccactgggatggtccggcaccgaggctccaactcaggtaacagttgagacacaccccgtacaggaaaccacctttcatgtagcaccacagcagaacgcccttcatcaccaccatggaaatagttctcaccaccatcaccatcaccatcatcaccatcaccaccatggccagcaggccttgggtaaccgtaccagacctagagtttacaacagccccaccaacagcagctcgacacaggattctatggaggtaggtcattcgcatcatagtatgactagcctgtcgagttccacaacttcctcgagtacttcttcatcgtccactggcaaccaggggaatcaggcttaccagaaccggcccgtggcggccaacacattagattttggacaaaatggggccatggacgtgaacctgacggtctattccaatccgcgacaggagaccggcatcgctggacatcctacctatcaattctccgcgaatacaggtcctgcccactacatgacggagggacacctgacgatgcgacaaggtgctgatcgtgaagaaagcccaatgaccggcgtgtgtgtgcagcagtcgcccgttgcctcaagctag

SEQ ID NO: 185948 - DNA, 1890 bp, Artificial Sequence
  Description of Artificial Sequence: Synthetic coding sequence
atggccgtgccccccggccacggccccttcagcggcttccccggcccccaagagcacacccaggtgctccccgacgtccgcttgctcccacggcgcctgcctctcgctttccgggatgctacctccgcacccttgcgcaagttgagtgtggatctgatcaaaacgtacaaacacattaatgaggtatattacgctaaaaagaagcggcgggcccagcaggcccctcctcaagacagctccaacaagaaggagaaaaaagtgctgaaccatggttacgacgatgacaaccacgactacattgtgagaagtggagaacgttggctcgaacgctatgagatcgacagtcttatcggtaaaggctccttcgggcaggtcgtcaaagcttatgatcatcagacacaggaattggtcgctatcaagataattaaaaacaaaaaggcctttttaaatcaagctcagatcgaactacgcctgctggagctgatgaatcagcatgatacggagatgaaatattacatcgttcacttgaaacgccatttcatgttccgcaaccacctgtgccttgtgttcgagttgctctcctacaacttatatgacttattacgcaacacccactttcggggcgttagtctgaatctgacgcgaaaattagcccagcagctgtgtactgctctgttgtttcttgctacgccggagctgagcatcatccattgcgacctgaagccggaaaatatcctcctatgcaatcccaagcggtctgccatcaaaatcgtggacttcggcagtagctgccaactaggacaacggatttatcagtacattcaatccaggttttatcggagcccagaagtccttcttggcacaccatacgacctcgccatcgacatgtggtccttgggttgcatacttgtggaaatgcatacaggcgagccactgttcagtgggtctaacgaggtggatcagatgaacagaattgtggaagtgctgggaattccaccagccgctatgctggaccaggcccccaaagcccggaagtactttgagaggttgcccggcggaggctggaccctgcgaaggaccaaggaactgcgaaaggattatcaggggcccggtacaaggagattgcaggaagtgctgggcgtgcagacgggagggccagggggccgtcgggccggagaaccgggccacagccctgccgattatctgcggttccaggacctggtactgagaatgttggagtatgaacccgcggccagaatctcccctttgggggcacttcagcacgggttcttcaggcgtactgcagacgaagcaacaaataccggaccggccggctcaagcgcctcaacatcgccagctcccttggacacatgtccctcatcaagtaccgcttcctctattagtagcagtggcggatcaagcggatcaagttccgataacagaacttatagatacagtaatagatattgcggaggccccggcccccctatcactgactgcgagatgaattccccacaggtccctccctctcaaccactgaggccatgggctggcggcgatgtgcctcataagacacaccaggcaccagccagcgctagttccttacccgggacaggggctcaactacctcctcaacccagatatctgggaagaccccccagtcccactagtcccccaccgccagaactcatggacgtgagcctcgtcggagggccggctgactgcagtcccccacaccctgcccccgcgccacagcaccccgctgcgagcgccctgcggacgaggatgaccggcgggaggcctcccctgccaccgccagatgacccggccacattggggccccatttgggcctgagaggcgttccacagtcgacagccgcaagctcctag

SEQ ID NO: 185949 - DNA, 1806 bp, Artificial Sequence
  Description of Artificial Sequence: Synthetic coding sequence
atggccgtgccccccggccacggccccttcagcggcttccccggcccccaagagcacacccaggtcctgcccgacgtgcgactactaccacggagacttccgctggcgtttcgtgatgcaacatctgcaccattgagaaagttgtcggtcgacttgattaaaacctacaagcatatcaacgaggtatactatgcaaagaaaaaaagaagagcgcagcaggcaccaccccaggacagtagtaataaaaaagaaaaaaaggtacttaaccatgggtatgacgatgacaatcacgattacattgtgagatccggcgagaggtggttggaacgctatgagattgactcactgattggcaaaggctccttcgggcaggtggtcaaggcctacgatcatcagacacaggaactggtggcaattaagattatcaagaataaaaaggcctttttgaaccaagcccaaatcgaactacgcttacttgaactgatgaaccagcacgatacagagatgaagtattacattgtgcatctgaaacggcactttatgtttcgaaaccacctgtgcttggtttttgaactgctgtcctacaacctttatgatctgctgagaaacacacacttccggggtgtttccctaaatctaactcgcaaattggcacagcaactgtgtactgccctccttttcttagctacccctgagttaagtatcatacattgtgaccttaagcctgagaacatactcctgtgcaaccctaaacggtccgccatcaagatcgtggactttgggagctcctgccagttggggcagcgcatctaccaatacattcagtcacgcttttaccggtctcccgaggtactgctgggcaccccctacgacctcgctatcgacatgtggagtctgggatgcattcttgtcgagatgcatacaggggaaccactctttagcggtagcaacgaggtggaccagatgaatagaatcgtcgaagtcctcggaatccccccagccgcgatgctcgaccaggctcccaaggcaaggaaatactttgagcggctgcctgggggaggatggacactgagacgcactaaagagctgagaaaagattaccagggacctggaactcgaagactccaggaggacctcgtgcttcgaatgctggaatatgagcccgcggcacggatcagtcccttaggggctttgcagcatggattctttagacgaaccgcagacgaagcaaccaatacaggcccagccggttcatctgcaagtacctcccccgccccactcgacacctgtccctcaagctcaacagcaagctctatcagcagctctgggggttccagtgggagctccagcgacaacaggacgtaccggtactctaacagatactgtgggggacctgggccacccattactgactgcgagatgaacagtccccaggtgccgccaagccaacctttgcgaccctgggcagggggcgacgttccccacaaaacacaccaggctcccgcctccgccagctctcttcccggtacaggcgctcaactgccgccgcagcctagatatcttggtaggcctccaagccccaccagccctcctccccccgagctaatggacgtgagtttagtcggaggccccgccgactgttcccctcctcatccggcaccggcccctcaacaccctgccgcttctgcgttgcggaccaggatgactggtggccggcctcccctccccccacccgatgaccccgccaccctggggcctcacctggggctcagaggcgttccgcagagcacggccgctagcagctag

SEQ ID NO: 185950 - DNA, 1770 bp, Artificial Sequence
  Description of Artificial Sequence: Synthetic coding sequence
atggccgtgccccccggccacggccccttcagcggcttccccggcccccaggagcacacacaagttctcccagacgtccgcttgttgccccgccgcctacccctcgcattccgcgacgccactagtgctccacttagaaagttaagcgtggacttgataaaaacctataagcacatcaacgaagtttactatgctaagaaaaaacggagggctcagcaggctcccccccaagactcgagcaataagaaggagaagaaagtcctgaatcacggctatgacgatgataaccatgactacatcgtgagatctggtgagcgttggctggagcgctatgagatcgatagcctgataggaaaaggttccttcggacaggtggtcaaagcatatgatcaccaaactcaggaattggtcgctatcaaaattatcaagaataagaaggccttcttgaaccaggcacagatcgagttgcgcctgttggagctgatgaatcagcacgacactgagatgaagtactatatcgtccatctgaagaggcactttatgtttcgtaatcatttgtgtctggttttcgaactcctcagttataatctgtatgatctactgcgcaacacccactttcgtggagtcagcttgaatctcacacgaaaactggctcagcagctctgcacagcactgctctttctggcaacccctgaactttccatcattcattgtgacctgaaaccagaaaacatcttattgtgtaacccgaaacgttctgccatcaaaattgtggatttcgggagctcatgccagttaggccagcgcatataccagtatatacaaagcaggttctaccgcagtcctgaggtgctactcggaaccccctacgaccttgccatcgacatgtggtccctcgggtgtatcctggtggaaatgcacactggggagcccctgtttagcgggagcaacgaagtggatcagatgaacaggattgtagaggtgctgggtattccccctgctgctatgctcgaccaggcccccaaagccaggaaatatttcgagcgactccctggagggggatggaccctgcggcgcacaaaggagctgcggaaggatctcgtgctgcggatgctcgaatatgagcctgccgcccgcatcagccctctgggggctctgcagcacggattttttcgaaggactgcagacgaggccaccaacacgggacctgccggatcatccgcctctacttcacccgccccactcgacacctgtccatcttcatcgaccgcgagtagtatatcttcaagcggcgggtcgtcaggaagttctagtgacaataggacttaccgatactctaaccgctactgtggcggaccagggcctcctattaccgattgcgagatgaatagccctcaggtccctccaagtcaacccttgcgcccatgggccggcggcgacgtgccccacaagacccaccaggcacccgccagtgcgtcaagtctcccaggaacaggagctcagctccccccccagcccaggtatctggggcgaccccctagccccacgtcccctccacccccagagcttatggacgtcagcctggtgggtggaccagctgattgtagcccgccccaccccgcacctgcccctcaacatcctgctgccagcgctctccgtacacgcatgacgggcggaaggcctcctctccctcctccagatgatccggctaccctgggccctcacctgggactgcggggcgtaccccagagtacagctgcatcttcctag

SEQ ID NO: 185951 - DNA, 285 bp, Artificial Sequence
  Description of Artificial Sequence: Synthetic coding sequence
atgaacgaccacctgcacgtgggcagccacgcccacggccagatccaggtacagcaactgtttgaggacaactccaacaaacggactgtgctcacaacacaaccaaacggcctgaccactgtaggaaagacaggactgcccgtggtgcccgaaagacagttagattccatacaccggcggcagggttcttccaccagcctgaagtcaatggaaggtatgggcaaagtgaaggccactcccatgacacccgaacaggctatgaagcagtatatgcagaaactgtag

SEQ ID NO: 185952 - DNA, 1806 bp, Artificial Sequence
  Description of Artificial Sequence: Synthetic coding sequence
atgctgacccggaagcccagcgccgccgcccccgccgcctaccccaccggccgggggggagatagcgcagttcggcagctgcaggcttctccgggtctcggagctggggcaacaaggtcgggtgtgggcaccggccctccgtcccctatcgcactgccaccactgagagcctccaatgcagccgccgctgctcacaccattggggggtccaaacacactatgaacgatcacctgcatgtgggcagccacgcgcatgggcagatccaggtgcagcagctctttgaggataattctaacaagcgcactgtattgacaacccagcccaacggcctcacaacagtgggaaaaaccggtttaccagtcgttcccgaacggcagctggactcaatccacagacggcaggggagctctaccagtttgaaaagtatggaaggtatggggaaggtcaaagcaacccctatgacgccagaacaagcaatgaagcagtacatgcagaaattgacagcctttgaacatcatgagatatttagctatccagagatctatttcctaggcctgaacgcaaaaaaaagacagggtatgaccggtgggccgaacaatggtggctacgacgatgaccagggatcctacgtgcaggtgccacacgaccacgttgcctatcgctacgaagtgctgaaggtcatcggtaaaggctcatttggtcaggtggtcaaagcttatgaccacaaagtgcaccagcacgtagcgctgaaaatggtccggaacgaaaagagatttcacaggcaggctgcggaagagattagaattctggagcatctgcgcaagcaggacaaggataacaccatgaatgtaatccatatgctggagaattttacatttcgaaatcatatctgtatgacatttgagctcttaagcatgaacctctatgaattaatcaagaaaaataagttccagggtttttcactgccgctggttcgcaaattcgcccactcgattctacaatgcctggacgctctgcacaagaatagaataatacactgtgacctaaagccagagaacatcctactgaaacagcagggacgatcaggaatcaaggtgatcgatttcggatcctcctgctatgagcatcaaagagtgtatacatacatccaaagcagattttacagagctcctgaggtgatccttggagcccgatacggcatgcctatcgatatgtggtcgctcgggtgcatcctagcagagctcctcactggctacccattgctgcctggggaggacgagggggatcagcttgcatgtatgattgaactccttggcatgccaagccagaagctgctggacgcatccaaacgagcaaagaacttcgtaagttcaaaggggtacccccggtactgcacagtgaccactctttcagatgggtccgtggttctcaatgggggcaggagtagacgaggaaaactgcgtggcccaccagagagtcgggaatggggaaatgctctgaaaggctgtgatgacccgctgttcctcgacttccttaagcagtgcctcgagtgggatcccgctgttaggatgacgcccggccaggccttgaggcatccttggctgcgacgaaggctgcctaagcccccaacaggagagaaaacttcagtgaaacgaattaccgagtcaacaggagcaattacttctatctctaagttaccccccccaagctccagcgcatccaaactgcgcactaacttagcccaaatgaccgacgcaaatggaaacattcagcagcggacagtcttacctaaactggtgtcatag

SEQ ID NO: 185953 - DNA, 1587 bp, Artificial Sequence
  Description of Artificial Sequence: Synthetic coding sequence
atgaacgaccacctgcacgtgggcagccacgcccacggccagatccaagtgcagcagctcttcgaggacaactccaataagcggactgtccttaccactcagcccaatggacttaccaccgtgggtaagactggtctcccggtcgtgccagagcgccagctagattccatacacaggcgtcagggatcgagcaccagcttaaagtcaatggaagggatgggaaaggttaaggcgacccctatgaccccagagcaagccatgaaacagtatatgcagaagctgaccgccttcgagcaccatgagatattttcctatcctgagatttactttctgggcttaaacgctaagaaaagacaaggtatgactggcgggcccaacaacggcgggtacgatgatgaccagggatcatacgtccaagtccctcatgaccacgttgcctatcgctacgaagtgctcaaggtgattgggaaaggatccttcggccaggtcgtgaaggcctacgaccacaaagtgcaccagcatgtggccctcaaaatggtaaggaatgaaaagaggttccacagacaggctgcggaggagatacgtatcctcgaacatctcagaaaacaggacaaggacaatacgatgaacgtgattcacatgctggaaaacttcactttccggaaccacatatgcatgactttcgagctgttaagtatgaatctgtatgaactgatcaagaagaataaatttcagggattctccttgcccctcgtacgcaagttcgcgcattccatactccaatgtctggatgcactgcacaaaaatagaattattcactgtgatctgaaaccagagaatattcttctcaaacagcaagggcgctcaggaataaaggtgatcgacttcggatctagctgctacgagcaccagcgagtatatacttatatccaatctcggttctacagggccccagaggttatcctaggagcgaggtacgggatgccaattgatatgtggtcccttggttgcattctggccgagctcctgaccggatatccactcctgccgggggaggatgagggagaccagctcgcttgtatgatcgagctgctcggtatgccttcccagaagctgctcgacgcatccaaaagggctaaaaattttgtgtccagcaagggatatcctcgatattgcactgttaccacactgtcggatggctccgtggtcctaaatggcggtcgttctcgcagaggcaaattgcgaggtccacctgaatcacgggaatggggtaatgctctgaaggggtgcgatgacccactttttctggattttctgaagcagtgtctggagtgggaccccgccgttcggatgactcccggtcaggcgctgagacatccgtggttgaggcggaggctacccaagcctccgacgggggagaaaacctcggtaaaaagaatcactgagagtacgggcgccatcacctccatttccaagctgcctcctccttcctcctccgcctcaaaactgcgcactaacctcgctcagatgactgacgctaatgggaacatccagcaaagaacagtgctccctaaactggtgagttag

SEQ ID NO: 185954 - DNA, 471 bp, Artificial Sequence
  Description of Artificial Sequence: Synthetic coding sequence
atgaacgaccacctgcacgtgggcagccacgcccacggccagatccaagtacagcagcttttcgaggacaatagcaataaacgaaccgtgctaactacacagcccaatgggctgacaacagtgggaaagaccggactgcccgttgtgcctgaacgccagctagacagcatccatagacgccaagggagttctaccagcttgaaatctatggaggggatggggaaggtcaaagcgactcccatgactccagagcaggctatgaagcaatacatgcagaaactcaccgcttttgaacaccacgaaatctttagctaccccgagatttatttccttggcctgaacgccaagaaacggcagggcatgactggtggtcctaacaatggcgggtacgatgacgaccagggctcctacgtgcaggtgccccatgatcacgttgcctacagatatgaagtgctgaaggtaatcggttag

SEQ ID NO: 185955 - DNA, 1707 bp, Artificial Sequence
  Description of Artificial Sequence: Synthetic coding sequence
atgaagtggaaggagaagctgggcgacggcgtgtacgacaccttcatgatgatcgatgaaaccaagtgccccccgtgttctaatgttctgtgcaacccttcggagcctccgccacctcgccggctaaacatgacgaccgaacagttcactggagaccatacacagcatttcctggatggtggggagatgaaagttgaacagctttttcaggaattcgggaacagaaagtccaatactattcagtctgatggaatctcagatagtgaaaaatgttcacctactgtctcgcagggcaaatcctccgactgtcttaatacagtgaagagcaactcctcctctaaagcacctaaagtggttccccttacaccagagcaagccctgaagcagtataagcaccacctcacagcgtatgaaaaactggaaatcatcaattacccagaaatctattttgtgggcccaaatgccaagaagcgccatggggtgatcggaggccccaacaacggcggctatgacgacgcagatggcgcttatatccacgtgcctagggatcacctcgcctacaggtatgaagtgcttaagatcataggtaagggatcctttggccaagtggctcgcgtgtacgaccataaactcaggcagtacgtcgctctgaagatggtaagaaatgagaaacggtttcacagacaagcggctgaagagatacggatcctcgagcatctcaaaaagcaggataagaccgggtcgatgaacgtgatccacatgcttgaatccttcaccttccgcaatcacgtttgtatggcgtttgagctgctcagtatcgacctgtacgagcttattaaaaaaaacaaattccaaggcttttctgtgcagctcgtccgcaagttcgcacagtcaattcttcaatcattggatgcattgcataaaaataagatcatccattgtgacctcaagccagagaacatcttactgaaacaccatggacgttcctctaccaaagtcatagactttggaagcagttgctttgagtaccagaaattatatacttatattcagtcgcgcttttaccgggcgccagagatcatactgggaagtcgttactcaacacctatcgatatatggtcctttggatgtatcttggcagagctgctgaccgggcagcctcttttccccggagaggacgaaggagaccagttggcttgtatgatggagcttctgggcatgcctccaccaaaattactagagcagagcaaacgagctaaatactttattaactcaaaagggattccaagatactgtagtgtcacaacccaagcagacggccgggtggtgttggtgggggggagaagcaggaggggcaaaaaacgtggcccacccgggagtaaagactggggcacagcgttgaaagggtgcgatgattatctctttatcgagttcttgaagcggtgcctccactgggacccttctgcaaggctcacacccgcccaggctctgcgacatccttggattagcaaatccgtgccaagacctctcacgaccatagacaaggtatctggtaaacgtgtggttaatcctgcctccgccttccagggactgggctcaaaactccctcccgtcgtgggaatcgccaacaaactgaaggcaaaccttatgagcgagaccaatggaagcattccgctttgtagcgtgcttcctaagctcattagctag

SEQ ID NO: 185956 - DNA, 1707 bp, Artificial Sequence
  Description of Artificial Sequence: Synthetic coding sequence
atgaagtggaaggagaagctgggcgacggcgtgtacgacaccttcatgatgattgatgagactaagtgtccaccatgttctaacgttttatgtaatccctccgagccacctccccctcggcggctgaatatgacaaccgagcagtttaccggcgaccacacacagcatttccttgatggaggcgaaatgaaggtggaacagcttttccaagagtttggcaataggaagtctaacacaatccagtctgatggcatctccgattctgagaagtgcagtccaactgtttcacaggggaaaagtagtgactgtcttaacacagtgaagtctaattcaagcagtaaggctcccaaagtagtacctctgacccccgagcaagcccttaagcagtacaaacaccacctcactgcctacgagaagctcgagattattaactacccagagatttatttcgtcggtccgaacgctaaaaaaagacatggcgtaataggcggccccaacaacggcggctacgacgatgcagacggagcttatatacacgtgcctcgggaccatctggcttacagatacgaggtgctaaagattattggaaagggctcctttggccaggtagcgagagtgtatgaccacaagttgcgccagtatgtcgcattgaagatggtgcgcaacgaaaaaagatttcacaggcaggctgccgaagagataagaattctcgaacacctaaagaaacaagacaagacaggctctatgaacgtgattcacatgctggagtcattcacgttccgcaaccatgtgtgtatggcttttgaactcctgtctatcgacttgtacgagcttatcaaaaagaacaagttccagggattctcggtccagctggttcggaagtttgcccaatccatcctgcagtcactggacgccttgcacaagaacaaaattatccattgcgacctaaagcctgaaaacattctcctcaagcatcatgggagaagcagcaccaaggtaatcgactttggctcttcatgtttcgagtaccagaaactgtacacctatatccagtcccggttttaccgggcacctgaaataatattaggaagccgctattctacccctatcgatatctggagctttggctgtatcttggccgagctcctgactggccaacctctctttccgggggaagacgagggcgatcagctggcttgcatgatggagctccttggtatgcctccccccaagctcttggagcagtctaaacgagccaagtatttcattaattctaaggggattccaaggtattgcagcgtgaccacccaagccgacgggagagtcgtgctggtgggagggcgatcaagaagaggcaagaagagaggccctcccggttcgaaagattgggggactgccctgaaagggtgcgacgattacctgtttatcgaattcctgaagagatgcctgcattgggatccgtccgcgcgccttactcccgcccaagctcttaggcacccttggataagcaagagcgtccctagaccgctcaccacgatcgataaagtgtctggcaaaagagtcgtcaaccccgcgagcgcctttcagggtctgggcagtaagctgccacctgtggtggggatcgccaataagttaaaggcaaatctcatgtctgaaaccaacggctccattccactctgttctgttctgcctaaactcatcagttag

SEQ ID NO: 185957 - DNA, 1767 bp, Artificial Sequence
  Description of Artificial Sequence: Synthetic coding sequence
atgggcggcaccgcccggggccccggccggaaggacgccggcccccccggtgctggattaccgcctcaacagcgtcgcctcggcgatggggtctacgacacatttatgatgatcgacgaaaccaaatgtcccccctgttcaaacgtcctgtgtaatcccagcgagccccctccaccacgaagactcaatatgacaaccgaacagtttacaggggaccacacacagcattttctagacgggggggaaatgaaagttgaacagttgtttcaggagtttggaaaccggaagagcaataccatccagtccgacggcatttcggactctgagaagtgcagtcccaccgtctcacagggcaagagctcagactgtctgaatactgtgaagagcaattcatcttccaaggcacctaaagtggtcccactgacccccgaacaggctctcaagcagtacaagcaccatctcacagcttatgaaaagctcgagattatcaattatccagaaatttacttcgtcggtcctaatgcaaaaaagcgccatggtgtgattggcggccccaataacggcggatatgatgacgctgacggagcttatattcacgtgccaagagaccacctggcgtaccggtacgaagttctgaagatcataggtaaggggagcttcggtcaggtggcgagagtgtatgaccacaaattgcgccaatatgttgcccttaagatggtgaggaatgaaaagagattccatagacaagccgctgaggaaattaggattctcgagcacttaaagaagcaggacaaaacgggttctatgaacgtcattcatatgctagagtcattcacctttcgaaatcacgtctgcatggccttcgaactcctgtctattgacctctatgagctgatcaagaagaacaaatttcaggggttttccgttcagttagtccgtaagttcgcacagtcaattctgcaaagtttggacgcattacataaaaataaaatcattcattgcgacctgaagcccgaaaacattctcctgaagcaccacgggcggtcctcgacaaaagtcattgacttcggttccagctgctttgagtaccagaagctttatacctatatccaatccagattctacagggctccagagatcatcctggggtcaaggtacagcactcccattgacatctggtcttttggctgcatactggccgagctcctgacaggtcaacccttgtttcctggcgaggacgagggcgaccagttggcttgtatgatggagctcctgggcatgcctccaccaaagcttttagaacaaagtaaacgggccaaatatttcattaactctaaaggaattccgcgttattgtagtgtcaccacacaagctgatggaagggtcgtgctagtgggaggacggtcacgtaggggaaagaagcgggggcccccggggtccaaagattggggtaccgcccttaaagggtgcgatgactacttgttcatagagttcctgaaaagatgtctgcactgggatccatcagcacggcttactccagctcaagctctacgccacccctggatctctaagagcgtcccacgtcctctgaccactatcgataaggtgtcaggtaagcgggttgtcaatcccgcttcagctttccagggcctgggttctaaactccctccggtggtagggatagccaataaattgaaggctaatttaatgagcgagacaaacggtagcattcctctttgttctgtccttcctaagctcatctcttag

SEQ ID NO: 185958 - DNA, 732 bp, Artificial Sequence
  Description of Artificial Sequence: Synthetic coding sequence
atgaagtggaaggagaagctgggcgacggcgtgtacgacaccttcatgatgatcgacgagactaaatgtcccccctgttcaaacgtgttgtgcaacccaagcgagccaccccctcccaggagactaaacatgacaaccgagcagttcaccggcgaccatacacagcacttcctggacggcggggagatgaaagtggaacagctgttccaagagttcggaaacaggaagagcaacaccattcaatcagatggaatcagtgattcagagaaatgctcccctaccgtttcccagggcaagagttccgactgcctgaatacggttaagtccaactcctcctctaaggcgcctaaggtggttcctctgacacccgagcaagcccttaagcagtacaaacatcatctgacggcttatgagaaactggaaatcataaactatccagagatttattttgtgggccctaatgcaaagaaaagacatggggtgattgggggcccgaacaatggtggatacgatgatgcagacggcgcttatatccacgtgccgcgcgaccatctggcatatcgctatgaagtcttaaaaatcattgggaaaggtagttttggtcaggtggcacgcgtgtatgaccataagctgagacagtatgtggccctgaagatggtccgcaacgagaagcggtttcaccgccaggccgccgaagagatacgcatcctcgagcacttgaagaagcagtag

SEQ ID NO: 185959 - DNA, 1563 bp, Artificial Sequence
  Description of Artificial Sequence: Synthetic coding sequence
atgcccgccagcgagctgaaggccagcgagatccccttccacccctccatcaaaacacaagaccccaaagccgaggagaagagtccaaaaaaacagaaggtgacactgactgcagcagaggcattaaagctgtttaagaaccaactgagcccctatgaacagagtgaaatcttgggctacgccgagctgtggtttctcggcctggaggccaaaaagcttgatacggcccccgagaaatttagcaaaactagctttgacgatgagcatggtttttacctgaaagtcctgcatgatcatatcgcctaccgatacgaggtgttagagactatcggcaaagggtcttttggtcaggtcgcaaagtgcctggatcataagaacaacgagttggtggctctaaaaatcattaggaacaaaaagaggtttcaccagcaggccctgatggaattaaagattctcgaagcccttcgcaagaaggacaaggataatacatacaacgtcgtgcacatgaaagattttttctacttccgtaaccacttctgtataacattcgaattgctaggaattaacctgtatgaacttatgaagaacaacaatttccagggattcagtctgagcatcgtgcgacgctttactctctcagttcttaagtgtctgcagatgctctccgtggagaagatcatccactgtgacctcaagcctgagaacatcgtgctctaccagaagggccaagccagcgtgaaagtgatcgatttcggctccagctgctacgaacaccaaaaggtctacacatatatccagagcaggttttatcgctcaccagaggtaatcctggggcacccttatgacgtggcaatagacatgtggtctctcgggtgcatcactgccgagctctacacaggatatcctcttttccccggcgaaaacgaagtggagcaactggcctgtattatggaggtccttggcttgccccctgcagggttcattcagactgcttcccggcgccagacctttttcgattcaaagggcttcccaaaaaatatcacgaataatcgcggtaagaagcgatatccagatagtaaggatctgaccatggtccttaagacgtatgacacatcctttctggatttccttaggagatgtctggtttgggagccatctcttcgaatgactccggatcaggccctcaaacacgcctggatccaccaaagtcgaaatctcaagccgcaaccccgccctcagacccttcggaagtcaaattcgttctttccctcagagacgcggaaagacaaggtccagggctgtcaccatagctctcgcaaagccgacgagatcacgaaggaaactaccgagaaaactaaggatagccccaccaagcacgtccaacacagcggcgaccagcaggactgcctgcagcatggcgctgacaccgttcagttgccccagctggtcgacgcacccaaaaagtctgaggcggccgtgggcgcagaggtgtccatgacatctccaggacaatccaagaatttctccttgaaaaacactaatgtgctccctcccattgtatag

SEQ ID NO: 185960 - DNA, 1563 bp, Artificial Sequence
  Description of Artificial Sequence: Synthetic coding sequence
atgcccgccagcgagctgaaggccagcgagatccccttccaccccagtatcaagacacaggatccgaaggccgaggaaaaaagcccaaagaagcagaaggtaaccctaacggccgcagaggccctgaaactgttcaagaatcagctgtctccatatgagcagtcggagatcttgggctatgcagaattgtggtttcttggattggaagctaagaaactcgatactgcaccagaaaagttcagcaagacatcattcgacgatgagcacggcttctacctgaaggtcctgcacgaccacatcgcctatcgttatgaggtcctcgaaacgataggtaaaggaagtttcggccaggtcgccaaatgcttggatcacaaaaacaatgagcttgtggcactgaagatcatacggaacaagaaacgctttcatcaacaggcccttatggagctgaaaattctggaagctttgaggaagaaggacaaagacaacacctacaacgtggtccatatgaaggatttcttctactttagaaaccatttttgtatcacctttgagctcctggggattaatctatatgaactgatgaagaacaataactttcagggattttctctgtcgatagtacgccggtttactttgtctgtgctgaagtgccttcagatgctttctgtcgagaagataattcactgtgatctcaagcctgagaacatcgtactctaccagaagggccaagctagcgtgaaggtgattgattttggctctagttgttatgagcaccagaaggtgtacacctacattcagtcaaggttttacaggtcaccggaggtgattctcggccatccatatgatgtggctatcgatatgtggtcactcggatgcataacggccgagctctatacaggttaccctctctttcccggcgaaaatgaggtcgagcagctggcatgtatcatggaggttcttggcctccccccggccgggttcatccaaacagccagcaggcgtcagactttctttgatagtaaaggctttcccaagaacattacaaacaatagggggaaaaaacgataccccgacagcaaggacctgaccatggtcctgaagacttatgacacttcttttctcgattttctgcggagatgcctcgtgtgggagccatccttgcgaatgacccctgaccaggcactaaagcacgcgtggatccaccagtcccgcaacctgaagcctcagcctaggcctcagactctgcgcaagtcaaattcttttttcccctcggaaacacgcaaagataaggtgcaagggtgccaccactcaagcagaaaggctgacgagataaccaaggagaccacagagaagacgaaagacagccccactaaacacgtgcagcattccggagatcagcaggactgccttcagcacggagccgataccgttcagctgccacaactggtcgatgctccaaagaaatctgaagcagccgtcggagcggaggtcagtatgacatctcccggtcagtcaaagaacttctccttgaaaaacaccaacgtgttgccccctattgtgtag

SEQ ID NO: 185961 - DNA, 1560 bp, Artificial Sequence
  Description of Artificial Sequence: Synthetic coding sequence
atgcccgccagcgagctgaaggccagcgagatccccttccacccctccataaagacacaggaccccaaagctgaggaaaaaagtccaaagaagcagaaggttacactgactgcggcagaggcgttgaagctctttaagaaccagctgtctccttacgaacagtctgagatcctgggatacgccgaactgtggttccttggtcttgaagctaaaaaactggacacagccccagaaaagttctctaagaccagtttcgacgatgagcacggattctatctaaaggtgcttcacgatcatatcgcctaccggtacgaagtgttggaaaccatcgggaagggtagctttgggcaggtagccaaatgcctggaccacaagaataacgaactcgtggccctcaaaatcatcagaaataagaagaggttccaccagcaggccctgatggagcttaaaatcctcgaggctcttcgcaagaaagacaaagacaacacatacaatgtggtccatatgaaagactttttctatttcagaaaccacttctgcatcacttttgaactgcttggtattaacctttacgaattgatgaaaaacaataacttccagggatttagcttgagtatcgttaggaggtttacactgtctgtactcaaatgtttacagatgctctctgtggagaagatcattcactgtgatttgaagcccgagaacattgttctgtaccagaaaggccaagcaagtgttaaggttatcgactttggaagctcttgctatgagcaccagaaagtgtacacctacatccaatctcgattctatagaagtccagaggtcattctgggccacccctacgatgtagccatcgatatgtggtccctcggttgcatcacagcggaactatacaccggatatccactgtttccaggagagaatgaggtggagcagctcgcatgcattatggaggtgcttgggctcccccctgccggattcattcagaccgcttctcggcggcagaccttttttgactctaaaggatttcccaaaaacattactaataacaggggcaagaagcgatatcccgacagcaaagaccttacgatggttcttaaaacttacgacacttcatttctggacttcctccggcggtgcctggtgtgggaaccgtctttgcgtatgactcccgatcaggcgctcaagcatgcttggatccatcagagcaggaatctcaaaccacagcccagaccccagacgcttcggaaaagtaactctttttttccatccgagaccagaaaggataaagttcagggctgccaccactccagtagaaaagatgagatcaccaaggaaaccactgaaaaaaccaaggactcgcccaccaaacacgtgcaacatagcggcgaccagcaggactgcttgcaacacggcgcagataccgtgcagctgccgcagctggtggacgcaccaaagaaaagtgaagccgcagtgggggcagaggtcagtatgacgtctccaggccagtctaagaacttttctctgaaaaatacaaacgttctgccccccatcgtgtag

SEQ ID NO: 185962 - DNA, 474 bp, Artificial Sequence
  Description of Artificial Sequence: Synthetic coding sequence
atggtgctgaagacctacgacaccagcttcctggacttcctgcggcgttgcctggtgtgggaaccttccctgcgaatgacccctgaccaggcgcttaagcacgcttggatacaccagagcaggaacctgaagccacaacctcgaccacaaactctccggaaaagcaacagtttctttccttccgaaacgcgaaaggataaagtgcagggctgccaccactcctcacgtaaggccgacgagattactaaagaaactacggagaagactaaggacagccctacaaagcacgtgcagcactcaggagaccaacaggattgtcttcagcacggcgccgatactgttcagttaccccagttagttgatgccccaaaaaaatctgaagccgcggtgggcgccgaggtgagcatgacaagtcctggccagagtaaaaacttttctcttaagaacacaaacgtactgccaccaatcgtgtag

SEQ ID NO: 185963 - DNA, 1011 bp, Artificial Sequence
  Description of Artificial Sequence: Synthetic coding sequence
atgggcaactgcctgcaccgggccgagctgagccccagcaccgagaattccagtcaactagattttgaggacgtttggaacagctcgtacggtgtcaatgattcttttcctgatggagattacggtgccaatctcgaagccgctgctccatgccactcttgtaacttactcgacgattccgccctgcccttcttcattctgacaagtgtgctgggtatactggcatcttccacggtcttgttcatgctctttagacctttgtttaggtggcaattgtgtcccggatggcctgtcttggcccagctcgcagttgggagcgcactcttttcaatcgttgtccccgtactggcaccaggcctggggagtactcggtcgagcgcgctttgtagcctgggatattgtgtgtggtacgggagcgcatttgcacaggctctgcttctcggttgccacgcctccctggggcaccggcttggcgcaggtcaggtccctggactgactctgggtctgacagtgggcatctggggagttgccgcgttattaactcttcctgtgaccctcgcaagcggggcgtctggaggtttgtgcactctgatttactcaacagaactgaaggccctccaggcgactcatacggtagcttgtctcgccattttcgtgctcctgcctttgggtctgttcggcgctaaaggcctgaagaaagccctcggcatgggaccaggaccctggatgaacattctgtgggcatggtttattttctggtggccccacggtgtggtacttgggctggacttcctagtgcgaagtaagctgctactgctgtctacttgtttggcccagcaggccctggatctgttgctgaacctggcagaggctttagctatcttgcattgtgttgctactcccctgttactcgcactgttctgtcatcaggccacgcgcaccttactgccttccctcccactgccggaggggtggtcctcccatctggacaccttaggttcgaaaagttag

SEQ ID NO: 185964 - DNA, 1017 bp, Artificial Sequence
  Description of Artificial Sequence: Synthetic coding sequence
atggccagcagcggctacgtgctgcaggccgagctgagccccagcacagagaatagttcacagctggattttgaggacgtgtggaatagtagttatggagttaacgattctttccctgatggggactacggtgcgaatctggaggctgccgcaccatgtcacagttgtaatctgttagacgactctgccctgccattctttattctcacatccgtattagggatcttggctagctccacagttctgttcatgcttttcagacccctgtttcggtggcagctatgtcccggatggcccgttctcgcgcagttggcagtggggtccgccttgttcagcatcgtagtgcccgtgttggcacctgggctgggctctacaagatccagcgcactttgttctctgggctattgtgtgtggtacggttcagcctttgcacaggccctgctgctggggtgtcacgcatcattgggccacaggctaggtgctggtcaagttcccggcctcaccctagggctgaccgttggcatttggggagtggctgcccttctgaccttgcccgttacgctggctagcggagcaagtgggggcttgtgcacactgatttacagcacagaactcaaggcactccaggctacgcataccgtggcatgcctcgcaattttcgtcttgctccctttaggtctctttggggcgaaggggctcaaaaaagcgctcgggatgggccccggcccctggatgaatattctctgggcttggtttatcttctggtggcctcatggcgtcgtactgggactagattttcttgtcaggtccaagctgcttttgctgagcacttgtctggcccagcaggcactggatcttttgcttaaccttgcagaggcactggctattctgcactgtgttgctactcccctactgctggcgctcttctgccaccaggccactaggacccttctcccttcattacctctccccgagggttggtcatcccatctagataccctgggatccaaatcatag

SEQ ID NO: 185965 - DNA, 1011 bp, Artificial Sequence
  Description of Artificial Sequence: Synthetic coding sequence
atgggcaactgcctgcaccgggccgagctgagccccagcaccgagaattcatcgcagctcgacttcgaggatgtttggaacagctcatatggcgttaatgactccttccccgatggggattatggagccaatctcgaggctgctgccccctgccactcttgtaacctattagatgattccgctctgccctttttcattttgacgtctgtgctgggaatcctggccagttctaccgtcttgtttatgctttttcggcctcttttccggtggcagctgtgtcccggctggccagtgttagcccaactggcggttggctctgctctgttttccatagtggtccccgtgctggcccccggactggggtctacaaggtctagtgccctctgcagcctcggttactgtgtgtggtacgggtccgcctttgcgcaggctttactcctgggctgccatgcttctctcggacatagactgggcgccggacaggtgcctgggctaaccttgggccttaccgttggaatctggggagtcgcagccctgctcactctgccagtgactctggctagcggcgccagcgggggcctctgcacattaatttacagcacagaactcaaggcccttcaggccacgcacaccgtggcgtgtttagcaatcttcgtcctgctacccttaggcctgtttggagctaagggccttaagaaggcactcggcatgggacccggtccctggatgaacatcctgtgggcttggtttatcttctggtggccacacggggtggttttgggcctagactttttagtgcgctccaaacttctgctccttagcacgtgtctggcacaacaggccctggatttactgctgaacctggcggaagcgctcgccatcctccactgcgtggcgacgccactcctgctagcactgttctgtcatcaggcgacccgaacgcttctcccctccctgcccttgcccgaagggtggagcagccatttggatacacttggatcaaagtcatag

SEQ ID NO: 185966 - DNA, 468 bp, Artificial Sequence
  Description of Artificial Sequence: Synthetic coding sequence
atggccagcagcggctacgtgctgcaggccgagctgagccccagcacagaaaactccagccagctggactttgaggacgtgtggaacagctcatatggagtcaatgactcctttcccgacggcgactacggagccaacctggaagccgccgctccatgccactcctgcaacttactcgatgattccgcactgccattttttatcctaactagcgtgttgggcatactggccagtagtacagtattgttcatgctattccgtccactgttcaggtggcagctgtgccccggttggccagtcctggcgcagcttgccgtggggtccgctctgttctctatagtcgtccccgtgctggctcctggactcggctcgaccaggtccagcgctctctgctcattaggctattgtgtgtggtatgggtcagccttcgcgcaggcgttgctacttggttgtcatgcaagcctctag

SEQ ID NO: 185967 - DNA, 1011 bp, Artificial Sequence
  Description of Artificial Sequence: Synthetic coding sequence
atgggcaactgcctgcaccgggccgagctgagccccagcaccgagaatagcagccagctggactttgaggatgtgtggaattcaagttacggtgtcaatgactcatttccggacggcgattacggcgcaaatcttgaggcagctgccccatgtcatagctgcaatctcctggacgacagcgccctgcctttttttatacttacaagcgtcctgggtatcctcgctagctcaacagtgctattcatgctgttccggcccctgtttcggtggcaattgtgccctggatggcccgtgctggcacagttggccgtcgggagcgctcttttttctattgtcgtcccagttctggctcctggcctaggctcaaccagatcttccgctctttgctctctcggatattgcgtatggtacgggtcagcctttgcccaggctttgctccttgggtgtcacgccagtcttgggcaccggttgggggccggccaggtgcctggtctgaccctcggactcacggttggcatctggggcgtggccgctctcttgacattaccggtgactctggcatcaggggcctccggcgggttgtgcaccctcatctattctaccgaactgaaggcactgcaagccacgcacactgtggcctgcttggcgattttcgtgttactccccctgggactgtttggggccaaggggttgaaaaaggccctcgggatgggaccaggtccttggatgaatatcctctgggcttggttcattttctggtggccacatggtgtggtcctggggctagatttccttgttcgttctaagctgctgttgttgagcacctgcctcgcccagcaggcgttagacctgttactgaacctcgctgaggcgctggctatcctacactgcgttgccactcccctactgttggccctcttctgtcatcaggccaccaggaccctcctgccatcgctgccactgccagagggctggtcgtcccacctggacacccttggcagtaagtcatag

SEQ ID NO: 185968 - DNA, 2010 bp, Artificial Sequence
  Description of Artificial Sequence: Synthetic coding sequence
atgggcagcaacagcagccggatcggcgacctgcccaagaacgagtacctgaagaaactgagcggaaccgagagtatttccgagaacgacccattttggaaccaactcttatcgttttcattcccagcgccaacaagctcctccgagctgaaacttctcgaggaggccaccatctctgtttgccgttctctggtggagaacaatcctcgtacaggcaacctgggggctctcattaaagtgtttctgagccggacaaaagagctgaagttaagtgccgagtgccagaatcacattttcatatggcaaacgcacaatgcactgttcatcatatgctgtctgttaaaagtcttcatctgtcagatgagcgaggaggagctgcagctccactttacatatgaggagaagtcccctggcaactacagttccgactccgaggatctgttggaggagctgctgtgctgcttgatgcagctcatcactgatatcccgctactggatattacctatgaaatatcggtcgaagctatcagcaccatggtggtctttcttagctgccaacttttccacaaggaagttctgaggcagtccataagtcataagtacttaatgcgcggtccatgcctgccatataccagtaagctggtaaagaccctcttgtacaactttattaggcaggaaaaaccaccacctccaggcgctcacgttttcccccaacagagcgatggcgggggtctcctgtatggcctggcttccggcgttgccacaggtctatggacggttttcaccctcggaggcgtcggttctaaagcagcagccagtccagaattgtcgtcaccactggcgaatcagtcgctcctcctgttgctcgtgctcgctaacctgaccgatgcgtccgacgcccctaacccgtaccgtcaggctattatgtcctttaagaacacacaggactcttctccatttccatccagcatccctcacgccttccagattaacttcaatagcctttacaccgctctatgcgaacagcagacctcggaccaagctactcttctactgtacacactcctacaccagaactcaaacatcagaacatacatgctagcccgaactgatatggagaaccttgtgttgcctatcctggagattctgtaccacgtggaggagagaaactcccaccatgtttacatggcactgataatcctcctcattctgactgaggacgacgggttcaatagatctatccacgaagtcatccttaaaaacattacttggtactctgagcgcgtgctgacagaaatttccctgggctccctcttaatactagttgtcataaggaccatccagtacaacatgacaagaacaagagataaatacttgcatacgaattgcctggccgctctagctaacatgtccgcacagttcagatccctgcaccagtatgcggctcaacggatcatcagcctgttttccttactgtcaaagaaacacaataaggtcctggaacaggctacacaatccctaagggggagcctgtctagcaacgatgtgcctctcccagactacgctcaggatctaaatgtgattgaagaagtgatccgcatgatgctggagattatcaattcttgtctgactaattccttacatcacaaccctaatttagtttacgctctcctgtataagcgcgacctgttcgagcagttcagaacacacccttcctttcaggacattatgcagaacatcgatttagtgatctcttttttcagcagcagattgctccaggccggcgctgaactatcggtggaacgcgtgcttgagatcattaaacaaggagtcgtggcattaccaaaagatcgtctcaagaagttccccgaactcaaatttaagtacgtggaggaggagcagcccgaagagttctttattccgtacgtttggtcccttgtctacaatagtgctgtcggtctgtactggaaccctcaagatattcagctgttcaccatggactctgattag

SEQ ID NO: 185969 - DNA, 519 bp, Artificial Sequence
  Description of Artificial Sequence: Synthetic coding sequence
atggccctgatcatcctgctgatcctgaccgaggacgacggcttcaaccggtccatccacgaggtaatccttaagaatatcacttggtattctgagcgagtgctgacggaaatctctctcgggtctctcctcatcctggtcgtgatcagaacgattcagtacaacatgacgaggactcgtgataagtacctccacactaactgcctcgcagccctggcaaatatgagtgcccagtttcggagcctccatcagtacgccgcccaacggataatttcatatacctgccgccatctgcgtaggtatgtgtacgtcctggacaagctgtacttccctcatagtcattgctccactttgcagcactgttttagtactctgagtgataacggagaagaattgctatcgctgacatgttctcacatccttagatcctatgcaagcagcctcttcagtctcctgtcgaagaagcataacaaggtcctggaacaggctactcaatctctgaggggctccctgtcctag

SEQ ID NO: 185970 - DNA, 1440 bp, Artificial Sequence
  Description of Artificial Sequence: Synthetic coding sequence
atgggcagcaacagcagccggatcggcgacctgcccaagaacgagtacttaaaaaagctaagcggcaccgaatccatatcagaaaatgacccgttttggaaccagctgctatctttcagctttcctgccccgacaagcagctccgagctcaagttattagaggaggcgacaatttcagtatgcaggtctttggccgggttgtggacggtgttcactttggggggtgtcggaagcaaagcagctgcctctccagagctctcgagcccattggccaatcagtccttactgctgcttttagtcttggccaacctgaccgatgcttccgatgcacctaacccgtaccgccaagcaattatgagctttaagaatactcaagacagctcccccttcccgtctagcatcccacatgcctttcaaatcaacttcaatagcctctacacggcactttgtgaacagcagacatcagaccaggcaactctgcttctgtataccctcttacaccagaacagcaacattaggacttacatgctggctagaaccgacatggagaaccttgttctgcccatcttggagatcctttaccacgtggaagaacgtaattctcaccacgtgtacatggccctgattatcctgctgatattaaccgaggatgacggatttaataggtctatacatgaggttattctgaaaaacataacttggtacagtgagcgagtcctgacagagatcagcctcggcagcctcctgattctggtggttattcggactattcaatacaatatgaccaggacgagggataaatatcttcacaccaattgccttgcggctttagccaatatgagtgcacagtttcgaagcctgcatcagtacgctgcccaaaggattatctccctgttctcgctcttgtcaaaaaagcacaacaaagtactggaacaggcaacacagtcgcttcgtggaagcctgagttcaaatgacgtcccgctccctgattatgctcaggacctgaacgtcatagaggaagtaattcggatgatgctggaaattataaacagctgcttgaccaattcgctccatcataatccaaatcttgtgtatgctctgctgtataagcgggacctgttcgagcagtttcgtacccacccatccttccaggacatcatgcaaaacattgacctggtcatttctttcttcagttcacgactgctacaagccggtgccgaacttagtgtcgagagggtgctggagattattaagcagggagtagtcgcattacccaaagaccgcttgaagaagtttccagaattgaagttcaagtatgtcgaggaagaacagccagaggaattcttcatcccttatgtatggagcctcgtctacaacagtgcagtcggcctgtactggaacccacaggatatccagcttttcaccatggatagtgattag

SEQ ID NO: 185971 - DNA, 3837 bp, Artificial Sequence
  Description of Artificial Sequence: Synthetic coding sequence
atggcccagagcaagcggcacgtgtacagccggacccccagcggctctcgtatgtcagcagaggcttccgcccgacctcttcgggtggggtcccgggtggaggtcattggcaaggggcaccgcggcactgtggcatacgtgggcgctaccctcttcgctaccgggaagtgggtcggggtgattttggacgaagcgaagggcaagaacgacggaactgttcagggacgcaaatacttcacttgcgacgagggccatggaattttcgttcgtcaatcacagattcaggtattcgaggacggtgctgacacaacgtcaccagagactcctgacagcagtgcaagtaaggtactcaagcgcgaaggcaccgacacaacagcaaagacatccaagttgagagggctgaaacccaagaaagcaccaactgcgcggaagacaacaacacgcagacccaaaccgactaggcccgctagtaccggtgtcgccggggcctcatcaagcctcgggccatccggctccgcgtcagcaggcgaattgagttcttccgaaccaagcacacccgcccagacaccactggcagcccccattatacctacccccgtgctgacctctcccggcgccgttccccctctaccttctccaagcaaggaggaggagggattaagggctcaagttagagatcttgaggagaagttggagacactgcgactgaagcgcgcagaggacaaggctaaactgaaggaattggagaagcacaagattcagcttgaacaggtccaggagtggaagagtaaaatgcaagagcagcaggccgacttgcagaggcgtttgaaggaagcccgaaaagaagcaaaggaggccctagaagcgaaagagaggtatatggaggagatggcagacacagccgatgcaatcgaaatggcaacactggacaaggaaatggctgaggaacgcgctgaatctcttcagcaggaggtagaagccttgaaggaacgagtcgatgaactgactaccgaccttgaaatcctgaaggccgagattgaagagaagggctccgacggcgcggcttcaagttaccagctaaagcaactagaagaacagaatgcccgcctgaaagacgccctcgtaagaatgcgcgatctgtcctcttccgaaaaacaggaacatgttaagctgcagaagctgatggaaaaaaagaatcaggagctcgaagttgttaggcagcagcgcgagcggctgcaagaggaactgagtcaagccgagagcacgatcgacgagcttaaagaacaggtggacgctgccctgggcgcggaagaaatggtggagatgttgaccgaccggaacctgaatctcgaggagaaggtacgggaactccgcgagactgtgggtgacctcgaggccatgaatgagatgaatgacgagcttcaggagaatgccagggagacagaacttgaactgcgcgaacaactggacatggcaggggccagagtccgggaagctcagaagagagtagaggccgctcaggaaaccgtcgccgattaccagcagaccattaagaagtaccgccagcttacagcccacttacaagacgtgaacagagagcttacaaaccaacaagaggcttccgtggaacgccaacagcagcctcccccggagacttttgactttaagatcaagtttgcagagacaaaggcccacgccaaagccattgaaatggaactgcgccaaatggaagtggctcaggccaatcgacatatgtccttattgaccgccttcatgcctgacagcttcctgcggcctggcggagatcatgactgtgtcctggttctactgcttatgcctcgcttaatttgtaaagcggaattgatcagaaagcaagcccaagaaaaattcgagctgagtgagaactgttccgaacggccaggtctgcgaggtgcggccggggaacaactttcatttgccgcaggtctcgtgtactcacttagcctcctgcaggccacattgcatcggtacgagcacgctctttcccagtgctccgtagatgtttataagaaggttggtagtctgtaccctgagatgtccgcacacgagcgctctctcgactttctgatcgagctccttcacaaggatcagttggacgaaaccgtcaatgtcgaacctctaactaaagctattaaatactaccaacatctgtacagcatacaccttgccgaacagcccgaagattgcactatgcagctcgctgatcacatcaagttcacgcaatccgccctggattgtatgtccgtggaggtcgggcgactgagagccttccttcaggggggtcaggaggccaccgacattgcgctgttgcttagggatctggaaacctcctgctcagacatcagacagttttgcaagaagattaggagacgtatgcctggaaccgacgcgcccggcatacctgccgccctggcctttggcccgcaggtctcagataccttgctcgactgtagaaaacacctcacctgggtggtggccgtgctgcaggaagtggcagcagctgctgcacagttgatcgctccgctggcagagaatgaggggctgctcgttgccgctctcgaggagctcgccttcaaggcctcagagcagatctacgggactccctcaagcagcccttacgaatgtttaagacagtcatgcaatatactcatctccactatgaataagcttgcgacagcgatgcaagagggggagtatgatgcagagcgaccaccatccaagcccccacccgtggaactgcgggctgctgcactgagagcagagatcacggacgccgagggactgggattgaagctggaagacagggagaccgtgattaaggaactcaagaagtctctaaaaataaaaggagaagagctgtccgaagccaacgtgcgcctctcccttcttgagaagaagttggactctgctgccaaggatgccgacgaaagaatagaaaaggtgcagacaagactggaggaaactcaggctctccttcgaaaaaaagagaaagagttcgaggaaacgatggacgctttgcaagctgacatcgatcagttggaggcggaaaaagcggagctcaaacagcggctgaatagccagtctaagcggaccattgaggggctgaggggacccccaccaagcgggatcgcaactctggtctccggaatcgccggcgaggagcaacagaggggtgctattcctggtcaggcaccaggaagcgtcccagggcccggccttgtgaaggactcacccctccttctccagcagataagcgccatgcggctgcatatcagtcagctgcagcacgagaatagcattcttaagggtgcacagatgaaagcatcccttgcatccctgcctcccctacatgtagcgaaactgtctcacgagggccctgggtcagaacttccagcaggagcgctttaccgaaagacttctcagcttctagaaaccctaaaccagttatccacccacacccacgtcgtggacatcacccggaccagtcccgccgcaaaatccccatccgcacagcttatggagcaagtggcccagttgaaaagccttagcgacactgtggagaagctgaaggacgaagtcctcaaggagacagtgagtcagcggcctggcgccaccgtccccaccgatttcgctacatttccatcctccgctttccttagagcaaaagaggaacaacaggacgacactgtctacatgggtaaggtgacattttcatgcgctgccggttttggccagagacataggcttgtgctgacacaagagcagttgcaccagctgcattcgcgcttaatatcttag

SEQ ID NO: 185972 - DNA, 3786 bp, Artificial Sequence
  Description of Artificial Sequence: Synthetic coding sequence
atgagcgccgaggccagcgcccggcccctgcgggtgggcagccgggtggaagtgattggaaaaggacaccgcggtaccgtggcttatgtaggcgctacccttttcgctactggcaaatgggtgggtgtgatcttagatgaagcgaaagggaaaaacgatggcactgtgcagggccgaaaatacttcacatgcgacgagggccacggcatttttgttaggcagagccagatccaagtgtttgaagatggggcagatacgactagccctgaaactccggactcttctgcttctaaggttctaaaacgcgaggggaccgacacaaccgccaaaacaagcaaattacgcggcctgaagcccaagaaagcaccaacagcgcggaagggccggcgtgtgaggactaagcccaccagacccgcaagtactggtgtcgctggcgcctcctcaagcctgggcccctccggaagcgcaagcgccggggaattatcctcttctgagcctagcacacctgcacaaacaccgctggccgcccccattattcccaccccagttctcacaagtcccggcgctgtccctccattaccaagcccaagcaaagaggaggaaggtctcagggctcaggttagagatctcgaggagaagctcgagactcttagattgaagagggccgaagataaggctaaactgaaagaattggagaagcacaaaatacaactggagcaggtacaggagtggaagtcaaagatgcaggaacagcaggcagacctgcagcgtaggctgaaagaagcaagaaaggaggcaaaggaagccctggaggcgaaagagcggtacatggaggagatggctgatactgcagacgccatagagatggccaccctcgacaaagaaatggcggaggagcgggccgaatctctccagcaggaggtggaggcactgaaagagagagtcgatgaactgactactgatttggaaatactgaaggcagaaatagaagaaaagggcagtgatggtgcagcgtcatcataccaactcaagcagcttgaggagcaaaatgctagattgaaggacgcccttgttcggatgcgagacctaagcagctctgaaaagcaggagcacgtgaagctccaaaaactgatggagaagaaaaatcaggagctggaagtcgtgcgacagcagcgcgagcgcctacaagaagaactttcccaggcagaaagtaccatcgacgagcttaaggagcaggtggacgccgccctgggcgcagaagagatggtagagatgctcaccgacaggaatcttaacctggaggagaaggtgagggagctcagagaaacagttggagacctagaggctatgaatgaaatgaacgacgaattacaggagaatgctcgcgaaaccgagttggaactcagagagcagctcgacatggccggagcgagggtgagggaggctcagaagagagttgaagctgcacaagagaccgtagctgactaccaacagactataaagaaatataggcagctgaccgcccatctgcaagacgtgaaccgggagttaacaaaccagcaggaggcatccgtggagaggcaacagcagccacctcccgaaacctttgatttcaagattaaattcgcagagactaaggcacacgccaaggccatcgaaatggaacttcgacaaatggaggttgcccaggccaacagacacatgtctcttttgaccgcattcatgcctgattcctttctgcgccctggcggggatcacgattgtgtgttggttctgctcctcatgcctcgattgatttgtaaggcggaactgatcagaaaacaggcccaagaaaagttcgagctgtccgagaactgcagtgagaggcccggcttaaggggagccgccggagaacagctttcctttgcagctgggctagtttacagcttgtctctcctgcaggctactctacaccgatatgaacacgcactgagtcagtgcagcgtggacgtctataagaaggtcggcagcctgtatccggaaatgtctgctcacgagaggagcctcgatttcctgatcgaattacttcacaaagatcaacttgatgaaacagttaacgtggaacccctcacaaaagccattaagtactaccagcatctatacagcatccacctggccgaacaacctgaggactgtacaatgcaactggccgaccatataaaattcacccagtcagcactcgactgtatgtcggtggaagtcggccgactgagagcgtttctgcaggggggacaagaggctactgatattgctctgctgctgcgggacctggagacctcctgcagcgacattcgccaattttgtaagaagattcgcagacggatgccaggaactgacgcccctggcatcccggccgccctggccttcggtccccaggtctctgacacactattagactgtcgtaaacacctcacctgggtcgtagccgttctgcaggaggtggctgccgccgccgcacaactgatcgccccactcgcagagaatgaaggactgttggtagcggcattggaagagctggccttcaaagcctcggaacaaatctacggaacgccatcgagctctccctacgagtgcctcagacagtcctgtaacatcttaatcagtactatgaacaagctggcaaccgcaatgcaagagggcgagtatgacgcggagcgccctccctcaaaaccgccccccgtggaactccgagcagcggccctgagagctgagatcacggatgccgaggggctcggacttaaactagaagatagggaaactgtaatcaaggagttgaagaagagtctgaagattaaaggcgaggagctctccgaagcaaacgtccgtctttcccttctggaaaagaagcttgatagcgccgccaaagacgctgacgaacgcatcgaaaaggtgcagactagactcgaagaaacccaggctttacttcgaaagaaagagaaagagtttgaggagactatggacgctctgcaggctgatatcgaccagctggaagctgagaaggcagaattgaagcagcgcttgaactctcagtccaagcgaaccatcgagggcctgaggggaccccctccttccggtattgctaccttagtgtcaggaatcgctggtgaagagcagcagagaggagctattccagggcaagccccggggtcagtccctgggccaggactggtgaaagacagtcccctgctgctgcagcagatttctgctatgcggttacacatttctcagctgcagcacgaaaattccattctcaagggagctcagatgaaggccagtctagcttcattacctccactccatgttgccaagctgagccatgaggggcccggctctgagttaccagccggagcactctacagaaagacctcacaactcctggagacgttgaaccagctgtccactcatacgcacgtggtcgacatcacccgcactagccccgcggccaaatccccaagtgcccagctgatggagcaagtggcacagttgaagtcgcttagcgatacagttgagaagctgaaggacgaggttttgaaagagactgtttcacaacgtcccggtgcaactgtgccaacagattttgcgacattcccatcatctgccttcctgcgggccaaagaagaacaacaagatgacacagtatatatgggcaaagtgaccttctcttgtgctgcgggatttggacaacggcaccgactggtgttaacgcaggagcagttacaccagctccacagtaggctcattagctag

SEQ ID NO: 185973 - DNA, 3816 bp, Artificial Sequence
  Description of Artificial Sequence: Synthetic coding sequence
atggcccagagcaagcggcacgtgtacagccggacccccagcggctctcggatgagcgccgaggcctctgccagacccctgcgggtgggcagccgggtggaagtcatcggtaagggtcacaggggcactgttgcttacgtgggagcaaccctgtttgctactgggaagtgggtcggcgtcatattggatgaggccaaaggtaaaaacgatgggacggtgcagggccggaagtattttacctgcgatgagggacatggtatcttcgtgaggcaatcccagattcaggtctttgaggatggagccgacactactagtcccgagacccctgattcctctgcctctaaagtgttgaagcgagagggcacggacacaactgccaaaacttcaaagttagcacccaccgcccgcaagacaacgacaagacgtccaaaacctacgagacccgcaagcacgggtgtggccggtgcatcaagcagcctgggaccatccggaagcgcatctgccggagagctgtcttcatcagagccttccactcccgctcaaacacctctcgcagctccaatcatccccactcccgtgctcacatcacccggtgcggtgcctccgctcccttccccaagtaaagaggaggaaggcctccgggcacaggttcgtgatcttgaagaaaaactcgagactctgcgcttaaagcgtgctgaggacaaagcgaagcttaaggaactggagaaacataagattcagctcgagcaggtgcaggaatggaagagcaaaatgcaagagcagcaggccgacctccagcgcaggctcaaagaagccagaaaggaggctaaagaggccttagaggctaaagagagatacatggaggagatggcggacaccgctgacgcaatagagatggctacattggataaggagatggcagaagaaagagctgaaagtctccaacaggaggtagaagcgttgaaggagagagttgacgaactgaccacagacctggagatcctgaaggcagagatcgaagagaaaggttccgacggtgctgcctcctcttatcagctcaaacaactagaagaacagaacgctcgcttgaaggacgccttagtcagaatgagggacctcagttctagtgaaaaacaggagcacgtcaaactgcaaaagctcatggagaaaaagaaccaggaacttgaggtagtgcgccagcagcgtgagcgacttcaggaagagctctctcaggctgagtcaacgattgatgagctgaaagagcaggtggacgcggccctcggcgcagaggagatggtggagatgctgactgatcggaatctaaacctggaggagaaggtgcgcgagctgagagagacagttggcgaccttgaggcaatgaatgaaatgaacgacgagctccaggagaacgcacgtgaaaccgaattggaactgagggaacaattggacatggcaggcgcgagagtgcgagaagcccaaaaaagggtagaggctgcccaggaaaccgtagcagactatcagcagacgatcaagaaataccgccaactgacagcccacctccaggatgtgaatagggaattaacgaaccagcaagaagcatctgtcgaaagacagcagcagcccccccccgaaacattcgattttaagataaaattcgccgagacaaaggcccacgccaaagcaatagagatggagcttaggcaaatggaagtggctcaagccaatcgtcatatgagtctgttaactgcattcatgccggacagtttccttcgaccaggcggcgaccatgactgcgtgttggttcttttgttgatgccgagactgatctgtaaggccgagctgatcaggaagcaggcccaggagaaattcgagctgtcagagaattgcagcgagaggcccggactcaggggggcagcgggcgagcagctttctttcgcggctgggttggtgtattccctgtcactcctacaggctacgctacaccggtacgaacacgcactttcccaatgctccgtcgacgtatacaagaaggttggctccctgtatccagagatgagtgcccatgagcggtctcttgactttctgatcgaactgcttcataaagaccagttggacgaaacagtgaacgtggagccactgacgaaagcaatcaaatattaccaacatctgtattctattcacctggccgagcagccagaggactgtactatgcagttggccgaccacattaaatttacgcagtcagccctagattgcatgtctgtggaggttggcagacttcgcgccttcttgcaggggggacaggaagccacagacattgcgttactacttcgagatctggagacatcttgctccgatattaggcagttttgcaaaaaaatccgccgtcgcatgcctggaacagatgctcctgggattccggccgctctcgcctttggcccacaggtgagtgataccctgctagattgtcgcaaacacctcacttgggtggtggcggtgctgcaggaggtagccgctgccgctgctcagttgatagctcctttggccgaaaatgaaggactgctggttgcagcactagaagagctggcctttaaagcctccgaacagatatatggcaccccatcaagctctccatatgaatgcctgcgacagtcttgcaatatcctgatatccaccatgaacaaattagccacagctatgcaggagggcgagtatgacgcggagcgcccccctagtaagccaccgcccgtggagctccgggccgctgctctgagggccgagattacagatgccgagggcctcggtctgaagctggaggatcgggaaaccgtaatcaaggagttgaaaaagtcacttaagataaaaggagaagagttatccgaggctaacgttcggctgtctctgctggaaaaaaagctcgattccgcagcaaaggatgccgacgagaggattgaaaaggtgcaaactcggttagaggagacccaagctcttttaagaaaaaaagagaaggagtttgaggagactatggatgcgcttcaggcagacatcgaccaactggaagccgaaaaggcagagctgaagcagcgattgaattcacagtctaaacgtactatcgaagggctccgtggacccccaccatcaggcatcgcaacactcgtgagcggaattgccggagaggagcagcagcgcggcgcaatccccggccaagcgccaggctctgtaccaggccctggacttgtgaaagactcacctttgctgctccagcagatctccgccatgcgtcttcacatatcccagctgcagcatgaaaattctatacttaagggagcccagatgaaggcaagtctggcttctttgcctccgctccatgtcgcgaagctgtctcatgaaggacccggatccgaactgccggccggagccctgtaccgaaagacttcccagctgctggagacattaaaccagctgtcaacccacactcatgtcgttgacattacaagaacttcacccgccgctaagtcaccaagtgcacagctcatggaacaagtcgctcaacttaagtctctgtccgacacagtagagaaactcaaagacgaggtattgaaagaaactgtctcccagcgtcccggagctacagtgcctacagactttgccacattcccgtctagtgcctttcttagggccaaagaggaacagcaggacgataccgtgtacatgggcaaagtcacgttcagctgtgctgctggctttgggcagcgtcacagattggttcttacgcaggagcaactgcaccagcttcacagtcgtttgatctcctag

SEQ ID NO: 185974 - DNA, 3435 bp, Artificial Sequence
  Description of Artificial Sequence: Synthetic coding sequence
atgatgcggcaggcccccaccgcccggaagaccaccacccggcggcctaaacctacacgacccgcaagtaccggagtcgccggtgcctcttcgtcactgggccccagtggctcagccagtgccggcgagctgagtagcagtgagccaagcactcccgctcagaccccgttagccgcacccattataccgactcctgtgttgaccagcccgggagccgtgcctcccctgcctagcccttctaaagaagaggaaggcctgagggcacaagttcgggatttggaggaaaagttggagacacttaggctaaaacgtgcagaagataaagcaaagcttaaggaactggaaaagcataaaatccaactggagcaagttcaagaatggaagtcaaagatgcaggaacagcaagccgatttgcagcgtcgattaaaagaggcccggaaagaggccaaggaagctctggaggcaaaggagaggtacatggaggaaatggccgatacagccgatgccattgagatggctactctggacaaggagatggcggaggagagggctgagtcactgcagcaagaggtggaggcgctcaaagaacgggtggatgaacttaccactgatctggagatcttgaaagcagagatcgaagagaaggggtctgacggcgctgctagttcttaccaattaaaacagttagaggaacagaatgcacgattaaaagacgcactggtgcggatgcgcgacctgtcttcgtctgagaagcaggaacatgtgaagcttcagaaacttatggagaaaaagaaccaggaactggaggtggtgcggcagcaaagggagagattgcaagaggaattaagtcaggccgagtcaacgattgacgagctcaaggagcaggtggacgcagccctgggcgcggaggaaatggtggaaatgcttacggacagaaatctgaatctggaggaaaaagtgcgtgagctgcgagagacagtaggagacttagaggctatgaatgaaatgaatgacgaactgcaggagaacgctcgggagacagagctggagctccgagagcagttggatatggccggcgcccgagtgagagaagctcagaagcgggtagaagcggcccaagagacggtggccgattaccagcagaccattaagaaatacagacagttgactgcccatttgcaggacgttaatagagagctgaccaatcagcaagaggccagcgtcgaaagacagcagcaaccacccccagagacctttgattttaagattaagttcgcagaaaccaaggcccacgcgaaggcaatcgaaatggagttaagacagatggaagtggcacaagcgaatcgccatatgagcctgctaaccgcttttatgcccgatagcttcttaagaccaggcggagaccacgactgcgtgctcgtgttgctgttaatgcctaggctgatctgtaaggccgagctgattcgcaagcaggcacaggaaaagttcgagctttctgagaactgttccgaaaggcctggcctgcgtggagcagctggagagcagctctctttcgcagcaggcctagtttactctcttagtctgcttcaagcaactctgcacaggtacgagcacgccctgagccagtgttctgtcgacgtctacaaaaaggtcgggtcactgtaccccgaaatgtccgcacacgagcggtccctcgatttcctgatcgaactgctacataaggatcagctcgatgaaacagtgaacgtcgaaccactgactaaagctattaaatattaccagcacttgtactctattcatctagcagaacagcctgaggactgtacaatgcagctggccgaccacattaaatttacgcaatccgcgctagactgcatgtcagttgaggtagggcggcttcgggcgtttcttcaagggggtcaggaagccacagatattgctctgctgctcagagacctcgagacttcctgttcagacataaggcagttctgcaagaaaatccggaggagaatgcctggcaccgatgcccctgggattcctgctgcattagccttcgggccacaggtttctgacaccctgttagattgcaggaagcacctgacatgggtggttgccgtcttacaagaggtagccgccgccgccgcacagctgattgcacccttggctgaaaatgaagggctccttgttgccgcactcgaggaattagcatttaaggcttcggagcaaatttacggaaccccttcttccagtccatatgagtgtttgcgacagagctgtaatatcctcatatccacgatgaacaagctcgctacagctatgcaggagggcgaatatgacgcggagaggccgccgtccaagccacctcctgtcgagttaagagcagccgcactgagagcggaaatcacagatgccgaaggattaggcctgaagctggaggacagagagacagtcattaaggaactaaagaagtccctgaagatcaagggggaagagttgagcgaagctaacgttcgtctttcattactcgaaaagaaactcgactcagcagctaaagatgccgacgaaagaatcgagaaggttcagaccagattagaagaaacacaagccctgctccggaagaaggagaaagagttcgaagaaacaatggatgccctgcaagccgacattgaccaactggaggcagagaaggcagaactgaaacagagactgaattctcagtcgaaacggaccattgaaggtctgcgggggcctccacccagcggaattgcaacactggtatccggcatcgccggtgaggagcagcagcgcggtgccattcccggtcaggcccccggatcagttccggggcctggcctggtgaaagattcccctctgctgctgcaacaaattagcgctatgcgcctacacatctcccagctccagcacgaaaactctattctgaagggcgcccagatgaaagcatctctcgcgtcacttcctccgctgcacgttgccaaactcagtcatgaagggcctggcagtgagctgccggccggggccttataccgcaagactagtcaactgctggagactttgaaccagttgtcaacgcacacacacgttgtggatatcacccggaccagccccgctgccaaatccccctcagcccagctcatggaacaggtagctcaattaaagtccctcagcgacacagtggagaagcttaaagacgaggtcttaaaggaaacagtgtctcagcggcctggagcaaccgtacctactgacttcgccaccttccctagtagtgccttcctccgcgcaaaagaggaacagcaggatgacactgtgtatatggggaaagtcacatttagttgtgctgctgggtttgggcagcgccacagattggttctgacacaagagcagctccatcagctccactctagattaatctcatag

SEQ ID NO: 185975 - DNA, 3771 bp, Artificial Sequence
  Description of Artificial Sequence: Synthetic coding sequence
atgagcgccgaggccagcgcccggcccctgcgggtgggcagccgggtggaggtgatcggtaagggccataggggcactgtggcctatgtcggcgcgactcttttcgccacagggaagtgggttggcgtcattctggatgaagcgaaaggcaaaaacgatggaacagtgcaaggtcgcaagtactttacttgtgatgagggacacggcatattcgtgagacagtcccagattcaagtgtttgaggacggcgcggatacaacttctccggagacccccgattcgagtgccagcaaggttcttaaaagagaaggcaccgataccacagctaagacaagtaagttacgcggacttaagcccaaaaaagcgccaacggcgcgcaaaactaccacacgacggccaaagccgaccaggcccgcttcgacaggagtcgctggcgcttcctccagcctggggccatctggctctgcctctgctggggagttgagctcatcagagccatccacgccagcccagaccccactggcagccccaattattcccacccccgtgttaacatcccctggtgctgtgcccccccttccttctcctagtaaggaggaggagggactgagggcccaggtgcgcgaccttgaggagaagttagagacacttcggttgaaacgggcggaggacaaggcaaagctgaaagagctggaaaaacataagatccaactcgaacaggtgcaggagtggaaaagcaaaatgcaggaacagcaggcggatttgcagagacgcttgaaggaggcacggaaggaagcgaaggaggctctggaggccaaagagcggtacatggaggaaatggccgataccgctgatgccatcgaaatggccaccctcgataaagaaatggccgaagaaagggctgaatcgctccagcaggaggtcgaggccctcaaggaacgcgtggatgagctgactacagacctcgagattctgaaggcggagattgaggagaagggctcagacggcgctgcaagctcttatcagttgaaacaactagaggaacaaaatgcgagattaaaggacgcacttgtgagaatgcgagatctgagctcatccgaaaagcaggaacatgtcaagctgcagaagctcatggagaaaaaaaaccaggaacttgaagtggtgcggcaacagcgagagagactccaggaggaattatctcaggctgagagcacaattgatgaacttaaagagcaagtagatgcggcgctgggggcagaagaaatggtagaaatgctcacggatcgaaatctaaacctcgaggagaaagttcgggagttgagagaaactgtcggggacttagaagccatgaatgagatgaacgacgaattacaggaaaatgcaagggagacagagctggagctaagagagcagctagacatggcgggagcacgcgtgcgtgaggctcagaaacgagtcgaggccgctcaggaaacagttgcagattaccagcaaactattaagaaatataggcagctaactgctcatctgcaggatgtgaacagagagctgacgaaccagcaggaggcctcagtggaacggcagcagcaacccccccccgagacattcgactttaagatcaagtttgccgaaactaaagcccatgcaaaagccatcgaaatggaactgcgacagatggaagtcgctcaggcgaaccggcacatgtccctgctgaccgctttcatgcccgacagttttctgcggccgggtggcgaccacgattgtgtcctggtattactgctgatgcctcggcttatttgtaaggccgaacttattaggaaacaggcgcaggaaaagtttgagctctccgagaattgctcagagagacctggactacgtggtgccgccggcgagcaactctcatttgcagccgggttggtgtactccctttctctgctgcaggcaaccctccatagatatgagcacgctttaagccagtgcagcgtcgatgtatataaaaaagtgggtagtctctacccggaaatgtccgcccacgaacgatctttggatttcctgatcgaactgcttcataaagatcagttggatgagactgtgaacgtcgagcctctgactaaggccatcaagtattaccagcatctctattccatccacctggcagagcagcccgaagattgtaccatgcaactagccgatcacatcaagttcactcagtcagccctggattgcatgtccgttgaggtgggtagactccgagcctttctacaggggggccaggaggccacggacatagcgttactgttgagggacctggagacttcttgcagcgacattaggcagttctgcaaaaaaataaggcgcaggatgcctgggactgacgcacccgggatcccagccgcgctggcttttggaccacaggtgtcagacactctgcttgactgccgcaaacatttgacttgggtggtggcagtgttgcaggaggtggcggccgccgccgcccagctaatagctcctctcgcggagaatgaaggccttctagtcgccgccctggaggagctggcctttaaagcgtccgagcagatatacggcacaccctcaagcagcccttatgaatgcctaaggcagagctgcaacatcctcatctcaactatgaacaaactggccacggccatgcaggagggggagtacgacgccgaacggcctccttccaagccaccccctgttgagctacgcgctgcggccctgcgcgctgaaataactgacgcggagggccttgggcttaaactcgaagatagagaaacagtcattaaagagctaaaaaaatccctgaaaataaaaggagaagagctcagcgaggccaacgtacgcctgtcccttctggagaagaaactggacagcgctgcgaaagacgctgatgaacggattgagaaagtgcagactcgcctggaagaaacccaggccctgctgagaaagaaagagaaggagttcgaagagactatggatgcactgcaagccgacatcgaccaactggaagccgaaaaggctgagctgaaacagagactgaacagccagtctaagcgcactatagagggactcaggggcccacctccctccgggatcgcgaccctggtgtccgggattgccggtggggctattcctggccaggctcctggaagcgtccccggcccaggccttgtgaaagatagcccgctactcctgcagcagatctctgcgatgcgactccatattagccaactgcagcatgagaacagcatactcaagggcgctcagatgaaagcatccctggcctcgcttccgcctttacatgtcgccaagctgagccatgaaggacctggctctgagctgccagctggcgcgttgtaccgaaagacctcacagttactcgagactctgaaccagctgtcgacccacacacacgtggtggacatcacacggacctcccctgccgccaagtcaccctcggcacagcttatggagcaagtcgctcagctgaagagcctatcagatacggtggagaagctgaaggacgaagtcttaaaggagaccgtttcccaaagacccggagctactgtcccgactgactttgcgacctttccttctagcgcttttctgcgagcaaaagaggagcaacaggatgacaccgtatacatggggaaagtcaccttctcctgtgcagccggatttggacagaggcaccggcttgtcttaacacaggaacaactgcatcaactgcattcgcgcctgatctcatag

SEQ ID NO: 185976 - DNA, 2673 bp, Artificial Sequence
  Description of Artificial Sequence: Synthetic coding sequence
atgagcgccgaggccagcgcccggcccctgcgggtgggcagccgggtggaagtgattggtaaaggccaccgcggtactgtcgcatacgtcggggccacgctgttcgccacgggtaaatgggtaggggtcatcctggatgaggcaaagggaaagaacgacggaactgtccaaggaaggaagtattttacatgtgacgaaggccacggcatttttgttagacagtcacagatccaggtgttcgaggacggagctgataccacctcacctgaaacccccgactcctcagcaagtaaggtccttaagcgggaaggcacagacaccaccgctaagacgtctaagctccctacaagacctgccagcaccggggtagctggcgcgtctagtagtcttggtccgtctggcagcgcttctgctggagaactgtcaagctcagagccaagcacacccgcacagacccctttggctgcccccatcattcccaccccagtgttaactagtcctggggctgtgccgcccctgccatcaccctccaaagaagaggagggcttgagggcccaggtccgcgatctcgaggagaaattggaaaccttgcgcttaaaacgagccgaagacaaggccaagctcaaggagttagagaagcacaagatacagctggaacaggtgcaggaatggaagagcaagatgcaggagcaacaggcggatctgcagcgacgtctgaaggaggctaggaaggaggccaaggaggccctagaagccaaagaacgctacatggaggaaatggccgataccgcagacgcaatcgaaatggctaccctcgataaagagatggctgaggagcgggcagagtctttacaacaggaggttgaagcgcttaaagaacgagtggacgaactgactacggacctggagattctaaaagcagagatagaagagaaaggctctgacggagctgcctcctcttaccagctcaagcagcttgaagaacaaaatgctcggttgaaagatgctttggtccggatgagggacttatctagttctgagaagcaagaacacgtcaaactgcaaaaactgatggagaaaaaaaaccaagaactcgaggtggtgaggcagcagcgcgagcgcttacaagaggaattgtcccaggcagagtcaaccattgatgagctgaaggagcaggtggacgccgctctgggtgccgaagaaatggtcgagatgctaaccgacagaaatctgaacctcgaggaaaaagtccgcgagctgcgcgaaaccgtgggagacttagaagcaatgaacgagatgaacgacgagctccaggagaacgcccgggaaaccgaactggagctgagagaacagttagatatggcaggggcgcgggtgcgggaagcgcagaagcgggttgaggcggctcaggaaaccgtcgccgactatcaacagactattaagaaatatagacaactcactgctcacctgcaggatgttaaccgggagcttacaaaccaacaggaggctagcgtggagagacaacaacaaccacctcccgagaccttcgacttcaaaattaaattcgctgagacgaaggctcacgccaaagccattgaaatggaattaaggcaaatggaggtcgctcaggccaacagacacatgtctcttctgactgccttcatgccggatagctttcttcgtcctggcggcgaccatgactgcgttttggtgctgctccttatgccccggcttatctgcaaagctgagcttataaggaagcaggctcaagagaagtttgaactctccgaaaactgtagcgagaggcctgggctgagaggagcagcgggagagcaactttcctttgcggctggactggtttattcccttagtctccttcaggcaaccctccacagatacgaacatgccctgagccagtgctcggtggacgtttacaaaaaagttggctccctttatcccgaaatgtccgcccatgagcgttctctggatttccttattgagcttctccataaagatcagttggatgaaactgtcaacgttgagccgctgaccaaagctattaaatactaccagcacctatactcaatacacctggcagagcagcccgaggactgcaccatgcagctcgcagatcatatcaaatttactcagagcgctctggattgcatgagcgtggaggtaggaaggctgagggccttccttcagggagggcaggaagccaccgatattgcccttctcctccgggatttagagacgagttgcagcgacattagacaattttgcaaaaagattcggcgccggatgcctggcacagacgctcctggaatccccgcagctctggctttcggacctcaggttagcgatacactcctggattgtagaaagcacctgacctgggttgtcgcagtcttgcaggaggttgctgcggcagccgctcaactgatcgctcctctggctgaaaacgaagggctgctagtggcagccctggaggaactggccttcaaagcttctgagcaggtgggcctcgacggatgggtggagggtgtagggagagtttctgaccagtgcggcgcctttaccagcgcattgggctcctgtcggagtatggggccccctcccgctgcccccatgtcggtatgtgccagccacgcaactagcagttctgtgccatag

SEQ ID NO: 185977 - DNA, 561 bp, Artificial Sequence
  Description of Artificial Sequence: Synthetic coding sequence
atgctgatgggcctgctgcggccctacatcctgggcgagcggggcactgtgatgaccccttcaggatcacgaatgtccgccgaagccagcgcccggcccctccgagtgggttcccgcgtggaggtcatcggtaagggccacagaggtacagtagcttacgtgggtgctacactcttcgccactggaaaatgggtcggcgtaatactcgatgaggccaagggcaagaacgatggtactgtgcagggccggaagtatttcacttgcgacgagggccacggcatatttgttcgccagagccaaatccaggtgtttgaggatggtgccgacacgacctcaccggagacccctgattcttcagcctctaaggtgttaaaacgagagggcaccgatacaaccgccaaaacatctaagttgaggggactgaagccaaagaaggctcctaccgccagaaagacaacaacccgtaggcctaagcccacccggcctgctagcacaggcgtcgcgggtgccagtagctccctgggcccctcaggctccgcctctgccggcgaactcagctag

SEQ ID NO: 185978 - DNA, 3711 bp, Artificial Sequence
  Description of Artificial Sequence: Synthetic coding sequence
atgagcgccgaggccagcgcccggcccctgcgggtgggcagccgggtggaggttatcgggaagggccatcggggaactgtggcgtacgtgggagccactctctttgcaaccggtaaatgggtgggagttattctggacgaagccaagggcaagaatgacggtactgtgcaggggcggaaatactttacttgcgacgaaggtcatggtatttttgtccgccagtctcaaatacaggtatttgaagatggggcagacaccacaagcccggagaccccggactctagtgccagcaaggtcctcaagagggaggggacggacactactgctaaaacgagcaaactgcctacaagacccgccagtaccggggtagctggtgcctcgagttccctcggaccaagcgggtccgctagcgctggggaactgtcgtcaagcgaaccctccaccccagctcaaactcccctggcagctcctataattcccacacccgttctcacctcccctggtgctgtgccccctttgccatcccccagtaaagaggaagagggtctcagggcacaggtgagggatctggaggaaaaattggagacactcaggctgaagcgagccgaggacaaagccaagctgaaggagttggagaagcacaagatccagttggagcaggtgcaggagtggaaaagtaagatgcaggagcagcaggccgaccttcagagacgtttgaaggaagccaggaaagaggccaaagaggcacttgaggccaaggagcgctacatggaggaaatggcagatacggctgatgcgatagagatggccacattggacaaagagatggccgaggagagggccgagagcttgcaacaggaggtggaagcactgaaagagagagtcgacgagctgactactgacttggagattttgaaggctgaaattgaggagaaagggagtgatggcgccgctagctcttatcaacttaaacagttagaagagcagaatgcaaggctcaaagatgcattggtgcgaatgcgcgacttatcatccagtgagaagcaggagcacgtgaaactccaaaagttaatggagaagaagaatcaggaactggaggtggtgcggcagcaacgcgagcgtctccaggaggaactttcccaagccgagagcactattgatgaactcaaagaacaggttgacgccgccctgggcgcagaggaaatggtggaaatgctgaccgatcgtaacctcaatttggaggagaaggtccgggaactgcgcgagaccgtgggcgatctggaagccatgaacgagatgaatgacgagctccaggagaatgcacgggagacagagctggagctgagagagcagctcgatatggccggggctagggtccgggaggctcaaaaacgagtagaggcagcacaggagacagtcgctgattatcaacagactataaaaaagtaccgccaactaactgctcacctgcaagatgtgaacagagaacttacgaaccaacaagaggcctcggtggagagacaacagcagcctccccccgagacctttgatttcaagattaagttcgctgagacaaaggcccatgcaaaggccattgagatggaactccgacaaatggaagtcgcccaagcgaacaggcatatgtcactattgactgcattcatgccagattccttcctgaggcctggtggggatcacgattgcgttcttgttctccttctcatgcctcgtcttatctgtaaggctgaactgattcgaaaacaggcacaggaaaaatttgagctgtccgagaactgtagcgaaaggcctggactgaggggagccgcaggcgaacagttgagttttgcggccggcctcgtgtatagtttgagcctgctgcaggcaaccctccatagatacgaacacgccctctcccagtgctctgtcgacgtttacaagaaagtgggctcgctctatcctgagatgagcgcccacgagaggtctctcgacttcctgatcgaacttctgcataaagaccagctcgatgagacggtcaacgtagagccattgactaaggccattaagtactatcaacacctgtattccatacatctggccgaacagccagaagattgcactatgcagttagctgaccacatcaagttcacgcagtccgcccttgactgcatgtcggtcgaagtaggcagattgcgcgcctttcttcagggcggacaggaggctactgatattgccctcctcctccgcgacctggagactagctgtagtgacattaggcagttctgcaagaaaatcagaagaaggatgccgggtaccgatgcacccggcattccagctgctctcgccttcgggcctcaagtatctgacactctgctggattgtaggaagcacctcacttgggtcgttgccgtactgcaggaagttgctgctgcggcagcccagttgatagctccccttgctgagaacgaggggctcctagtggcggccctggaggagcttgcttttaaggctagtgagcagatttacgggaccccctctagcagtccctacgaatgtctgcgtcagtcctgtaatattctaatctccactatgaacaaacttgcgaccgcaatgcaggagggagaatatgacgccgaaagaccgccttccaagccaccacccgtggagctccgcgcggccgcactccgtgccgagattacagatgcggaggggttgggcctcaagcttgaagaccgggaaaccgtaattaaagagttaaagaagagtcttaagattaaaggggaggagctgtctgaggctaatgttcgcctgagcctgttggagaaaaagctcgactccgccgcaaaagatgcagacgagagaatagaaaaggtgcagaccagattggaagagactcaggctctcctcagaaagaaagaaaaagagttcgaagagaccatggacgcactccaagcggatatcgatcaacttgaggccgaaaaggccgagctcaagcagcgcctgaactcccagtctaagaggacaatcgaaggcttacgcggtccgcccccctccggtatcgccactctggttagcgggatcgccgggggcgctatcccaggtcaggcaccagggagtgttccgggcccagggctagtaaaggatagtcccctcctgttgcagcagatctctgctatgcgcctgcatatctctcagcttcaacacgagaattccattctgaaaggggcccagatgaaggcgtcgctggcatccctgcctcccctacacgtggcaaaattatcgcacgagggaccaggaagtgaacttccagcgggggctctgtataggaaaacgagccagctactggaaaccctgaaccagctgtccactcacacccacgtcgtggacatcacacgcacctctccggcagccaagagcccctccgctcagctgatggaacaggtcgcccaactaaaaagcctctcagatactgttgaaaaactgaaagatgaagtcctaaaggagacagtttcccagcgtccaggtgcgaccgtgccgacagatttcgcaacatttccatcaagtgcgtttttgagagcaaaggaggagcagcaggacgacactgtttatatgggtaaagtaacattcagctgtgctgctggattcggtcagcgccacaggctcgtcttgacccaggagcagctccatcagcttcattctcgcctcatctcttag

SEQ ID NO: 185979 - DNA, 3420 bp, Artificial Sequence
  Description of Artificial Sequence: Synthetic coding sequence
atgatgcggcaggcccccaccgcccggaagaccaccacccggcggcctaagcccaccaggccggcatcaactggcgtcgccggcgcaagtagctctctgggtcccagcggatccgccagtgccggcgaactgtcttcgtcagagccatctaccccggcacagacacccctggccgcccccattattccaacacccgtactgacttcaccaggtgctgtcccgcctcttccttctccatccaaagaggaagagggcttgcgggcgcaggtcagagatttggaggagaaattagagactttacggctcaaacgcgccgaagataaggccaaactgaaggaactcgaaaaacacaagattcagcttgaacaagtacaggagtggaagagtaaaatgcaggagcagcaggctgatctgcagaggcgcctgaaagaggctcgtaaagaagcgaaggaggctctggaggcgaaggaaagatacatggaggagatggccgacactgctgacgcaatagagatggccactttagataaggagatggccgaggagagagcagagagtctgcagcaggaagttgaggcactgaaggaaagggttgacgaactcaccacagacctggagattctcaaggctgaaatcgaggagaaaggcagcgacggcgctgcaagcagctaccagctgaagcaactcgaggagcagaacgcgcgcctgaaagatgccctagtcagaatgagagacctgagctcatccgaaaagcaagagcacgtgaaactgcagaaactgatggagaagaaaaaccaagagctcgaggtggtgcgccagcagagagagagactgcaagaggaactttctcaagccgagtcgacgatcgacgaattgaaggagcaggtcgacgctgctctgggagccgaggagatggttgagatgttaaccgaccggaacctgaatctggaggagaaagttcgcgaacttcgcgaaaccgtcggtgatcttgaggccatgaacgagatgaacgacgagctgcaggagaatgctagggaaaccgagttagaactgcgggaacagctagatatggcgggcgctagagttcgcgaagctcagaaacgagtggaggctgcacaggagacggtggctgactatcagcagactatcaagaaatataggcaacttacggcacatctgcaagatgtaaatagggaactgaccaaccagcaggaggccagtgttgagcgacagcagcagcccccgccggagacatttgactttaagatcaagtttgctgagaccaaggcacatgccaaagccattgaaatggagctccgccagatggaagtggcccaggctaaccggcatatgtccctcttaactgcctttatgcccgacagcttcttacgtcctggtggcgaccatgattgtgtgctggtgttgcttctcatgccccgactgatctgcaaggccgagctgatccgcaagcaggctcaggaaaaatttgagctgtcggagaattgcagcgaaaggcccggcctgaggggcgctgctggggaacaattgtcttttgccgctggcctggtgtactctttgtctctccttcaggcgacattgcacagatacgaacatgccctgagtcaatgcagcgtagacgtctacaaaaaggtcggatctctgtatccggagatgtcagcacatgaaagatccttggattttctaattgaactgctgcataaggatcagctggatgaaaccgtgaacgttgagccattaacaaaggcgattaagtactatcaacacctttactctattcatctggctgagcagccagaggattgtaccatgcagcttgcagatcatatcaagttcacccagagtgctctggactgcatgtcagtagaagtgggacgcctgagggcttttctccaggggggacaggaggccactgatattgctctgctgctgcgtgacttagagacttcctgctccgatatccggcagttttgtaaaaagatccgccggaggatgcccggcaccgacgcccctggcataccggctgcgctcgccttcgggccccaggtctccgacacattgcttgattgtcgaaaacaccttacttgggtggtggctgttttgcaagaggtcgccgctgccgccgctcagctaatcgcccccttagccgagaacgaagggctgttagtagccgccttggaagagttggccttcaaagctagcgagcagatctatggcaccccctcatcttcaccttacgaatgcctcagacaatcatgcaatatcctcatttccaccatgaataaactggctaccgccatgcaggagggcgagtacgatgccgaaaggccacctagcaagcccccacctgtagagctgagagctgccgccctgagagccgagatcacagacgccgaggggctcggcctgaagttggaggacagggagaccgtgatcaaggaactgaagaagagcctgaaaattaaaggtgaggaattgagcgaagctaatgtccgtttgtctctgctcgaaaagaagcttgactccgcggccaaagatgccgacgagcggattgagaaagtacagaccaggctggaggagacacaggcactcctgcgaaagaaggagaaggaattcgaggaaacaatggacgcgttacaagccgatatcgaccagctggaagccgagaaggccgaactgaaacagcggcttaacagtcagtcaaagcgaactattgaagggctacgggggccgccgccttcaggaattgctacacttgtgagtggaattgccgggggggctatccccggtcaagcccccggttcagtccccggacctgggctcgtcaaagatagccccctgctccttcagcagatctccgctatgcgtcttcatatttcacagctccagcatgagaattctattttgaagggggcccagatgaaggcatctctggcgtctcttcccccactacacgtagccaagctgagtcatgagggccccggcagtgagctccccgctggtgctttgtataggaagacttcccagctcctcgagacccttaaccagcttagcacccacacccatgtagtggacattacacggacatcccccgcagccaagtccccatcggctcaattaatggaacaggttgcccagctgaagtccctgtccgataccgtcgagaaactgaaagatgaggtgctcaaggagacggtctcccagcgccctggagcaaccgtgccaacagacttcgcgacgttcccatcctccgccttcctacgcgccaaggaggaacagcaggacgacactgtttacatgggcaaggtcaccttctcttgcgcagctggatttgggcagagacatcggttggtgctcactcaggagcaactgcaccagttgcatagtagacttatttcctag

SEQ ID NO: 185980 - DNA, 3762 bp, Artificial Sequence
  Description of Artificial Sequence: Synthetic coding sequence
atggcccagagcaagcggcacgtgtacagccggacccccagcggctcgcgtatgtccgccgaggcatccgccagaccactacgtgtggggtctcgggtggaggttatcgggaaaggacacagggggaccgtggcatacgtcggcgcgaccctatttgccacagggaaatgggtcggcgttatcctggacgaagctaaaggcaagaacgacggtacagttcagggtagaaagtatttcacttgtgacgaaggacacggcatcttcgtaaggcagtcccaaattcaggtgtttgaagacggtgccgatacaacttcccccgagactcccgactctagtgccagtaaggtcctcaagagggaaggaacagatactaccgctaaaacctcaaaactgcccaccaggcctgcatccactggggtggccggcgcgtcctcttctctcggaccttcgggctctgccagcgccggcgaactcagtagctctgaaccatccacccctgcacagactcccttagcagctcctattataccaactcctgtcctcacaagcccaggagcggtgccacctctgccttctccatcgaaggaagaggagggcctgcgagcccaggtcagggatttggaagaaaaattggaaaccttgcgacttaagagggccgaagataaggccaaacttaaggagttagagaaacataaaattcagctggaacaggtgcaagagtggaaatccaaaatgcaagagcaacaggcagatttacagcgtcggcttaaagaagcgagaaaggaagcaaaggaggcattggaggccaaggagaggtatatggaagagatggcagataccgcagacgctatcgaaatggcaactcttgataaggagatggccgaagaacgcgcggagagcctgcagcaggaggtcgaggcgctgaaggaaagagtggacgaattaactaccgatttggaaatcctgaaagccgaaattgaagagaagggtagtgatggcgccgcgtccagttaccagctcaagcagctggaagagcaaaacgcccggctgaaagacgcactggtgagaatgagggatctctcttcaagtgaaaaacaggagcacgtgaagctgcagaaactcatggaaaagaaaaaccaagaactcgaagtagtgagacaacagcgggagcgactgcaagaagagttgtctcaggctgaatctacgatcgacgagctcaaggaacaggtggacgctgcactcggagctgaggaaatggttgaaatgctcacagatcgtaatctgaacttggaagagaaagtgagagagctgcgggagacggtgggcgacctggaggcaatgaacgagatgaacgacgaacttcaggagaatgcaagggaaacagaactggaacttagagaacagctggacatggctggcgcacgggtccgcgaagcacagaagcgagtggaagctgcgcaggagaccgtggccgactatcaacagactatcaagaaatacaggcaactcaccgcccacttgcaggacgtgaatagagagctgactaatcaacaggaggcttcggtggagcgccagcaacaacccccaccagagacattcgactttaagataaaattcgccgaaactaaggctcacgccaaagcaatcgagatggaattgcgccagatggaagtagctcaagcaaacaggcacatgtcactgctcaccgctttcatgccagatagcttccttcgcccaggtggggatcacgattgtgtgcttgtgctattgctgatgccaaggttgatctgcaaagccgagttgatccgtaagcaggcacaagagaagttcgagctgagcgagaactgttcagagcgcccgggtctccggggagcggctggggagcagctgagcttcgccgctggcctggtgtactccctgtccttgctgcaggctaccctccacagatatgagcatgccctcagccagtgttctgtggatgtgtacaagaaagtgggctccctctatcccgaaatgagcgctcacgagcggtcacttgatttcctgatcgagttgttgcataaagaccagttggatgagaccgtcaatgttgaacctctcacaaaggccattaagtactaccaacacttgtattctattcacctggccgagcagcccgaagattgcacaatgcagctcgcagatcacattaaattcacccagtccgctctggactgcatgagtgtggaagtgggcagactgcgcgccttcttacagggtgggcaggaggcaaccgatattgcgctgcttctgagggaccttgaaacttcctgcagcgatattcgacaattctgtaaaaagattaggcgacggatgccagggactgacgccccaggcattccagcagcccttgctttcgggcctcaggtatccgacacactgctggactgccggaagcatctgacgtgggtggtcgccgtcttgcaggaagtggccgcagcagccgcacagctgatagcgcctttggccgagaacgaaggactcctggtagcagctctcgaggaactggcctttaaggcctcagagcaaatatacggcactccctccagcagcccttacgaatgtttaaggcagagctgcaatatacttatcagcacaatgaataagctggccactgctatgcaagaaggagaatacgatgccgaacgtcctccatctaagcctccacccgttgagctgcgagccgctgccctgagggctgaaatcaccgatgcagagggattgggccttaaactcgaggaccgcgagactgttataaaggagctgaagaagagcctcaagatcaagggagaggagcttagcgaagccaatgtaagactgtcacttttggaaaaaaaattggatagcgccgctaaggacgctgacgaacggatcgagaaggtgcagacaagactggaagagacccaagcactcctgcgcaagaaggagaaagagtttgaggaaacaatggacgcgctacaggcggacatcgatcagctcgaagcggagaaagccgagcttaaacaacgtctaaatagccagtcgaaaaggacaatcgagggactgcggggcccaccacctagcggcattgccaccctggtaagcggcatagctggtggcgccatacccggtcaggcccccgggtcagttcccggtccaggtctcgtcaaggacagtccgttgttgctacagcagatctcagcaatgcgcttacacatcagccagctccaacacgaaaatagcatcctcaaaggggctcagatgaaagcctctttggcaagcctcccacccctgcacgtggccaagctgtctcatgagggcccgggaagcgagctccctgcaggtgccttgtaccggaaaaccagccagcttttggaaacactgaatcaactatcaactcacacccatgtggtcgatatcacacggacgtctcctgctgcgaagagtccctctgcccaactcatggagcaggtggctcagcttaagtcacttagtgacactgttgaaaaattgaaggacgaggtgctgaaagagacggtctcccagcgtcctggtgcgacagtacctacagattttgcaacttttccctctagcgccttcctgagagccaaggaagaacagcaggatgataccgtctacatgggaaaagtcacattctcttgtgccgcagggttcggacaacgtcaccggctcgtcctgacacaggaacagcttcaccagctccacagtaggctgatctcctag

SEQ ID NO: 185981 - DNA, 1221 bp, Artificial Sequence
  Description of Artificial Sequence: Synthetic coding sequence
atggccgaccccaagtacgccgacctgcccggcatcgcccggaacgagcccgacgtctatgaaactagtgatcttccagaagacgaccaggcggaattcgatgccttcgcgcaggagctggaagaattaacttccacatctgtggaacatattatcgtcaatcctaatgcagcatatgacaagttcaaagataagagagtggggactaaaggactcgatttctctgatcgtatcggaaaaaccaagaggaccggttacgagagtggtgagtatgagatgctaggcgagggcctcggggtcaaggaaacgccgcaacagaaatatcaaagactgttacacgaggtgcaggaactgacaacagaggttgagaaaattaagacaactgtaaaggaatctgctactgaagagaagctgaccccagtgctgttagccaagcagctagcggctctcaagcagcagcttgtcgcatcccacctggagaaacttctgggtcccgatgctgccatcaatctgacggacccagatggagcgcttgccaagcgcttgctcctccagcttgaggcaacaaagaattctaagggcggatcaggaggcaagaccaccgggacacccccggatagctcattagtgacttacgaactgcacagtcgccctgagcaggataaattcagtcaggctgctaaagttgcagagcttgagaaacgcttgacagagctggaaactgccgttcggtgtgaccaggatgctcagaacccactgtcggctggattgcagggcgcctgcttaatggagacggtggaacttctgcaggccaaagtgtctgccctcgatcttgcagtcctggaccaggtggaagcacgtctccagagtgtgttaggtaaggtaaatgagattgctaagcataaggcatccgtagaagacgcagatacacagagcaaggtgcatcaactctacgaaacaatccagagatggagtcctatcgcctccacactaccagaacttgtgcagcggctagtaacaattaagcagctccacgaacaggcgatgcaattcggacagcttctgacacatctcgataccactcagcagatgattgcaaactcactgaaagacaataccacgctcctgacacaggtccagacaactatgagagaaaacctggccactgtcgaagggaatttcgctagcatagacgaacgcatgaaaaagctcggcaagtag

SEQ ID NO: 185982 - DNA, 1137 bp, Artificial Sequence
  Description of Artificial Sequence: Synthetic coding sequence
atgtacgcccagggcaccgaggacagccggaccctggaggagctgactagcacctccgtggagcacatcatcgtgaacccaaacgccgcttacgataaatttaaagacaagagagtgggaacgaagggcctggacttcagcgacagaattggcaagacaaaacggacgggctacgagagtggagagtatgaaatgcttggagagggattgggcgtcaaggagacaccgcagcagaagtatcagcgactattgcacgaggtgcaggagcttacgactgaagtggagaaaatcaaaaccacagtgaaagagagtgcgaccgaggagaaattgaccccggttctgctcgccaagcagcttgctgccctcaaacaacagcttgtcgcatcccacttggagaagttactcggcccggatgcagccattaatctcaccgaccctgacggcgctctggcaaaacgactactgctccagctagaggctacaaaaaactcgaagggcggttcagggggcaaaaccacgggcacacctccagactcttctctggtcacatatgaactgcattcgcggcccgagcaggataagttctcccaagcagccaaagtggccgagctggagaaacgcttgaccgaactagagaccgcagtgcgctgcgaccaggatgcccagaaccctctgagcgctggcttgcagggggcctgccttatggagacagtcgagttactgcaggctaaagtcagcgctttggacctagctgtcctcgaccaggtggaagcacggctgcagtcggtattggggaaagttaatgagatagctaagcacaaagcgagtgtagaggatgcggacactcagtccaaggttcatcagctgtacgagacgatccaacgctggtcaccaatcgcatctactctacccgaacttgtacagcgtcttgtcacaatcaagcaactgcacgaacaggcaatgcaattcggacagctgcttacacacctggacactacacagcagatgattgctaactcccttaaagataatacaacactcctgacccaagtacaaactacaatgagggagaatctggctactgtcgaaggtaacttcgccagtattgatgagcggatgaagaagttgggtaaatag

SEQ ID NO: 185983 - DNA, 945 bp, Artificial Sequence
  Description of Artificial Sequence: Synthetic coding sequence
atgctgggcgagggcctgggcgtgaaggagaccccccagcagaagtaccagcgattgctgcatgaagtgcaagaactaacaacagaagtggagaagatcaagacaactgtcaaagagagcgcaactgaggagaaactcactccagtgcttttagctaagcaattggcagcgctgaaacagcagttggtcgcaagtcacctggagaagctgctgggccccgacgccgccatcaatctaactgacccggacggcgccctcgcaaagcggctgctcctccaactggaggctacgaagaacagcaaaggcggaagcggcggaaaaaccacaggaacccccccagatagcagcctggtcacttatgagcttcactcccgaccagaacaagacaagttttcccaagctgccaaggtagccgagcttgaaaagaggcttacagaattagagacggccgtgagatgcgaccaggatgcccagaatcctttgtccgcagggctgcaaggcgcctgcttaatggagaccgtggagttattgcaagcaaaggtaagtgctctggacctggcggttctggaccaggtggaagccagactccagagcgtactgggcaaggtgaacgaaatagcaaaacataaggcaagcgtcgaggacgcagacacacaaagtaaggtgcaccagttgtacgaaacaatccagaggtggtcacccattgcttctactctgccagaactggtccagagactggtgacaattaagcaattacatgagcaggcaatgcagtttgggcagctgctcacgcacctggacaccacccagcagatgatcgcgaatagtctgaaggacaacacaactctgctgactcaagtccagaccacaatgcgggaaaacctggccacggtggagggaaatttcgcctcgatagatgaacggatgaagaaactgggcaaatag

SEQ ID NO: 185984 - DNA, 1221 bp, Artificial Sequence
  Description of Artificial Sequence: Synthetic coding sequence
atggccgaccccaagtacgccgacctgcccggcatcgcccggaacgagcctgatgtgtatgaaaccagcgatctgcctgaggacgatcaagcagaattcgatgccacagtgcaacacttagaggagctaacctctacatctgtggaacacatcatagtcaaccctaacgcagcctatgataaattcaaggataagcgcgtgggaactaaagggctggactttagtgaccggattgggaaaaccaagcgcacaggttacgaatctggtgagtatgagatgctgggcgaaggactgggcgtaaaagagactcctcaacaaaaatatcagcggctccttcacgaagtgcaggaactgaccaccgaggttgagaagataaaaacgaccgtgaaggaatcggccaccgaagaaaagctgaccccagtgctcctcgccaaacaactggctgccctgaaacaacagctcgttgcgtctcatctggaaaaactgctcggtcctgatgccgctattaatctgacggatcctgacggcgctctcgccaaaagactgctgctacagctagaagccacaaagaatagtaaaggcggcagcggaggcaagacgaccggtacacctccagactcctcgctggtgacatatgagctgcatagcagaccagagcaagataaattcagtcaagccgctaaggttgccgaacttgaaaagaggctgacagagctggaaacagctgtgcgctgcgaccaggatgcacagaaccccctgagcgccggattacagggggcctgtctcatggagacagtggaactcctccaagccaaagtttccgctttagacctcgcagtcctggaccaagtggaagcccgcctgcagagcgtgcttggcaaggtgaacgagatagccaaacacaaggcctctgttgaagacgcagacacgcaatccaaggtgcatcaactgtacgagacgattcagcggtggagtcctattgccagcactcttccggagctggtgcaacggctcgtgactatcaaacagttacatgagcaggccatgcagttcgggcagctactgacacatctggacaccacccagcagatgattgccaacagtctgaaggacaacactaccctgcttacccaggttcagactacgatgcgagaaaacttggccactgtcgaaggcaactttgctagtattgacgagcgaatgaaaaaactcggtaaatag

SEQ ID NO: 185985 - DNA, 1206 bp, Artificial Sequence
  Description of Artificial Sequence: Synthetic coding sequence
atggccgaccccaagtacgccgacctgcccggcatcgcccggaacgagcctgacgtgtacgaaacttcagatcttcccgaggacgaccaggctgagttcgatgcggaggaattgacctcgacatcagtggaacacatcatagtgaacccgaatgccgcttacgataagttcaaggataaaagggtcggtactaaaggcttggacttcagtgaccggatcggaaagacaaaacgtactggttacgaatctggcgaatacgagatgctgggtgagggcctgggagtgaaggagactccacagcagaagtaccagagactgctccatgaggtccaggagctgacaactgaggtagagaaaataaagacgaccgttaaagaatctgctaccgaggaaaaactaacccccgttttgctggcaaagcagttagcagctctgaaacagcaactcgtggcttcacacctcgaaaaactacttggtccggacgcagccataaatctgacggaccccgatggggctctggcgaaacggttactgctccagcttgaggctacaaaaaactctaaaggtggctccggagggaagactaccggaacacctcccgactcctccctcgtcacatacgaacttcattcccggcccgaacaggataaattctcacaggccgcaaaagtggccgagttggagaagcgcttgacggaactggagactgccgtgaggtgtgatcaagatgctcaaaaccccttaagtgcgggtcttcaaggggcttgtcttatggagactgtagagctgctacaagcaaaggtgagtgccctggatctggccgtgctggatcaggtggaggcccgactccagtctgtcctgggcaaagtgaatgagatcgccaagcacaaggcaagtgttgaagatgcggacacccagagcaaggttcatcagttatatgaaactatccaaaggtggagccccattgccagtaccctccctgaactggtgcagcggttagttacaattaagcagctccatgaacaggccatgcagtttggccagctactcacccatctggacactactcaacagatgatcgcaaatagtctgaaggataataccactctgttaacacaggttcagactaccatgcgcgaaaatctggctacagtcgaagggaactttgcttccatcgacgagaggatgaagaaattagggaaatag

SEQ ID NO: 185986 - DNA, 561 bp, Artificial Sequence
  Description of Artificial Sequence: Synthetic coding sequence
atggccggcctgaccgacctgcagcggctgcaggcccgggtggaggaactggaacggtgggtatacggccctggaggagcgaggggttctaggaaggtcgctgatgggctggtaaaagttcaggtggcgttgggtaatatctcatcaaagagggaacgcgtaaagattctctataaaaagatcgaagacttgattaagtatctggatccagaatacatagatcggatagcgatccctgatgcttctaaattgcagttcatcctggctgaagaacaatttatcctcagtcaagtggctctgctggagcaagtcaacgccttagtgcctatgctggatagcgcccatatcaaagccgtgccagagcacgctgcccggctacagcgcctggcacagattcatattcagcagcaggaccaatgtgttgaaatcactgaggaatccaaagccctgcttgaagaatacaataagacaactatgctgctgtccaaacagttcgtgcaatgggacgaacttctatgccagcttgaagccgcgactcaagttaagcccgcagaggaatag

SEQ ID NO: 185987 - DNA, 531 bp, Artificial Sequence
  Description of Artificial Sequence: Synthetic coding sequence
atggccggcctgaccgacctgcagcggctgcaggcccgggtggaggaactcgagaggtgggtatacggacctgggggagcacgaggctcccggaaggtagccgacgggctagtgaaggtgcaagtggctttgggcaacattagtagcaaaagggaacgcgtgaaaatcctgtacaagaagatcgaggatctgattaaatacttagacccagagtacattgatcgaatcgccataccagatgcgtccaagttacagttcatcctggcagaagagcagttcatcctgagtcaggtggctctgctggaacaggtaaacgcactagtgcccatgctggactctgcccacatcaaagccgtcccagagcacgccgcccgcctacaacgactagcacagatccatattcagcaacaggcaccttggggtgtaggagttagagacgaggctgggtcgctcgtggaggacgttggattcgcccagtttctatctgtcttacactttggccccacaggcccggtctgtggcaaccactag

SEQ ID NO: 185988 - DNA, 486 bp, Artificial Sequence
  Description of Artificial Sequence: Synthetic coding sequence
atggccggcctgaccgacctgcagcggctgcaggcccgggtggaggagctcgagagatgggtgtacggacccggtggggctagaggttcgaggaaggttgcagatggattggtcaaggtgcaggtagccctggggaatatatcttccaaaagagagcgcgtcaaaatcctgtataagaaaatcgaggacctcatcaagtacctggaccctgaatacatagaccggattgccatccccgacgcatctaagctccagtttattctggccggaaacgccggcctacatgtgtatatgcacctgaggatgtgggtcgtaggcgaagtgaagcatcgggacggactgagtatacagtctagcggcgggtacaagccttggatgctcctgtcaggaatcgtggcctggttttgggtggaagaccccatggatccgctggtcgatatcgaatactcaatacctcttcatcagttacaggccatggtaccttag

SEQ ID NO: 185989 - DNA, 315 bp, Artificial Sequence
  Description of Artificial Sequence: Synthetic coding sequence
atggccggcctgaccgacctgcagcggctgcaggcccgggtggaggagctggaaaggtgggtgtacggcccaggcggcgccagaggctcaaggaaggtggcggatggcttggttaaagtgcaagtggcattgggcaacatttcatcaaagagggagagggtgaagatcctgtataagaaaattgaggatttgatcaagtatctggatccggagtacatcgaccgtatcgccattcccgacgcatcaaaattacagttcatccttgctgagcggtcttccctgtcctttccccgcctccatagttggagtagatag

SEQ ID NO: 185990 - DNA, 477 bp, Artificial Sequence
  Description of Artificial Sequence: Synthetic coding sequence
atggccggcctgaccgacctgcagcggctgcaggcccgggtggaggaattagaacgttgggtgtatggccccgggggcgctcgcgggtctagaaaggtcgcagacggtctggtgaaagtccaggttgccctcgggaatatctcctctaaacgcgaacgagtaaagatcctatataagaaaatcgaggacctcattaagtatctggatccagaatacattgaccggatcgcaatccctgacgcgagcaaactgcagtttatcttagcggcagtgcccgaacatgcagcgaggttacagcgattggcacaaatccacattcagcaacaagaccagtgtgtcgagataaccgaggagtccaaggccctgttagaagaatataacaaaactacgatgctgcttagcaagcagttcgttcaatgggatgagttgctttgtcaacttgaggcagcaacccaggtgaagccggcagaagagtag

SEQ ID NO: 185991 - DNA, 456 bp, Artificial Sequence
  Description of Artificial Sequence: Synthetic coding sequence
cagcggctgcaggcccgggtggaggagctggagcggtgggtgtacggacctggcggggcgcgcgggtcaaggaaggtagccgacggtctcgtcaaggtgcaggtagcactaggcaatatctcttctaaaagggagcgcgttaaaatactgtacaagaagatcgaggatctcatcaagtaccttgatcccgaatatatcgatagaatcgctattcctgacgcctccaaactgcaatttatactggccgccgtccccgagcatgctgcaaggctccagagactcgcacagattcacattcagcagcaagaccagtgcgtcgaaatcacagaggaatcaaaagccttgctggaggagtataataaaaccacaatgttactgtctaaacagttcgtgcagtgggatgagctgctgtgccagctcgaggccgctacccaggtcaagcccgccgaagagtag

SEQ ID NO: 185992 - DNA, 519 bp, Artificial Sequence
  Description of Artificial Sequence: Synthetic coding sequence
atggccggcctgaccgacctgcagcggctgcaggcccgggtggaggagctggagcggtgggtatatggccctggcggtgcccgaggttcacgtaaggtggcagacggactcgtgaaggtgcaggttgcgttagggaatattagcagtaaacgcgaacgcgtcaagatattatacaagaagattgaggacttaattaagtatctagaccctgaatatatcgataggatagctatcccagatgccagcaagctccagttcattcttgctggaaatgcaggactgcacgtgtatatgcacctgaggatgtgggtggtcggagaagtgaagcatcgagacgggttgagtattcaaagctctggaggatataaaccctggatgctgctgtctggtatagtggcctggttttgggtagaggaccccatggatccattggtcgatatagaatattctatacccctgcaccagttgcaggccatggttccggctacggtaggggccagcccagtgttctaccagtag

SEQ ID NO: 185993 - DNA, 549 bp, Artificial Sequence
  Description of Artificial Sequence: Synthetic coding sequence
atggagctgggcgagctgctgtacaacaagagcgagtacatcgagacagcatccggcaataaagtctctagacagagtgttctctgcggcagtcagaacattgtgctcaacgggaagaccattgtgatgaacgactgcatcatacgtggagacctggcaaatgtgagggtgggaagacactgcgtggtgaagagccgatccgtgataagaccaccattcaagaagttcagcaagggggtagcatttttccctctgcacatcggtgatcatgtctttatcgaggaggattgtgtggtgaatgctgcccagatcggaagttatgtccacgtgggtaagaattgcgtcatagggcgcaggtgtgtgctcaaggattgctgcaagatactggacaatactgtactaccacctgaaactgtagtgcccccattcacggtattctccggctgtccaggcctgttctctggtgaattgccggagtgcacccaagaacttatgatcgatgtgaccaagtcctactatcagaagtttcttcctttaactcaggtgtag

SEQ ID NO: 185994 - DNA, 255 bp, Artificial Sequence
  Description of Artificial Sequence: Synthetic coding sequence
atggagctgggcgagctgctgtacaacaagagcgagtacatcgagaccgccagcggcaacaaggtttcgaggcagtcagttctgtgcggctcacagaatatagtgctgaatggcaagaacttcgtcataagcgtcttcctgagcccctacattcgatgccattctgcctgccgggacaggaagagaagtgatgaatcggttagactgagtgtgaataaccgggagtggtggggcctcgttaactggagaatgtag

SEQ ID NO: 185995 - DNA, 1650 bp, Artificial Sequence
  Description of Artificial Sequence: Synthetic coding sequence
atggagttcgccgagctgatcaagaccccccgggtggacaacgtggtcctacaccgcccattctatcccgcagtcgaaggcaccctgtgcttgaccggccaccatctcatactgtctagcagacaagataatactgaggaactatggctgctccactccaacattgacgcgatagataagcgattcgtgggttccctaggtactatcattatcaaatgcaaagactttagaattatccaactcgacatcccagggatggaggagtgcctgaatatcgcctcttccatcgaagctttatctaccctggatagtatcacgctgatgtacccctttttttaccgccccatgtttgaagtgatcgaggacggatggcattcctttctaccggaacaggagttcgagctgtattcctccgcaacttccgagtggcgattaagttatgtcaacaaggaattcgcagtgtgcccttcatatcctcccattgtcacagtacctaagtcgattgatgatgaggccttaagaaaagtggctactttccgtcacggggggcggtttccggtcttaagttattatcacaaaaaaaacggcatggtgattatgagatccgggcaaccactgaccggaaccaacggaagacgctgtaaagaagacgagaagcttatcaatgctactctgcgggctggaaaaaggggttatatcatagacactaggagccttaacgtggctcaacagacgcgagccaagggggggggtttcgaacaggaagcacactacccgcagtggcgaaggatccacaagtctatcgagcggtaccacatcttgcaggagagcttaattaagctggtggaagcctgtaacgatcaaactcataacatggatcgctggctttcaaaactcgaggcttcaaactggctcactcacatcaaagagatactgactacagcttgcttagcagcccagtgtatcgaccgcgagggtgcatccatactgatccatggcaccgagggaaccgattccactttgcaggtcaccagcttggcccagatcatcctggaacctagaagcaggaccatccgcggctttgaggctctcattgagcgggaatggctgcaggcaggccaccccttccagcagcggtgcgcgcagtcagcctactgtaatacgaagcagaaatgggaggcacctgtgttcctgctgtttctggactgtgtttggcagattctccgacagtttccctgttctttcgaattcaatgagaattttctcattatgctgtttgaacacgcctacgccagccagtttggtaccttcctggggaataacgaatccgaaaggtgtaaattgaagctccaacagaagactatgtcactatggtcctgggtaaaccagcccagtgagcttagtaaattcactaatcccttattcgaggctaacaaccttgtcatctggcctagcgttgcaccacaatccctgcctctgtgggaaggaatctttttacgatggaatcgctcctccaagtacctggatgaagcatatgaggagatggttaacatcatcgagtacaataaagagcttcaggcaaaagtgaacattctgcgcaggcaactagctgagctggaaactgaagacggaatgcaggagtccccatag

SEQ ID NO: 185996 - DNA, 2556 bp, Artificial Sequence
  Description of Artificial Sequence: Synthetic coding sequence
atgggcaaccggggcatggaggacctgatccccctggtgaaccggctgcaagatgccttcagcgccattgggcagaacgccgacctggatctcccacaaatcgccgtggttggcggccagtcagccggcaaatcaagcgtgctcgaaaattttgtgggtagagactttctccccaggggcagcggcatcgtgactcgccggcctctggtcctgcaactggtgaatgctaccacagaatatgcggagtttctgcattgcaagggaaagaagtttaccgatttcgaggaggtgcgtttggagattgaggcggaaaccgaccgagtgactggcactaacaagggcatcagcccagtgccaatcaatctaagagtctactctccccacgttctgaacctaacactcgtggacctgcccggtatgaccaaagtgccagtcggcgaccagcctcctgacatcgagttccaaatcagggatatgctcatgcagttcgtcactaaagaaaattgcctaattctcgcagtgagtccagccaatagcgatttagcaaattccgacgctcttaaggtcgccaaggaagttgatccacaggggcaacgaacaatcggcgtgataactaaattggacctcatggatgaggggacagatgcccgggacgtcctggaaaacaaacttctcccgctgcgaagaggttacattggagtggtgaatagaagccagaaggacatcgatggcaagaaagatattacggcagccctcgccgctgaaaggaagttcttcctgtcacacccaagttacagacaccttgccgaccgtatgggcacaccttatctacagaaagtgctgaaccagcaactcaccaaccatatacgagacacgctgccgggactgcgtaataagcttcaaagccaacttctgtcaatcgagaaggaggttgaggagtataaaaattttcgcccagacgatcccgccagaaaaacaaaagctctgctgcagatggtccagcagtttgccgtggatttcgagaaacgtattgaaggcagcggcgaccagatcgacacctacgagctctctggcggtgcaagaatcaatcggatctttcacgaacgattcccttttgagttagttaagatggaattcgacgagaaagagcttcgtagagaaatctcctacgccattaaaaacattcacgggatccgcactggattgttcaccccggacatggccttcgagacaattgtgaaaaagcaggttaagaaaatccgggagccgtgcctaaaatgtgttgatatggtgatcagcgaactgatctctacagtgcgccagtgtacaaagaagctgcagcagtacccaaggctaagagaggaaatggagagaatagtaactactcacatcagagagagagaaggccggactaaggagcaggtaatgctgttaatcgacattgaattggcgtatatgaatacgaatcatgaagattttatcggatttgccaacgcacaacagaggtcaaaccaaatgaataagaaaaagactagtggcaatcaggacgaaatcctagtaatcaggaagggctggctgaccataaacaatataggcataatgaaaggcggctctaaagagtactggttcgtgctgactgccgagaatctctcttggtacaaggacgatgaggagaaagagaaaaagtacatgctctcagtggacaacctgaaactacgagacgttgagaaaggtttcatgagctcgaagcacatcttcgccctttttaacacggaacagcgcaacgtgtataaggattacagacaattggagttggcctgcgaaacacaggaggaggtggacagctggaaggcctccttcctgagggccggcgtgtatcccgagagagtcggagataaagagaaggcctctgaaacagaggaaaacgggtctgatagcttcatgcacagcatggatccacaactcgagcgacaggtcgagactattaggaacctcgtggattcctacatggcgatcgttaacaagacagtgagagacctgatgcctaaaactatcatgcacctgatgattaataatactaaggaatttatcttcagtgaattgctggcgaatctgtatagctgcggtgatcagaatacattgatggaggaatccgcggagcaggcccagaggagggatgaaatgttaagaatgtaccacgctctcaaagaagccttaagcatcattggggacataaataccacaaccgtcagtaccccaatgcccccgcccgtggatgacagctggttgcaggtccaatctgttccagctggacgtcggagccctacgtctagccccaccccgcaaaggcgggcccccgctgtaccccccgctaggcctggctcacggggcccagctcccggccctccaccagcaggttctgccttaggcggggccccccctgttccgagccggcctggagctagtcctgacccattcggccctcctccgcaggtaccctccaggccaaatagggctcctcccggcgtgccaagaatcacgatttcagacccctag

SEQ ID NO: 185997 - DNA, 2595 bp, Artificial Sequence
  Description of Artificial Sequence: Synthetic coding sequence
atgggcaaccggggcatggaggacctgatccccctggtgaaccggctacaagatgcattctctgctatagggcaaaacgctgacctggacctcccgcaaatcgctgtggtcggggggcaaagtgcagggaaatccagtgtccttgaaaacttcgtagggagagactttcttcccaggggaagcggcattgtcacccgacgcccgcttgttcttcaactggtgaatgcaaccactgaatacgccgagttcctacactgcaagggcaagaaattcacagacttcgaggaggtgcggctagagatcgaagcagaaactgaccgcgtgacgggcaccaacaagggtatttctcccgtccctattaatctgagggtgtactccccccatgtgctgaatttgaccttggtggatctccctgggatgacaaaggtccccgtcggtgaccaaccaccagacatagaatttcagatccgagatatgttaatgcagtttgtcactaaggagaactgcctcatcctagccgtgagtcccgctaatagcgatttagccaacagtgacgccttgaaggtcgctaaagaagtggacccgcagggccagcggacaataggcgtcattaccaagctggatctgatggacgagggcacagatgctcgcgacgttctggagaataaactacttccccttagacgaggctacattggggtagtgaacagatctcagaaagatatcgacggcaagaaggatattaccgccgcactcgccgccgagcggaaattctttctatcccacccgagctaccggcatctggccgaccggatgggcaccccctacctgcagaaggttttgaaccaacagctgaccaaccacattagagataccctgccaggcctaaggaataaacttcagtcacagctattgagtatcgagaaggaggtggaggagtacaaaaatttccgtccagatgaccctgcacggaaaaccaaggcattgttacaaatggttcaacagttcgccgttgatttcgagaagagaatcgaaggatccggcgaccagattgatacgtacgaactgtctggaggggctagaattaaccggatatttcacgagagattccctttcgaactggtcaagatggagtttgatgaaaaagaactcaggcgggaaatttcatacgctattaaaaacatccacggcatccgaactggtctctttacgcccgacatggctttcgaaacaatcgttaaaaagcaggttaagaaaatccgcgaaccctgccttaagtgcgtggatatggtaattagcgaactgattagtactgtccgacagtgtactaaaaaactgcaacagtacccccgcctccgggaggagatggaacgcatcgtgactacccacattcgcgagcgggagggacgaaccaaggaacaagtcatgttgttaatcgacatcgagctggcttacatgaacaccaaccacgaggactttatcggctttgccaacgctcaacagaggtcaaatcagatgaataagaagaagacatctgggaaccaggatgagatactcgtcatacgcaaggggtggcttacaataaacaatatcggcataatgaaagggggtagcaaggagtactggtttgtgctcacagccgaaaacctgagctggtataaagatgacgaagaaaaggaaaagaagtacatgctatctgtggataaccttaagttaagagatgttgagaagggctttatgtcgtcaaaacatatcttcgccctattcaatactgagcagcgcaacgtgtataaagactacagacagctcgaattagcatgtgagacacaagaagaggtggactcctggaaggcgtcgtttttgcgagcaggagtgtatcctgagagagtcggtgacaaggagaaagcttcggagacagaagagaatggctctgactcatttatgcattcaatggaccctcaactggagaggcaggtggaaaccatcaggaacctggttgactcctatatggccattgtcaacaagaccgttcgggacctgatgcccaaaaccattatgcatctcatgattaataacactaaagaattcatcttctctgagctgttagccaatctttacagttgcggtgaccagaatacacttatggaggagagcgcggaacaggctcagcggcgcgatgagatgctcagaatgtatcacgcgctgaaggaggccctatctattattggagatattaacacaaccaccgtcagcactcccatgcccccccctgtggatgacagctggctccaggtacagagtgtccccgcgggaagacggtctccgacctcatctcctaccccccagcgccgcgccccagctgtgccccccgcccgtccaggttcgagaggcccagctcctggacccccgcccgctgggtctgcattgggcggagcgccacctgtcccgtccagaccaggagccagtcctgatccattcggaccacctcctcaggtccccagccgcccaaacagggcaccgcctggagtaccgtctcgttctggacaggcatccccaagccggcctgaatctcctagacctccattcgacctgtag

SEQ ID NO: 185998 - DNA, 1989 bp, Artificial Sequence
  Description of Artificial Sequence: Synthetic coding sequence
atggaggacctgatccccctggtgaaccggctgcaggacgccttctcagcaatcggccagaacgccgacctagatctgcctcaaattgcagtggtaggcggacagagcgccggcaaatcctcagtattggaaaatttcgttggtagagactttctcccacgcggatcagggatcgtgacccgtcgcccactcgtactgcagctggtcaacgccactaccgagtatgctgaattcttacactgcaaaggcaagaagtttaccgactttgaagaagtgcgactggagatagaagccgaaacagaccgagtgactgggacaaacaaagggatctctcccgtcccaattaacctgagagtgtatagcccacatgtgctcaatctaaccctggttgatctgccagggatgacaaaggttccagttggtgatcagcctccagatattgagttccaaatcagagacatgttaatgcaattcgtgacaaaggagaattgcctcatcctggctgtctcaccagctaatagcgacttagcaaactctgacgctctaaaggtggctaaagaggtggatccacagggccagcggacaatcggagtcataaccaagctggatctcatggacgaaggtactgacgccagagacgtactggaaaacaagttattaccacttcgcagggggtacatcggcgtcgtaaaccggagccaaaaagacattgatggtaaaaaggacattactgcagcattagcggctgaaaggaagttctttctctcccatccttcatatcggcatctagccgaccgtatggggactccttacctgcaaaaagtgctgaaccagcagttgacaaatcatatccgtgataccctcccagggctcaggaataagctccagtcccagctgctcagcattgagaaagaagtcgaggaatacaagaattttcgacctgatgaccccgcacggaagacaaaggcactcctgcagatggtccaacaatttgcagtcgatttcgaaaagcgcatagaggggagcggcgaccaaatcgacacctatgagctctcgggcggtgcgaggataaaccgaatctttcacgagcggttcccctttgagttagtcaaaatggagtttgacgagaaggaacttaggcgggagatctcgtatgcgatcaaaaacatccacggaattagaactgggctatttacccccgacatggccttcgaaactatcgtgaagaagcaggtcaagaagatcagagaaccttgtttgaagtgcgtggatatggtgataagtgagttgatcagcaccgtaaggcaatgtacaaaaaagctccagcagtaccccagattgcgggaagagatggagaggatcgtgacaacacacatccgagaaagagagggccgcaccaaggagcaggtcatgctcctgattgatatcgagctggcttacatgaacacgaatcatgaggacttcatcgggttcgccaatgctcagcagaggtctaaccagatgaataagaagaaaacgtctggcaaccagattacactccaggttatccgaaaaggctggctcacaatcaacaacatcggaataatgaaggggggatctaaagagtattggttcgttcttacggccgaaaacctctcatggtacaaggacgacgaggaaaaggaaaagaaatatatgctaagcgtcgataacttgaaactgcgtgacgttgagaagggattcatgtcttcaaaacacatctttgccttgtttaataccgaacagcggaatgtctacaaggactataggcagctggagctggcttgcgagacacaagaggaggtggactcctggaaggcctcatttctacgcgctggggtataccccgagagggtcggagacaaggagaaagtgagtgtccctttttcgtgcctgctaccgggcatctgcagcctagcccccgcccctgcgcggtttagctccaaaggacctggagatgtgctgttctag

SEQ ID NO: 185999 - DNA, 2556 bp, Artificial Sequence
  Description of Artificial Sequence: Synthetic coding sequence
atgggcaaccggggcatggaggacctgatccccctggtgaaccggctgcaggacgcgttctcagctatagggcagaacgcagacctggatctgccccagattgcggtggtgggaggccagtccgcaggcaagtcttctgtgctcgagaattttgtggggagggacttcctacctcgcggctcaggtattgtcacccgccggccgctggttttacagctagtcaacgcaacaacggagtacgccgagttcttacactgtaaaggaaaaaagttcaccgactttgaagaggtgcgccttgaaattgaagctgaaactgacagggtgacaggtaccaacaagggtatcagccctgtgcccatcaatctgcgcgtctatagtccccatgttttgaatctgacactcgtggatcttcctggcatgacaaaagtgccggtgggcgatcagccacctgatatcgaatttcagatccgcgatatgttgatgcagttcgtgacaaaagagaattgtctgattttggctgtctccccagccaacagtgatctagcgaattccgatgcactgaaagtggccaaggaagtggatccgcagggacagcggacaatcggcgtcattacaaaattggatctgatggatgagggaaccgacgctcgggatgtcctggagaacaaactattgccattgaggcgcgggtatataggcgtcgtgaatagaagccagaaggatatcgatggaaagaaggacattacagctgcgctggcagctgagcggaagttctttctaagtcacccttcttacaggcacctcgcagacagaatgggaacaccctacctgcagaaggtgcttaaccagcagttgactaatcatatccgcgatacgctccctggcctcagaaacaaactgcaatcccagttattgtccatagagaaagaggtcgaagagtataaaaatttcaggccagatgatcctgcgcgtaaaacaaaggccctgttacagatggtgcagcagttcgccgtagattttgagaagcggattgaaggcagcggcgaccagattgacacttatgagttgtccggaggcgcccgcatcaatagaatcttccacgagcggttcccttttgaattagttaagatggagttcgacgagaaagaactgcgtcgggaaatctcttatgcaatcaagaatattcacggaatacgcaccgggcttttcacccccgacctggcttttgaagctaccgttaagaagcaagtccagaagttgaaggaaccatccattaagtgcgtagatatggtggtgtctgaattgaccgcgacaatccggaagtgttctgagaaactacagcagtacccacgcttacgggaggaaatggagcggattgttaccacgcacattcgagaaagagaaggacgcacaaaggaacaggtgatgttgcttatcgacatcgaactggcgtacatgaatacgaaccacgaggactttattgggttcgcgaatgcgcagcaacgctctaaccaaatgaacaagaaaaagaccagtggtaatcaagacgaaattcttgtgattcgtaaaggctggctgacaatcaataacatagggattatgaaaggggggtccaaagagtactggtttgtcttgacggccgaaaacctcagctggtacaaggacgatgaggagaaggaaaagaagtatatgctgagcgtggataatctgaaactaagggacgttgagaaggggtttatgtcctctaagcacatatttgccttatttaatactgaacagagaaatgtttacaaagactatcggcagttggaactagcctgtgagacgcaggaggaggtggacagttggaaggcaagcttcctacgggcgggtgtgtaccctgagagagtgggtgacaaagaaaaggcctccgagacagaggagaacggatcggatagcttcatgcattcaatggacccccaattggagaggcaggttgagacaattcgcaacctcgttgactcttacatggctattgtgaacaagactgtgagggatctgatgcctaaaactatcatgcaccttatgatcaacaataccaaagaattcatctttagtgaactcctcgctaatctgtactcttgtggggaccagaacaccctcatggaggagtccgccgaacaggcccagcgcagggatgaaatgttgaggatgtaccacgccctgaaagaagccctgtccattatcggtgacatcaacactacaacagtttccaccccgatgccccccccagtggatgactcatggctacaggtgcagagtgtgcctgccgggcgtagatctccaacgagcagcccaacgccccagcggagagcccccgcagtccctcccgctagacctgggtctcggggaccagcacctggtccacctcctgcaggctctgctttgggcggcgcccctccggtgccctcacggcctggggccagcccggatccgtttggtcccccaccacaggtacccagccggcctaaccgcgccccccctggagtgccacgcattacgatttctgacccatag

SEQ ID NO: 186000 - DNA, 2556 bp, Artificial Sequence
  Description of Artificial Sequence: Synthetic coding sequence
atgggcaaccggggcatggaggacctgatccccctggtgaaccggttgcaggacgcttttagcgccatcggccagaatgccgacctggacctcccccagattgccgtggtcggtgggcagagtgcgggcaagagctcagttctagagaatttcgtcggccgcgacttcttgcccagaggttccgggattgtcacacgcaggccactggtgctgcaactggtgaacgcaactacagaatatgcagaattcctgcattgtaagggcaagaagtttaccgactttgaggaagtacgactcgagatcgaagccgaaaccgatcgtgtaactgggacaaataaaggaatctcaccagtgcccattaacctgcgagtctacagtccacatgttctaaacctgaccctagtggacctccctggtatgaccaaagtgcccgtcggagaccaaccaccggacatcgaatttcagatcagagacatgcttatgcaatttgttaccaaggagaattgcctcatcctggccgtgagccctgcaaatagtgatctcgcgaacagtgacgcgctgaaggtggccaaggaagtcgaccctcaagggcagcggaccatcggggtcataactaaactggacctaatggacgagggaactgacgcaagagacgttctggagaacaagctcctcccactccggagaggctacatcggggtcgtgaacagatctcagaaagatatcgacggcaagaaggatattacagctgccctggcagctgaaagaaagttcttcttgagccatcccagttaccgccatttagccgaccgaatggggaccccgtacctccagaaggtgctcaaccagcagctcactaaccatatcagagacacgctgcccggcctccgcaacaaactgcagtctcagctgttgagcatcgaaaaagaggttgaagagtataagaattttcgacctgatgatcctgccagaaagaccaaagccttactccagatggtgcagcagttcgcagtggacttcgaaaagagaatagagggatccggggatcagatcgacacatatgagctcagtggaggagctcgcattaataggatctttcatgagaggtttccttttgaactggtaaagatggagtttgacgaaaaggaactacggcgagagatttcctacgccattaaaaatattcacggaattaggacagggctctttactcccgacctggcttttgaggccaccgtaaaaaaacaggtgcagaagcttaaggagccttcaattaagtgcgtggatatggtggtaagtgagttaactgccacaatcaggaagtgctccgagaagctgcagcagtaccccaggctccgcgaggagatggaacggatcgtgacaacacatatcagggagcgagaagggcgcacaaaggagcaagtaatgctgctgattgatattgagctcgcatatatgaataccaatcatgaagattttatcggatttgccaatgcccaacagcggtccaaccagatgaacaaaaaaaaaactagcgggaaccaggacgaaattctagttataaggaaaggctggctgactatcaacaacatcggaatcatgaaaggtggctcgaaagagtattggtttgtcctgacggctgagaatctgagttggtacaaagacgacgaagagaaggaaaagaagtacatgctgtcagtggataacctcaaattaagagatgtcgagaagggattcatgtcctcaaaacatatcttcgctctcttcaacaccgaacagagaaacgtatacaaagactacagacagctggaactggcatgtgagacgcaggaggaggtagactcttggaaggcgtcttttctaagggcaggcgtataccccgagcgcgtgggcgacaaggaaaaagcctcagagacggaggaaaacggaagtgatagctttatgcattccatggatccccaactggaaaggcaggtggagacaatcaggaaccttgtcgattcctacatggctatcgtcaataaaactgtgagagatctcatgcctaagaccatcatgcacctaatgatcaacaacaccaaggagttcattttttccgagctgctcgccaacctgtatagttgtggagatcaaaacaccctcatggaggaatctgctgagcaggcccaaagaagggatgagatgctcagaatgtaccacgccctgaaagaggccctcagtatcataggtgacattaatacaaccactgtgagcacaccaatgcctccccctgttgatgatagttggctccaggtgcagtcagttccggccggcagaaggtcaccgacttcatctcctaccccccaacggcgggcccctgcagtaccccccgcaagaccagggtctcggggtcccgctccaggaccgccacccgcgggttcggccttgggcggagccccgcccgtgcccagcaggccgggagcctctcccgaccccttcggtccaccgccacaggttccttcccgaccaaacagagccccaccgggagtgcctcgaatcacaatttctgatccttag

SEQ ID NO: 186001 - DNA, 2595 bp, Artificial Sequence
  Description of Artificial Sequence: Synthetic coding sequence
atgggcaaccggggcatggaggacctgatccccctggtgaaccggttgcaagacgcattttcggccatcggtcagaacgccgatcttgatctgccccaaatcgccgtcgtgggtgggcaatccgcaggaaaatcatctgttcttgagaatttcgttggtcgggacttcttgcctaggggttctggaattgtgacccggcgtccactcgtgctgcagctggtgaatgccaccacggagtatgctgagttcctacactgtaagggtaagaaattcactgattttgaggaagtcagacttgaaatagaggccgagactgatcgagtaactggaaccaataaaggtatttctccagtcccaattaatctgcgagtctatagccctcacgtgctgaatttgaccctagtagatctgccaggtatgactaaggttcctgtgggcgatcaacctcctgatatcgaatttcagattagggacatgctgatgcagtttgtgactaaggaaaattgcctgatcctcgcagtgtctccagccaactcagatttagctaatagcgatgccctcaaggtcgcgaaggaagtggatccacaggggcaacgcactattggcgtcatcacgaagctggatctgatggacgagggcacggacgcaagggacgttctggagaataagctcctacctctccgtcgcggctacataggcgtggtcaataggtcccaaaaggatattgacggcaagaaagatatcactgccgcactcgctgccgaacgtaagttttttctctcccatcctagctaccggcacctggccgatcggatggggacaccttacttgcagaaagtcttgaatcagcaactcaccaaccacatcagggacacgctgccaggcctgcgaaataagcttcagagccaactgttgtccattgagaaagaggtcgaggagtacaaaaacttcagacctgacgatcccgctcggaagactaaggccttgttacagatggttcagcagttcgccgttgacttcgagaagagaattgaaggcagcggggatcagatagatacttatgaactctccggaggcgcaagaatcaaccgcatatttcacgagagattccccttcgagttagtgaagatggagtttgacgaaaaggaattgcggagggaaatcagctacgccattaagaatatccacgggatcaggaccggcctgtttacccctgatctggcatttgaggcgactgtgaagaagcaggtccagaaattgaaagaaccaagcataaaatgtgtcgacatggttgtgtcagagttaaccgctacaatcagaaaatgctctgaaaaactccagcagtatccccgtctgagggaagagatggagaggattgtgacaactcatatacgggaaagggaaggccggacaaaggagcaagtgatgttgctcattgatatcgagttagcctacatgaataccaatcacgaggatttcatcggattcgccaacgcccagcagcgcagcaatcagatgaataagaagaagactagcgggaatcaggacgaaattttggtgatccgcaaaggctggctaacaatcaataatatcggtatcatgaaaggtggtagtaaggagtactggtttgtgctgacagcggaaaacttatcctggtacaaggacgacgaggaaaaagaaaaaaaatatatgcttagtgtggacaatctcaagctacgtgacgtggagaagggttttatgtcatctaagcacatttttgcactcttcaacacagaacagcggaatgtgtataaggactatagacagctggagttagcgtgtgagacacaggaagaagtcgattcctggaaagctagcttcctccgggcgggggtctaccctgagcgtgtgggcgacaaagagaaagcctctgagactgaagaaaatggaagcgattcattcatgcactccatggacccacagctggagcggcaggtcgaaaccatcaggaatctggtggactcctatatggccatagtcaataaaacagtaagggacctgatgcctaagacgatcatgcatctgatgattaacaacacaaaggaatttatcttctccgagctcctggccaatctctactcttgcggggaccagaacacactcatggaggagtcagcggagcaggctcaacgtcgtgatgaaatgttgcgtatgtatcatgcccttaaagaggccctgtcaatcattggtgatatcaacaccactaccgtgtcaacaccaatgcccccccccgttgatgacagctggctccaagtgcagagcgttcctgccggaagaagatctcctacctcatcacccacaccacagcggagggcccctgctgtaccgccggccaggcccgggtcaaggggtcccgcaccgggccctcccccagccggtagcgcacttggcggcgcgcctcccgtccccagtcgccctggggcaagcccagatccttttggcccccccccccaggtaccctcacggcccaatcgagcccctccaggcgtgccaagtaggtctggccaggcctcaccctcaagaccggagtccccccgtcccccgtttgatctgtag

SEQ ID NO: 186002 - DNA, 1191 bp, Artificial Sequence
  Description of Artificial Sequence: Synthetic coding sequence
atggagcggatcgtgaccacccacatccgggagcgggagggccggacaaaagagcaggttatgctccttatcgacatagaattggcgtacatgaacacgaaccacgaggatttcatagggtttgctaatgcgcagcagaggagtaaccagatgaataaaaaaaaaacctctggcaatcaggatgaaattctggtaattaggaagggctggctgacaatcaataatatcggcattatgaagggcggatctaaagagtactggtttgtgctgaccgcggagaacctgtcttggtataaggacgacgaggaaaaggagaagaaatatatgctgtcggtcgacaacctaaaacttagggatgtggaaaagggctttatgtcttcgaagcacatctttgctctgttcaacacagagcagcggaatgtgtacaaagattaccgacagttggaacttgcttgcgaaacccaagaggaggtagattcctggaaggcttcattcctgcgcgcaggggtttaccctgagcgagtgggtgacaaggagaaggcgtcagagaccgaggagaatgggtctgactcattcatgcactctatggatccccagctagagcgccaggtggagaccatccggaatctggtggattcctacatggcaatcgtcaataagaccgtgcgagatctgatgcccaagaccatcatgcatttgatgatcaacaacaccaaggagttcatcttctcagagctgctggcaaacctgtatagctgtggtgatcaaaacaccctcatggaggagtcggccgaacaggcacagcgcagggatgaaatgctccgcatgtaccacgcactgaaggaggctttatcaattatcggagacattaacaccacgacagtttccaccccaatgcctccccctgtcgacgatagctggctacaggtccagtcagtccccgccggccggcggtctcctacctcaagcccgacccctcaaaggcgagctccagccgtgccacccgcccgcccaggtagcagggggccagcccccggccccccccctgctggcagcgccctggggggggcccccccggtgccctcccgtccgggcgcctctccggatcctttcggaccaccaccccaggtgcctagtcgcccaaatagggctccaccgggggtccctcgcatcactatatctgatccctag

SEQ ID NO: 186003 - DNA, 1728 bp, Artificial Sequence
  Description of Artificial Sequence: Synthetic coding sequence
atggaggccctgatccccgtgatcaacaagctgcaggacgtgttcaacaccgtgggagccgatataatccagctgcctcagatcgtggttgtcggcacccagtccagcgggaagtccagtgtactcgagagcctggttggccgggacttattgccgcgcggcactggcattgtcacacgacgcccactgatcctccagttggtccacgtgagccaggaggataaacgcaaaacaacaggagaggaaaatggtgtcgaggccgaagaatggggcaaatttctgcatactaaaaacaagctttacaccgactttgatgagatacggcaggaaattgaaaatgagaccgaacgcatttcaggaaacaataagggggtgtcccccgaacccatccaccttaagatcttctcaccaaatgtggtaaacctcacgctcgtcgacctaccaggaatgactaaagtgcctgtgggtgatcagcccaaggacatagagctacagatacgggaattgattttacggttcatcagtaatcctaactctataatacttgccgtaaccgccgccaacaccgatatggccacctctgaggctctgaagattagtcgggaggtcgaccccgacggccgacgcaccctggcagtgattactaagttagatctcatggatgcagggaccgacgccatggacgtactgatgggccgcgtgatccccgtgaaactgggaattatcggcgtggtcaacagatctcaactggacatcaataacaagaaaagcgttacggattccattagagacgagtacgccttcctccagaaaaagtaccccagcctggccaaccggaacggaactaaatacctggcccgaaccctgaacaggttgttgatgcaccatatacgcgactgcctaccagagttaaaaacccggatcaacgttttggcagcacaataccagtctttgctgaattcctatggggagcccgtcgatgataaaagtgccacccttctgcaactcattacaaaattcgcaaccgaatattgtaatactatcgaaggtactgctaagtatatagagacatctgaactgtgtggaggcgcgagaatttgctacattttccacgagacatttggccggaccctggaatccgttgacccactggggggccttaacacaatcgacattttaactgctattagaaatgccactggcccacgccccgccttatttgtgccagaggttagttttgaattgcttgttaagagacagataaaacggctggaagaaccttcactcagatgcgtagagctggtccacgaggaaatgcagcggattatccagcattgtagtaattatagcacacaggagcttctgaggtttccaaagcttcacgatgccatagtcgaggtagttacttgcctgctccgtaaacgtctcccagtcaccaacgaaatggtccataacctcgttgccattgagctggcttatattaataccaagcacccagatttcgccgacgcatgtggactgatgaataacaatatcgaagaacagcggcgtaataggctggctagagaactaccaagtgcagtctccagagataaagtagcctctggtgggggcggggttggcgatggcgtacaggagcctacaaccggaaactggcggggaatgctgaagaccagcaaagccgaggaactcctggccgagaagaaaaagaagaaaaaaaaaaaatag

SEQ ID NO: 186004 - DNA, 2100 bp, Artificial Sequence
  Description of Artificial Sequence: Synthetic coding sequence
atggaggccctgatccccgtgatcaacaagctgcaggacgtgttcaatacagtgggtgcagatattattcaactcccacagattgtggtggttgggactcagagctccggaaaatcctctgtgctggagtcactagtggggagggacttgttgccacgtggcacaggtatcgtgactaggcgacctttgattttacagctggtccacgtgagtcaggaggataaacgcaaaacgacaggagaggaaaacggtgtggaggccgaggagtggggcaagtttctccatacgaagaacaagctttacaccgattttgacgaaatacgacaggagattgaaaatgagactgaaaggatctccggaaataataagggggtgtcccccgaacctatccacttgaaaatcttctccccaaacgtggtgaatttaacattggtggatctgccgggaatgaccaaagtgcccgttggagaccaacccaaggacatcgaactgcaaattcgcgaactgatcttgcggtttatcagcaatcccaattctataatcctcgccgtcactgccgccaacacagacatggccacatctgaggcacttaagatcagcagggaggtcgaccccgatggacgccgaaccctggcggtaattacaaaattggatctcatggacgcgggcactgacgccatggacgtgctcatgggccgagtgattcccgttaaactaggcatcattggcgttgttaacagatctcagctcgatattaataataaaaagagcgttactgactccatccgagacgagtacgccttcctccagaagaaatacccaagtctggccaatcgcaacggaacaaagtatctcgcccgtacccttaacagactgcttatgcaccacatcagagactgtctcccagagcttaaaactcgcatcaacgtgctggctgctcagtaccaatctctgttgaactcctacggcgagcccgtggatgataaatcggccactctcctgcagttgattacaaagtttgccactgagtactgcaacaccatcgaaggaaccgctaagtatatagaaactagtgaactctgcggcggagccaggatctgttatatattccacgaaaccttcggcaggaccctggagagtgttgatcctctgggaggactaaataccattgacatcctcactgcaatcagaaacgcgacgggcccccggcccgccctgttcgtcccagaggttagctttgaactgctggtgaaaaggcagatcaagcgcctagaggaaccctccctgaggtgcgttgagttggtccacgaagagatgcagagaataatccagcattgctcaaattacagtacacaggagcttctgcgcttccctaagcttcacgatgctattgtggaggttgttacctgcttactacgaaaaaggctgcctgttaccaatgaaatggtccacaacctcgtggccatagagcttgcctatatcaacaccaagcatccggacttcgccgacgcatgcggcttaatgaacaataatatcgaagaacagagaaggaatagacttgctcgagagctcccgtctgcagtgtcccgagataaagtagcctcaggtggcgggggagtgggggacggcgtccaagagccaaccaccggcaactggcgcggcatgcttaagacaagcaaggctgaggaattgctagccgaggagaagagcaaacctattccaatcatgcccgcttcaccacagaaaggccacgcggtcaatcttttggacgtacccgtgcccgtggcccggaaactgagcgcccgggagcagcgcgattgcgaggtgatcgagcgcctgataaaatcctatttcttgatcgtgcgcaagaatatacaggactccgtgcctaaagccgttatgcactttctcgttaaccacgttaaagacactctgcaaagcgagctggtagggcagttatacaagtcatcgctgctggatgacctcttgaccgagtccgaggatatggctcagcggcggaaggaagccgccgacatgctgaaagccttacaaggcgcttctcaaatcatcgctgagattcgcgaaacgcacctctggtag

SEQ ID NO: 186005 - DNA, 2376 bp, Artificial Sequence
  Description of Artificial Sequence: Synthetic coding sequence
atggcctgccgggagggcgccggcagccggcgggcccggagcaacggctgccggcttcctcgcagagggcgtagacggggcggcagaagaaggaccgtcgggcctggacccatccattgtcgggggcggcgggctctgggcccaagggtgttccgggtcatggaggcactgatacccgtgatcaataagcttcaggacgtgtttaatacagtcggggccgacattattcaactgccccagatagttgtggttggaacccagtcatctgggaagtcttctgtcttggaaagcttagtagggcgggatctcctgccgcggggaacaggcattgtgactcgtcgtcccctgatactgcagctggtgcacgtaagccaggaagacaagaggaagaccaccggcgaggagaatgatccagcaacgtggaaaaacagtcggcacctcagcaaaggcgtggaggcagaggagtggggcaaatttctccacacaaaaaacaagctctataccgactttgacgagataagacaggagatcgagaacgagaccgagagaataagtggaaacaacaaaggggtgagtccagaacctatccatcttaagatcttcagccccaacgtggtcaacctgactctggtcgacctgccaggaatgaccaaggtgcccgtgggtgaccagcccaaagatatagaattgcagattcgggaacttattcttagattcatctcaaacccaaatagcataatactggcggtgacagcggccaacacagatatggctacaagtgaggcccttaagatcagcagggaggtggatcccgacggtcgaagaaccttggcagttatcacaaaactggatctgatggatgcaggcaccgacgcaatggatgtgctgatgggccgggtcattccagtgaagctggggattataggagtggttaaccggtcacagcttgatatcaataacaaaaaatctgtcaccgacagcattagggacgagtacgcatttcttcaaaaaaaatatccctcgcttgccaacagaaatggaaccaaatatctggctcgcaccctgaatagacttctgatgcatcatatacgcgactgtttgccagaactaaagaccaggatcaacgtcttagctgcacagtaccagagcttactcaacagttatggcgaacccgtggacgataagtccgccaccctgctgcaattgatcacaaaattcgcaactgaatattgtaacacgattgaaggcacggccaagtacattgagaccagcgaattgtgtggtggagccagaatatgctacattttccatgagacattcggcaggaccctggaatcagtggatccacttggaggactgaacactatcgatatcctgacggctatccgcaacgccacagggccccgccccgcactgttcgtgcctgaagtctctttcgagctcctcgtaaagcgccaaattaaacggttggaagaacctagcttgcgatgtgtggagctggtacacgaggaaatgcaaaggatcattcagcactgttccaattatagcactcaggagctgttgcgctttcctaagttgcacgacgcaattgtcgaggtggtaacgtgtctgttgagaaagcgattgcctgtcacaaacgaaatggtccacaatctcgtggcgatcgagctcgcatatattaacactaaacatcccgactttgcggatgcctgtggactgatgaataataacatagaagaacagcggaggaaccgcctcgcccgcgagcttccctccgccgtctccagggataaaagctccaaagtgcccagtgccctggcacctgcaagtcaggagcctagtcctgctgcgtcggcggaggcagacggtaaagtggcctcgggaggaggaggtgtgggtgacggtgtacaggagcccaccactggcaactggcgtgggatgctcaaaactagcaaagcagaggagctgcttgccgaagagaaaagcaaacctattcctataatgccagcgtctccccagaaggggcatgccgtgaacctgctggatgtacctgtgcccgtagcccgcaagctgtctgcccgtgagcagcgagactgtgaagtgattgagcggttaatcaagtcttatttcctgattgtacggaaaaatatacaggacagtgtcccaaaagccgtcatgcatttcctcgttaaccatgttaaagatactctgcagtctgaactggtcggccaactgtacaaatctagtctgttggatgacctgttgactgagagtgaagacatggctcaaagacgaaaggaagcagctgacatgctgaaggctttgcagggcgcctcgcagatcattgctgaaatacgggaaacgcatctgtggtag

SEQ ID NO: 186006 - DNA, 1602 bp, Artificial Sequence
  Description of Artificial Sequence: Synthetic coding sequence
atgttccacaagaagatcaacggcaagcagcaggagaagaagatgacattactgcacgggaagactcaggatacattcctcaaaggatggaagcagaagaatggggttaacttcttcacaccgaaaatccggtcccaattggatatcaacaacaagaagagcgtgactgactctatccgagatgagtatgcatttctccagaagaagtaccctagccttgccaatcggaatggaaccaaatatttagcgagaactctgaatcgcttgctgatgcatcacatccgtgattgtctgccggaactgaaaacacggattaatgttttggcggcacagtaccagtctctcctgaactcctacggcgagccagttgacgataaatctgccactctgctacagctgataaccaagtttgcaacagagtattgtaacacaattgaaggaaccgccaagtatattgagactagcgaattatgcggaggagctcggatatgctatatctttcatgaaacctttgggcgcaccctggagagcgtggaccctctcgggggcctgaatacaatcgacatcctcaccgctattagaaatgccacagggcctcggccagccctctttgtgcccgaagttagctttgagctcttggtcaaacgtcagataaaacgtctggaagaaccatccctccggtgcgtggaactcgtgcacgaagagatgcagcgaatcatccagcactgcagtaattattcaacccaggaattactgagatttcccaagctgcatgatgccatagtggaggtagttacgtgccttttgcgaaagaggctgcctgtgacaaacgaaatggtgcacaatctggtcgccattgaactggcttacatcaatactaagcatcccgactttgcggacgcatgcggcttaatgaataataatatcgaggaacagcgtcggaacaggctggctcgcgaactgccctcagctgtttcccgggacaagtcttcgaaagtgcccagcgctcttgctccagcgtctcaggagcctagcccagcagcttcagccgaggctgacggtaagcttattcaagatagccgtcgggaaaccaaaaatgtagctagcggcggaggaggtgtgggagacggtgttcaagaacctacgacagggaactggcgaggcatgctgaaaacatctaaagccgaggagctactggccgaagaaaaatcaaaacccatccccatcatgcccgcgtcacctcaaaagggccacgccgtgaacctgcttgatgtgcctgtcccagtggcacgaaaactgtccgccagggaacagcgggattgcgaggtgatcgaacgtctgataaagtcctattttttgatcgtgagaaagaacatccaagattccgtgcccaaggccgttatgcattttctcgtaaaccatgtgaaggatactttgcagagtgaactcgtgggacagctatacaagtcatcactcctggatgacctcctgaccgaaagtgaggacatggcacagcgccgcaaagaagcagctgatatgcttaaggctctacagggagcttctcaaatcattgcagagattcgggagactcatctctggtag

SEQ ID NO: 186007 - DNA, 2133 bp, Artificial Sequence
  Description of Artificial Sequence: Synthetic coding sequence
atggaggccctgatccccgtgatcaacaagctgcaggacgtgttcaacaccgtcggcgccgacatcatccaattacctcaaatcgtggtagttggcacccagtcctcagggaagtcctcagtcctggagagcctagtcggccgtgacttgctgccccgcgggactggcatcgtcacacggcgtccactgatcttgcaacttgttcatgtgtctcaggaggacaagaggaagacaacaggagaagaaaatggagtggaagccgaggaatgggggaagtttctgcacacaaagaataaactctacaccgatttcgacgagattcgtcaggagatagagaacgaaaccgagagaatatctggtaataataaaggcgtgtcgcccgagcctattcacctgaaaatcttttcgcctaatgttgtgaacctgactcttgtggacctgccaggcatgaccaaagtgcccgtgggggatcagccaaaggatatcgaattgcagattagagaattaatcctccgcttcatttctaatcccaactccatcatcctcgccgtcactgctgccaataccgacatggccacctcagaggccctaaagattagtagagaggtggaccctgacggacggcgtaccctcgctgtgatcactaagcttgaccttatggacgctggcaccgatgctatggacgtgctgatgggtcgtgtgatacctgtgaagctgggcatcattggggtggtcaacagatctcaactcgatatcaataataaaaaatcagttaccgactctataagggatgagtatgctttccttcagaaaaagtatccctccttggcaaatagaaatggcacgaagtatcttgccagaacgctaaaccggctccttatgcaccatatacgcgattgccttcccgagttgaagacacgtataaacgtgttggcggctcagtaccaaagcctattgaactcatacggtgagcctgtggatgataaaagtgctactctcctgcagctcattacaaagttcgccacagagtattgtaacaccatcgaaggcactgctaagtatatcgaaacgtccgagctgtgtggaggagctcgcatatgctatattttccacgaaaccttcggccgaactttggaaagtgtcgaccccctgggcggactaaatactattgatattcttaccgctattcggaacgcaaccgggccaaggcctgcattgtttgtgccggaagtctccttcgaactgctggtgaaacggcaaatcaaacggttagaagaaccatctctacggtgtgtggaacttgttcatgaggaaatgcagcggatcattcagcactgtagtaactacagtacacaggaactcctgagattcccgaaactccatgatgccatcgtcgaggtggtcacctgtctgctgagaaaaagactcccggtcactaacgaaatggtccacaacctggtggcgattgagctcgcgtacattaatactaaacacccagactttgccgacgcatgcgggctcatgaataacaacattgaagagcagcgccgcaatcgcttagccagggagctgccatccgcagtatcacgggacaagcttatccaggactctcgcagagagacgaagaatgtagcctccgggggaggaggtgtaggagacggagtacaggagccaaccaccgggaattggaggggaatgttaaagacttctaaggccgaggaactgctggcagaggaaaaaagcaaacccataccaattatgcctgccagtcctcagaaggggcacgcagtaaacctgcttgatgtaccagtccctgtcgcccgaaaattaagcgcccgtgagcagagagactgtgaagtgattgaacgactgataaaatcctacttcttgatagtgagaaagaacatccaagactctgttcctaaggccgttatgcatttcctggtcaaccacgtgaaggacactctccagagcgagctggtgggacagttgtataagagttcccttttggacgaccttttgacggaaagcgaggacatggcccagagacgcaaggaggctgcagacatgttaaaggccctgcagggggctagccagattatcgctgagataagagagacccacctgtggtag

SEQ ID NO: 186008 - DNA, 2178 bp, Artificial Sequence
  Description of Artificial Sequence: Synthetic coding sequence
atggaggccctgatccccgtgatcaacaagctgcaggacgtgttcaacacagtgggagcagatattatccagcttcctcagatagtggtggtgggtacccaatcgagcgggaaatcctccgtcttggaaagcctcgttggccgggatctcctccctcgagggacaggaatcgtgacccgcaggcccctgatcctccagcttgtgcatgtaagtcaggaggacaagcgcaaaacaaccggcgaggagaacggcgtggaagctgaggaatggggcaagttcctacacaccaagaacaagctttacactgactttgatgaaataaggcaggaaattgagaacgagacagaacggatctctggcaataataagggcgtgtcaccagagccaatacacttaaaaatctttagtccaaacgttgtgaatcttactctagtggatctgccggggatgacaaaagtgcccgtcggcgatcagcctaaggatatcgaactccaaatcagggagctcattctgaggtttatttccaaccctaacagtatcatcctggcagtgacagcagccaatacagacatggcaacctctgaagccctgaaaattagcagagaggtggaccccgatgggcgccgtacgctggctgtaattacaaagctagatttgatggacgccggtacagatgcaatggatgtccttatgggcagggtgatccccgtaaaactgggtatcataggcgtggtgaaccgatcccagctcgatattaacaataaaaagagcgtaactgattcaatccgcgacgagtacgccttcctccagaagaaatatccaagtctcgctaaccgcaacggcaccaaatacctggcaaggactctgaaccggttactgatgcatcatatcagggattgcctgcccgagttgaagactcggatcaatgtactggccgctcaatatcagtcactgctcaatagctatggggaacctgttgacgataagtccgccactctcctgcagctgataactaaattcgccaccgaatattgtaatacaatagagggaacagccaaatatatcgaaacatccgaactgtgtggcggcgcgagaatatgttatatttttcacgagaccttcgggcgcaccctggagagcgttgatcccctgggcggcctgaacactatcgacatcctcacagctatccggaacgccactggtcccaggcctgcgttatttgtgccagaggtctcttttgaactgctggttaaacggcagatcaaaaggcttgaggaacccagcttgcggtgtgtcgagctggttcacgaggagatgcagagaattatccagcattgttctaactattctacacaggagttgctgaggtttcccaagttgcacgacgctattgttgaggtggtaacctgtctgctgagaaagcgtctacctgttactaacgagatggtccacaaccttgtggctatcgaattagcctatattaacactaaacatccagatttcgccgatgcctgtggactcatgaacaataacatcgaagaacaaaggcgcaaccggctggccagggaactgcccagcgcagttagtagggataaatcctctaaagtcccaagtgctctagctcccgcctcccaggaaccttctcccgccgccagcgcagaggccgatgggaaggtggcatccggcggtggtggagttggagatggagtgcaagagcccacaacaggtaattggaggggcatgttgaagacctctaaagccgaggagctgctggctgaagagaaaagcaagcctatccctattatgcccgccagccctcagaaggggcatgcggtcaacttgttagatgtaccggtccctgtcgcccggaaactttccgcccgagagcagcgagactgcgaggttatcgagcgcctcattaaatcttattttctcatagttagaaagaatatacaggattcagttcctaaggcagtgatgcacttccttgtgaatcacgtgaaagacaccctccagtccgaactcgtaggtcaactgtataaatcatccttactagacgatttactgacggagtcagaggatatggcacagagacgaaaggaggccgcagatatgctgaaggcactacagggggccagccagattatcgcagagatccgcgagacccatctctggtag

SEQ ID NO: 186009 - DNA, 2211 bp, Artificial Sequence
  Description of Artificial Sequence: Synthetic coding sequence
atggaggccctgatccccgtgatcaacaagctgcaggacgtgttcaataccgtgggcgctgatattatccagcttccacagattgtagtcgtcggcactcagtcttcgggcaaaagctcagtgctagagagtctcgtcggccgcgacctgttgccacgcggaaccggcattgtgacgagaagacccttaatcctgcaactagtgcacgtatcccaggaggataagcggaaaacaaccggtgaggagaatggggtggaagctgaggagtgggggaagtttctccacaccaagaacaaactgtatacggattttgacgagattagacaggagatagaaaatgaaacggaaaggatcagtggcaacaataagggcgtgtcgcccgagcccatccacctcaagattttttccccaaacgtggtgaacctgacacttgtcgatctcccagggatgaccaaagtaccagtgggcgaccagcccaaagatatagaattgcagatcagagagctcatcttgaggttcatctccaaccccaattcaatcattctcgctgtcacggccgccaataccgacatggcgacttccgaagctctgaagatatctcgcgaggtggaccccgatggacgacggaccctggcggtcatcaccaagctggatcttatggacgccggcactgacgctatggacgtactgatggggagggtgatccctgttaagctcggcatcattggcgtggtgaaccggagccagctggatattaacaataaaaagtcagtcacagattcaattagagacgaatatgcgttcctgcagaaaaaataccccagtctcgctaatcgcaatgggactaagtatctcgctcgtacacttaatcgcctcctcatgcatcacatcagggactgcttacctgagctcaaaactcggatcaatgtcttggcagctcagtatcagtcactgctcaatagttacggtgaaccagtcgatgacaagtctgcaaccctactgcagctaatcacaaaattcgcgacggaatattgcaacacgattgagggtaccgccaagtatattgaaacatccgagctgtgtgggggagctcgcatttgctacattttccacgaaacattcggtagaacactcgaatctgtagacccacttgggggactgaataccattgatatactgaccgccatccggaacgcaacaggtccgcggccggctctgtttgtgcccgaggtgagcttcgagctgttagtgaagaggcagataaaacggctggaggaacctagcttacggtgtgtcgagctggtccatgaggaaatgcagagaatcattcagcattgttccaactattccacccaggagctgcttcgatttccaaagctgcacgatgctattgtggaggtggtgacctgcttattgcgcaagaggcttcccgtcactaacgagatggtgcataatctggttgctattgagctggcttacatcaacacaaagcaccctgatttcgcggacgcctgtgggctcatgaataacaacattgaagagcaacgtagaaatcgccttgctcgggagctcccatccgccgtctcccgagacaagtcatcgaaagtaccatctgcactggcacccgctagccaggaaccctctcccgctgcttcggctgaggccgatggaaagttgattcaggattcccgccgagagaccaaaaatgtggcaagcggaggggggggtgtgggtgacggagtacaggaaccaacaacaggcaactggcgcggtatgctgaaaacaagcaaggccgaagagctgctggccgaagagaaaagcaagcccataccgatcatgcccgcgtcccctcaaaaagggcatgcggtgaacttactggacgtcccagtaccggtggccagaaagctctctgcacgcgaacagcgcgactgtgaggttatcgagcgcttgattaagtcttactttctgattgtgcgcaagaacattcaggattccgtacccaaagccgtaatgcacttcttggttaaccacgtgaaagatactctgcaaagcgagctcgtcggccaactctacaagtcatctctactggacgacctgctgaccgaatctgaggatatggcccaacggcgtaaggaagccgcagatatgctgaaggcactgcagggggcgtctcagattatagccgagatcagagaaacacatctttggtag

SEQ ID NO: 186010 - DNA, 2250 bp, Artificial Sequence
  Description of Artificial Sequence: Synthetic coding sequence
atggaggccctgatccccgtgatcaacaagctgcaggacgtgttcaacacagtgggggcagacattattcagttgccccagatcgtggtggtggggactcagagcagtggaaagtcctcagtgctggaatctcttgtgggtcgcgatttgctgccacgcggcactggaatcgtgactcgcagacccctgatactgcagctggtccacgtgagccaagaggacaagcggaaaactacgggcgaggagaacgaccctgcgacctggaagaatagccgtcatctcagcaagggggtcgaagccgaggagtggggaaagtttctgcacactaaaaacaaactgtacactgactttgacgagattaggcaagagattgagaacgaaacagaacgaatttcaggaaacaacaaaggcgtctcgccggaacccatccacttgaagatcttttctcctaacgtggttaatctgacactggtggacctgccaggcatgaccaaagtgcccgtgggcgatcagcccaaagacattgaactgcaaattcgggagctcattctgaggttcatttctaaccccaatagcattatcctcgccgtgaccgcagctaacaccgacatggcaactagcgaagctctgaaaatctcccgcgaggtggaccctgacgggcggagaacgctggccgtgataactaaactcgacctgatggacgccgggactgacgctatggatgtgcttatgggccgagtgatcccagtgaaactgggtattataggagttgtgaatagaagccaattggacatcaataacaaaaagagcgtaacggactcaattcgcgatgaatacgctttcttgcagaagaaatatcccagcctggccaaccggaatggcacaaaatatctggcccgcactcttaatcgcctccttatgcatcacatccgtgactgccttcctgaattaaaaacgcgcattaacgttcttgctgctcaataccagtctctcttaaactcttatggtgagccggtggatgataaaagcgccacacttctccaactgattactaaattcgcgaccgaatattgcaacacaattgaggggacagccaagtacatagagacgtccgaactctgtgggggtgccagaatttgttatatctttcatgaaacatttggtagaactctagagagcgtcgatccgctcggcggcttgaacaccattgatattttgacggcgattcggaatgctaccgggcctcggccagcactgtttgttccagaagttagtttcgaactgctggtcaagcgacaaattaaacggctcgaggaacccagcctgagatgtgttgagctggtgcacgaggagatgcagaggattattcagcattgcagcaactattctactcaagagctccttcgcttccccaagctccatgatgccatcgtagaggtggtcacttgtctgctccgaaagcgcttgccagtcactaacgagatggttcacaatttggttgctatcgaactcgcatacatcaacactaagcacccggacttcgctgacgcctgtggccttatgaacaacaacatcgaagaacagcgccgtaatcggctcgccagagaattgcctagcgctgtttccagggataagagtagtaaagtgccctcagccttagcccccgcttcacaagagccttctccggcagctagcgccgaagccgacggcaaattaatccaggactcacgacgagagacaaagaacgtggcctctggggggggcggagtaggtgacggtgtccaggaacctacaacggggaattggagagggatgctcaaaacatcaaaggccgaggagctgctcgccgaagaaaagagtaagcccatcccgatcatgccagcatctcctcaaaaggggcatgccgtcaatctgttggatgtcccagtgcccgtcgcaagaaagctctctgccagggaacagagggactgtgaggtcattgaacgcttgattaagtcctactttttgatcgtccggaagaacatccaggatagtgtgcccaaggcggtcatgcactttctcgtgaaccacgttaaggatactttgcagtccgagctggtgggtcagctctacaaaagttctctgcttgatgatctgctcaccgagtctgaggacatggctcaaaggcggaaagaagccgctgatatgctgaaggccctgcagggcgctagtcagatcatcgccgagatccgagagactcacttatggtag

SEQ ID NO: 186011 - DNA, 2613 bp, Artificial Sequence
  Description of Artificial Sequence: Synthetic coding sequence
atgggcaaccggggcatggaggagctgatccccctggtgaacaagttacaggacgccttttcctccatcgggcagagctgtcatttggacctcccccagatcgccgttgtgggaggacagagcgccggcaagtcttccgtcctggagaattttgttggaagagacttcctcccgcgggggagcggcatcgtgaccaggcgccctctcatacttcagcttatttttagcaagacagaacacgccgagtttttgcactgtaaaagcaaaaagttcactgactttgacgaagttagacaggagatcgaggccgagaccgatcgcgttaccgggacaaataagggtatttcacctgtacccatcaatctgcgcgtgtactcacctcacgtactgaacctgactctcatcgatcttcctggaataacgaaagttccagttggcgaccaaccacccgacattgaataccagattaaggacatgattttgcagttcattagtcgcgagtcatcactgatattggccgttacccctgcaaatatggatctggctaacagcgacgcactgaaactggccaaagaggtcgatccacagggccttaggactattggagtgattactaaactggatctcatggatgaaggcacagacgcacgggatgtacttgaaaacaaattactgcccctgaggcggggatatatcggcgtggtgaaccgctcccagaaagacatcgaaggaaagaaggacatccgcgcagcactggcagccgaacgcaaatttttcctcagtcaccccgcttaccgacatatggccgatagaatgggtacacctcacctgcagaagacgctgaaccaacaactgaccaatcacatccgagagagcttaccggccttaaggtctaaactgcaatcgcaactacttagcttggaaaaggaagtagaagagtataagaatttcaggccagacgaccctacccgcaaaacaaaggcgcttctgcaaatggtgcagcaatttggcgtcgatttcgaaaaaagaatagaaggctctggcgatcaggtagatactctggagttgtccggtggcgcccgaatcaaccggatattccacgagcgtttcccatttgaactggtgaaaatggagttcgacgaaaaggatttgcgacgcgagatttcttacgccattaaaaatatacacggggttaggacaggactgttcacccccgacatggcctttgaggccatagtgaagaagcaaatcgtcaaactgaaggaaccatccctgaaatgcgtcgaccttgtcgtgtctgagctggccaccgtgatcaagaaatgtgcagaaaagctaagttcttacccgcgactcagggaggagaccgaacgaatagtgactacatacatcagggagcgagagggtagaacgaaggaccagattctgctgctcattgacatcgagcagtcttatataaataccaatcatgaggacttcatcggctttgctaacgctcagcagaggagtacacaactgaacaaaaagcgtgctatcccaaaccaaccagagacattggtcatccgtcgcgggtggctgaccattaacaatatctcgttaatgaagggtgggagtaaggaatactggttcgtactaacagcagaatctctgtcttggtacaaagatgaagaggaaaaggaaaaaaaatatatgctgccacttgataacctcaagatacgcgatgtggagaagggatttatgagcaataagcacgtgtttgcaatctttaacacagagcaaagaaacgtatataaggatctgaggcagatcgagcttgcatgcgacagccaggaagatgtggattcttggaaggcctcctttctcagagccggcgtgtacccagagaaggatcaggctgaaaacgaagatggtgcccaggaaaataccttttccatggatcctcagcttgagcgccaagttgagactatcaggaacctggttgattcttacgtggcgatcatcaacaagagcatccgcgacctgatgccgaagaccattatgcacctgatgattaacaatactaaggcatttatccatcacgagcttcttgcttacttgtattcttctgcagaccagtcctcacttatggaggaaagtgccgaccaagcccagcgccgggatgatatgctgcgtatgtatcacgcactaaaggaagccctcaacataatcggagacataagcacctctacagtcagcacacctgtccccccaccagtcgatgatacctggctgcagtccgcatcctcccacagccccacacctcaacgccggccagttagtagtatccacccccctggaagacctccagccgtccgtggacccactccagggcctccgctgattccagtgcccgtgggggctgctgcctcttttagtgccccccctatacccagtcgccccggaccacagagcgtttttgccaatagtgatcttttcccagctcctccgcagattccctctcgcccagtgcggataccaccaggaatacctccaggcgtcccctcaagacgcccaccagctgccccctctcggcctacaattatccgccccgcagaaccatccctacttgattag

SEQ ID NO: 186012 - DNA, 2601 bp, Artificial Sequence
  Description of Artificial Sequence: Synthetic coding sequence
atgggcaaccggggcatggaggagctgatccccctggtgaacaagctgcaggacgccttctcctcaatcggacagtcctgccacttggatctgcctcagatcgcggtagtgggcggacagagtgctggaaagagttccgtgctggaaaattttgtcggccgtgacttcttgccaagaggcagcgggatagttacccggaggccactcatcctgcagctgatctttagcaaaaccgagcatgctgagtttctgcattgtaaaagtaagaaatttacagacttcgatgaggtgaggcaggagatcgaggcagaaacagacagagtgactgggaccaataaaggcatctctcctgtgcccattaacctccgtgtgtacagtccacacgtgctcaacttgacactaattgatctgccaggcatcaccaaagtgcccgtcggcgatcaaccaccagatattgagtatcaaatcaaagacatgatcttacagtttataagccgcgagtctagcctgattcttgcagtgactcccgcaaacatggatttagctaactctgatgctctgaagctggcaaaggaggtggatccacagggattgcgaacaataggcgtcattacaaagctggatctcatggatgaggggacagatgcacgggacgtattggagaacaaactgctgcccctccgtagggggtacattggagtggtcaacaggagtcaaaaagacattgaagggaagaaagatattcgagccgctctggctgccgaaagaaaattttttctgagccacccggcgtacagacatatggccgaccgtatgggtacacctcaccttcagaagaccctgaaccagcagctaacgaatcacatcagggagtccctgcccgcactgaggagtaaactgcagtcgcagcttctgtcgctggaaaaggaggtcgaggaatataagaatttcaggcctgatgaccctacaaggaaaaccaaggccctgctgcagatggtccagcagtttggggtggattttgaaaagagaatcgagggttctggcgaccaggttgacacgctggaactcagcggcggtgctcggattaatcgcatttttcacgaaaggttcccgttcgaactggtgaaaatggagttcgatgagaaagatctgcgacgggaaatttcctacgccatcaagaacatccacggcgtgaggactgggttgttcacccccgatttagcatttgaagccattgtaaagaaacaggtagtgaagctcaaggagccatgtctgaagtgcgttgacctggtgattcaagagctaatcaacaccgtccggcaatgcacttctaagctgagcagttatcctagactaagagaagagacagagcggatagtcacaacttacatccgcgaaagagaggggagaactaaagaccagatcctcctgctcatcgatattgaacagtcctacattaacaccaatcatgaggacttcattgggttcgcaaatgcccagcagcgttcgacccaactgaacaaaaaacgcgccatccccaaccaagtaattagaagaggatggctaaccattaataatatttcgctgatgaagggggggagcaaagaatattggtttgtgctgacagctgagtcactgagttggtacaaagacgaggaggaaaaagaaaagaaatacatgctccctctggataatctgaaaatcagagacgttgaaaaaggctttatgagcaacaagcatgtctttgcaatctttaatacagaacagcggaacgtctataaagatctcaggcagatagaactagcatgtgactcccaagaggatgtggacagttggaaggcctcctttctcagagcaggcgtgtaccctgagaaagaccaggccgagaatgaagacggcgctcaggagaatacattcagcatggatccccagctcgagaggcaggtcgaaacaattcgcaaccttgtggattcctacgtggctatcatcaataagtctatccgggatctaatgcccaaaacaatcatgcacctgatgattaataatacaaaagcctttatacaccatgagctgctggcctacttgtactccagcgcggatcagtccagtctgatggaagagagtgccgaccaagcccagcggcgagacgatatgttacgaatgtatcacgctcttaaggaagcgttaaacattatcggggacatctctacgtctaccgtgtcaaccccggtacccccccccgtggacgatacttggctccagagcgcttccagccacagtccaacaccgcaacgtagacctgtatcttccatccaccccccggggcgtcctcccgctgtgcgcggcccaacaccgggaccgccccttattccggtcccagtgggagctgcagcttcattctccgcgcctcccatccctagccgtcccggacctcagagtgtattcgcgaatagtgacctgttccccgccccgcctcagatcccttcccgccccgtcaggatcccccccggtatcccccccggggtgcccagtcggcgaccacccgccgctcctagccgaccaaccattattcggccagccgagccttccctcctcgattag

SEQ ID NO: 186013 - DNA, 2613 bp, Artificial Sequence
  Description of Artificial Sequence: Synthetic coding sequence
atgggcaaccggggcatggaggagctgatccccctggtgaacaagcttcaggatgccttctcatctattggccagtcttgtcatttggacttaccccagatagccgtcgtaggaggccagagcgccggtaagagctcggtgctggaaaattttgtgggccgcgattttttgcctcgcggcagtggtatagtcacccgaaggcctcttatactgcaactaattttttcgaaaactgagcacgcagaatttctgcactgtaaaagcaagaagtttaccgactttgacgaagtacggcaagagattgaagctgagacagatagagtgacgggtactaataaaggcatttcccctgtccccattaacctaagagtgtactcacctcacgtgcttaatcttaccctcattgaccttcccgggattaccaaagtgcccgtgggcgaccaacctccggatatcgagtaccagattaaggatatgatcttgcaattcatctcccgggagtcaagcctcattctggccgtgaccccggcgaacatggatttggcaaacagcgatgcactcaaactggcaaaggaagtcgatccccagggtctgcgcaccataggcgtgattactaaactggatctgatggacgagggcacggacgctagagacgtgctcgaaaataaactcctaccactcagacgtggatatattggtgtggttaatagaagccaaaaggacatcgaaggtaagaaggacatcagggcggcccttgcagcagaacgcaagttttttctgtcacaccccgcttacaggcatatggcagaccgcatgggtactccgcacctgcagaagacactgaaccagcagctcacgaatcacattagggaaagcctgcccgccctgagatccaaactccagtctcagctgctgtctctggagaaggaagttgaagagtataagaactttcgtccagacgacccgacccgcaaaaccaaggccttgcttcagatggtgcagcaatttggggtggactttgagaagagaatagaaggttcaggcgaccaggtggataccttggagctctccggaggggccagaatcaatcgcatattccatgagagattcccattcgagctggtgaaaatggaattcgatgagaaggatctgcgacgcgaaatcagctacgcaattaaaaacattcacggagtgcggaccggactgtttacacccgacctggctttcgaagccattgtgaaaaagcaggttgtgaagttaaaagagccttgcctgaagtgtgtggacctggtcatccaggaactgattaatacagtccgtcagtgcacctctaagttgtcctcttacccccggcttcgcgaagaaactgaaaggattgtgacaacatacattagagaacgagagggacgcaccaaagatcagatcctcttgctgatagatattgagcagagctacattaatactaatcacgaggatttcattggctttgccaatgcccaacagcggagcacccagctcaataaaaaacgcgcgataccaaaccagggggagatcctggttattcgcagagggtggctgaccataaataatatttccctcatgaaaggcggctccaaggagtattggttcgtgttaacagctgaatctctgtcctggtataaggatgaggaagaaaaggaaaagaagtacatgcttccgctcgataatctgaagattcgggacgtggaaaaaggattcatgtcgaacaaacacgtctttgcaatattcaataccgaacaacgcaacgtctacaaggacttgagacagatcgaactcgcatgtgacagtcaggaagatgtagatagctggaaggctagttttctgagagctggggtgtaccctgagaaggaccaggcggagaacgaagacggcgcgcaggaaaatactttctccatggatccccagctggagagacaagtcgaaacaattagaaatctggtggactcttacgtggctatcatcaataagtctatccgggacctgatgcctaagactatcatgcatttaatgatcaacaataccaaagccttcattcatcatgaactgcttgcgtacctgtactcctctgccgaccagagctccttgatggaagaaagcgctgatcaggcccaacggcgagacgacatgctgcggatgtaccatgccttgaaagaagctctcaacataatcggggacatctccactagcacagtcagcacaccggtgcccccgcctgtggacgatacatggctccagtctgcgagtagccactctccaactccccagagacgtcccgtgagttccatacacccaccggggaggcccccagcagtacgagggcccacacccgggccacctctgatacccgtacctgtcggcgccgctgcatcattttctgcgccccctatcccctctagacccgggcctcagagtgtatttgcgaattccgacctgtttccagctcctccccagattcctagccgtcctgtacggatcccacctggcatccccccaggggtcccttcccgccgccccccagcagcgccttctcggcctaccatcatcaggcccgctgaaccctctctgctcgattag

SEQ ID NO: 186014 - DNA, 1461 bp, Artificial Sequence
  Description of Artificial Sequence: Synthetic coding sequence
cacgtgaccgtggccgccgccgacagctggaagccccccgccagcgcacagcacgtaggacgcgcacctagggccggggccgcaacttgtttcctggggccccggccacccagtcatctggggggcagggacttcctgcccaggggctccggaatcgtcactcgtagaccgctgattctgcagctcatattcagcaagacggagcacgcggaattcctccactgtaagagtaagaaattcaccgacttcgacgaggttaggcaagagatcgaagccgagacagacagagtcaccggaactaacaaaggtatcagccccgtgccaataaacctgagggtgtattcaccacacgtgttgaaccttactctgatagatcttccaggcataaccaaggtgcccgtaggcgaccagcccccggatatcgaataccagatcaaggatatgatactgcagttcatcagtcgcgagtcttccctgatcttagccgtcacgccggcgaacatggatttggccaactcagacgccctgaagctggctaaagaggtcgacccccagggactgagaaccatcggagtgataaccaaactggatcttatggacgaggggacagacgcccgcgatgtgctggagaacaaactccttcctctcagacgtggctatatcggtgttgtgaaccgttcccagaaagatattgaaggaaaaaaagacatacgggcagccctagccgctgagaggaagttttttctttcccatcccgcttatcgccatatggcagatcggatgggcacaccccatcttcagaagaccctgaaccaacagctgacaaaccacatccgtgagtccctgccagcactccggtcaaagctgcaaagtcagcttttgtcattggaaaaagaggttgaggagtacaagaactttcgccccgatgatccaacacgaaagacaaaggcacttctgcagatggtccagcaatttggtgttgatttcgagaagagaatcgaggggtctggagatcaagtcgacactctcgagctgagtggcggcgctaggatcaacaggattttccatgagcgcttcccttttgagctggtgaagatggagtttgatgaaaaggacctgagacgggagatctcatacgccatcaaaaatatacacggcgtgagaacaggcctattcacacccgatatggcgtttgaagcaatagtgaaaaaacaaatcgtgaagcttaaggaaccgtctctgaaatgtgtggaccttgttgtgagcgaacttgccaccgtcattaaaaagtgcgccgagaagctgtcctcctatccccgtcttcgcgaagaaacagagaggatcgtcacaacttatatccgagagagagaagggcgcacaaaagaccagattttactgttaatcgatatagagcagagctacattaacactaaccacgaggattttatcgggtttgcatag

SEQ ID NO: 186015 - DNA, 2613 bp, Artificial Sequence
  Description of Artificial Sequence: Synthetic coding sequence
atgggcaaccggggcatggaggagctgatccccctggtgaacaagttacaggacgccttcagctctattgggcaatcatgtcacttagatcttccgcagatcgccgttgtgggcggccagtccgctggaaaatcctcagtcttagaaaactttgtgggcagagatttccttccgcggggctccgggatcgttaccaggagacccctgattttacagctgatattttcgaagacagagcatgcagagtttttacactgtaagtcgaagaagttcaccgatttcgatgaagtccggcaggaaattgaggctgaaacggacagggtcaccgggaccaataagggcataagcccggtgcccattaatctgcgggtttacagtccccacgtgttaaacctcaccctgattgatctcccaggcataactaaggtgccagtcggtgaccagccgccagacatcgagtaccagatcaaagatatgatcctccagttcattagccgggagtcatccttgatcctcgcagtgacccctgcgaatatggacctcgccaacagcgacgctcttaagctggcaaaggaagtagacccacaggggctcaggacaattggagtaattactaaacttgacttgatggacgaagggacggatgcccgggatgtactggagaacaaactgctacccctccgccgcggctacattggcgtggtgaataggtcccaaaaagatatcgagggcaagaaggacattcgggccgcacttgcggctgagcgcaaattctttttgagccaccccgcttatagacatatggctgatagaatggggacccctcacctccagaaaacgctcaatcaacagcttactaatcatattcgagagagcctccctgcccttcgaagcaaattgcagtcccagttgctgtctctagagaaggaagtcgaagaatacaagaactttaggcccgacgaccctacacggaagacaaaggcccttctgcaaatggtgcagcagttcggcgtggactttgagaagcgcatagagggatctggcgatcaggttgatactctggagctttctgggggagctagaattaaccggatcttccacgagagatttcctttcgagttggtcaaaatggaattcgatgagaaagacctgcggcgtgagatctcctacgccatcaaaaatatccatggagtaaggacaggccttttcacaccagacatggctttcgaggctattgttaagaagcaaatcgtgaagctgaaagagcctagtctcaagtgtgtcgacctagtggtcagcgaactcgccactgtgatcaagaaatgcgcggaaaagctgagcagttacccaagactgagggaggagacagaacggattgtgaccacatacataagagagcgcgagggcagaactaaggaccagatcctcctgctaatcgatattgagcagagctatattaacacaaatcacgaagatttcatcggattcgcaaatgctcaacagaggtcaactcagctgaacaagaagagagctatcccgaaccagggcgaaattctcgtgatacggagaggatggctcaccatcaacaatatttcgctgatgaagggcgggagcaaagaatattggtttgtccttacagcggagagcctgagttggtataaagacgaggaggagaaagaaaagaagtatatgctcccactggacaatctgaagattcgtgacgtagagaaaggcttcatgtctaataaacacgtgttcgccatcttcaataccgagcagcgcaacgtgtataaagacctgcgccaaattgaactggcttgcgacagtcaagaggacgtagacagctggaaagcgtctttcctccgggccggagtgtacccagaaaaggatcaggctgaaaatgaggatggcgctcaggagaacactttttcaatggaccctcaactggagaggcaggtggaaacaatcagaaatctggtagactcctatgtggcaataatcaataaaagtatcagggatctgatgcccaaaacaattatgcatttgatgatcaacaatactaaagcttttatacaccacgagcttctggcatacctctactcttcagctgatcagtcatccctcatggaagagagtgctgaccaggcgcagagacgtgacgatatgctcagaatgtatcacgccttgaaggaggccctgaacattattggggatatttctactagcacagtgtcgacccctgtaccaccacccgttgacgacacttggctgcagtccgctagcagccactctccgacaccccagaggaggcccgtttcttcgattcaccctccaggtagacctcccgccgtaagaggcccaactcccgggcccccccttattccagtgccagtgggagccgctgctagttttagcgcccctcccataccatcgcgccctggacctcagagcgtgttcgcaaactcagatttgtttccagcaccccctcagatcccttcacgacccgttagaattccgcctgggatccctccaggcgtgccgtcacgccgcccacctgcggcgccgtcccgtcccactattatacgacctgcggagccctccctgcttgattag

SEQ ID NO: 186016 - DNA, 2601 bp, Artificial Sequence
  Description of Artificial Sequence: Synthetic coding sequence
atgggcaaccggggcatggaggagctgatccccctggtgaacaagctgcaggatgcctttagctccatcgggcaaagttgtcacctcgacctcccacagatcgctgttgtggggggccagagcgcaggtaaatcatcggtcctggaaaacttcgtggggcgggacttcctaccccggggatcgggaatcgtgactcgacgcccacttattttgcagctcattttttccaaaaccgagcatgcagaattcttacattgcaagtcgaagaagtttaccgacttcgatgaggtaaggcaggaaattgaagccgagaccgatagagtcacaggaacgaataagggaatcagcccagtgcccattaacctgagggtgtactctcctcacgtgctaaacctgacactcatagatctccccgggattacgaaggtccctgttggtgatcagcctccagatattgagtaccagatcaaggacatgatcctccagttcatttcaagagaatcgagcctgatcctggccgtcactcccgcaaacatggatttggccaactccgacgctctgaagctggccaaagaagtagaccctcagggactgcggacaatcggcgtcattactaagctggatctcatggatgaggggacagatgctcgggacgtacttgagaacaaactactcccactgcggcgaggatacattggagttgtcaaccgctctcaaaaagacatcgagggcaagaaagatattagagcggccctcgcggccgagcgcaaattctttttgtcacacccagcctatagacacatggccgacaggatgggaaccccgcatctccagaaaaccctcaatcaacaactaactaaccatattcgtgaaagcttgcccgccctgcgatccaagctgcagagccagctgctctccctggagaaagaggtggaagaatacaagaactttcgaccagacgatcctacacgaaaaactaaggctctgctgcagatggtccagcagtttggcgtggacttcgaaaaacgaatcgagggaagtggtgatcaggttgacactttagaactatcgggcggcgcccgcattaatcgtattttccatgagaggttcccatttgaacttgtgaaaatggaattcgatgaaaaagatctgcgccgagaaatcagctacgccattaagaacatccacggtgtccggacagggctctttacacctgatatggccttcgaagcgattgttaagaagcagattgtgaaacttaaggagccgtccctcaagtgtgtggaccttgtggtgtctgaactcgccacagtgataaaaaaatgcgccgagaagctgagcagctatcccaggctgcgcgaggaaacagaacgcattgtgaccacgtacatcagggagagggagggacgcactaaggatcaaattctgctcctaattgatattgagcagtcctacataaacacgaatcacgaggattttataggttttgcaaatgctcagcagcgttccacgcagctcaacaaaaagagggccataccgaatcaggtgatcagacgtggctggctcactattaacaacatttctctaatgaagggaggctccaaagagtactggtttgtcctgaccgctgagtctcttagctggtacaaggacgaagaggagaaagaaaaaaagtatatgctccctttggacaacttaaagatccgcgacgtggagaagggattcatgtcgaataagcacgtgtttgccatattcaataccgagcagcgtaacgtgtacaaagacctcagacagattgagctagcttgtgactctcaggaggacgtggatagctggaaggcttccttcttgcgtgcaggggtttatccagaaaaggaccaagcggagaacgaagacggggcgcaggagaatactttttccatggacccccagctagagagacaggttgaaacgattcggaacctcgtagacagctatgtggccatcatcaataaatctatcagggatctaatgcccaaaaccatcatgcacctgatgatcaacaacaccaaagcatttatccatcatgagctactggcctatctgtactcttctgctgaccaatcctccctgatggaggaatcagcagaccaggcacagcgacgagatgatatgctacgcatgtaccacgcattaaaggaggccttgaacatcataggcgatatctctacatccaccgtgtccacccccgtgccgcctcctgtcgatgatacctggcttcagtcagcttcctcccacagccccactccacagaggagacctgtgtcgagcattcacccgcccgggaggccccctgcggtgagaggacccacaccaggtcccccccttattccagttccagtgggagcggcagcatcatttagcgctcctccaatcccatcacggcccggtccacaaagtgttttcgccaactccgacctgtttccagccccacctcagatcccctctagaccagtgcgcatcccaccaggcattcctccgggcgtgccatccaggcgcccgccagcagcgccttctaggccaacaatcatcaggccagcggaaccctcccttctcgactag

SEQ ID NO: 186017 - DNA, 1200 bp, Artificial Sequence
  Description of Artificial Sequence: Synthetic coding sequence
atgctgcccctggagccctacctgacccagaccagcgccgtgccccaaatgtcccattttatgtgccattctccgacacataaaccccaggggctactgccatgggcaccttttcaccaagcgtctgtctctctgtatccgatctctccatggcccagtgagtctgtatgtcctccaacatgtccaggtggagcctcttgctggtttcccgccggaaacgcctgggatagggttgaacttggcttcctgggctttggagctgggggggtgtctattgctgtacctggctttccacttagttgcggtcagggatgttgtgcaggcggttggctggggcacggtgcccgattccctgccaagcttcgcgccttcccccaagtgatcagacgcgggtggctaaccattaacaacatcagcctgatgaaggggggctcaaaagagtactggtttgtgctgactgcagaaagtctgtcttggtataaagacgaagaagagaaagagaaaaaatatatgctgccattggacaatcttaaaattcgtgatgtggagaaaggcttcatgagcaataagcatgtatttgctattttcaatactgagcagaggaacgtgtataaggacctgaggcagatcgagctcgcctgtgatagccaggaagacgttgacagctggaaggcatcattccttcgcgctggagtctacccggagaaagatcaggccgagaacgaggacggcgcccaagagaacactttttccatggacccccaattggagaggcaagtggagaccatcagaaacttggtggactcatacgtcgcgattatcaacaagtccatcagggatctgatgccgaaaacgatcatgcacctcatgataaataataccaaggccttcattcaccacgagctgcttgcatatctgtatagttcggcagaccagtcgtcactgatggaggagtctgccgatcaggctcagagaagagacgacatgctccgtatgtatcatgccctgaaagaggccctgaatatcatcggcgacatttctacctctaccgtgagcacaccagtgcctccaccggttgacgacacctggttgcagtccgcaagctcccattctcctacgccccagaggcgccctgtgtcatccatccatccaccaggcagaccaccagcagtgcgaggaccaactcccggccctccctag

SEQ ID NO: 186018 - DNA, 13284 bp, Artificial Sequence
  Description of Artificial Sequence: Synthetic coding sequence
atgagcagcaaggccgagaagaagcagcggctgagcggccggggctcctcacaggccagctggtctggtcgggcaaccagggctgcagtcgccacacaggaacagggcaatgcgccggccgttagcgagcccgaattacaggctgaactcccaaaggaggagccggaaccccggctggagggaccacaggcccagtcggaggaaagcgtcgagccggaggctgatgtgaaaccgttgttcctttctagagctgccctgaccggactcgccgacgcagtgtggacacaagaacacgacgccatcctcgaacattttgcccaggatcctaccgaatcgatactaactatcttcattgacccttgttttggtcttaaactcgagcttggcatgccagtccaaacacagaaccaactagtgtactttattcggcaagctcctgtccctattacttgggaaaatttcgaagccaccgttcagttcggtacagtcaggggcccgtatattccagccttattgcggctcctcggaggcgtattcgccccccagatattcgcaaacacaggctggcccgagtccattagaaatcactttgcgagccacttgcacaagttcctcgcatgcctcactgacacccggtacaaacttgaagggcacaccgtcctctatatcccagcagaggccatgaatatgaaacctgagatggtcattaaggacaaagaactcgtccagcgcctggaaacatccatgattcactggaccaggcagataaaagagatgttgtccgcacaggagaccgtggagaccggggagaatctgggaccactggaggaaatcgaattttggagaaacaggtgcatggacctgtccggcatcagtaagcagctcgtaaaaaaaggcgtcaagcacgtggagagtattctgcatctcgcgaagagttcctacttggcaccatttatgaagctggcccaacagattcaggacgggtctcggcaagcccagagcaatctgactttcctgtctatcctcaaagagccttatcaggaactcgcgttcatgaagcccaaggatatatcctctaagttgcctaaattaataagtctgataagaattatatgggtgaatagtccgcattacaacacgagagagcgcttaacttctctttttcgcaaagtgtgtgactgccagtaccacttcgcccgatgggaggatggaaaacagggtcccctgccttgtttctttggggcccaggggccacaaattactcgaaacctcctcgaaattgaggacatctttcacaagaatttgcacacgcttagagccgtgagggggggaattctagacgtcaaaaacacttgctggcacgaagattataacaagttcagagccggcattaaagatctggaggttatgacacagaatctgattaccagcgcttttgaactggttcgggatgttcctcatggcgttttgcttctggatacttttcatcgcctggcctcacgggaggcgattaaacgcacctacgataagaaagcagtggacctgtatatgttatttaattctgagctagccctggtgaacagagaaaggaacaaaaaatggcccgacctggaaccatacgtcgctcagtattctgggaaggccagatgggtccacatcctccgaaggcggatcgatcgcgtgatgacgtgcctggccggagcacactttctcccacgaatcggaactggtaaagaatcggtgcacacctatcagcaaatggtgcaggccatcgacgagctcgttcgaaaaacattccaggaatggacctcgagtctcgataaagattgtatccgcaggctcgatactccactcttacgaatcagtcaggagaaggcgggcatgttagatgtgaactttgataagtccttgcttattttgtttgccgagattgactactgggagagactgctcttcgagactccacattatgttgtgaacgttgccgagcgtgcagaggaccttagaattcttagggaaaaccttctgctcgtggcaagagactacaaccgaatcatcgcgatgctgtctcctgacgagcaggcactctttaaagaaaggatcaggttattagacaaaaagatccatccaggactgaagaagcttcactgggcgctaaaaggagcaagcgcctttttcattactgaatgtaggattcatgccagtaaggtgcagatgattgttaatgagttcaaggcatccaccttgactatcggatggcgggcacaggaaatgtccgaaaaactgctcgttcggatttcggggaaacgtgtttaccgcgatctcgagtttgaagaagaccagagagaacatcgtgccgctgtgcagcagaagctgatgaacctccaccaagacgtagtgacaatcatgacgaattcgtacgaggtgtttaaaaacgacggtcccgagatccagcaacagtggatgctgtatatgatccggctggacaggatgatggaagacgcattacgcctgaacgtgaagtggagtctgctcgagttgtccaaagcaatcaacggcgatggcaaaacttcacccaatccgctatttcaggtactggttattcttaaaaatgacctccaggggtctgtggctcaagtggaatttagtcccaccctccagactctcgcgggggtcgtaaatgatatcggaaatcacttattttctactatttctgtgttttgccatctgcctgacatattgacaaaacgtaaactgcaccgggagcccatacagactgtcgtggagcaggatgaggatatcaagaagatccaaactcagattagttctggaatgaccaacaatgcatctctgttgcaaaactacctcaagacatgggacatgtacagggagatctgggagatcaacaaggactcttttatccacaggtatcagagacttaatcctcctgtcagctccttcgttgccgatatcgctaggtacactgaggtggcaaacaatgtccagaaagaagagacggtaacaaatatacagtttgtgctcctggactgttctcacctcaagttttctctggttcagcactgcaatgagtggcagaacaagtttgcaaccctgctgcgggaaatggcagcaggcaggctgctggagctccacacttatctgaaggaaaacgccgagaaaatctcccgccccccccagacgttagaggagctcggggtttccctccagctggttgacgcgctgaaacacgaccttgcaaacgtggagactcaaataccacccattcacgaacaattcgcaatacttgaaaagtacgaagtgccagtggaagactcagttcttgagatgttggactcattgaatggggaatgggtggtgtttcagcagaccctgctcgactccaaacagatgctgaaaaaacataaggagaagtttaaaaccggcttaattcacagcgctgatgacttcaagaagaaggcacataccctcctggaggacttcgagtttaaaggtcatttcactagtaacgttggctacatgagcgcactcgaccagatcacgcaggtgcgagccatgctgatggctatgcgagaagaagagaattccctccgggccaatctcgggatttttaagattgagcagcctcccagcaaggatctccagaatctggagaaggaactcgatgctcttcagcaaatttgggaaattgccagagactgggaggagaactggaacgagtggaagaccggtcgcttccttattctgcaaactgagactatggaaacaacagcccatgggttgttcagaagactgactaagttggccaaagagtacaaggataggaactgggaaattatagaaactactagaagtaaaattgaacagtttaaacgtactatgccattgatctccgacctgagaaatcccgctctccgcgagaggcactgggaccaggtaagagacgaaatccagagagaatttgaccaggagtccgaatcttttactctggagcagatcgttgagctaggcatggatcagcacgttgagaaaatcggcgagatttccgcgagcgctacgaaggagctggctattgaagtcgcccttcagaacattgccaaaacctgggatgtgacccaattggacatcgtgccttacaaggacaaagggcaccatcgattgcgcggaaccgaagaggtgttccaggccctcgaagataatcaagtcgcactttccacaatgaaggcttctcgtttcgtcaaagcatttgaaaaagacgtagaccactgggaaagatgcctatccctcattttggaggtcatcgagatgatcctcaccgtgcagagacaatggatgtacttggagaacatctttttaggcgaggatatcaggaaacagctgccgaatgagtctaccctgttcgaccaggtcaatagcaattggaaagccattatggacaggatgaacaaggacaataatgccctccgctctacccaccaccccggactgctcgacactttgattgaaatgaacaccatcctggaagatatacaaaagagtttagatatgtacttggaaaccaaacgccacatattccctcgattctactttttgagtaatgacgacctgctggaaatccttggacaaagtaggaatcccgaagccgtgcagccacatctcaagaagtgcttcgacaatatcaaattattgagaattcaaaaggtggggggccctagcagcaagtgggaagcagtcggaatgttctctggtgatggtgagtatatcgattttttgcacagtgtgtttctggaaggacccgtggaaagctggctaggcgacgtcgaacagacaatgcgcgtgaccctccgagatctcttgaggaactgtcatttggcccttagaaagtttctgaataagcgcgacaagtgggtgaaagaatgggcagggcaggtcgtgattacggccagccaaatccagtggactgccgatgtgacgaaatgtctgcttaccgcaaaagagcgcgccgataaaaagattcttaaagtgatgaagaaaaaccaggtttccatattgaacaagtacagcgaagccatccgggggaatctgacaaaaattatgagactgaagatcgttgccctagtaacaatcgaaattcatgcccgtgatgttttagaaaaactgtacaagtctggactgatggatgtaaattcattcgattggcttagccagctgaggttctattgggagaaggatctggatgactgcgtgattcggcagaccaacacccaattccagtataactacgagtacctgggcaacagtggacggctagtcatcaccccattgaccgacagatgttatatgacgcttaccaccgctctccaccttcaccgtggcggatcaccaaaagggccggcaggcacaggcaagacggagaccgtgaaagatctgggaaaagctcttgggatttacgtgattgtggtgaactgttcagaaggtttggactataaaagcatgggaagaatgtatagcggcctggctcagacgggagcttggggatgttttgacgagttcaaccgtattaatattgaggtgctcagcgttgtagcacaccaaatcctgtgtattctgtcggctttggcggcgggactgacccactttcacttcgatggatttgaaatcaacttggtgtggagctgcgggatcttcatcactatgaatccaggatacgctggccggacagagctgcctgagaacctgaagagtatgttcaggccaatcgcaatggtagttcccgattccacacttattgctgaaattatcctgttcggtgagggcttcggcaattgcaagattctcgccaagaaagtctacacactttattctctggctgttcaacaattatcgcgtcaagaccattatgacttcggcttacgcgccctgacttccctcctgaggtatgcgggcaagaaaagacgtctccagccagatctgactgatgaagaagtactcctgctcagtatgagagatatgaacatcgctaagctgacctccgtggatgctcccctcttcaatgctattgtgcaggacctctttccaaacattgagcttccagtgattgattatggaaaacttcgcgagaccgtggaacaggagataagggacatgggtctacaaagtacgcctttcacacttaccaaggtgtttcaattgtatgaaacaaagaactcacggcacagcacaatgatcgtgggctgcacgggcagcggcaaaacagcatcttggaggatcttacaagcaagtctctcaagcctgtgccgcgcaggggatccgaatttcaatattgtgagggaattcccccttaaccccaaagcgctgtcactgggagagttgtacggcgaatacgatctgtctactaacgagtggaccgacggaatcttatcgtctgtgatgaggaccgcctgcgccgacgaaaagccagatgaaaagtggatccttttcgatgggccagtcgacacattgtggattgagaacatgaactccgtcatggatgacaacaaagtacttacgctcattaatggcgaacgcatagctatgcccgagcaggtgtcacttctattcgaggttgaggacctcgctatggcatcccccgccacggtgtcacgctgtggtatggtctataccgattatgccgacctgggctggaaaccttatgtgcaaagctggctcgagaaaaggccaaaagcggaagtggagcccctgcagcggatgtttgagaagttaattaacaagatgttagccttcaagaaggataattgtaaagaactggttcctctcccagagtacagcggaatcactagcctttgtaagctgtacagcgcactcgcaactccagagaacggcgtgaatcccgctgacggggaaaattacgtcaccatggtcgaaatgacctttgtcttttccatgatctggtccgtgtgtgctagcgttgacgaagaaggcaggaaacgcatcgatagctatctgagggagattgagggatctttccccaataaggacacagtctacgaatattttgtggacccaaagattagatcgtggacatcattcgaggataaacttcccaaatcctggcgatatcctcctaacgcaccattctataagataatggtgccaactgttgataccgtgagatataattacttagtttcgtcgctggtggccaatcaaaatcctattttgctggtgggacctgtggggacggggaagacatcgatcgctcagagcgtgctgcaatctctgccttcttcccaatggtctgtgctggtagttaatatgagcgcacaaaccacctctaacaatgtgcagtccattatcgagtcaagagtcgaaaagcggactaaaggcgtgtacgttccgtttggcggcaaatcaatgattacctttatggacgacctaaatatgcccgccaaagacatgttcgggtctcagcccccactagagctcattcgactttggatcgactacggcttttggtatgataggactaagcaaactatcaagtatattagagagatgttcctgatggccgcgatggggccaccgggtggaggcagaactgtaatctccccccggctacgcagtcggtttaatataattaatatgacattccctaccaagtctcagattatcagaatctttggaaccatgatcaatcagaaactgcaagactttgaagaagaagttaagcccatcggcaacgtggtcaccgaggcaactctcgacatgtacaatactgtggtccagcgatttctgccaacacctacaaagatgcactatttgtttaatcttagagatatatcaaaagtattccaggggatgttacgcgctaataaggattttcatgatacgaagagttcaattacccgtttgtggatccatgagtgctttagagttttttcggataggcttgttgacgcagctgacaccgaggcctttatgggcattatctcggacaagctgggtagcttcttcgacctgacttttcaccatctgtgtcctagcaagcgccccccgatcttcggtgattttctgaaggagcctaaagtatacgaggaccttaccgaccttacggttctcaagaccgttatggaaaccgcactgaatgagtacaacttgagccctagcgtggttccaatgcagctagtgttattccgcgaagctatagaacacatcacgaggatcgtcagagtgataggacagccccgcggaaatatgctcctggtggggatcggtggaagcgggaggcagtcactcgcgcgtctggcttcaagcatttgtgattacacgacattccaaattgaggttacgaaacattaccggaagcaggagtttcgcgatgacataaagcgcttatatcggcaggcaggtgtcgaactgaagaccacaagcttcatattcgttgacactcaaatcgccgacgagagcttcctggaggatattaacaacatcctgtctagtggagaagtacctaacctgtataagcccgacgaatttgaagaaattcagagtcatatcatagatcaggctagggttgaacaagtgcctgagtcttccgacagcttgtttgcatatctgattgagagagtgcagaataatcttcacattgtgctgtgcctttctccaatgggggaccctttccgtaactggatccggcagtacccagccttggttaattgcacaaccattaactggttttccgagtggcctcaagaggccctgttagaggtagccgaaaaatgcttgatcggggtcgacctcgggacgcaggagaacattcataggaaggtggcccagatctttgtcactatgcactggagcgttgcccagtattcacaaaaaatgcttttagagctgaggcgtcacaactatgtgaccccgacaaagtacttggagctgctctccggatataagaagctcctgggcgagaaacggcaggagctacttgcacaggcgaacaagctcagaactggactgtttaaaatcgatgaaacccgagagaaagtgcaggtgatgagcctggagctcgaggatgccaaaaagaaggtagctgagtttcagaaacagtgtgaagaatatttagtcatcatagttcaacagaaaagagaggcagacgaacaacaaaaagctgtcaccgccaacagcgagaagattgctgttgaggagattaagtgccaagcgctagccgacaatgctcagaaagatctcgaggaagcactgccagccctggaggaagccatgcgggccctggagtctctgaacaagaaagatatcggcgagatcaaaagttacggtcggcctccagcgcaggtggaaattgtgatgcaggccgtgatgatcctgcggggaaatgagcctacatgggcagaagccaagaggcagctgggagaacagaatttcattaaatccctgatcaatttcgacaaggataatatttcagacaaggtcctcaagaaaattggtgcgtactgcgcccagcctgactttcaacctgacatcattggccgtgtatctttggccgctaagtccctgtgtatgtgggttcgggcaatggagctatacggccgtctgtaccgcgttgtcgagcccaaaaggatcaggatgaatgccgcactcgcccagcttagagagaagcaggcagccctggccgaggctcaggagaagctgcgggaagtggcggagaagctcgagatgctgaagaaacagtatgacgaaaagctcgctcagaaagaggaattaaggaagaaatctgaagagatggaattgaagctcgagagagccggaatgttggtgagcggacttgccggagaaaaggccaggtgggaggaaacagtccaagggctcgaagaggacttagggtacctggtgggagattgcctgttggccgctgcctttttaagctatatgggcccctttctcactaattacagggatgagatagtgaatcagatctggatcggtaagatctgggagctccaggtgccgtgctcgccctcctttgcgattgacaattttctgtgcaatcctactaaagtgcgcgactggaacatccaggggctgccaagcgatgcattctcaactgagaacgggatcatagtgaccagggggaaccgatgggcgctcatgatcgatcctcaggcgcaggcactcaaatggatcaagaacatggagggcgggcaggggctgaagatcattgacctgcagatgagtgattacctccggatcctggaacatgcaattcactttgggtacccggtgttgctccagaatgtgcaggaatatttagatcccaccctcaacccgatgctgaacaagagcgtggcccggattggcggcaggctgttaatgcggatcggtgataaggaagttgagtacaacaccaactttagattctacatcaccaccaaactctcaaaccctcattattctcccgagacaagtgcgaaaaccacgattgtgaactttgctgtgaaagaacagggactcgaggcccaattgctggggatcgttgtgaggaaagagagacccgagctggaggagcagaaggattctctggtcatcaatattgctgccgggaagcgaaagctgaaggaactagaagacgaaatcctccggctattgaatgaagcaacaggatccctactagacgatgtgcagctggtgaatacactccacacctcgaagatcacagccacagaggtgacagagcaacttgaaacctccgagaccaccgaaattaacactgatctggcccgggaagcatatagaccttgtgcacagagagcctcaattctgttcttcgtgttgaacgacatgggttgtatagaccccatgtatcaattttctctggatgcgtatatcagtctcttcatcctcagcatagataaatcccaccgttcaaataagcttgaggataggatcgactaccttaatgactatcatacctatgctgtgtaccgctatacatgccggaccctgttcgaaagacacaagctgcttttctcatttcacatgtgtgccaagattctagagacctctgggaagctgaacatggatgagtataacttctttctgaggggaggagtagtgctcgatcgagagggccagatggacaatccgtgcagttcctggctagccgacgcttactgggacaatatcaccgaacttgataagctgacaaattttcacgggttgatgaatagttttgagcaatatccaagagattggcatctgtggtacacaaatgcggcaccagaaaaggcgatgttaccaggagagtgggaaaatgcatgcaacgagatgcaacgcatgcttatagtacgcagccttaggcaggatcgcgtggctttctgtgtcacctctttcatcattactaacctgggaagtcgtttcatcgagcctcctgtgctaaacatgaagtcagtactggaggacagtactccaagaagcccccttgtgttcatactttcacccggggttgatcccacttctgccttgctccagctggcggaacatatgggcatggcccagcgctttcatgcgctgagtctgggccagggccaggctccaattgctgctcgcctcctgcgcgagggcgttacccaggggcactgggtgtttctcgctaactgtcacctgtctcttagttggatgccaaatcttgataaattagtcgagcagctgcaagtagaggacccccacccctcattccggctttggctcagctctatccctcatccagatttccccatcagtatcctgcaagtaagcatcaagatgaccacggagcccccgaagggcctgaaggcaaacatgacacgactctaccagctgatgtctgaaccacagttttctaggtgtagcaaacccgctaagtacaagaagttgttgttctcactgtgcttcttccatagcgtgctgttggagaggaagaaatttctgcagctcggatggaatattatttacggctttaacgacagtgatttcgaggtctctgagaatctgctttctctgtatctcgatgagtatgaagagaccccctgggacgctctgaagtatttgattgctggtataaattacggcggacatgtgacggacgactgggatcgcagactgctgaccacttatattaacgattacttttgtgaccagagtttatctaccccattccaccgactttctgccctggaaacatatttcatacccaaggacggaagtcttgccagctataaagaatacatctctctgctacccggtatggacccccccgaggcattcggccagcacccaaacgcagacgttgccagccagattaccgaagctcagacactctttgatactcttctgtccctacagccccaaatcaccccaactcgcgccggtggccaaacaagggaagaaaaagtgctagagctggccgccgatgtgaaacaaaaaattccagagatgatcgattacgagggcacacagaagcttctggctctggatcccagcccgttgaatgttgtgctgttacaggaaatacagcgctataacactcttatgcaaaccattttgttctccctgactgatctggaaaagggtattcagggactaatcgttatgagtactagtctcgaggaaatctttaactgtatttttgatgcacatgtgccaccactgtggggcaaggcttaccccagtcaaaaaccccttgctgcatggaccagggatctggctatgagagtggaacagttcgagctgtgggcttcccgggctcgcccgcccgtaattttttggctgtccggtttcacctttccgactggcttcctgactgccgttctgcagtcctccgcccgccagaataacgtcagtgttgattcactaagttgggaatttattgttagtacagttgacgactcaaatcttgtgtaccctccgaaggatggcgtgtgggtgcgcgggttatatctggaaggtgcagggtgggataggaaaaactcatgcttggtggaggcagaacccatgcagttagtctgtctcatgcccaccattcacttccgccctgcagagagcaggaagaaatctgcgaaaggaatgtactcctgcccctgctattattaccctaatagagctggctccagcgaccgggcgtcctttgtaattggtattgatctgaggagcggggcaatgacacctgaccattggatcaagagaggaacagctctgttgatgtccctggacagctag

SEQ ID NO: 186019 - DNA, 1782 bp, Artificial Sequence
  Description of Artificial Sequence: Synthetic coding sequence
atggagatcgtgtacgtgtacgtgaagaagcggagcgagttcggcaagcagtgcaacttcagcgacagacaggccgagctgaatatagatatcatgccaaatcccgaattagcagagcagttcgtagagcgaaaccccgtggacacgggaattcaatgctctatttcaatgtctgagcacgaagctaattccgaacgcttcgaaatggagaccagaggcgtgaatcatgtggagggagggtggccgaaggacgtgaaccctctggagctggagcagacaatccgcttcaggaagaaggtggagaaggatgagaattatgtgaatgccatcatgcagcttggctctattatggagcattgcataaagcaaaacaacgcaatcgacatctatgaagaatattttaacgacgaagaagccatggaagtgatggaggaggacccatccgctaagaccatcaacgtgttccgggaccctcaggagatcaagcgagccgctactcatctgtcatggcacccggatggcaacagaaaactagccgttgcctattcttgcctggactttcaacgtgcccctgtgggcatgagttctgacagctacatctgggacctggaaaaccccaataagccggagcttgctctcaaacctagttctccacttgtaacattggagtttaatcccaaagatagccacgtgctcctgggcggctgctacaacgggcagatcgcatgttgggatactcgcaagggatctctggtggccgaactcagcactatagagtcctcccaccgggaccctgtctatggcacaatatggctgcagtcgaagaccgggacagaatgcttcagcgcttccacagatggtcaagtgatgtggtgggacatccggaagatgtcggagcctacagaggtggtgatcctcgatataacaaagaaagagcagctggaaaatgcactcggagccatctccttggaatttgaaagcacgctacccacgaagttcatggtggggaccgagcaaggcatagtgatttcctgtaaccgtaaggctaaaacttcggcagaaaagatcgtgtgtacttttcccggtcatcacgggccaatctatgcgcttcagagaaatccgttctaccctaaaaattttctcacggtgggcgactggactgcccgaatctggtctgaggactcgcgagagtctagtattatgtggaccaaataccatatggcatatttgacagatgctgcatggagtccagtgcggcccaccgttttctttaccacccgtatggatgggactctcgatatttgggattttatgtttgagcagtgtgatcccactctaagcctgaaggacaatggatgcctcattgcgtgtggttcgcagttagggacaacaacactgttggaggtcagccccgggctgtcaactctgcaaaggaacgagaagaatgtagctagctccatgtttgagagagaaactagaagggagaagatcctcgaggcccgacaccgtgaaatgaggctgaaagagaaggggaaggccgaaggtcgggatgaggagcaaactgatgaagagctcgccgtagatctggaagccttagtgagcaaggccgaggaggaattcttcgacataatctttgccgaacttaaaaagaaagaagcagatgccattaagctgactcccgtgccccagcagccttcacccgaggaggatcaggttgtggaggagggtgaggaggccgcaggggaggagggtgatgaggaggtggaggaggaccttgcctag

SEQ ID NO: 186020 - DNA, 2676 bp, Artificial Sequence
  Description of Artificial Sequence: Synthetic coding sequence
gagaaggacaacggcctggacgtgttcaagctgagcgaccgggacttcctgagatctatggagaacgccatacgatttgggaagccttgcctgctagaaaacgtaggggaagaattagatccggcccttgaaccagtcctactgaagcagacttataagcagcagggaaacacagtgctcaagctgggagatactgtcattccctatcatgaagactttaggatgtatataaccaccaaacttcccaacccgcattacactccagagatttctaccaagctgacattgatcaacttcacccttagccctagcggccttgaagaccagctgttaggacaggtcgttgctgaggagcgccctgacctggaagaagcgaagaatcagttaataatatcaaacgcaaaaatgaggcaagagctgaaagacatcgaagatcagattttatatcgcttgtcttcatcggaaggcaacccagtggatgatatggagcttattaaggtgctggaggcctctaaaatgaaagccgcggaaattcaggcaaaagtccgaatcgccgaacagacggagaaggacattgacttgacaaggatggaatatatccctgtcgccattaggacccagatcttgttcttttgcgtgtccgatctcgctaacgtggatcccatgtatcagtatagcctggagtggtttttgaacattttcttatccgggatagctaacagtgagcgcgccgacaacctgaagaagcgcatttctaacataaaccgatacctgacttacagtttgtattccaacgtgtgtagaagcctcttcgagaagcacaagctcatgtttgcattcctcctctgcgttagaataatgatgaatgagggcaagatcaatcagagtgagtggaggtacttactgagcggaggatccatctctataatgaccgaaaatccggcccctgattggttatcagaccgggcttggcgcgacatcctggccctgtccaatctcccgacattttcttcattttcctccgacttcgtgaagcatctgtccgaatttagagtaatcttcgactccctggagccgcatcgagaacccttaccgggaatctgggaccaatatttagaccaatttcaaaaattgctggtgctgagatgcttgcgaggcgataaggttactaacgccatgcaagacttcgtagctacaaatctggagccacgcttcatcgagcctcagactgctaacctctcggtcgttttcaaggactccaacagcaccacccctttaatttttgtattatcgcctggtacagatccggccgccgatctttataagttcgcagaggagatgaagtttagcaagaagctgtcagccatcagtctcggacaggggcagggtccccgagccgaggccatgatgcgctcctcaattgaacggggcaagtgggtgtttttccagaactgtcatctcgcacccagttggatgcctgccctggagcgcctgatcgagcacatcaatcccgacaaagtccatagagatttccgtttgtggctgacttctctcccctctaataaattccctgtgtctatactgcagaatggtagcaagatgaccattgaaccccctcgtggagtcagggccaacctgctgaagtcttattcatctctgggagaggacttcctcaacagctgccataaggtgatggaatttaaatcactgttgctttctctttgtctgtttcatggaaacgcactggagcggcataagttcgggccacttggattcaacattccgtatgagttcactgacggagatctccgcatctgcatttctcagcttaagatgttcctggacgaatacgacgacattccatacaaggtgctcaagtataccgccggagagatcaactacggaggcagggttacagacgactgggataggcgatgtattatgaatattctggaagatttctataaccccgatgtcctaagccccgagcattcttatagtgcttccgggatctaccaccaaattccaccaacgtacgacctgcatggctacctgtcctatattaagtcgctccccctcaatgatatgccagaaatttttggactgcacgacaatgccaatattacatttgcccagaacgagacgtttgcgttgttgggaacaatcattcagttacaaccaaagtcttccagcgccggatctcagggaagggaagaaattgttgaggacgtgacacaaaacatcctgctgaaggtgccagaaccaattaatctgcagtgggtgatggccaaataccccgtgctgtacgaggagtcaatgaataccgtgcttgttcaggaggttatcaggtataatcgtctactgcaggtgattacccaaacccttcaggacctgctgaaggctcttaagggtctcgttgtgatgtcctcccagctggaactcatggctgcatcactatacaacaacacggtgcccgagctctggtccgctaaggcctaccctagtttaaagcctctgagctcttgggtgatggacctgttacagcggcttgacttcctgcaggcatggatccaagacggcatccctgctgtgttttggatcagcggattttttttccctcaggccttcaatcggcattccgctgaattttgcccacagatctgtcatcttcattag

SEQ ID NO: 186021 - DNA, 12798 bp, Artificial Sequence
  Description of Artificial Sequence: Synthetic coding sequence
atggagcagcccaacagcaagggctacagcctgggccggaccccccaaggccctgagtgcagtagcgctccagccgtgcaggtggggacccatcgtggactggagtacaaccccgggaagattctccccggttctgactacggactggggaacccacccgctctcgacccgaaactcccccacctcccactcccccccgctccacctaccctctcggatctggggcaacctcggaagtcacccctgacaggaacagacaagaaatatcccctgatgaagcagcggggtttctactctgacatactgtcacccgggactctcgaccagttaggggaggtgtgtaggggcccacgcatgagtcagaacctgctccgtcaagcagatctcgacaagtttacccctcgggtaggttccttcgaagtcccagaggattttcaggaacgaatggaacagcaatgtattggttccaccacaagactacttgcacaaaccgatttcccgctacaagcatacgaaccaaagatgcaggtcccgttccaggtgctgcctggacagcaccctagaaagatcgaaatcgagcggagaaaacaacagtacctgtccttagatattgaacaactcctgttcagccagggtattgatagtaacaagctaatgcctcggcacctcgatcatcaacatccccagaccatagaacaaggccacgatccaatctttccaatctacctgcctttgaaggtcttcgataacgaggactttgactgtaggactccacgagaatggatcaacatgggtctggaaccaggcagcctcgataggaaaccagtgcccgggaaggccctgcttccaactgacgattttctgggtcacgaggatcccaaaagtcaaaaactcaagtataaatggtgcgaagtgggagtgcttgactatgacgaggagaaaaaattatatctggtgcataaaaccgatgagaaaggactggttcgtgacgagatgggcagaccaatcttaaatgcgggcgtgaccaccgaaggaagacctcccctccaagtttgccagtattgggttccccgaatccagctgctcttctgcgctgaggacccctgtatgtttgcccagagggtagttcaggcgaacgctttacgcaaaaataccgaggcattgctattgtataacttgtatgtggattgtatgccctccgacggccagcatgtgataagcgagcagtctctctccaagatcaagcagtgggcactttcgaccccacgcatgcggaaaggaccctctgtactggagcacctgagtagcctagcccgggaggtgtctctggattacgagagaagtatgaataagattaacttcgaccatgtggttagctccaagcctgagacattcagttatgttaccctgccgaagaaggaggaggagcaggtacccgaaagaggattggtgagcgtcccaaagtatcacttctgggagcagaaagaggactttactttcgtgagcctcctgactaggccagaggtcattactgctcttagtaaagtgcgggctgaatgtaataaagtaacagctatgagcctgttccacagcagtctgtctaagtacagccaccttgaagaatttgagcagatccagagccagacgttctcccaggtgcagatgttcctgaaggacagctggatctcatcattgaaggtagctatgaggtcaagcctccgggatatgagcaagggatggtacaatctctacgaaactaactgggaagtctatttgatgagcaagctgcggaaacttatggaactcgtcaagtacatgctgcaggatactctgagattccttgtgcaagacagcttggcctccttcagtcagttcattagtgatacttgctgttcagtgctcaattgtacggatgacatggtttggggcgatgatttgatcaattcaccttaccggccgcgcaagaacccgcttttcatcatggatcttgttctggactcttctggagtccattatagcactcccctggaacagtttgaggcgtctctccttaatctttttgacaaagggattctcgctactcacgccgttccccagctggagaaattggtgatggaggacatctttatttccggagatccactccttgaatcggtggggctgcatgagccattggttgaagaattgagagcaaccattgcttccgcagtatccaaagcgatgataccactgcaggcctacgcgaaagagtataggaagtacttggagctgaacaataatgatatcgcctcattcctaaagacttaccagacgcagggcttgctggcccaagaagtgagggaggtggtactcactcacctgcgggaaaaagagatcctcgatagctctttgcccagtagcattatcatcggccccttctatataaacacagataacgtgaaacagtcactgtctaaaaagcggaaggcgctcgcgacttctgtgttggacattcttgctaaaaacctgcacaaagaagtggacagcatttgcgaggagtttagaagcatctcccgcaagatttatgagaaaccgaacagcattgaggagctggctgaactccgggagtggatgaagggcattccagaaagactggtagggctggaagaaaggatagtcaaagtcatggacgactaccaagtgatggacgagttcctgtacaacctgtcgtctgacgatttcaacgataagtggatcgccagtaactggccttccaagatccttgggcaaatcgagcttgttcaacagcagcacgtggaggatgaggaaaaatttagaaagattcaaatcatggaccagaacaacttccaggagaagctggagggactgcagttggtcgttgctggattttcgatccacgttgagatttcccgcgctcatgaaattgcaaatgaggtccgcagagtgaagaaacaactgaaagattgccagcagcttgcgatgctatacaacaaccgagaaagaatcttctccttacctattactaactacgataaactgagcaggatggttaaggagttccagccctacttagacctgtggacaaccgcatctgactggcttaggtggtctgaatcctggatgaacgatcccttgtccgctattgatgccgaacagcttgagaaaaatgtggttgaggcctttaaaaccatgcataagtgcgtaaagcagtttaaggatatgcctgcatgtcaggaagtggctctcgacatacgggctcgcatcgaggaattcaagccttatattcctctaatccagggactgagaaaccctgggatgagaatccgccactgggagaccctgtccaatcagattaatatcaatgtcagacctaaagccaatctcactttcgctcgctgtctggagatgaatctgcaggaccacatcgaaagtatctctaaagtggctgaggtcgctggaaaggagtacgccattgagcaggccttagacaagatggaaaaggaatggagcaccatcctctttaacgtcttaccttataaggctaccgatacatacatactgaagagccctgatgaggcttctcagctattggacgatcatatcgtcatgacgcagaatatgtcatttagcccctacaaaaagccattcgagcaaaggatcaatagctgggaaaacaagcttaaactgacacaggaagtgctggaagaatggctgaattgccagcgcagctggttatacctggaaccaatattcagcagcgaggatatcaaccagcagttgcctgttgaaagcaagagataccagacgatggaacgaatttggaagaagataatgaaaaatgcatacgaaaaccgggaagtgattaatgtgtgctctgatctgagaatgctcgactccctcagagattgtaacaagatactggacctggttcagaagggactttcagagtatctggagaccaagcgctccgcatttcctcgattctatttcttgagcgatgacgagctcttggaaatacttagccaaacgaaggaccctacagctgttcagcctcacctgcgaaagtgtttcgagaatattgctcggctgctgtttcaggaagacttggaaatcactcatatgtattccgctgagggcgaggaggtacagttatgcttttcaatatatccatcttccaatgtggaagactggctgagggaagtcgagcgaagcatgaaggcatccgtgcatgacatcatcgaaaaagcaattagggcttatcctacaatgccccgtacccagtgggttcttaactggcctggtcaagttacgatagctggatgccaaacttattggacaatggaggtagccgaggctctggaagctggtaacctccggtcccagctcttcccacaactgtgccagcagttgagcgatctggtagcactagtccgaggcaaactgagtaggatgcagcgggcggtgctctccgcgctcatcgtgattgaggtccatgcaaaggacgtggtgagtaagctgattcaggaaaatgtcgtcagtgtgaacgacttccagtggatctctcaactgcggtactattggactaataacgacttgtatatccgggcggtaaacgcagagttcatttatggctacgaatatcttgggaactcagggcggctggtcattaccccccttactgatcgttgttacctgacactcacaggggcattgcacctgaagttcggaggagctccggccgggcccgctggtactggcaaaacagaaacaaccaaagacttaggaaaagccctggccatccagacagtggtgtttaattgctccgaccagcttgactttatggccatggggaagtttttcaaagggctggcatcagccggagcctgggcatgctttgacgaattcaatagaattgacatcgaggttctctccgtggtagcgcagcagattactacgatccagaaagcccagcagcagcgagttgagaggttcatgtttgaaggcgtcgaaattccactcgtgccatcttgtgccgtgtttattacaatgaaccccggctacgcagggcgcacagagctgccggataatctaaaggctttgtttcgtcccgtcgccatgatggtgcctgattatgcaatgattacagagattagcctctactccttcgggtttaatgaggcaagtgtgctcgcgaagaaaattactaccactttcaagctctcatctgagcagctgtcctcccaagatcattacgacttcggaatgcgcgctgtgaagacagtgatctcagccgctgggaatctaaagagagagaacccctccatgaacgaagaactgatatgtctacgtgccatccgggatgtgaacgtaccgaaatttctacaggaggatcttaagctctttagtgggattgtgtctgatctcttccctactatcaaagaggaggataccgactatggcatcctggacgaggctatcagagaggcctgccggaattctaatttaaaggatgtagaaggttttcttacaaaatgcatccagctgtacgaaaccaccgtggtccgacacggcctcatgctggtaggccctacggggtccggcaagtcaacatgctatagagtgctggcagccgctatgaccagcctgaagggtcagccgtcaatttccggtggtatgtatgaagctgtgaattattatgtgctgaatccaaagtccatcaccatgggccagctctatggggaattcgatctgctgacccacgagtggacggatgggatatttagttctttcattcgggcaggtgccatcaccagcgatactaataaaaaatggtacatgtttgatggccctgtcgatgctatctggatagagaatatgaacaccgtcttggatgacaataagaagctctgccttagctccggcgagatcattaaactcaccgaagccatgacaatgatgttcgaggttcaggacctggcggtggcttcacccgcgactgtgagccggtgcgggatggtttacctggaacctagcatcctgggactgatgccctttatcgaatgctggctgcggaagctgccccctttactcaagccatacgaggagcacttcaaggcccttttcgtgagctttttagaagaaagcatatccttcgtgcggtccagtgtgaaggaggttatagcctcgaccaactgcaacctgacaatgagtctgcttaaactgctggattgttttttcaagccattcctgcctagagaaggccttaaaaaaataccaagcgagaagctgtcccgcattgtagagctgatcgaaccatggtttatcttctctttgatttggagtgttggggccaccggcgattccagtggaaggacgtccttcagtcattggctaagactcaagatggagaacgagcagctgaccctgctttttcccgaggaaggtcttgtttttgattataggttagaggatgctggcatatccggcactaatgattcagaggatgaagaggaggaatacaaacaggtggcctgggtgaagtggatggactcaagcgctccgttcaccatggtgccggatacaaattactgtaacattattgttcccacaatggacacggttcagatgtcacacctgcttgatatgctcctcacaaataagaaacctgtactgtgtatcggccccacaggtaccggcaaaactctgaccatttccgacaagttacttaagaatctcgcattggattatatatcacacttcctgacctttagtgcccggacttcagctaaccagactcaggacttcatcgatagcaagctggacaagagacggaaaggcgtgtttggaccccccctggggagaaactttattttttttatcgacgacttgaatatgccggccctggagacctatggggctcagccccccatagaactcctcagacaatggatggaccacggtgggtggtacgaccgcaagatcattggggcctttaagaatctagtcgacatcaactttgtttgtgctatgggcccccccggagggggtcgaaacaccgtgacaccccgccttatgcgccacttcaactatttaagttttgcggaaatggatgaggtctccaagaagcggatcttttccacgattctggggaactggctggacggtctgcttggagaaaagtcataccgcgagagagtgcccggggcccctcacatcgcccacttcactgaaccattggttgaggctaccatcatggtgtacgctactatcactagccagctcttgcctacacccgcaaagtcccattacacattcaacctgcgcgatctcagcaaagtgtttcagggcatgctaatggccgaccccgcaaaggtggaggatcaggtccaactgctgcgactctggtaccacgaaaattgtagggtctttcgggaccggctagtgaacgaggaggaccggagctggtttgatcagttactcaagagatgtatggaacagtgggaggtgacctttaacaaggtctgtccttttcagccaattttgtacggcgacttcatgtccccaggaagtgatgtgaagtcctacgaactgattacatctgaatcaaaaatgatgcaagtgatcgaagagtacattgaagactacaatcagatcaacacagccaaactaaagttggttctatttatggacgcaatgtcacatatctgccgtatcagtcgaacgctcaggcaggcacttggcaacgccctgctactgggcgttggtggctcagggcgctcatccctgacccgactggcaagtcacatggcagagtatgaatgcttccagattgagctgtctaagaactacggaatgagcgaatggagggacgacgttaagaaggttctactgaaggcgggcctgcagaatctacccattacgttcctcttttctgatacccagataaagaatgagtctttcctcgaggacataaacaatgtcctgaatagcggagatatccccaatctgtatactgccgacgagcaggaccagatcgttagcacaatgcggccatatattcaggaacagggcttgcagcccaccaaagccaatttgatggcggcctatacaggccgggtgagatccaatatccatatggtgctctgcatgagccccatcggagaagtattcagggcaagactccgtcagtttccatccctggtcaattgttgtaccattgattggtttaacgagtggcccgcggaggctttaaagagtgtcgctacggtcttcttgaatgagattccagagctggaaagttcccaggaggaaattcaaggcctcatacaggtctgtgtgtatatccaccagagcgtctcaaaaaaatgcattgaatatctggccgaactgacacgccacaactatgtcacccctaagtcctaccttgaattactgcatatctttagcattttaattggccagaaaaaactcgagctaaaaaccgccaagaacagaatgaaatctggtttggacaagctgttgagaaccagtgaagacgtggctaagatgcaggaggacctggaatccatgcacccgctgctcgaagaagctgccaaagacaccatgctgaccatggaacaaattaaggtggatacagcaatcgcagaagaaactcgaaactcagtgcagacagaggaaattaaagcaaatgaaaaggctaagaaagctcaggccatcgcagatgatgcccagaaggacctcgacgaagctctgcctgcactggatgcggccctggcctcattaaggaaccttaataagaatgatgtcactgaagtgcgagctatgcagcgaccaccaccaggggtcaaactggttattgaggccgtctgcattatgaagggcattaaaccaaagaaggtaccgggcgagaagcctggtaccaaggtggacgactattgggagccaggaaagggtttgctgcaggatccaggccacttcctggagagtctatttaagtttgataaggacaacattggagatgttgtgattaaagcaatccagccatacattgataacgaggagtttcagccagccactatcgccaaggtgtcaaaagcgtgtacctcaatttgccaatgggtgcgagctatgcacaagtaccatttcgtggccaaggccgtggagcccaagcgccaggctctgctggaggcacaagacgatctcggagtaacacagcggattttggacgaggcaaagcagcggctgagggaggtggaggatggaatcgccaccatgcaagcaaagtatcgcgaatgtataactaagaaagaggagctggagcttaagtgtgaacaatgcgaacagcgcctgggtcgcgccggtaaactgatcaatggcttgtccgacgagaaagtccggtggcaggagactgtagaaaatctacagtatatgctcaacaacatttcgggggacgtgcttgtcgccgcgggtttcgtagcctatctcggccctttcaccggacagtatagaacagtcttgtatgacagttgggtcaagcaactgagatctcacaatgtcccccacacaagtgaacctacacttatcgggacattagggaatccagtcaagatccgcagctggcaaattgccggcctaccaaacgatactttgagtgttgaaaatggcgttatcaatcagttttcacagcgatggacacacttcatcgatcctcaatcccaggctaacaagtggataaagaacatggaaaaggacaatggcctggatgtcttcaagctgtctgatagggacttcctcagatctatggagaacgctatccgcttcggaaagccctgccttctagagaatgtgggtgaggaactggaccctgcgcttgagcccgttctgctgaagcagacttacaagcagcagggaaataccgtgctgaaactcggcgatactgtgataccgtaccatgaagacttccgcatgtatatcactacaaagctcccaaatccccattacactccagaaatcagcacaaaactgaccttaataaactttactctgtcgccaagtggcctggaggatcagctgctaggacaagttgttgctgaagagagaccggacctggaggaggccaagaaccagcttatcatcagtaatgcgaagatgcgccaagagctcaaggatatcgaagatcaaatcctgtataggctgagttctagcgagggtaatccagttgatgacatggaattgattaaagtcctggaagccagtaagatgaaagcagccgaaatccaggctaaggtgcgcatagctgagcagacagagaaggatatagatctgaccagaatggagtacatcccggtggccataagaacccagattctattcttctgtgtgagcgacctcgctaatgtggaccctatgtatcagtacagtctggagtggttcttgaatattttcctgtctggaatcgccaatagtgagcgggctgataatcttaaaaagagaatatcaaacataaaccggtatcttacgtacagcctctattccaatgtgtgtagaagcctgttcgagaaacacaaactaatgtttgctttcctcctctgtgtgcgcattatgatgaatgagggcaaaatcaaccagagcgaatggagatacctactgagtggaggctctatctcaatcatgaccgagaatcctgcccctgactggctgagcgatagggcttggcgggatattcttgcactaagcaacctacccacctttagtagcttcagttctgattttgtgaagcatctgagtgagtttcgggtcatttttgatagcttggagcctcaccgggagccgctgcccggaatctgggatcagtacctggatcagttccaaaaactgctggtgcttcgctgcctgcggggtgacaaggtcaccaacgctatgcaggacttcgtcgcgaccaacctggaacctagattcattgaaccacagacagcaaatctatccgtcgtgttcaaagattctaattccactacaccactgatctttgtgctatcacccggcacagaccccgctgccgatctttataagtttgccgaagagatgaaattttcgaaaaaactgagtgccatttccctcggacagggccaaggcccgcgtgccgaggctatgatgaggtctagcattgagcgcggcaagtgggtcttctttcaaaattgccatcttgcaccctcttggatgccagcactggagcgcttaattgaacacatcaacccagataaagtacaccgagactttagactttggcttacatctttaccaagcaacaagttccccgtgtccatacttcagaacggttcaaaaatgactatcgaacctccacggggcgtcagagccaacctccttaagtcctacagttccctgggcgaggacttcctgaacagttgtcataaggtgatggagttcaagtccttgctgctctccctgtgcttgttccatggaaatgctctggaaagacacaaattcgggcctctgggatttaacattccatatgagttcactgatggtgatctgaggatctgtatttctcagctgaagatgttcctggacgaatacgatgatattccttacaaggttctcaaatatactgctggggaaatcaactacggaggacgggtcacggatgactgggatcgaaggtgtattatgaacattctcgaagacttttataatcccgacgtgctgtctcccgagcattcatacagcgcaagtggaatataccaccaaatccctcctacatacgatctccacggttatttatcatacatcaaaagtttgccactgaacgacatgccagagattttcgggctacacgataatgctaatattacctttgcacagaacgagacatttgcactactcggcactatcattcaactacagcctaagtcatcttctgcagggtctcagggtagagaagagatagtggaggacgtgacgcaaaatattctgttaaaggttcccgagcccattaatcttcagtgggtgatggccaaataccccgtgttgtatgaagagagcatgaacaccgtgctggtccaggaggtgatacgttacaacaggctcttgcaagttattacgcagacattgcaggacttactcaaggccctgaagggattggtcgtgatgtcctcgcagctggaactaatggcagcttctctgtacaataataccgtccccgagctctggtctgccaaagcctacccctcgcttaagcctctgagcagctgggtgatggacctcctccagcggctggatttccttcaggcgtggatccaggacggaattcccgcagttttttggatatctggattcttttttcctcaagcctttctaactgggactctccagaactttgccaggaagttcgtgatatcaattgacaccatctccttcgacttcaaagtgatgtttgaagcaccctcagagctgactcagcggccccaggtagggtgttatatacacggtctgttcttggagggagcacgctgggatccagaagcgtttcagcttgctgagtcccagcccaaagagttgtacactgagatggcagtgatttggctcctccctacgcctaacagaaaagcccaggatcaagatttctacctgtgcccaatttataagactctgactagagcaggtacccttagcaccaccgggcactctacaaattacgtgatcgcagtggaaatcccaacccatcagcctcaacgtcactggatcaaacgaggtgtagccctaatttgcgctttggattactag

SEQ ID NO: 186022 - DNA, 13416 bp, Artificial Sequence
  Description of Artificial Sequence: Synthetic coding sequence
atggtgcccgaggaggtggaggtggagatcgacgagatccccgtgcttagtgaggagggtgaggaagaggaggagacatatagccagaaagtggagtcagtcgataaagtgagggcaaagagagtgtcacttcggacagagtcactggggcagccactgaaccgagaggatgaagagatggataaggagatttccgaaaagctcccatcgaagcggaccgccaaacacatcatggagaagatgcacttgcacatgttatgtacccctttgccagaagagtttctcgaccagaatgtggtcttctttctgaggaacacgaaagaggcaatttccgaagccactgatatgaaggaagccatggaaatcatgcccgagacactggagtatggaatcatcaatgccaatgtgttgcacttcctgaagaatatcatctgccaggtgttcctgcccgcactcagctttaaccaacatagaacttcgacaaccgttggcgtcacaagcggcgaagtttccaatagttcggagcatgaatccgacctgcccccaatgcctggcgaagctgttgagtaccatagcattcagcttatccgagacgagttcctcatgaatgtgcagaagttcgcctccaatattcagcggacaatgcagcagcttgaaggagaaatcaaactggaaatgcctatcattagcgtggagggagaggtgtccgatctcgcagcagatccagagactgtggacatattggagcagtgcgttatcaactggctgaaccagattagcaccgctgtggaagcccaactgaaaaaaacgccccaaggaaagggccccttggctgagattgaattttggcgtgagcgcaacgccacactgtccgctctacacgaacagactaaactgcccattgtgcggaaagtgttggacgtaatcaaggagtccgacagtatgttagttgccaatctgcagcctgtctttacagaactgttcaagtttcacacagaggcctctgacaatgtacgcttcctgtccacggtggagagatatttcaaaaatatcacccacggctccggctttcacgtggtgttagatactattcccgccatgatgagtgcactccggatggtctggattattagtcggcactataataaagacgagaggatgatacccctcatggaaagaattgcatgggaaatagccgagcgggtgtgcagggtcgtgaatctgcgcacacttttcaaggagaacagggcctcggcgcagagtaagaccctggaggctcgaaacaccctgcgactgtggaagaaggcttacttcgacacccgcgctaagatagaagcaagtgggagggaagacagatgggaattcgacaggaagcggttgttcgaaagaaccgactacatggccaccatttgccaggatctgtccgacgtgctccagattctagaggagttctacaacattttcgggcctgaacttaaggccgttaccggcgaccccaaacgaattgatgacgtgctctgcagagtcgacggtcttgtgaccccaatggagaatttgacattcgatccctttagcatcaagtcttcccagttttggaagtatgtgatggacgaattcaaaatcgaggttttgatagatattatcaacaaaatattcgttcagaatttggaaaacccacctctatacaagaaccacccacctgtggccggagcaatctattgggaacggtccctcttcttccgtatcaagcacaccatcttgcggtttcaggaagtccaggaaattctggatagcgataggggccaggaggtcaagcagaagtacctcgaagtggggagaaccatgaaggagtacgaggaccggaaatatgaacagtggatggaggtaactgagcaggtactgccggcactgatgaaaaagtccctgctcacaaaaagtagcatagccactgaggagccatcgaccctcgagcgcggcgcagttttcgcaataaactttagtccggcacttcgcgaaatcattaacgaaaccaaatacttagaacagttaggtttcaccgttccagaactcgcccgcaatgtcgcccttcaggaagataaattcctcagatacaccgcaggaatccagcggatgttagaccactaccatatgctcattgggaccctcaatgacgccgagagtgttctgctgaaggatcactctcaggagttgttgagggtcttccgctccggatacaaacgacttaactggaacagcctcggcataggggactatatcacgggatgcaagcaagcaatcggaaagttcgaaagcttggtacatcagatacacaagaacgctgacgacatctccagtcggctgaccttaatcgaagctataaatttgtttaaatatcccgctgcgaaatccgaggaagagctgcccggagttaaggagttctttgagcatatcgagagggagagggcttccgatgtagatcacatggtgcgctggtaccttgccatcggccctttgctgactaaggtcgagggcctggtggtccacacgaatacaggaaaggctccaaaactggcctcttactacaagtattgggaaaagaaaatttacgaggtgctcacgaagctgattctcaagaacctgcagtcgtttaactctctgatactcggcaatgtccctctgttccacaccgaaaccattcttaccgccccggaaatcattctacacccaaatacgaacgaaatcgacaagatgtgcttccactgcgttcgtaactgcgtggagataaccaagcactttgtgagatggatgaatggttcatgtatcgaatgtccgccccagaagggcgaggaagaagaggtggtcatcattaacttttataacgatattagcctgaatcctcagatcatcgaacaggccgtaatgattccacagaacgtgcaccgcatattaatcaatctgatgaaatatttacagaaatggaagcgctatcgaccactgtggaaactcgataaagccattgttatggaaaaattcgctgctaaaaagcctccttgtgtcgcctatgacgaaaaactacagttttactccaagatcgcctacgaagtcatgaggcatccactgattaaggatgaacattgtattcgattgcaattgcggcacctcgcaaacacagttcaagaaaatgcgaagtcctgggtcatctccctaggcaagttattaaacgagagtgctaaagaagagctctataaccttcatgaggagatggagcatttggccaagaatttgcgtaagatcccaaacaccctcgaggacctgaaattcgtgctggccacaatcgcagaaatccgcagtaagtccttggttatggaattgaggtacagggacgtgcaggagaggtacaggaccatggcaatgtacaacctgtttcccccggatgctgagaaggagctggtggacaagatcgaaagtatttggtccaatctgttcaacgactcagtcaatgtcgagcatgcactgggggatattaagcgtaccttcacagagttgacccgcggggagattatgaactacagagtgcagattgaagagtttgctaagaggttctactctgagggcccggggagcgtgggcgatgacctcgataaaggcgtggaactgttaggagtgtacgaaagagagcttgcccgccacgagaagtctcgtcaggagctcgctaacgccgaaaaactgtttgatctgcccataactatgtaccccgagttgctgaaggtccagaaggagatgagcggtctgcgtatgatctacgaactttacgagggacttaaagtggctaaagaggagtggagccagacgttgtggatcaacttgaacgttcaaatcctacaagagggaatcgagggattcctgagagccctcaggaagttgccaagaccagtcagaggattgtctgtcacttactatctcgaggctaaaatgaaggcatttaaagactccattcctctgctcttagaccttaaaaatgaggctctgagggacaggcactggaaagaactgatggaaaagacctctgtgttttttgaaatgaccgagacattcactctagagaacatgttcgcaatggaactgcacaaacatacagatgtgcttaacgaaatcgtaactgccgccatcaaggaggttgcaatagaaaaagctgtgaaggagatcctggatacttgggagaatatgaaattcaccgtcgtcaagtattgtaagggaacacaggaaaggggatacattctgggttcagtggacgaaattattcagagtctcgacgacaacacatttaatctccagtctatctcaggctcccgatttgtcggcccattccttcaaaccgtccataagtgggagaagacattaagcctgataggggaagtgattgaaatctggatgctggtacaaagaaaatggatgtatctggagagtattttcataggcggcgatatcagatcccaactaccagaggaagctaagaaatttgataacatcgacaaagtgtttaagagaataatgggtgaaacactgaaagatccggtgatcaagcgatgctgtgaggcccctaaccgcctctcagatctacagaacgtgtccgagggtctggagaagtgccagaaatctctgaatgattacttggactcaaagagaaacgccttccctcggttcttttttatatcagatgacgaactcctgagcattctggggtctagcgatccgttgtgcgtgcaagaacatatgattaagatgtacgacaacattgcttctctccgcttcaatgacggggacagcggagagaagctggtctctgctatgatttcagccgagggcgaagttatggaatttaggaagattctgagggcagagggccgtgtggaggactggatgactgctgttctgaatgaaatgcgtcgcacaaatcgcttgatcacaaaggaagccatattccggtactgcgaggataggtcacgggtggattggatgttattgtaccaagggatggtggttctcgcagcgtcccaggtgtggtggacctgggaggttgaggacgtctttcataaagcacaaaagggtgaaaaacaggccatgaagaattacgggcgtaaaatgcataggcagattgacgagctcgtgaccagaatcacaatgcctctgtccaagaacgatcggaagaagtacaataccgtattaatcatcgatgtgcacgcccgcgatattgtagacagttttattcggggctcaatccttgaggcgagagagttcgactgggagagccagctgagattctactgggaccgcgaacccgatgaactgaacatcagacagtgcaccggaacattcgggtacggatatgagtacatgggcctcaatggacgactggtcatcacacctctcaccgaccgtatttatctcactctgacgcaggccctgtcgatgtatctgggcggcgctcccgccggccctgccggcacaggaaaaacagagactacaaaggatcttgcaaaagccctggggttactctgcgttgttacaaattgtggggaaggaatggactaccgcgccgtaggcaagatcttctcgggtctcgcccagtgtggggcctggggttgctttgacgaatttaacagaattgacgcctcggtgttgagtgtcatttccagtcagatacagaccatccgaaacgctctgattcatcagcttaccacttttcagtttgaaggacaggagatctctttagattcacgtatgggcattttcatcacaatgaaccccgggtatgcagggcggacagaattgcccgagtctgtaaaagctctcttccgcccagtggtggtcattgtgccagatctgcaacagatctgcgagattatgttgttctccgagggctttcttgaggctaagaccttagccaagaaaatgacagtgctctacaagttggcccgagagcaactaagcaaacagtaccactatgattttggcctgcgggcactcaagagcgtattggtaatggccggtgaactcaaaaggggctcctctgacctacgcgaagatgtcgtactgatgcgggctctccgcgacatgaaccttcctaagttcgtcttcgaagacgtgcccttgtttttgggtctgatctctgacctcttccccggactcgactgtccccgggtgcggtaccccgactttaacgatgccgtcgaacaagtgctggaagagaatggctacgcagtcctgccgattcaagtcgataaggtggtgcagatgtttgagactatgctgacaagacatactactatggtagttggtcctacccgtggcggaaagagcgtcgtgatcaacacgctgtgtcaggcgcagacaaaactagggttaaccactaagttgtacatcctaaaccccaaggcggtgagtgttatcgagttgtatggaatactggatcccaccacgcgagactggaccgacggggtcctttccaacatctttagggagatcaacaaacccacggacaagaaagagaggaagtatatactgtttgatggagacgtcgacgcactgtgggtcgaaaacatgaattctgtcatggatgacaatcggcttctgaccttggcaaatggagagcgaatcagactccaggcgcactgcgccctgctcttcgaggtgggggacctccagtatgcatcacctgccaccgtgtctcgttgcggaatggtgtacgtcgatcctaaaaatctgaaatataggccttactggaaaaaatgggtcaaccagatccccaataaagtggaacaatataatttgaacagtctttttgagaagtatgttccctacttgatggacgttatcgtggagggaatcgtggacggtcgccaggccgagaagctaaagacaattgtccctcagaccgacctcaacatggttacacagctggccaaaatgcttgacgcccttctggaaggcgaaatcgaagatctggacctcctggaatgttatttcctggaagccttgtactgtagtcttggggcttccctcctagaagacggtcgcatgaaatttgatgaatacatcaagaggctggcatcactatctacggtcgatacggagggtgtgtgggcaaaccctggggagctccctggccagctaccaacactatacgatttccacttcgataataagcgaaatcagtgggtgccttggagcaaacttgtacctgagtacattcacgcaccagagcgaaaatttatcaatatactggttcatactgtcgacactacacggaccacatggattcttgagcagatggtcaagatcaagcagcccgtcatattcgtgggtgagtccggcacctcaaaaaccgcaactacccagaattttctcaagaacctctcggaggagaccaatatcgtcttgatggttaacttctccagccgtacaacgtcaatggatatccagcgcaatctggaagccaacgttgagaagaggactaaggatacgtatggccccccgatgggcaaacgactgcttgtgtttatggacgatatgaacatgcccagagtggacgagtacggaacacagcagcctatcgccctactgaaattactgttggagaagggctacctgtatgacagaggcaaagagctgaattgcaaatcaatccgggatctcgggtttatcgcggcaatgggaaaagcaggcggagggcggaatgaggtggatccaaggttcatctcgttgttcagcgttttcaacgtgccctttccttccgaggaatcattacacctcatttattcctccattcttaagggtcacacctccacctttcatgagtctatcgtagcagtatctggtaaactcaccttctgtactctggctctttataagaacattgtccaggacttgccaccaacccccagcaagttccactatatttttaatctgcgggacttatcacgcgtgttcaatggcctggtactcacgaaccccgagcgtttccagacggtcgcgcagatggttcgggtttggcggaacgagtgtctcagagttttccacgaccgcttgatatctgagacggataaacagttggtacagcagcacatcggctctctggtggtggagcacttcaaagatgacgtggaagtggtgatgcgagatccgatactgtttggtgacttccagatggccctgcacgagggcgaacctcggatctatgaggacatccaggattacgaggccgcaaaggccctctttcaggagatcctggaggaatacaacgagagcaacacaaagatgaacctggtgctctttgatgatgcgcttgagcacctcaccagggtccataggatcattaggatggatcgtggccacgcactgctcgttggcgtcggtggctctgggaaacagagcctgagtcgtttggcggcattcacggcatcctgtgaggttttcgagatcctgctctctagaggttatagcgaaaacagtttcagagaggatctgaagtccctgtacctgaagttgggcatcgagaacaaagcaatgatattcctgtttacagacgcgcatgtggccgaggaggggttcctcgagctcataaacaatatgctaacatccggtattgtgcccgccctcttctccgaagaggaaaaggaaagtatcctttctcaaattggtcaagaagcactgaaacagggtatgggacctgcaaaggagtcagtgtggcaatacttcgtaaataagtcggccaacaacctgcacatcgtgctcggaatgagcccagtgggcgacacacttcgcacatggtgtcggaatttccccgggatggtgaataatacaggcatcgattggtttatgccatggcctcctcaggcgctccacgccgttgcaaagtcttttctggggtataaccccatgattcccgccgagaacattgaaaacgttgttaagcatgtggtgctcgtacatcaatccgtggaccattatagtcagcagtttcttcagaagctgcgccggtcaaattacgtgacgcccaaaaattatcttgacttcattaacacatattctaagctgctggacgaaaagacccagtgcaatattgctcagtgtaagcgtctcgacgggggtctggacaagcttaaggaggccaccatccagctggacgaactcaatcagaagctcgccgagcagaagatcgtgctggcagaaaagagcgccgcttgcgaagccctgctggaagaaattgccgtcaataccgccgtggccgaggaaaagaagaagctcgctgaagaaaaggcgatggagatcgaggagcagaataaggtcatcgccatggagaaggccgaagccgagaccactttggccgaagtgatgcccatcctggaagcagcaaagctcgagttgcagaagcttgacaaatctgacgtgactgaaattaggtctttcgcgaaacccccgaagcaggtccagacagtttgcgaatgcatcctcattatgaaggggtacaaggagcttaattggaaaaccgccaaaggagttatgagcgaccctaacttcttaagatcactcatggaaatcgacttcgactcgatcacacaatctcaggtgaagaatataaaagggctcctcaagacacttaatacaactaccgaagaaatggaggcagtgtccaaggcgggccttggcatgttgaagttcgtagaggcggtcatgggttattgtgacgtcttccgggagataaagccaaaaagagagaaggttgcccgtctggagaggaacttttatctcactaagagggagctggagcggattcaaaatgaacttgcggcaatccagaaagaattggagaccttgggtgccaaatacgaagctgcgatcctggaaaagcagaaactgcaggaggaggctgagatcatggagagacgcttgattgctgctgacaagcttatctctggactggggagcgagaacattaggtggttaaatgacctggacgagttaatgcatcgaagagtaaagctgcttggggactgcctcctgtgtgccgcattcttgagctacgagggtgccttcacctgggaattccgcgatgaaatggtgaacaggatctggcagaacgacatacttgaaagggaaattcctctctctcagcctttcaggttggagtccctactcaccgatgacgtggagatatctcgatgggggtcacagggcctgcctcccgacgaactgtctgtgcagaatgggattctcaccacacgcgcgtctcgatttccactgtgtatcgacccccagcagcaagcattaaactggatcaaacgaaaggaggagaagaacaatttaagggtcgccagctttaacgaccctgattttttgaaacagctcgaaatgtccattaagtatggtactcctttcttgttccgggacgtcgatgaatatatcgatcctgtaattgataatgtcctcgagaaaaacatcaaggtaagccagggtaggcaattcataattctcggcgataaggaggttgattacgacagcaattttcgcctatatttgaacaccaagcttgcaaacccacgctactctccttccgtgttcggcaaggctatggtcattaattacaccgttacactgaagggcctagaagaccagttgctcagcgtcctggtggcctacgagaggagagagctggaggagcaaagggagcatctgatacaggagacttctgaaaataagaacctgttgaaagatctggaagactctttgttaagggaattggccaccagcactgggaacatgctggacaatgtggatttagtccacaccctcgaagagacgaagagcaaagccacagaagtgtccgaaaaactaaaactggcagagaaaaccgcgttagacattgacaggctgagagacggttaccgtcccgctgcaagacggggagctatcctctttttcgtgctgagcgaaatggcccttgtcaacagcatgtaccaatactcccttatagccttccttgaggtatttcggctaagtcttaaaaagtccctgccggatagtattctgatgaagcgacttagaaacataatggataccttgacattcagcatatacaatcacggctgcaccgggctcttcgagagacataagctattgttcagcttcaacatgaccattaagattgaacaggcagaaggacgcgtgccacaagaggagctggactttttcctcaagggtaacatctcccttgaaaaaagcaaaaggaaaaaaccttgcgcatggctctccgatcaaggctgggaagatattattcttctgtccgaaatgttttctgacaatttcggacagctccccgatgacgtcgaaaataaccagactgtctggcaggagtggtatgacctcgacagcttggagcaattccccgtacccctggggtatgataacaatattaccccctttcaaaaactcctgattctccgctgcttccgagtcgatcgggtgtacagagcggtaactgattatgtgaccgttactatgggcgaaaagtacgtgcagccccctatgattagcttcgaggctatttttgaacagtctacaccccatagccctatagttttcatcctcagccctggttcagatcccgccacagacctcatgaagctggcagaacggtcaggattcggtggaaataggttgaagttcctggccatgggccaggggcaggagaaggttgcccttcaactacttgaaactgctgtcgcacggggtcagtggctaatgcttcagaattgccatcttctggtgaagtggctgaaggaccttgaaaagtcactcgagaggatcactaagccccatccagattttcggttgtggctgactaccgacccaacgaagggattccccataggcatcctacagaagtccctcaaggtggtgaccgagcctcccaatgggctgaagctcaatatgcgcgcaacgtactttaagattagtcacgagatgctggaccagtgtcctcaccccgctttcaagcctctggtgtatgtacttgcatttttccacgccgtcgtgcaggaacgcagaaaattcgggaagatagggtggaatgtgtactacgattttaatgagtcggactttcaggtgtgtatggaaattttgaacacctacctcacaaaagcgttccagcaacgtgatccaagaattccttggggcagcttgaagtacctaatcggtgaagtcatgtacggcgggagagcaatcgacagcttcgaccggcgcatcctgacaatatacatggatgagtacttaggagactttattttcgatacatttcagccattccacttctttcggaacaaagaggtagattataaaatccctgttggcgatgagaaggaaaaattcgtcgaggcgatagaggccctgcccttggcaaacactccagaggtctttggcctgcacccaaacgctgagattggatactatacgcaggctgcgcgcgatatgtgggcccacctcctagaactccaaccgcagacgggcgaaagttcctctgggatctccagagacgattacatcggtcaggtggccaaggaaattgagaacaagatgcccaaggtttttgacctcgaccaggtaaggaagaggcttggaactgggctgtcaccaacttccgtcgtcttgctccaggagctggagcggtttaacaaactggttgtacgaatgactaagagcttagctgaactgcagagagcgctggctggcgaggtgggcatgtctaacgagctggatgatgtggcccgctccctgtttataggccatattccaaatatatggcgacggctcgcacctgatacactaaagagcctgggcaattggatggtttatttccttaggcgcttctcacagtatatgctctgggtgacggagagcgagccatcagtaatgtggctgagtggcttgcacattcctgaatcatacctgacagccctcgtccaggccacttgccggaagaacggttggcccctggatcgatccaccctctttacgcaggtgacaaagttccaagatgctgacgaagttaatgagcgagccggccagggatgttttgtgtctggtctgtatctggagggggccgactgggacatcgaaaaagggtgtctgattaaaagcaaaccaaaggtgttggtcgttgatctccccatccttaagattatcccaattgaagcacatcggctcaaacttcagaacaccttcaggacacccgtgtacaccaccagcatgagacgaaacgccatgggtgtggggctggtgtttgaagcggacctgttcaccaccaggcacattagccattgggtcctgcagggtgtatgcttaacactcaattctgattag

SEQ ID NO: 186023 - DNA, 13572 bp, Artificial Sequence
  Description of Artificial Sequence: Synthetic coding sequence
atggccgcccaggtggccgcccgggaggcccgggacttccgggaggcccctactttgaggctgacgtctggcgctggactcgaggccgtgggcgccgtcgaacttgaagaagaggaagagaatgaagaggaggctgcagcccggcgagcgagaagcttcgcccaagatgcgcgcgtccggtttttaggaggccgcttagctatgatgctggggtttactgaagagaagtggtcccagtacctcgaatccgaggataaccgacaggtgctgggagaatttctggagagcactagtccggcctgtttggtattctcatttgctgcctctggcagacttgccgccagccaggagataccccgcgatgctaatcacaagctcgtgtttatctctaagaagatcaccgaaagtatcggtgtcaatgacttcagccaagtagttctttttggtgaattgcctgcgttgtccctgggccatgtcagcgcattcctcgacgagattctggtcccagtactctcaaataagaacaaccacaagagctggagctgtttcaccagccaggacatggaataccacatcgaggttatgaaaaagaagatgtatatctttagggggaagatgtcacggcgcaccctgttaccgatcccaaccgtcgctggaaaaatggacttagatcaaaactgttctgagaacaagcccccgtccaatgagcgcattatcttacatgccatcgagtctgttgttatcgagtggtcccaccagatccaggagatcatcgagagggattcagtacagcgcctacttaacggactccacctgagcccccaagccgagctggatttttggatgatgagaagggaaaatctgtcctgtatctacgaccagctgcaggcacctgttgtgctcaagatggtcaaaatccttaccactaaacaatcatcatatttccccacgttgaaagatatctttctggccgtggaaaatgccttgctggaagcccaggatgtggagctgtacttgcgacctcttcggaggcacatccaatgtctacaggagacggagtttccgcaaacgagaatcctcattgcacccctatttcatacaatttgtctgatatggtcacatagcaagttttataacacccccgcgagggtcatcgtcttacttcaagagttttgcaacctgttcataaatcaggctaccgcatacctttcgcctgaggatcttctcaggggggaaatcgaggaaagcctggaaaaggtgcaggtggccgtgaatatactgaaaacctttaaaaactcctttttcaactacagaaagaaacttgcttcatacttcatgggacgcaaactgcggccatgggatttccaatctcacctcgtgttttgccggttcgacaaatttttagaccggctgatcaagattgaagatatttttgccaccacactcgagtttgagaagctggaacgcctcgaattcggcggtaccaagggggctattctgaacgggcaagtgcacgagatgtctgaggagcttatggagctgtgcaaattattcaagcagagcacctacgaccccagcgactgcacgaacatggagttcgagtctgattatgtggcctttaagtctaagacgcttgagttcgatcgccgcttagggaccattatctgcgaggccttttttaactgtaacggcctggaagcggcttttaagctgctcacgatctttggaaattttttggaaaagcccgttgttatggagattttttcccttcactactccaccttagtgcacatgtttaatactgagttggacgtgtgcaagcagctatataacgaacatatgaagcagatcgagtgtggccatgtcgtccttaacaagaatatgccctttacctctggaaacatgaaatgggctcagcaggtgctccaacgacttcaaatgttctggagtaatttcgccagtctgagatatctgttcttaggcaatccggaccatgctctggtgtaccagaaatacgtcgagatgaccaccctactggaccaattcgaaagcagaatttataacgagtggaagagcaatgtagatgaaatttgtgaattcaatctcaatcagccactggtgaagttctcagccattaacgggctgttgtgtgtgaacttcgaccctaaattagtggctgtcctgcgagaggtcaagtatctgctcatgctgaagaagcaggacatacccgactctgctctggctatcttcaaaaaacgcaataccatcttgaaatacatcggcaacctagacctgcttgtacaggggtataacaaactcaaacagacactcctcgaagtggagtatccactgatcgaagatgaattgcgcgctatcgacgagcaattaacagctgccacaacatggcttacctggcaggacgattgttggggatacatagagagggtccgagccgcaacatccgaactggagcaccgggtggaacggacacagaagaatgtgaaggtaatccaacagactatgcgaggatgggcccgatgcgtgcttcccccgcgccgagagcatcggcgggaggccgccttcacactagaagacaaaggcgacctattcacaaaaaaatataaacttatacagggcgacgggtgtaaaattcataatctggtcgaggaaaataggaagttgtttaaagcaaatccctccctggacacctggaagatttatgtcgagtttatcgatgacatagtggtggagggcttcttccaggccattatgcacgacttggacttcttccttaagaatacggagaagcagctcaaaccggctccatttttccaggcgcagatgatacttctgcctcctgaaatcgtctttaaaccttccctggacagggaagccggggatggtttttacgatctggtggaagaaatgctttgcaatagctttcggatgagcgcgcagatgaatcgcattgccacacatctggagattaaaaattaccagaatgatatggataatatgctcggtctagccgaagtgcggcaggaaattatgaaccgagtcgtgaatgttattaacaaagtgttagacttcagaaatacacttgagactcacacatatctctgggtcgacgaccgtgcggagtttatgaagcatttcttactctatggtcatgccgtgtcctccgatgaaatggacgctcatgccaatgaggaaattccggagcagcctcctaccttggagcagtttaaagagcagatcgacatctatgaagctctgtacgtacaaatgtcgaaatttgaggattttagagttttcgacagctggtttaaagtcgacatgaagcctttcaaagtctctctcctgactatcattaaaaagtggtcctggatgttccaggagcatcttctgaggttcgtgatcgacagcttgaatgaattgcaggaattcattaaggagacggactcggggctccagcgggaacttaacgaaggcgaccacgatggtctggtcgatatcatggtccacctcctggccgtgagatctagacaacgcgctaccgatgaattgtttgagcctctgaaagagacaatcaccctgctcgaaagttacgggcagaaaatgccagagcaagtgtatattcagctagaagaactaccagaaagatgggagaccacgaagaagatcgcagccaccgtgcggcacgaggtcagcccccttcacaatgcggaagtgacactcataagaaaaaaatgtatcctctttgacgcaaagcaggccgagtttcgcgagcgctttaggcactatgctcctctgggtttcaatgctgaaaacccctacactgctctggacaaggctaacgaagagctggaagcactggaggaggaaatgttgcagatgcaggagagcactagactctttgaggtcgcccttcctgagtacaagcagatgaagcagtgcaggaaagaaataaagctgctcaaaggactgtgggacgtgattatttacgtccggcggtccatagacaactggactaaaacacagtggagacaaattcacgttgagcagatggatgtcgaattgaggagattcgcaaaggctagtagtattacagaaatttggagcctaaacaaagaagtgagagtgtgggacgcatacactggcctggaaggaacagtgaaggatatgaccgctagtctgcgtgccataaccgaactacagagcccagccttacgcgaccggcactggcaccaattaatgaaggccatcggagttaagtttctgatcaacgaggccaccaccttagctgaccttctggccctcagactgcacagagttgaggacgatgtgcggcggatcgttgacaaagccgtgaaggagctggggacagagaaggtcatcactgaaatctctcaaacttgggccactatgaagttctcttacgaggtgcattaccggaccggaatccctctgcttaagtcagacgaacagcttttcgaaacactcgaacacaaccaggtccagctccagaccctgttacagagtaagtacgtcgagtatttcattgagcaggtcctatcctggcagaacaaacttaatatcgcggatttagtaatctttacttggatggaggtccagcggacctggtcccacttggagtccatctttgtgtgctcagaagatattcgaatccaacttgtcaaggatgcaagaaggttcgacggggtggatgccgagtttaaggagcttatgttcaagaccgccaaagtggagaacgtattggaggctacctgtagacctaatttatatgaaaagttgaaagacctgcagtcaagactgtctttgtgcgagaaagccctggcggagtacttagagaccaagcgcatcgctttccctagattttacttcgtaagctcagcagacctgttagacattttgtctaagggggcccagccaaagcaggtcacctgccacttggccaaacttttcgactccatcgctgatctgcagtttgaggataaccaggacgtttccgctcatcgggctgtgggaatgtatagtaaggagaaagagtacgtgccattccaagccgagtgtgagtgcgtgggccatgtagaaacatggttgcttcagctggagcagaccatgcaggagaccgtgagacattccatcaccgaggccatcgtggcctacgaggaaaaaccccgggagctttggatattcgacttcccagcgcaggtggctctaactagtagtcagatctggtggactactgatgtggggattgccttctccagattagaagaaggatatgagaccgctctgaaggatttccataagaagcagatcagtcagctcaacaccctcatcacactcctgttaggcgaactcccacctggggacaggcaaaagatcatgacaatatgtacaatcgatgttcacgccagagatgtagtagcaaagctcatcagccagaaacaggtggtcgtgagtccacaggcgtttacttggctctcacagctccggcacagatgggaggacactcagaaacattgctttgtaaatatctgtgacgctcagtttcagtacttctacgagtacctcggtaattcaccacggctagtcatcactcccttgacagatcgttgttatatcacgttaactcaatcccttcatctcactatgtccggagcaccggccgggcccgccggcaccggcaagactgagactaccaaggacctcggccgcgcactagggatgatggtgtacgtgttcaactgcagcgagcagatggactacaagtcaattgggaacatctataaagggctggtgcaaacgggtgcttggggctgctttgatgagttcaaccgcatatcggtcgaagtgttatccgtggtggcggtacaggtcaagatgatccacgatgccattcgcaatcgaaaaaagcggttcgtgttcctcggagaagctatcacactcaagccctccgtaggaatctttatcaccatgaatccaggctatgccggtaggacagagctgcctgaaaatctcaaagcactattccgtccgtgtgccatggtggcacccgacatcgagctcatctgtgagattcttctggtcgccgaagggttcgtggacgcaagagccttggctcggaaattcattacattatatacattatgcaaggaactcctctccaaacaggaccactatgattggggcctcagagccataaaatccgtcttggtggtggctggcagcctgaaacggggtgacaagaaccgcccagaagatcaggttctgatgcgagccctgagagattttaacatgcccaagattgtgacagatgacataccggtgttcctgggactggtcggtgacctcttccccgcgcttgatgtccctaggcgccgtaagttacatttcgagcaaatggttcggcagtcaactcttgagttgcgcttacagcctgaggagtcatttattttgaaggtggtacagttagaggaacttctggcggtacggcacagcgtgtttgtggttgggaatgcagggacaggcaagtcaaagattctgcgcaccttaaaccgaacctatgtgaacatgaagcagaaacccgtctggaacgacctgaacccaaaggcagtgaccaccgacgaattgtttggatttatccatcacgcaacccgggagtggaaggacggcaaaatcgtctatagttatttcataggactcttctcatcaatccttcgcgagcaagcaaatcttaaacacgatggcccgaaatggattgtacttgatggagatatcgatcccatgtggattgagtccttgaatactgtaatggatgacaacaaggtcctgacgttggcctcaaatgagcggattgcccttacaccatttatgcggctgctgtttgagatacatcacctgcgcagcgccacgcccgcgactgtgtctagggcaggaatactatatgtgaatcctcaggacctgggctggaacccatacgtggcctcatggatagatcgcagacggcaccaaagtgagaaggccaacctcaccatcttatttgacaagtacgtccccgcatgtctagataagctgcgaaccagtttcaaaaccatcacaagcatcccagaaagctcactcgtccagacgctttgtgtgctgttggagtgtctgctgacccccgagaacgtgcccagcgactcacccaaagaggtatacgaggtctatttcgtgttcgcctgcatttgggcgtttgggggtacactactgcaggatcagatctccgattaccaggccgacttcagtcggtggtggcaaaaggaaatgaaggctgtgaagtttccaagtcagggcaccatttttgactactacgtggatcacaagactaaaaagctgcttccttgggccgacaagattgcacagtttactatggatcccgacgtgccacttcagactgtgctggtccacaccactgagacagccaggctgagatacttcatggagctgctcctggagaagggcaagccgctgatgttagtgggaaacgcaggtgtaggaaagacggtgttcgtgggcgacacacttgctagtttgagcgaagactatattgtctcaagagtgccattcaactattatacaacctccactgccctgcagaaaatactggagaagcccctggagaagaaggccgggcacaactatggcccgggcggcaataaaaagctaatttatttcatagacgatatgaacatgcccgaggtggacttgtacggtacggtgcagccccacaccctcattaggcaacacatcgattacgggcactggtacgacaggcagaaagtaatgctcaaggaaatccataattgccagtacgtggcgtgcatgaatcctatggtgggttctttcaccatcaacccacgtttacagcggcactttaccgtgttcgccttcaactttccatccctggatgccctcaataccatatacgggcagattttcagcttccactttcaacagcaggccttcgctccaagcatcctgcgcagcggaccaactctgatccaagcgaccattgccttccatcagacgatgatgtgtaacttcttacccaccgcaattaagttccactacattttcaacctacgggacttgtcgaacgttttccagggcattttgttcgcttcccctgaatgcctcaagggtccgctcgatttgatccacctgtggctccacgaaagcgctagagtgtatggagacaagctgatcgataagaaagactgcgatttatttcaacggcgcatgctcgaaactgcgtataagtactttgaaggcatcgactcacatatgctcctgcaacaaccactgatctactgtcactttgctgacagagggaaagatccgcattatatgcctgtcaaagactgggaagtgttgaagacaattttgacagagacactggacaactataatgagcttaacgctgctatgcatcttgtactctttgaggacgctatgcaacatgtctgcaggatcagtcgaattctgagaacccctcagggatgtgcactcttagtgggagtcggcggcagcggaaagcagtctctgagcaggctggctgcctacttgaggggcctggaagtattccagatcaccctcacagaaggttacggcattcaggagctcagagtcgaccttgcgaatttgtacattcggacaggggcaaagaacatgcccacagtttttcttttgactgacgcccaggtgttggatgagagtttcctggtactcatcaatgacctcctggcaagcggcgagatccctgatttgttctcagatgaggacgtcgataagataatctccgggatccacaacgaggtgcatgcgttggggatggtcgattctagagaaaattgttggaaatttttcatggccagagtaagactccagctgaaaattattctctgtttctctcctgtaggccgcaccttgcgggtgagggcacgcaaatttcctgccattgtcaattgtaccgctatcgattggtttcatgcctggccccaggaagccttagtttctgtctctagaagatttattgaggagaccaagggcatcgaaccagtccataaagacagtatttctcttttcatggcccacgtgcatactaccgtcaatgagatgtcaacgcgctattatcagaatgagaggcgtcataactacaccacacccaagagttttctagaacagatctccctattcaaaaatctccttaagaagaaacaaaacgaagtgtccgaaaagaaagagcggctggttaacggcatacagaaacttaaaaccaccgcctcccaggtgggggacctgaaggcccgacttgccagccaagaagccgaattgcagctgcgcaaccatgacgcagaggccctgataaccaagatcggcttacagacggaaaaggtgtcacgggaaaaaacgatcgcggacgctgaagagcgcaaggttactgcaattcaaacggaggtgttccagaagcagcgagaatgtgaggccgatctgctgaaggccgagccagcgctcgttgccgcaacagctgccctgaacacgctgaatagggtgaatctgtccgaactgaaagcctttccaaacccacctattgccgttactaacgtgactgccgcagtgatggtgctgctcgcccccaggggcagggtgcctaaggataggtcatggaaggctgccaaggtgttcatgggcaaagtggacgattttctccaggccctgattaactacgacaaggagcatatcccagaaaactgcttgaaggtggttaacgaacattacttaaaggaccccgaattcaatccaaacttaatccggacaaaatccttcgcagcagccgggctttgtgcttgggtaatcaacataattaaattttacgaagtgtactgtgacgtcgaacccaaaaggcaagccttggcacaagcaaatctagagctggctgctgccactgagaaattagaggctatcaggaagaagctcgtcgatctggacagaaacctcagtagattgacggcatcattcgaaaaggctaccgccgagaaggtgcgctgccaagaagaagttaaccagacaaacaaaactataaagctcgccaatcgcctggtgaaagaactcgaggctaagaaaatcagatggggacagtcgattaagtcctttgaggcccaggagaaaacactttgtggcgacgtgctgctgacagccgcctttgtctcgtacgttggtcctttcaccagacagtacagacaagaactcgtgcactgcaaatgggtgcctttcttacagcagaaagtgagcatcccattaacagagggcctggaccttatttccatgctgacagacgatgcaacgatagccgcatggaataatgaaggcttaccctccgataggatgtcaacagagaatgcagcaatcctcacgcactgcgaacggtggcccctggtgatcgatccccaacagcagggcatcaagtggatcaagaataagtatggcatggatctgaaagtgacacacctagggcagaagggcttcttgaacgcaatcgagacggctttagcctttggcgacgtgatcctgatagaaaacctggaagaaactatcgaccctgtactggatcctctcctggggcggaatactataaagaaaggcaagtacattaggattggcgataaagaatgtgagtttaacaagaattttcgactcatcttacatacaaaacttgccaatccacactacaagccagaactgcaagctcagaccacgctgttaaattttaccgtgacagaagatggcttagaagctcagctgttggcagaggttgtgagtatcgagcgacctgatttggagaagctgaaactcgttctaactaagcatcagaacgactttaagatagagttgaaatacttagaagacgacctcctgctaaggttatccgccgccgaaggttcttttttggacgatacaaagctggtcgagcggttagaggctacgaagacaacagtagctgagatcgagcataaggttatcgaggctaaggaaaacgaacgaaaaatcaatgaagcccgggaatgctatagacctgtcgccgcaagggcttccttgctctatttcgtaattaacgatctgcagaagattaatcccttgtaccagtttagcctcaaagcttttaatgtgctgttccatagggccattgaacaggccgataaagtggaagacatgcaagggagaatctccatcttgatggagagtattactcatgctgtgtttttatacacctcacaggcgttgttcgagaaagacaagctaactttcctatctcaaatggctttccagatccttcttagaaaaaaggagattgaccccctggagctggacttcctccttaggtttacagtcgagcatacacatttatccccagtcgacttccttacaagccagagttggtctgccataaaggctatagcagtcatggaagagtttcgagggatcgacagagacgtggaagggtcagctaagcagtggcggaagtgggtcgaaagcgagtgtccagagaaagaaaaactcccccaggagtggaagaaaaagagtctgatccagaagctaatactactgagagcgatgaggccggatcgtatgacatacgctctccgcaactttgttgaggaaaaactgggagcaaagtatgtagaacggaccagacttgatctggtgaaggcctttgaggagtcttctcccgcaactccaatatttttcattcttagcccgggcgttgacgcgctgaaagacctggagatactggggaagcgccttgggtttaccatagattccggcaagttccataatgtgtctctcggacagggccaggagacggtggcagaagtggctctcgagaaggcaagcaagggaggacactgggtaatcctgcagaatgtacacctcgtggcaaaatggctggggaccttagagaagctcctggagcgttttagccagggctcgcatagagactacagggtgttcatgagtgccgagtcagcacctacccccgacgaacacattataccccaggggctgcttgaaaacagcatcaagataacgaatgaaccgcccaccgggatgctggccaaccttcacgccgctctgtataacttcgatcaggatacccttgagatatgcagtaaggagcaggagttcaagtcaattttattctccctctgttacttccatgcatgtgtggctggcaggctcagattcggaccacaggggtggagccgctcgtatccttttaaccctggcgacctcaccatctgcgccagtgtgctctacaattatctggaggccaatagcaaggtcccctgggaagacctgagatacttattcggtgaaataatgtatggagggcatatcactgacgattgggaccgtaaactttgcagagtgtatctggaggagttcatgaatccctctctgactgaggatgagctgatgctcgcaccaggcttcgctgcccccccttacctcgactacgccgggtatcaccaatacatcgaagaaatgctgccacctgagagccccgccctgtatggcctccaccccaatgccgagatcgagttcctgaccgtcacctctaacacactgttcagaactctgttggagatgcagccacgcaacgccctatccggagacgagcttggtcagtccactgaggagaaggtgaaaaacgtcttggacgacatcctggaaaagctccctgaggaatttaacatggcagaaattatgcagaagaactccaaccgctccccctacgtgttggtgtgctttcaggagtgcgagcgcatgaacatcctgattcgggagataagaatctccctggagcagctcgatctgagcctgaagggcgagcttgctctctctccagcagtcgaggcccagcagtttgcactcagttacgacactgtgccagatacttggagtaagttagcatacccttcaacatatgggttggcacagtggttcaatgatttactgctcagatgccgagagctggacacttggactcaagatctgacccttcccgcggtagtctggctctctggcttcttcaatccacagagctttcttacggcaatcatgcaaactatggcccgcaaaaacgagtggcctctggacaagacaaggctaaccgcagatgtaacaaagaagaccaaggaagattacggccatcctcctcgagagggcgcatatctgcacggcctcttcatggaaggagcacgctgggacacacaggccggcaccatagtggaggccagactgaaggagctggcatgccctatgccagtgatttttgctaaggccacccctgttgatagacaagagaccaaacagacttacgagtgccccgtctatagaacaaaactccgcgggccctcctacatatggacatttcggttgaaaagtgaagaaaagaccgccaaatgggtgctggccggtgtggccttgctgcttgaagcctag

SEQ ID NO: 186024 - DNA, 1374 bp, Artificial Sequence
  Description of Artificial Sequence: Synthetic coding sequence
atgagcgacgccaacaaggccgccatcgccgccgagaaggaggccctcaacctgaaactcccaccgatcgtgcacctgcctgaaaacattggtgtggacacgccgacccaaagcaagctgctaaagtaccgaaggagtaaagaacagcagcagaaaattaaccagctggtgatcgacggggcgaaacggaaccttgaccgcaccttgggtaagcggacgcctctgttgcctccccccgactatccccagacaatgacttcagaaatgaaaaagaaaggatttaattacatctatatgaagcaatgtgtagaaagtagtcccctagtgcccattcagcaagaatggctggaccacatgttgcggttaatcccagagtcactaaaggaaggtaaagagagagaagaactcctcgagtccttgattaatgaggtgtctagcgactttgaaaactccatgaagaggtacttagttcaatcagtactggtgaagccaccggtcaaaagtctggaggacgaagggggcccccttcctgaatcgcctgtgggcctggattacagtaatccttggcactccagttatgtccaggcacggaatcagatcttttccaatcttcacataattcaccctactatgaaaatgctgctggatctaggctatacgaccttcgccgacaccgtcctgctggattttaccggcattagagctaagggacccatcgactgtgagagtctcaaaaccgatctgtccatccaaaccagaaacgccgaggaaaagattatgaacacatggtaccctaaggtgattaacctgttcaccaaaaaggaagcactcgaaggtgtcaagcctgaaaagctggatgcattctacagctgtgtgagcaccttgatgagcaaccagctaaaggacttactgaggcgcacagtggagggcttcgtaaaactgttcgacccaaaggatcagcagagactgcccatcttcaaaattgagctaacctttgacgacgataagatggagttttatcccaccttccaggacttggaagacaacgtcctgtctctcgtggagcgtattgccgaagcactacagaatgttcagactatcccctcttggctgtctgggaccagcacacctgtaaaccttgataccgagctgcctgagcacgtcctgcactgggctgtagacacattgaaggctgcagttcaccgaaatctggaaggcgccaggaaacattatgaaacatacgttgaaaagtataattggttattggatggcacggctgtagaaaacattgagacgttccagaccgaggatcacacattcgatgagtacacggaagaactggactgttgggtggtctgggaggtgtacttctag

SEQ ID NO: 186025 - DNA, 2040 bp, Artificial Sequence
  Description of Artificial Sequence: Synthetic coding sequence
atgttcctgctgaccggcggcgtgagcctgaagagcgccgagaagaacccggacccaacttggctgcaggacaagtcctgggaggaaatctgtagggcctccgagtttcctgccttccggggtttgcggcagcacttttgcgaacacatttatgaatggagggaaatctacgacagcaaggagccccacaatgctaagtttcccgcgcctatggacaagaatctcaacgagttacaaaaaattattatcctgaggtgcctgcggccagataaaatcacccccgcaataaccaactacgttacagacaagctaggcaagaaattcgtcgagccgccaccattcgatctaaccaagtcatacctggactcaaactgtacaatcccccttatcttcgtgctgtcaccaggagcagacccaatggcctctctgcttaagtttgcaaatgacaagtctatgtccgggaacaagttccaagccatttctctcggacagggccaaggccctatcgccgctaagatgatcaaggctgctatcgaggaaggaacatgggtctgcctgcagaactgtcacctggccgtgtcctggatgcccatgctggagaagatctgtgaagatttcaccagcgagacatgtaacagctcctttcggctgtggttgacgagttatccatcctccaagtttcctgtgactatcctgcagaatggcgtgaaaatgacgaacgaacctcccacagggctgagactgaatttgctccagagctacctcaccgacccagtgtctgatcccgagtttttcaagggatgccgagggaaagagttgctgtttataaatgaatatgataccattccctttgaggctattagttacctcacaggcgagtgtaactacggcgggcgggttaccgatgattgggaccggagactactgctgactatgctcgccgatttctataatttgtatattgttgagaatccgcattataagtttagtccatccggaaattatttcgctccacctaaaggtacatacgaagactatattgagttcattaagaagttgccatttacccaacatcctgaaatcttcggcctgcatgaaaatgttgacatctcaaaagatcttcagcagacaaaaacactatttgaatcattgctgctgacccaaggcggctcaaagcaaaccggcgcatccggcagtaccgatcagatcctgctagaaattaccaaggatatactaaacaaattgccctcagatttcgatattgagatggcactgcgcaagtatccagtccgctacgaggagagcatgaataccgtgctggtacaggagatggaaaggttcaacaacctgattattacaatcagaaatactctccgcgacctcgaaaaggcaataaagggagtggtcgtgatggatagcgcactggaagcactgtcggggagtctgctggtgggcaaagtgccagagatctgggccaagcggtcctaccctagccttaagcctctgggttcctacataaccgacttcctggctcggcttaacttcctccaggactggtacaacagcgggaaaccatgcgtgttttggctgagtgggtttttttttactcaggcattcctgacgggcgctatgcagaactacgcacgcaagtacactaccccgatcgatttgttggggtatgaattcgaggtgatccccagtgacacctcagacacctcccccgaagacggagtctatattcacgggctttacttggatggagccaggtgggacagggagtctggcttattagccgaacagtatcccaagttgctgttcgacctcatgcccattatttggatcaaacctactcagaaaagtagaatcatcaagtccgatgcttatgtctgccccctctacaaaacttccgaaagaaaggggacgctttcaaccacaggtcatagcacaaatttcgtgattgccatgctgcttaaaacagatcagcccacaaggcactggattaaacgaggtgtcgcactgctctgccagctggacgactag

SEQ ID NO: 186026 - DNA, 9279 bp, Artificial Sequence
  Description of Artificial Sequence: Synthetic coding sequence
atgagcgacgccaacaaggccgccatcgccgccgagaaggaggccctcaatctcaagttaccccccatcgtgcatctgcctgagaatattggcgtggataccccaacccagtccaaattgttgaagtatcggcgatctaaagaacaacaacagaagattaaccagctcgtaattgacggcgcgaagcgtaacctcgaccgcaccctaggaaagcggactcccctgctgccccccccggactatccacagactatgactagcgaaatgaagaaaaagggatttaactacatatatatgaagcaatgtgtcgagtcatctccgcttgtccccatccagcaggagtggctggaccacatgctacgactaatccccgagagtctgaaagaagggaaggaacgggaggagctgctggagtctctgatcaacgaggtgtcatccgacttcgagaatagcatgaagcgctacctggtccaatccgtcttagtgaagccccctgttaaatcgctggaagacgagggcggaccactgcctgagtctccagtgggtctggactattccaatccctggcactcctcttatgtgcaagcccggaatcagatcttctccaatctccacattatccaccctaccatgaagatgcttctagacctaggctacactaccttcgctgacactgtgctgttggactttacaggtattcgtgcgaagggtcccatcgactgcgagtccctgaagaccgacctgtctatccagacaagaaatgccgaggaaaagataatgaacacctggtaccctaaggtcatcaacctatttacaaaaaaggaagcactagaaggcgtcaaaccagaaaagctggatgccttttactcttgtgtgtcaaccctgatgtctaaccagttgaaagacctcctgaggcggaccgtggaaggatttgtgaagctgtttgaccccaaggaccagcagaggctgccgatttttaagattgagttgacattcgatgacgacaaaatggaattctaccctacgtttcaagaccttgaagataacgtgctgagcctagtagagcgaatcgctgaggctctccagaacgtacagaccatccccagctggctcagcggcacatctacgcccgttaacctcgacaccgaactcccagaacacgtactgcactgggccgtggacaccctaaaggccgccgtacaccgtaatctggaaggagcacgcaagcactatgaaacttacgttgaaaaatataactggttgctggacggtacggccgtcgaaaacattgagacattccagacagaggatcatacttttgatgagtatacagagttcatcgaaaaattcctgtctctcgctagcgagatcatgctgctcccacagtggattcattataccatggtgagacttgattgcgaggatcttaagaccgggctcaccaacaaagctaaggcctttgcaaatatcttattgaacgacattgctagcaagtaccgcaaagagaacgagtgcatctgcagcgaatttgaggcaattaaagagcatgccctgaaagtacctgaaacaactgaagagatgatggacttaatctcgtatgtcgaaaaagccagaacagttggcatcgaggaactcatcttaaggatacaggagtctaaaaggcaaatgtcctatttcctagacgtattcctgttcccccaggaggatttagccctgaatgctactgtgctgatgtggcctagaaagatcaatcccatttttgatgaaaacgacgagcttatcgagaacgccaagcacaagaaagaaaatgaactcatggctaaacgcgagaagctgattctcgaaatcgagaaagagtctcggagaatggaggaattcactgagttcgcggagttggagaggatgcaacagtacgttaccgacgtgcgccaattgcaaaaaaggatccaagagagcgaagaggccgtgcagtttattaacaaagaggaagagctcttcaaatgggaacttaccaaatatcccgagctggacaagctcaaagttaacatcgaaccataccaaaaattctttaattttgtgctcaagtggcagcgctctgagaaaaggtggatggacggtggcttcctagacttgaacggcgaatctatggaggcggacgttgaagaattttcaagggaaatctttaagactctcaaatttttccagacaaagctgaaaaaagagctgcaggaaaaaagaaaggccgcccgcaaacgtagtctggaggaggaaaagatcgaagaggaaccaaaagacaatgctacaatcactatgtgtaggatgcgtgcccggcactggaagcagatctctgagatcgtgggctatgatctcactcccgatagcggcactaccctccggaaggtgcttaaacttaacctcaccccctatctggaacaatttgaagtgatctccgcaggcgcctccaaggagtttagtctagaaaaggccatgaacactatgatcggcacttgggaggatatcgccttccacatttctctctacagagacactggagtttgcattcttagcagtgtggacgaaatacaggccattctggatgaccagatcattaagacccagaccatgagggggtctccctttattaagccttttgaacacgaaataaaggcctgggaggataggttgattaggatccaggaaacaatagacgagtggctgaaggtacaggcccagtggctgtaccttgagccaatcttttgctctgaagacatcatgcaacagatgccggaggaggggcgtcagttccaaaccgtggatcggcactggagagacataatgaagttttgcgctaaagaccctaaagttttagccgcaacctccctgaccgggttgctggagaaactccagaattgtaacgaactgctcgaaaaaatcatgaaggggctcaatgcgtacctagagaaaaagcgcctgttctttcctagattttttttcttgtcaaacgatgaaatgttagaaatacttagcgagacaaaggatcctctcagggttcagccacacctgaagaaatgctttgagggtatcgcaaaactggaattcctgcccaacctggacatcaaagctatgtacagcagtgagggcgaacgggtagagctgatagccctaatctctacaagcgccgcaagaggcgccgtcgagaaatggctcatacaggttgaggacctgatgctgagatctgtgcacgacgtaatagctgcggctcgcttggcgtaccctgagtcagcccgccgcgattgggtccgggagtggcccggccaggtcgtgctgtgtatctctcagatgttctggacctctgagactcaggaagtgatatctggagggaccgaaggcctgaagaagtattataaggaactccagaaccagttgaatgagattgtggagctcgtgcgcggtaaactgagcaagcaaacacggaccacgttgggagccttggtgacaatcgatgttcacgcccgggacgtcgtgatggacatgataaagatgggggtctcacacgataccgactttctgtggctggcccagctccgttattactgggagaatgagaatgcgcgtgtaaggatcatcaattgcaatgttaagtacgcttacgagtacctcggaaatagccctaggttagttatcaccccacttacggaccgatgctataggaccctgattggcgcattctacctcaatctgggcggcgccccagaggggcctgcaggcacaggtaagacagaaaccactaaagacttagctaaggcattagccgttcaatgcgttgtgtttaactgttcagacggcttggactacctcgcaatgggcaagttcttcaaggggctggcttcaagcggtgcctgggcatgctttgacgagttcaaccggattgaactggaggtgctgtctgtggtcgcccaacagatcttgtgtattcagagggccattcaacagaaactggtcgttttcgtgtttgagggaaccgaactgaaactgaaccctaattgcttcgttgcaattacaatgaatccggggtacgctggaagatcagagctaccagacaacctcaaggtgctgtttaggaccgtggcaatgatggtgccaaactatgcactcattgcggagattagcttatactcatatggctttctgaacgcacggccattgagtgtgaaaatcgtcatgacttatcggttgtgttccgagcagctgtcttcccagtttcattacgactacggtatgagagccgtaaaggccgtgttggtcgccgccggaaatctgaaactgaaatacccaaacgagaacgaagacattctacttctgagaagtattaaagacgtgaacgagcccaaattcctgtcccacgatattcccctgtttaacggcataacatcggatttgtttccaggcattaagcttccagaggccgattaccacgaattcctggaatgcgctcatgaggcttgcaatgttcacaatctgcaacctgtcaaatttttcttagaaaaaatcatccaaacctatgagatgatgatcgtgcggcacgggttcatgctggtcggagaaccgtttgccgctaaaaccaaagttctgcatgtgctggccgacaccctgaccttaatgaacgagcacggctatggtgaagaagagaaggtcatctaccggacagtgaacccaaagagcatcaccatgggccaattgtttgggcagtttgatcccgtttcacatgagtggaccgacgggattgttgccaacacctttcgagagttcgccttgtccgaaactcctgacagaaagtgggttgttttcgatggacccattgatacactgtggattgaaagcatgaacactgtgctggacgacaacaagaaactttgccttatgtccggtgagatcattcagatgtcaccccagatgagccttatttttgaaactatggatctcagtcaggcctcccctgctactgttagccggtgtggcatgatctacctggagccctctcagctggggtgggagcccctggtttcaagttggttgaacagtttgaagggccctctttgcgagccggagtaccaagcccttctcagaggcttattcgcatggctgataccaccatcgctcaatcaaagagtggaattatttcagctaaactatctttacacaactattgtgtcaaaaatcctgaagatcctgattacatttagaatcagcaattacttcaaatacgttccactgaagacccagtgcacttttataaaattttttctgcaccagcaggcctgttttatcttcagcctgatttggtccattggtgggtcctgtgacaccgacgggcgaagagttttcgacacgttcattagactgattattctcggtaaggatgatgaaaaccccgtgcccgactcagtcgggaagtgggaatgcccttttgatgaaaagggcttagtttacgactatatgtacgagctgaagaacaaggggagatgggtgcactggaacgaactgatcaagaatactaatctgggtgacaaacagattaagattcaggatataatcgttccaacaatggacacaatcagatacacgttcctcatggacttatcaatcacctatgcgaaaccactcctcttcgttggtccaaccggcaccggcaagtcggtgtacgtcaaagataagcttatgaatcatttggagaaagaccagtattttcccttctatattaacctatccgcccgcacaagcgctaatcaggtgcaaaatataattatggcgcgcctcgacaaaagacgtaagggagtgttcggacctcccatgggaaaaaaatgtatcatcttcattgatgacatgaatatgcccgctctggagaagtacggagcacaaccacccattgaactcctgcgccagttcttcgactgcggtcattggtatgacctcaaggataccagtaagattacgctggtcgacattgagttgattgccgctatgggcccgcccggggggggcagaaaccctgtgactcctcgctgcatccgtcacttcaatatctgctcaattaattctttttcagatgagacgatggtccgtattttcagtagcatcgtggctttctatttaaggacacatgagttcccccccgaatactttgtgattggaaatcagatagttaacgggaccatggagatctataaacagtctgtggaaaatcttctcccaaccccaaccaagtctcattacacattcaacctgagagacttctcccgcgtaatccgcggctgcctgctcatagagcgtgacgcagtcgctaacaagcataccatgattaggttgttcgttcacgaagtgctgcgggtgttctacgacaggctcattaacgacgatgatcgaagatggttattccagctgactaagactgtgataaaagaccatttcaaagagagctttcattcaattttttctcacttgcgcaaacaaaacgcgccagtcactgaagaagacttgaggaatctgatgttcggggattacatgaacccagatctggagggcgatgacagggtatacattgaaatcccaaatatacatcatttctctgatgtcgtcgatcagtgccttgatgagtataaccagactcacaagacacgaatgaacctcgtcatattccgctacgtgctcgagcacctgagccgcatctgcagggtgcttaagcagagcggaggaaacgccctgcttgtggggctgggcggttccgggagacagtccctgactcgccttgcaactagcatggccaaaatgcacatattccagcctgaaatctctaaatcttacggaatgaacgagtggcgtgaggacatgaaatcctttatcgctgtccctgtgacgaaccggatagtggataataagtctaaaatccttgagaagaggctcaggtatctcaatgaccactttacatataatctctactgtaacatatgccgttccttgttcgaaaaagacaagctcctgttctcctttttgttgtgcgccaaccttctcttggcgcgtaaggagatcgagtaccaagagctgatgtttctccttaccggcggagtgtccctgaaaagcgcagaaaagaatccagatcccacttggctgcaagacaaatcttgggaggaaatttgtcgcgctagtgagttccccgcatttcgcggactacggcagcacttctgcgagcacatctacgagtggagagagatctatgattcaaaggaaccccacaacgcaaagtttcctgcaccaatggataagaatctcaatgaactacaaaagatcatcattctacgctgcttgaggccagacaagatcaccccagccattacgaattatgtaactgacaagctggggaaaaaattcgtggagcctcctccatttgatctgacaaagtcgtatttagactcgaactgtacaatcccactgatttttgtgctttccccaggagccgatcctatggctagtctccttaaattcgccaacgataagagtatgagcgggaacaaattccaggcgatttcactcgggcaaggccaaggaccgattgcggccaagatgatcaaggccgccattgaggagggcacatgggtttgtcttcagaactgtcatctggcagtgagctggatgcccatgctggagaagatctgcgaggacttcacttcagagacctgcaattcctcgtttcggctctggctgacttcttatccaagttcaaagttcccagtaaccattcttcaaaatggcgtcaaaatgacgaatgagcccccaacaggactgcgattgaatctgctccaatcttacctgactgatcctgtgagtgaccccgagttctttaaaggttgcagaggcaaggaattagcatgggagaagctgttgtttggtgtgtgtttttttcacgcactcgtacaggagcgcaagaagttcggaccactcggatggaacataccctacggcttcaacgagagtgatcttcgaatcagcattcgccagcttcagctatttatcaatgaatatgatactattccctttgaggcaatttcctacctgaccggtgaatgcaactatggcggccgcgtaacggatgactgggaccggagactccttctgaccatgctggcagacttttacaatctgtatatagttgaaaaccctcattacaagtttagtccatctggcaattatttcgcaccaccaaaaggaacatacgaagactacatcgagtttataaaaaagctgccattcacccagcaccccgagatatttggtctccacgagaatgttgatatctccaaggacctacagcagacaaagactctgtttgagagtcttctgcttacacagggcgggtctaaacaaacaggcgcttctggttcaactgatcagattttgcttgaaatcactaaagacatcttgaacaagctcccctcagacttcgatattgagatggctctgaggaaatacccggtgcggtacgaagagagcatgaacaccgtgctggtgcaggagatggagaggttcaacaatctcatcatcaccatcagaaacaccttaagagacctggaaaaagctatcaaaggagtggtggtgatggattcagcactcgaggcactctccgggagccttttagttggtaaggtgcctgagatttgggccaagcgctcctacccctccttaaagccactgggctcttacataacagattttctagcccgtttaaacttcttacaggattggtacaatagcggcaagccttgtgtgttctggcttagtggattctttttcacacaggcgttcctgactggagctatgcagaactacgcccgcaaatataccacgcccatcgacttattgggctatgagttcgaagtgatcccgtcagatacgtccgacacctcccccgaagatggggtgtatatccacggactttatctagatggagccagatgggacagggagagtggcctcctggctgagcagtaccctaagctgctttttgatctcatgcccattatatggatcaagcctacccaaaaatctcgtattatcaagtccgatgcctatgtttgtcccttatataagactagcgaacggaaaggcacccttagtaccacaggacattctacaaatttcgttatagcaatgttgttaaaaaccgaccaacctacaaggcactggatcaaaaggggagtcgcattgttgtgtcagttagatgactag

SEQ ID NO: 186027 - DNA, 2355 bp, Artificial Sequence
  Description of Artificial Sequence: Synthetic coding sequence
atgagcgacgccaacaaggccgccatcgccgccgagaaggaggccctgaacctgaaactcccacccatcgttcacctaccagagaacataggagtggatactccaacccagagtaagctactgaagtaccggaggtctaaagagcagcagcaaaaaattaatcaattggtgattgatggtgcgaagagaaatttagaccgtacactcggcaagagaacaccgcttctgcctcctccagattatccccagaccatgacttctgagatgaaaaagaaaggattcaattacatttatatgaagcagtgtgttgaaagctcgcccttggtccccatccagcaggaatggctcgatcacatgctccgcctaatccctgaatcactgaaggaggggaaagaacgagaagagcttctggagagtctaatcaacgaagtttctagtgacttcgagaacagtatgaagagatacttggttcagtccgtgcttgtgaaaccccccgtgaaaagcctggaggatgaaggagggcctttgcctgaatcacccgttggactcgattattccaacccatggcactcatcatacgttcaggcccgcaaccaaatctttagcaaccttcatatcattcatccgaccatgaaaatgctgctggatctgggatatacaacgtttgccgacactgttctgctggacttcacaggcattcgggccaaggggccaatcgattgtgaatctttaaaaacggatctctctatacaaaccagaaatgccgaggagaagataatgaatacctggtatcccaaagtgatcaacctgtttaccaagaaggaggcactggagggcgtgaagccagagaaacttgacgctttctactcttgtgtgagtactctgatgtcaaaccagctgaaggatcttctgcggcggactgtggaggggtttgtcaaactcttcgatccaaaggaccagcagcggcttcccattttcaagatcgagctaacctttgacgatgataagatggagttttaccctacttttcaggacctggaagacaatgttctttcgctggtggaacggatcgcagaggcgttgcagaacgttcaaaccatccccagttggttgtccggtaccagcaccccggtaaacctggataccgagctgcctgaacacgttttgcactgggctgttgacactctcaaggctgccgtccacagaaatctggagggcgcaagaaaacattatgaaacctacgttgaaaaatataattggctcttggatgggacagccgtcgagaatatagagaccttccagaccgaggatcatacctttgatgagtacaccgaatttatagaaaagtttcttagcttggcctcggaaatcatgctcctgcctcagtggatccattacacaatggttaggctggactgtgaagatctgaagaccggactgactaacaaggctaaggctttcgctaacatactactgaatgatatcgcctcaaaataccgtaaggaaaacgaatgcatttgcagtgagttcgaagccatcaaggagcacgctctgaaggtacctgagacaactgaagaaatgatggaccttattagctatgtcgaaaaagcgagaaccgtaggtatcgaggagctcattctgcgcatccaggaatctaaaagacagatgagttattttcttgacgtttttctatttcctcaagaggaccttgccctgaatgcgactgtgctcatgtggccgcggaaaattaatcccatcttcgacgagaatgatgagttgatcgagaacgccaagcacaagaaggagaacgagctgatggctaaacgggaaaagctcatcctcgaaatcgagaaagaaagcagacggatggaagagtttacagagttcgcagagctggaacgtatgcagcagtatgtgactgacgtgcggcagttgcaaaagaggatccaggagagtgaggaggccgtccagttcatcaacaaagaagaggaactcttcaaatgggaactaaccaagtaccccgaactggacaaactgaaagtcaatatcgaaccgtatcaaaaattctttaactttgtgttgaaatggcagcgatccgagaaacgctggatggatgggggcttcctggatttgaatggagaatcgatggaagccgacgtggaagagttctctagggagatatttaagacactgaagttttttcaaactaaactgaaaaaagagctgcaggagaaaagaaaagccgcacggaaacgctcacttgaagaagagaagattgaggaggaacctaaggacaatgcaactataaccatgtgctccacggttatggaacaaataaaggcatttaaggtctag

SEQ ID NO: 186028 - DNA, 687 bp, Artificial Sequence
  Description of Artificial Sequence: Synthetic coding sequence
atggagaccttcatccccatcgacctgaccaccgagaaccaggagatggacaaagaagaaacaaaaacgaaacctcggctgctgagatacgaagaaaaaaaatacgaggacgtgaaacctttggagactcaacccgccgaaatcgctgagaaggagactttggaatacaagacggtgcggacattctctgagagtctcaagagtgaaaagacagaggactatttgagggaatccattattcagcagcatatggtctccccggagcctgcctccctcaaggagaaagggaagtcacgcagaaagaaggaccaaacccatgcctgtcccaacgtgaggaaagcacgccccgtgtcctatgatcggacagagcctaaggacgacgacgtgattcggaacatcataagacttcgcgaaaagttagggtggcagaccatcctgcctcaacacagcctgaaatacggctccagcaagatagctatacagaaaattacccttaagaaaccactggaggacgatggagaattcgtctactgcctccccaggaagtcccccaagagtttgtataacccttatgatttgcaagttgtctctgcccacacagctaaacattgcaaggagttctgggtgataacagccagcttcatctcaaaaagatatctggtgatctgcggggctgtgtatatctag

SEQ ID NO: 186029 - DNA, 687 bp, Artificial Sequence
  Description of Artificial Sequence: Synthetic coding sequence
atggagaccttcatccccatcgacctgaccaccgagaaccaggagatggacaaggaggagaccaagactaaaccaaggctcctccgttacgaagagaagaaatatgaggacgtgaaaccacttgaaactcagcccgctgaaatcgctgagaaggaaactctggagtataagacggtcaggacttttagtgagtcactgaaatccgagaaaacagaggactacctgagagagtccattatccagcagcatatggtgagtccggaaccagcttcactaaaggagaaaggaaagtctaggagaaaaaaggatcagacccacgcctgtccgaatgtgaggaaggccaggccggtgagctacgaccgcacagaacctaaggatgatgacgtgatcagaaacataatacgcctcagagaaaagctcggttggcagaccattttgccccagcattccttaaaatacggaagttccaaaatcgctatacagaaaattaccctgaaaaagcctttggaagacgatggcgagttcgtatattgcctcccccgaaaaagccccaagagcttatacaacccatacgacctgcaagtggtgtcagcccatacggctaaacactgtaaggaattttgggttattaccgcctcctttatcagcaagagatacctggtcatttgtggggccgtctacatatag

SEQ ID NO: 186030 - DNA, 1362 bp, Artificial Sequence
  Description of Artificial Sequence: Synthetic coding sequence
atggagaccttcatccccatcgacctgaccaccgagaaccaggagatggacaaagaggagaccaaaaccaaaccaaggcttcttaggtatgaagaaaagaagtacgaggatgtcaaaccactggaaactcagcctgctgaaatagccgaaaaagagaccttagagtataagacggtgagaacattttccgaaagcctcaagtctgagaagacagaggattacctgcgcgaatctattattcagcagcacatggtgagtccagagcctgcatcgctcaaagaaaaaggaaagagcaggcgaaagaaagatcaaacccatgcatgccccaatgtccgaaaagcccgccctgtttcctatgaccgcacagaaccaaaggacgatgacgtcatacgcaacatcattcgcctcagagaaaagctgggctggcaaactatactgccacaacacagtctgaagtacgggtcttctaaaattgccatccagaaaattaccctgaaaaagcctctcgaggatgacggcgagttcgtctattgcctgcctcgtaaatccccgaaatctctatataacccatatgacctgcaggtggtcagcgctcacaccgccaagcattgtaaggaattctgggttataaccgccagcttcatttctaaagttataaacatcgtgggcagcgtaaaagaggtagagctcataccgaccttagaatggctgtctgaacgacggcactactacttgctgcgccagtttaagattttcagcgattttagaatgaacaaggcgttcgtgacctggaagctcaacgttaagaggatcaaaacagaaaaatctcgctcatttctctatcaccacttatttctggcagatgatctattccagacttgtctcgtgtatatacgaggcctctgcgaggacgccatcaatctgaaaaattacaacgaccatgagaataacctcagtgctatctgcctggtgaaactggactcgtcaaggacttactccctcgacgagttctgtgaggagcagctgcagcaggcgacccaggcattgaaacagctcgaggatatccgtaataaagctatctcagagatgaagtcaacattcctgaaggtcgccgaaaaaaacgagattaaagagtatttcgagtctaaactcagcgaggatgatacgacccacttcaaactgcctaaatacaggagactattagaaacattcttcaaatttgttatgctggttgattatatttttcaggagttaatacgacaactgatgaataccgccgtaaccctcctcttagagctgtttaacgggtccgcaggcatgcctttttccgtggaaaaaaagaatgagaatctcataaggtag

SEQ ID NO: 186031 - DNA, 13548 bp, Artificial Sequence
  Description of Artificial Sequence: Synthetic coding sequence
atggagaccttcatccccatcgacctgaccaccgagaaccaggagatggataaggaagagactaagactaaacccaggcttctgaggtatgaagaaaaaaaatatgaagacgtaaagccactcgagactcagcccgctgagatagctgaaaaggagacgctcgagtacaagactgtgaggacatttagcgagtccttaaaaagcgaaaagaccgaggattatctgagagagtccatcattcaacagcacatggtctcccccgagcccgccagtctgaaagaaaagggtaagagtcgaaggaaaaaagaccagacacatgcgtgcccaaatgtgagaaaagccaggcccgtttcttacgacaggacagagcccaaagatgacgatgtgattcggaacatcatcagactcagagaaaaactcggttggcaaactattctgccccagcattccctaaagtatggctctagcaagatcgcaatccagaaaattacactaaaaaaacctttagaagatgacggcgaatttgtatactgtctcccccggaaaagtccgaagtccctgtataacccatacgacctccaagtcgtcagtgcccatactgccaagcactgcaaagaattttgggtcataactgcctccttcatctctaaagtcatcaacatagtcggatccgtgaaagaggtggagctgataccgactctggagtggttgtcggagcgaaggcactattacctcctgaggcagttcaagatattctctgacttcaggatgaataaggctttcgtgacctggaagttaaacgtcaagcggatcaagacagaaaagtctcgcagtttcttataccaccacctgtttctcgcggacgatctgttccaaacatgcttagtttacattcggggcttgtgtgaagatgcaatcaaccttaagaactataacgatcatgaaaacaacctatccgcaatctgcctcgtgaaacttgactcttctaggacctactctctggatgaattttgcgaggaacagctgcagcaggccacacaagcgctcaagcaattagaggacatccgcaataaggctatctccgagatgaaaagtaccttccttaaagtagccgaaaaaaacgaaatcaaagagtatttcgaatccaagctgtccgaggatgataccacacattttaagctccccaaatatcgtcggctactagaaacattcttcaaatttgtgatgcttgtcgattacattttccaagagttaattcgtcagctaatgaatactgccgttacgctcctgttagagctttttaatgggtctgcaggaatgcccttcagtgttgagaagaagaacgaaaatctcatcagaaccttcaaggataacagtttcccaacgggtaaaactacaaatgattgcgaagagttggtggataattcaaaattacatgccatcagcgttcagaagagcgaggtgaagactgacacggacatcaacgaaatactcaattccgttgaagtgggtaaagatctgcggaaaacatacgctcccattttcgaagttaatttatgtctccggatacctgctgagtctgatagctctgaaaattctaaggagaacttccatgagagcgaccagtgtcccgaggagtgtgtaatgtttgaagatgagatgagtgaaaacaaagacaattgcgtcaaaaaacattcgtccgaagagttactgccgaaagcaaagaaatcgaaggaaataagctataatttagaggacatcatttccgataccgaaatcgagactgagtttgagaataagtatatgtactacgaatttcccgagttcccaacgaacttgtttattgaccctaacagactggaattttcggttaagatccaaaacatgcttaccaatatggaaaaatgcattaccaccataacacccctatgtcaggatccccaactgtctatctttattgacttagtgagcatcatggatctaccaaacaagaccggtagtattatccattacaaggagcagacaaggtggcccgattgccacattttgttcgagaccgatcccgcctaccaaaacattatcgtcaacctcctcacaatcatcggcaacagtatgggcctagtgaatgcatactcccacaaattcattaaatattgcacaatgaccgagaaggctaaaatcatgtcaatgaaaatttcctcaatgggcgaactcacttcaaaggagttcgaagccattctaaaccggtttcgtaactattttcgtcacatcgttaatatggccattgaaaagcgcattggcatattcaatgtagtatcactggattaccagtccgaatgcttactgtatatcgataacgtgattcatatgtctcacactctgatacagagtgtaatagagaaaaagaataagaatttactggaggtcgtagaaagcagtctgcagcagcttgaatgtgaccctacagaaattgaggagttcctggagcacttcatttttctgaacgcgattagctcaaagatctccaagcttgagaaagagttcctgacaatgtcccagctctactccgtggctaagcaccaccaaatccacatttctgaggagcagatcgcaatctttcaggtattactcctcaaattcagccagctcaagtcgtctatgaaattatctaagattaataaagataccgcgatcacaaaattccgggataacctggaagcttgtatcagcgggctgcatgttgacgttgggaacctgaaggccaaaattagaacaccccttctcctgtgcgccggtacacaggtgtctacagcaatggagatgatacagaccttatcaggcgaagccgcctcacttaccaataaagccaaagcctactctcattaccaggattgtttctctgacagtcagagtcacatgcactcagtgaatgtggaagagatcactcaaatcgtgctttccgaaatctcagacattgagggggatctgactcttagaaagaaattgtgggaggcacaggaagaatggaaaagggccagctgggagtggcggaattcgtcactgcagtcaatcgacgtggagtccgtacagaggaacgtgagcaaactcatgcacattattagcgtcctcgaaaagggactgccgaaaagcgacatggtgacacatttgaaacaagtggttacggaattcaaacaggaactgccaatcatcattgccttaggtaatccttgccttaagcctaggcactgggaggcgctccaggaaatcatcggaaagagtgtcccgctggacaaaaattgcaaggttgagaatctcttggctctaaagatgttccagtatgaaaacgagattaatgatatgtctacatcagctacaaacgaggccgccctggagaaaatgctgttcaaaattatcgatttctggaacacaaccccactccctctgatcctgcatcacacagaaatctattccatcttcattattccaagcatcgacgatataagcgcccagctggaggaatcccaggtaattttagcaacgatcaaaggatcgccacatatcgggcctattaaggatctggtgaacgaatgggatcagaatctcactctgttctcttacactctggaggaatggatgaattgccagaggaattggttataccttgagccggttttccactcctcggagatccgaagacaactgccagctgagacagagctgttttcccaggtcattagcatgtggaagaaaattatgtccaagatacaaaacaagcaaaacgctctgcagataactacaagtgccggcgtgctcgaaatccttcaaaattgcaacattcacttggagcacattaaaaagagcttggaagattacctggaagtaaagcgtctaatatttcctagattctacttcctcagcaatgcggagctacttgacatcctggctgactcccgcaacccagaaagtgttcagccgcacctggttaagtgctttgagaatattaagcaattactaatctggaaacaggacatcggtccgcccgctgtgaaaatgctcatcagcgcggagggtgaaggtctggtcttaccaaagaaaatcagagtccgctcagcagttgaacagtggctagtcaacgtggagaaaagcatgttcgatgtcctaaagaaagagcggtacatttataatataattctgcttttccagagccagattatgttctacaacgattgcgttaaatccttcgtgtcctcttattcccgggaaaagctggaaaaagtgcacgcgggtcttatgtgccatttagaggaagtggccgacttagtggtcctcgacacttctaattcccgtactaaagccattctgggcgccctgctgattctgtacgtgcactgtcgcgacatcgttattaacctgctactcaagaacatctttaatgcagaggacttcgagtggacccgccatttgcaatacaagtggaatgaaaagcagaagctctgttacgttagtcaaggtaatgcatcttttacctatggttacgagtacctgggctgcacgagcaggctggtgattacccctctaacagataggtgctggcttaccttaatggaggccctgcacctcaacctgggcggctgcccagcggggccagctggaaccggaaaaactgagacagtgaaagacctggcaaagtcgcttggcaaacactgcgtggtgttcaattgcttcgaagacctggactacaaaatcgtgagaaagtttttcttcggtttggtgcagtctggcgcctggtcatgttttgatgagtttaatttgatcgacctggaggtgttaagtgtcatagcttcccaaatcctcactataaaggcagcgaaggataactactccgctcgcttcgtactggaaggaaaggaaattcgcattaacatgtcttgcgctgtgttcatcaccatgaaccctcggtatgggggcggagtcgaactcccggacaatctgaagagcctctttcgtcccgtcgctatgatggtgccacactatcagatgatcgcagagattatactgttctcttttgggtttaagagcgccaacagtctgagcggcaaactcacgaacctctatgagctggctagaaagcagctgtctcagcaggatcactacaatttcggcctgaggtcacttaaaatagtgttaatcatggcgggcacaaagaaacgtgaatttaagtgtctgagcgaggctgacgaaacactcattgttatcgaagcaatccgcgaggctagtttgcccaagtgtcctccagaagacgtgcctttattcgagaatataatcggggacatctttcccgaagtgacagttctaaaggtgaatcagctggctttggaaaaagtgatctataccgccacgcagcagttaggattacaaaattggtcaagccagaaggaaaagatcattcagttttataatcagctgcaggtatgtgtcggagttatgttggttggccccactggaggcggcaagactactgtccgaaggatcctggagaaggctctaaccctcctgcccattgctgattttctgagcgtggctgaaaggaagagcgcctccaagatatccgagagaaagggaaaagtggatatttgtgtcttaaatcccaagtgcgtcaccctgagcgaactgtatgggcagttagatccaaacacaatggagtggaccgacggcctgctcagtgcgacaatccgctcctacgtctacttcaatactccaaagaatacaaaaaaggatatcgacctaaggttaaagtcccgcattagcgatctaagcaacgtgtttaagctggattcttctgacactaccgagactgatgataacattttcgaggaaattgagaaagtagtaaagattccagagaatcacaacttcgactggcagtggatcatcctggacggcccggttgatacattctgggtggagaacttgaatagtgtgctcgacgacactcggactctctgcctcgcaaattccgagcgaatagccctgactaacaaaatccgggtgatctttgaggtcgacaacctgtcgcaggcatcacccgccaccgtgtcgaggtgtgccatggtatacatggacccagtggacctgggatgggaaccttatgtaaaaagctggcttcttaaaaccagcaagatcattagccagagcggtgtggattgcctggagtttatgattaaaaactctgtcaccgatgggttgcagtttatccggaacagacaaaaattccaaccgtatcccatggaagacatcaccgtggtgattaccttatgccgcatccttgacgctttttttgacttcatggggaagaatggggggttcgaacaatcagatgacttgaacgacaccagttccaaggaggccaatagtcaaagggagtctgtgacttttaaagacatcgagaagagggatgagaatacatggtaccccgaaaagaatcctgataagctaacaaaaatcatccagaaactttttgtgttcgctttcacatgggcctttgggggtgcactcaaccgagaggacgagcaccgggaaaacattccattctgcccaagcctggagccagatagcctcgcaaaggttacttatgattttgataagttagtgcacgaactgtttggcaactcatcccaggtaggatggaagcactgggggcagagtcagggccgccggcgaaaaggcaactgcataaacctccccacgggtgagtgctctatttttggttacttcgttgacattgaacagtgcgaattcatcccctggagcgatttggtgccgaacgaccagacattgatacagcgtggaacctcccttttaacaaacctgcagcggagtggcggtaatttcctgaaaatcactgaatgcggagaatgtataaattataccgctacacgcgataccacttgtctgagcttcctgatgagcctgctgttgaagaatagctgccctgtactacttactggcgaatcaggcgtcggcaaaaccgccgcaattaaccagatgttggagaagctcgagggtcccggagcctttgacataaagcatgggtccatcctcggggacactcttttgtatagcgaaattaagaaatcaagtagcctcaagcagaatatcaccattttgatcccagagacgcacaaaaccgcgaccggaagttctgacaatcctactaagaaaccagaggtgcgcacaaacaagaagctgctgaaaaacaatgatcataaaggcgttgttgtctccacaattaatttttcaactaacgtaaccgcggccaagacaaaggagatgatcttgaaaaaactgattcgccggacaaaggatacgttaggagcaccaaaaaacaacagaattctgatcttcattgacgatatgaatatgccagtgtctgatatgtacggagctcagccgcccctagagttgatacgacagctccttgatttgggtggggtatatgacaccgagaaaaacacctggaaaaatatccaggacctgtccatcgttgccgcctgcgtgcctgtggtgaatgatatttctcccaggctcttgaagcacttctctatgctggtgcttcctcacccaagccaggatatcttgtgcaccattttccaggcccacttggggatctatttctccattaataattttactcctgaagtgcagaaaagcaaagaccagattattagctgtagcttagccatctaccaccaggtgcgccaaaatatgctgcccacacccactaagtgtcactacatgtttaaccttcgcgacatgttcaagcttctgttgggcctccttcaggctgatcgcaccgtcgtgaactcgaaagagatggcagccctgcttttcgtccatgaggcaaccagagtcttccacgatagactgattgactttactgacaagtcactattttaccgcctgctgtccagagaactggaaaactgctttcagatcggcattgacggatgtggcaaaaaaacttgcgctacactggcatgttacctgaccgacaataaattgtaccgcgttcctatcagtcacaagtgtgcttatattgaattcaaggaagtgttcaagaaagtatttattcacgccggtctgaagggcaagcctactgtgctgatggttcctaatttaaatatcgaacaggattcctttctggaggacctcaactatattatttcctctggccgaattcccgacttattcgaaaacgtcgaactggacagtattgccatgaagatacggtatctgaccgagcagtctggtcatatggacaatcggcagtcccttcttagcttcttccagaagcgcatatacaagaatctgcacattttcgttatcatgtcacccgaaggccccagtttccgccagaactgtagagtctacccatccatgatttcctcatgcaccatcgactggtacgagcgatggcctgaggaggccttgctcatcgtcgccaattcatttctaaaggaaaaggtaaatttcgagaaccgggaaaatctcaaagaaaagctcgcccccacgtgtgtccagatccataagtccatgaaggatctgaacaggaaatatttcgaggaaactgggagattctattacactacaccgaactcatatttgcagttcatggaaacattcgctcacatcctgcgggcccgggaggaggagatgcaaacgaagcgcgacagatttcacatggggctcagcactatcttagaggccactaccctagtcacagagatgcaggaagagttactgattctgggaccccaagttgagcagaaaacgaaggagactgagactctaatggagaagttaaggaaagactcccaggttgttgagaaggtgcagatgcttgtaaaacaggatgaggaaatcgtggctgaagaggttcgtatagttgaagactacgcccagaagaccgccaacgaactaaagtccgtgttgcccgcatttgacaaggcgattgtggccctgaacgcactggacaaggctgacgtggctgagttgagggtgtacaccaggcctcccttcttagtgttgaccgtgatgaatgctgtgtgcatacttcttcaaaaaaagcccaattgggctactgcgaagcttttactaagcgaaaccggttttctgaaaaagctgatcaacctagacaaggattccatccccgacaaagtattcgtcaagctgaagaagattgtgactttgccagacttcaaccctcacaagatcagtttggtatctgtagcttgttgctccctgtgtcagtgggtgatcgccctgaacaactaccacgaggtacagaaggtggtgggcccgaaacagattcaggtcgcggaagcccagaacgtgctgaagattgcaaggcagcggcttgctgaaaagcagcgtggcctgcagttagttgaagaacacttgctgtttctccaggccgcatacaaagacacagtggctgagaaacaactcctggctaaccgtaaaaccatggcttcacgaagatttcagtgtgcatctgtgttactaacagtgcttgaagacgagaagacccggtggcaggaaacaattaaccagatcgataataaactagagggaattctcggggacatcctgctatcggctgcgtgcatcgtatactccggaattctaacacctgagtttcggcagctcattgtgaataaatgggaaactttctgtatcgaaaacggtatttcactgtcctcaaagttctcactaattaaagtaatggcgcagaaatacgagatatccagatggcacaatcaagggctgccccatggccagtactccgtagagaatgctatactaatcaagaacggccagcagtggcctctactgatcgacccccatcgccaagcccacaagtggattcgccagatggagggctcaagactgcagaagttgtcaatcgaagattccaactacactaagaaaatagagaatgcaatgaaaacgggaggttcggtgctgttacagaacctgctggaaacattggctcctgggttgaaggcaattcttaagaaggatatataccagaaaaaaggacattacttcattcgcgttggagatgcagaatttgaatacaattccaattttagattgtacctgtccactgagatcgataatccccattttcttcctagcgtctacaatttcgtgacgatgataaactttacggtgaccttccagggtctacaggatcagctcctgtctaccgtcgtaacccatgaggtccctcacctcgaagaccagcggagtaagctactggaatctatttccctggacgccataactctcgaggaactggaagaaaagacacttaacttactgcagaaggccctcgggagcatactggacgatgacaagatcgtcgacacactccggaagagcaagatgaccagcaacgagatttccaagaggattgaggccaccaaaaaggctgagtcggaaatccaagccattaggaagaactacctgcccatcgctacccgaggagccctgctgtatttcttagttgccgatctgacacagattaactatatgtatcagtttagtctggactggttccatcaggtatttgtgtcctcagtggtcagtaagtccaaagaacaagagcatagtttcaaacgagagaaggttagccccaaggaggtgcacgagttcatttccatcagtaaagagcctaacctggagaatgaaaaaaaccttctggacaagcatattaaaagcgcaattgatatgttgacaaaaagtatatttaaagtcgtttcctctgcactttttaatgaagacaagctgtgcttcagtttccgcctatgtacagtgatcatgcagaataatgctaacggtaacctcatacaggacgacataggctttctgccggaagaggagtggaatattttcctgtacagcggcattctgattaatatcaaatctgcgctgtcccagtctaggctgacttcaaccttcgaaattggcgagtcccaacatctccagtggttgtccgactcacgctggcggcagtgccagtacgtgtcaactcatctggagccgttctcgctgctttgcaaatccttgctgagtaatgtgtctcaatgggacacttttaaaaattcgaaagctgtgtattctctaattagtactcctttctctagcgaaaacgcctcattagaagagaacactaagcctcccgaggaaactgagcttctgaatgagaacaaagaaacctgcaatccaataaacttcccgtgggaaaagctcacctcctttcaacggctgattctggtcaaagtcttgcggcccgaatcacttaacaacagcgtgcggaagtttatcacagagaaaatgggcaacaaatatctccagcgcacgggggtgaatctcaaagacgcatataagggttctaatgctcggaccccactgatcctgattcagacacacgggatcgaccttactaatattttgctgaggtttgcacaggaactcaaagggacaactcaccacgtcaccatcatcagcctgggacgggaccaagccgccaaagccgaggacctcatccttaaggctctcactaagacccagcagtgggttttcctgcagaactgccacttggcgacttccttcatgcccagactgtgcaccatcgtggagagttttaacagtccgaatgtcacaattgaccctgaatttcgactttggctgtctagcaagtcctacagctcgttccccattccagttctgaaaaagggactgaagatcgccgtggagtctccacagggcctcaagtccaatctgcttcaaacatttggatgcactggctcgggcgaggttactgaagagatttttgaaaatccagactgtggccagtggtggaagaaactcctgttcagcctatgcttctttaacgctgtcatcaatgagcggaagaattacgggatcctcggatggaacattgcctacaaatttaatagctccgatcttggtgtggccataaaagtgctagagaattccctccggggccaaccctcaatctcgtggcaggccctccgctatcttatcggagaagtaatatacggaggcagggtcatcgataactgggacaagcgatgcctgaagacgctgttgtacaaattttgcaacccagaggtcctgaaagacgacttctccttttcaaggagcgcctctattaaggactacatccatatcatccagagtttgcccgacgacgatctcccggaagttctagggattcaccctgaggcaatcagaagctgctgggagacgcagggcgaaaaatttatagaaaatctaatagccatgcagcctaagaccacaaccgccaatttgatgattaggccagaacagtcaaaggatgagctggtgatggaaatcctcagcgatctgctcaaaagactgccacttactgtggagaaggaggagatagccgtcgggactccgagcacactgaaaagcatgatgtcctctagtatttgggaatcgttgtccaagaacttgaaagaccacgatcccctgatacattgtgtccttttgacctttttgaaacaggagattaaaagatttgacaaactgctgtttgtcattcacaagtcattgaaggatctgcagcttgccatcaaaggagaaatcatcctcactcaagagctggaggaaatctttaatagtttcctgaacatgcgggttcccacactgtggcagaaacatgcatatagaagctgtaaaccccttagttcgtggattgacgacttgatacagcggctgaacttctttaacacttgggctaaggttgcctataccgccatccagcgaaggtatatgagattcgttaccgtctggaaacaatctattccaagtaccagtcagaaatgcaagcaccccgaggactccgaaaacaacttttttgaggggtttccttctcgctactggttacctgctttctttttcccacaggctttcctggcggcagtactgcaagactacgggaggagccgcggaattgccgtggacgcccttaccttcacgcaccacgtgatttctaacacaactgacaaagatgagaaattctccgttttcatgccaaagaagctcaacatagtgaggcgggccttcaaaggatccgcatcctcacatactggcgtgtacatttttggcctgttcatcgagggtgctcgatggaaccgggaacagaaaatactggaggacagcttaccgttggaaatgtgctgtgactttccagacatatacttcctccctactaaaatttctactaaaactccaaatgcctccaaccaaacagatagtgaactctatgcgttcgagtgcccggtgtatcagaccccggaaagaagccggattttggccactaccggcctgcctaccaacttcctcacctctgtgtatttgagtactaagaaacctccatcccactggatcacaatgcgggtagccttgctgtgtgaaaaaaacgaaaagtag

SEQ ID NO: 186032 - DNA, 13548 bp, Artificial Sequence
  Description of Artificial Sequence: Synthetic coding sequence
atggagaccttcatccccatcgacctgaccaccgagaaccaggagatggataaggaagaaacaaaaacaaaaccacgtcttctccggtacgaggaaaagaagtacgaagatgtcaaacccttggaaacccaacctgccgagatcgcagagaaggagacactggagtataaaaccgtgcgaacgttctctgagtcgctcaagtccgagaagactgaggattacctgcgcgagagcatcatccagcagcatatggttagccctgaaccagcgagcctgaaagagaagggtaagagcagacggaagaaagaccaaactcacgcctgccccaacgtaaggaaggcacggccggtatcttacgacaggacagagcctaaggacgacgacgtcattcgcaatataatccgcctgcgggagaaactggggtggcagacaatcctgcctcaacacagcctgaaatatgggagtagtaaaatcgctattcagaagattacactcaagaaaccacttgaggatgacggcgaatttgtgtactgtcttcctcgcaagagccccaagagcctgtataatccgtacgacctgcaggtggtgtccgctcataccgcgaaacattgcaaagagttttgggtgattacggcatccttcatcagcaaggtgataaatattgtcggaagtgtgaaagaggttgaacttatccctacgctggagtggctttctgagcggcgccattattacttactacgacaatttaagatcttcagtgactttcgcatgaacaaggctttcgtgacctggaagttgaatgtgaagcggataaaaactgaaaaatctcgcagtttcttgtaccatcatctctttttggctgatgatttgtttcagacttgtctggtatatatccgaggtctgtgtgaggatgctatcaacctgaagaactacaacgatcacgagaataatttgagtgcgatctgcctagttaaacttgattcctctcggacctacagccttgacgaattttgcgaggagcagctccagcaggctacccaggccttaaagcagctggaggatatacgcaacaaggctatctccgagatgaaaagcacatttctcaaggtggccgagaagaacgagatcaaagagtactttgagagcaaactttccgaagatgacactacacattttaagctacccaaatacagaaggttgctcgaaactttctttaaattcgtgatgctcgtcgactatatctttcaggagctcattaggcaacttatgaatactgcagtgactctgctgctcgaactctttaacggttccgctggcatgcccttctcagtcgaaaaaaaaaatgagaacctgattcggacgttcaaggacaattccttccctaccgggaaaacaacgaacgattgtgaagagctcgtggataactcgaaacttcatgcaatctcagtccagaagagcgaagtgaagaccgacaccgatattaacgagatcctgaattctgtcgaagtcggcaaggacctgaggaaaacctatgcacctattttcgaggtcaacctctgcctgcgaattccagctgaatcggatagttctgaaaacagtaaagagaatttccacgagtctgaccagtgtccagaggagtgtgtcatgttcgaagatgagatgagtgagaataaagacaactgcgtcaaaaaacacagcagcgaggagctgttgcctaaagctaagaaatccaaggaaatctcctacaatttagaagatatcattagcgataccgaaatcgagaccgaattcgaaaacaaatacatgtactatgaattccctgagttccccacgaatttattcatcgaccccaatcgcctggagtttagcgtcaagatccagaacatgttgacgaatatggagaaatgcatcactaccatcacccctctttgccaagacccccaactgagtatctttatcgatctggtttccattatggatttgccgaacaaaaccggcagcataattcactataaggagcaaacccggtggcctgattgccatatcttatttgaaaccgaccccgcataccaaaacatcatcgtcaacctgctgacaattatcggaaacagtatgggcctggtgaatgcatattctcacaaatttataaagtactgcaccatgaccgaaaaggccaaaataatgtcgatgaaaatttcatccatgggggaactgacttcaaaggagttcgaggctatcctgaaccgattccgtaattattttcggcacatcgtaaatatggcgatcgagaagcgaatagggattttcaacgtggttagtctggattaccagtccgagtgtctgctgtacatcgacaacgtcattcatatgagtcacacacttatacaaagtgtaatcgagaagaaaaacaaaaacttactggaagtcgttgaaagcagtttgcagcagctggagtgcgatcctacagagatcgaggaattcttggagcacttcatctttctcaacgccatctcctctaaaatatccaaattggaaaaagagttcctgaccatgtctcaactgtattcagtggcaaagcatcaccagattcatatctccgaagagcagattgccatcttccaagtccttctgctgaagttttctcagctgaagtctagcatgaaactgtcaaaaattaataaggacaccgcaattacaaagtttcgcgacaacctggaagcgtgtatctccggtctacacgtggacgtgggcaacttaaaagctaagatacggacccccttacttttatgtgctggcacgcaggtcagtacagcgatggagatgattcagactctatccggtgaagcagcgtcccttacaaataaggctaaggcctatagccattaccaggattgtttttccgacagtcagtcacacatgcacagcgtcaacgtggaagagatcacgcagatcgtcctgagtgagatctcagacattgagggagatctgacactgagaaaaaagttgtgggaggctcaggaagaatggaaaagggcatcctgggaatggcgcaacagttctcttcagtcaattgacgttgagagtgtgcagcgaaatgtgtctaagcttatgcacatcatatccgttttggagaagggcttgcccaaaagtgacatggttactcacctgaagcaggttgtgactgaatttaagcaagagttacctatcattatcgctctgggcaacccatgcctgaagcctcggcattgggaggctctgcaagagattatcggaaaaagtgtgccactcgacaagaactgtaaagtcgaaaatctcttagccctgaagatgttccaatacgagaatgaaattaatgacatgtcaacctcagctaccaatgaggccgcgctggagaagatgctgtttaagatcattgacttctggaacactacccccctgcctctgatcctgcatcatacagagatctattccatcttcataattccctcaattgacgatatctcagcccagctggaggagagccaagttatactggccacaatcaagggatctcctcatattggtcctattaaagacctcgtgaatgagtgggatcaaaatctgacactcttttcctacacgctggaggagtggatgaattgccagcggaattggctgtacctggaacccgtattccatagctccgagattaggcgccaacttcccgccgagaccgaactcttttcccaagtgatctctatgtggaagaaaattatgtctaaaatccagaacaagcagaacgcactacagatcacaacatccgctggcgtcctggagatactccagaattgcaacatccacctcgagcacattaagaagtctctcgaggactacttggaagtgaaacgactcatcttcccaaggttttacttcctcagcaacgccgaacttctggacattctagccgactctagaaaccccgagtctgtccagccccacctcgtgaagtgtttcgagaatatcaaacaactgctgatctggaagcaagatattggtcctcccgctgtaaagatgctcataagcgccgagggagaagggttagtactccccaagaaaatccgcgtgcggagtgctgtcgagcagtggcttgttaacgttgagaaaagtatgtttgacgtgctgaaaaaggagcggtacatctataacattatattacttttccagtcccaaatcatgttctataacgattgtgtcaagtccttcgtgagttcctactcccgcgaaaaactggaaaaggtacacgcaggtctcatgtgccaccttgaagaggtggctgatctagttgttttggacactagtaactcaaggacaaaggccatcctcggcgcactcctgattctatatgtgcactgtcgggatatcgtgattaacctattacttaaaaacatctttaatgctgaggactttgagtggactaggcatctccagtacaagtggaatgagaagcagaaactatgctatgtgagtcagggaaacgccagttttacatacgggtatgagtatctgggctgcacgagccgattggtcattaccccgctcactgatcgatgctggttaactctgatggaagcacttcacttgaacctgggcgggtgcccagccggacccgcgggtacaggcaagacagagactgttaaagaccttgctaagtcactgggcaagcattgcgtggtgttcaattgttttgaggacctggactacaaaattgtcaggaagtttttcttcgggctggttcagagtggagcatggtcctgctttgacgagtttaacctcatcgatctcgaggtgcttagtgtcattgcatcacaaatcctgactattaaagctgcgaaggataattattctgcgcgctttgtgctggaggggaaggagatacggatcaatatgtcctgcgcagtatttataactatgaacccccggtatggaggcggtgtggagctgcctgataacctgaaatccctgtttcgacctgtggctatgatggtgccccactaccagatgattgctgaaatcattctgttctcctttggcttcaagtctgccaactccctgtcaggaaaactgaccaatctgtatgagctggcaagaaaacaactgagccagcaagatcattacaacttcggcctgcggtccctcaaaatcgtcttgatcatggcaggcaccaagaagcgggagttcaaatgcctgtcagaggctgacgaaaccctaatcgtgatcgaagcaatcagagaggcaagtctgcctaagtgtcctcccgaagatgtgcccctgtttgaaaatattattggagacattttccctgaggtgacagtgctcaaggtcaatcagcttgccctggagaaggtaatatataccgctactcaacagcttggccttcagaactggagcagccaaaaggagaagataatacaattctacaaccagttgcaagtctgcgttggagttatgctggtggggcctacaggaggcgggaagaccaccgtacggaggattctggaaaaagctctgacactactcccaatagccgatttcttatctgttgctgagcgtaagtccgccagcaagatctctgagcgaaaggggaaagtggacatttgtgtgctgaacccaaagtgcgtgactctatcagaattatacggccagctggaccccaataccatggagtggacagacggactgctgagcgctacgatacgaagctatgtgtacttcaacacacccaagaacacaaagaaagatattgacctgcgtctgaagagtaggatcagtgatctcagtaacgtgttcaagctggactcttctgacacaaccgagacagatgataatatttttgaggaaatcgagaaggtggtgaagatcccagaaaatcacaactttgactggcagtggataatcctggacggtccagtggacacattttgggtggaaaacttgaattccgtactcgatgatacaagaacactgtgcttggcgaattccgagcgcatagccctgacaaataagattcgagtgatcttcgaggtcgataacctgagccaggctagtccggctaccgtgtcaagatgtgcaatggtatacatggatccggtcgacctgggatgggagccctatgtcaagagctggcttctcaagacctccaaaattataagccagtctggagtggattgtctagagtttatgatcaaaaactccgtcaccgacggcctccagttcataagaaataggcaaaaatttcaaccttatcccatggaggatattactgtcgttataactctgtgtaggatcctggacgccttcttcgactttatgggaaaaaatggtgggttcgagcagagcgacgacttaaacgatacttcgagtaaagaagccaattcccagagagaaagcgttacctttaaagacatcgagaaacgcgacgagaacacatggtatccggaaaagaatccagacaagctcacgaaaatcattcaaaagcttttcgtattcgcattcacatgggcttttgggggggcactcaaccgagaagatgagcatcgggagaatataccattttgtccctcccttgaaccagatagtctagctaaggttacctacgacttcgacaagctcgtccatgaactcttcggcaatagcagccaggtgggatggaagcactggggacagtcccaaggccgtcgtagaaaaggtaattgcattaatttacccaccggggaatgctccattttcggttatttcgtggacatcgagcagtgcgagtttattccttggagtgatctggtgccgaacgatcagacactgattcaaaggggtactagcctgctgacaaacctacagagatcaggagggaattttctgaaaatcacggagtgcggtgaatgtatcaattataccgcgacaagggacacgacatgcttgtccttcctgatgagccttctactcaaaaatagctgccctgtgctgctgaccggcgagtctggcgtgggaaaaactgctgccattaatcaaatgctcgagaaactagagggacccggcgcattcgacattaagcatggatcaattttgggcgacaccttgttatacagcgaaataaagaaatcaagcagtttaaagcagaacatcaccatactcattcctgaaacccacaagacggcgacagggagtagcgataaccccaccaagaaacccgaggtccggacaaacaagaaactcctgaaaaataacgaccataaaggggtggttgtgagcacaatcaacttttcgacaaacgtcactgccgccaaaacaaaggaaatgattttaaaaaaattaataaggcggaccaaggatactttgggcgcccccaagaacaacaggattctcatatttatcgacgatatgaatatgcccgtgtccgatatgtacggggcccagcctcctctggagttaatcaggcagctgctggaccttggtggggtttatgatactgagaagaacacctggaaaaatattcaggacctgagcatcgtggcagcctgcgtacccgttgtgaatgacatatcccctagacttctgaagcatttcagcatgctggtgctgcctcaccctagtcaggatatcctgtgtacgatcttccaggcacacctgggcatatacttctctattaacaactttacaccagaggtgcagaaatccaaagaccagatcatatcttgctctttagccatataccatcaagtaagacagaacatgcttcctacacctacaaagtgtcactatatgttcaacttgcgggacatgtttaaactgctccttggccttctccaggccgacaggaccgtcgtgaattctaaggaaatggctgctctgctgttcgttcatgaggcaacgcgcgtatttcacgacaggctgatagacttcacagacaagtccttgttttaccgtctgctgtctcgagagctggagaactgttttcagattggcattgatgggtgtggaaaaaaaacctgtgcgacccttgcttgctacctgactgacaacaagctgtatcgcgtgcctatctcccacaagtgcgcttacatagagtttaaggaggttttcaaaaaggtttttatccatgccgggctgaaaggcaaacccaccgtactgatggtgcctaacctaaatattgaacaggattcctttttggaagatcttaattatatcatctcttcgggccggatccctgatctttttgagaacgtagaactggacagcattgctatgaaaatcaggtacctgaccgagcaaagcgggcatatggacaatagacaatcactgctatcttttttccagaaacgcatttacaaaaacctccacattttcgttatcatgtctcctgagggaccatcatttcgccagaactgtcgggtgtacccctccatgatcagctcatgcactatcgattggtacgaaagatggccagaagaagccctactcattgtggccaactcttttctgaaagagaaagtaaattttgaaaatcgggagaatttaaaagaaaagcttgcgccgacatgcgtccagatccataagagcatgaaagacctgaatcggaagtattttgaggagacaggaaggttttactacacaacccctaatagctatttacagttcatggagacattcgcccacatcttaagggcccgggaagaagaaatgcaaacaaaacgagataggtttcacatgggactctctactattctagaggccacaaccctcgttaccgaaatgcaggaggagctgcttattctgggtccacaggtcgagcagaagaccaaggagaccgagactctgatggaaaaactgcgcaaggattcacaggttgtggagaaggtgcagatgctggtgaagcaggacgaggagatcgtcgcggaggaggtaaggattgttgaggactatgcccagaaaaccgcaaacgaacttaaaagcgtcctcccagcctttgataaagctattgtcgcccttaatgccctcgataaggctgatgtggcggaactacgcgtgtataccaggccaccattcctggtcttaactgtaatgaatgctgtgtgcatcctgctccagaaaaagccaaactgggccaccgctaaattgctcctgtctgaaacgggtttcctgaagaagttaattaacctggacaaagactcaattcctgataaggtttttgtgaaattgaaaaaaatcgtaacactgcccgacttcaatccacacaagatcagcttagtgtctgtcgcctgctgctccctttgtcagtgggtcattgccttaaacaattatcatgaggtgcaaaaagtcgtgggacctaagcagatccaggtggcagaagctcagaatgtacttaagattgcaagacagagattagccgagaaacagcggggccttcagctagtggaagagcacctgttatttctccaggcagcctacaaggacaccgttgcagaaaagcaactactggccaataggaagacaatggcttccaggcggtttcagtgcgcaagcgtattgctcacagtcctcgaggacgaaaagacgcggtggcaggagaccatcaaccagattgacaacaaactcgaggggatactgggcgacatcttgctgagcgccgcgtgtatagtgtacagtggcattctaacacctgaatttaggcagcttatagtcaacaaatgggagactttttgcatcgaaaacggaatatctctgagtagcaaattcagcctcattaaagtaatggcacagaagtatgagatttccagatggcataaccagggactgccccacggccagtatagtgtggaaaatgccatattgattaagaacggacagcaatggccactgctgatagatccgcaccgccaggcccacaaatggatccgccagatggaaggcagcaggcttcaaaagctgagcattgaagatagcaactacactaagaaaatagaaaatgccatgaaaactggaggctccgtgcttttgcaaaacctgctcgagacactggctcccggactcaaggctattctgaaaaaagacatctatcaaaagaaaggacattactttattagagtcggcgatgctgaattcgagtataacagcaacttccgcctgtatctatcgacagagattgacaacccgcattttttgccaagtgtgtataatttcgtcactatgatcaacttcactgttacttttcaggggcttcaggaccaattgctgtctacagtcgtgactcacgaggtgccccatctggaggaccagcgctctaagctcctggaatctatctcgctagacgcaattaccctggaggagctggaggagaagacactcaatcttctgcagaaggctcttggtagtattcttgatgatgacaagatcgtggacaccttgagaaagtcaaagatgacctctaatgaaataagcaaacggattgaggccaccaaaaaggctgaatcagaaatccaggccatccggaaaaattacctaccgattgcaactcggggagcactgctgtactttctggtggccgacctcacacaaatcaattatatgtatcaattcagcctggattggttccaccaagtctttgtgagcagcgtggtgagcaagtctaaagagcaagagcatagtttcaagagagagaaggtttcccccaaagaagtgcacgaatttattagcatttcaaaagagcctaatctagagaacgaaaagaatctgctcgacaagcatatcaaaagtgcaatcgatatgctcaccaaatctatatttaaggtagtgtcttcagcactatttaacgaggacaagctttgcttctcttttcggctgtgtaccgtaatcatgcaaaacaacgcgaacgggaacctgatacaagatgatataggtttcctgccagaggaagagtggaacatattcctctatagcggaatacttattaacattaaaagcgcactctcacagtccagactcacatccaccttcgagattggagagtctcaacacttgcaatggctgtcagactcgaggtggaggcagtgccagtatgtatcaactcacctggaacctttttccctgctgtgcaagtccctgttgtcaaacgttagccaatgggacacatttaaaaatagtaaagcagtgtattcgcttatatccacgccattttcaagcgagaacgcaagtcttgaagagaatacaaagccccctgaagagacagaactcctgaacgagaataaagagacgtgtaaccccatcaactttccttgggagaagctgacgtcctttcagcgactgatactcgtgaaagtgcttaggccagagagtttaaacaattctgttagaaagtttattacagagaagatggggaacaagtacctccaaaggactggggtaaatctaaaggatgcctataaaggctccaacgccagaaccccactgatcctcattcagacccacgggatcgacctaaccaatattttacttcggttcgcacaggagcttaaggggacgacccaccacgttaccataatttcactcggccgggatcaagcagcaaaggcagaggaccttatcctgaaggcactgaccaagacacagcagtgggtattcttacagaactgtcacttggctacctcattcatgccgcggttgtgcaccatagtggagagctttaactctcctaacgtcacaatagaccctgagtttagactgtggctctccagtaagagttactcttcgttcccgatccctgtgctgaaaaaggggcttaagatcgccgtggaatccccacagggtctgaaatccaatctgctccaaaccttcggctgcaccggaagcggggaagtaactgaggaaatcttcgagaaccccgattgtgggcaatggtggaaaaaactgctcttctccctgtgcttctttaatgccgtcattaacgagaggaaaaactacggcatcttgggatggaacatcgcctataaattcaactcaagtgacctcggtgtcgccataaaggtcctggagaacagcctgaggggtcagccctctatttcctggcaagccttgaggtatcttatcggcgaggtgatttacgggggaagggttatcgacaactgggataagcgctgtctgaaaaccctgctctataagttctgcaatcccgaagtgctgaaagacgatttcagttttagtaggtcagcatcgattaaagactacatacatataatccagtccttgcctgatgatgacttgcccgaggtactgggaatccaccccgaggccatcagatcatgctgggaaacgcagggtgagaaattcatcgagaatctgatcgccatgcagcctaagaccacgaccgctaatctgatgattagaccagaacaatcaaaagatgagctggtcatggaaattctgtcggaccttcttaagcggctgcctctgaccgtagagaaggaggaaatcgccgtgggcacccccagcaccctgaaatctatgatgtcctcatctatttgggaatcactaagcaaaaaccttaaggaccatgatcctctgatacattgtgtgctcttgactttccttaagcaagagatcaaaaggttcgacaaactgctgttcgtaatacataagtcactaaaagatctgcaattggcaattaaaggagaaattattctgacgcaggaattggaggaaatcttcaactctttcctgaatatgcgggtccctacactctggcagaaacatgcgtacaggtcatgcaagcctctgtcctcctggatcgacgacctgatccagcgcttgaactttttcaacacctgggccaaagtggcttatactgcgattcagcggagatatatgagattcgtcactgtctggaaacagtccattccaagcacatctcagaaatgcaaacacccagaagactccgagaataatttctttgagggcttccctagtaggtactggctacctgctttctttttcccgcaggcattcctcgcagccgtgttacaggactacggaaggtctcgtggtatcgctgtcgacgcattgacctttacccaccatgtgatctccaacactactgacaaggacgagaaatttagcgtgttcatgcccaagaagctcaacatcgtgaggcgagcttttaaagggtccgcttcaagccacacgggagtgtatatcttcggccttttcatcgagggtgcccggtggaatagagagcagaagatcctcgaggatagcttacccctggagatgtgctgcgatttccccgacatttacttcctgcctactaaaatttctactaaaacacctaatgcgtccaaccagactgatagtgagctgtacgctttcgagtgccctgtgtaccagacaccagagagatcaagaatcctggctacaacaggactgcccaccaatttcttgacaagcgtctacctctctactaagaaacccccttcacactggatcactatgcgtgtcgccttgctctgcgagaaaaatgagaagtag

SEQ ID NO: 186033 - DNA, 10524 bp, Artificial Sequence
  Description of Artificial Sequence: Synthetic coding sequence
atgggccggcggagccagtggatctgggccatgcggtgccagatgctagtgcccgtactgtctctacacatcgggttggcccgcgcgttgggatgtgggtgcattgcctccaagatcgagtgtctaatccgttgcaacgcaccattccccctattggatgccgtgggctccgtcgcaagccaagaactgcagtcactaaccgggaccgttggcgtcaccagcggtgcggccgcgtaccctagatggaacctagcccgagcccgagcccccccacatctgccgggtacacaagacccgctccgcagagtgcgagatcctacaccaattgttgcatcttctccgggcagacggcgcggttcctggtctggcggttacggacaggaggcctcagaaccgggggtggtgggcctctgctgtgctgtgctcccaatccacccttcactggcccttgccggggtcgggggaccagacctgcggaggttccaggaaggcccccagcgtccttccgatcatggagccgcggagaaacatatggagacattcattcccattgatctgacgaccgaaaatcaggaaatggataaggaggagacaaaaactaaaccacgattgctgcgctacgaggaaaagaaatacgaggatgtcaagcctctggagacgcagcccgcggagatcgcagagaaggaaacactcgagtacaaaactgttcgcaccttttctgagtctctgaagtccgagaaaacggaagaacctaaagacgacgatgtcattcgaaacataatacgcttgagagaaaaattgggatggcaaactatcctgccccagcatagcctgaaatatggaagtagcaagatcgcaatacagaagattacactcaagaagccattagaagacgatggagagtttgtctactgcttgcctagaaagtctcccaagtccctctacaacccgtacgacctccaggttgtttccgcacacactgccaagcactgtaaggaattctgggtgataaccgcatcttttatatctaaattggattcaagtagaacttatagcctggacgagttctgcgaagagcagctgcagcaggccacccaggctctgaagcagctggaggatatccggaataaggcaattagtgagatgaagtctactttcctgaaggttgctgaaaaaaatgagatcaaagaatatttcgagagtaagctatctgaggacgataccacccattttaagctccctaaataccgccgactcctcgaaacattctttaagtttgtgatgctggttgactatatttttcaggaacttatcagacaacttatgaatactgcagttacacttctcctggagttgttcaacgggagcgccggtatgcctttctctgtagaaaagaagaatgaaaatctgattagaacgtttaaggataactcattcccaaccggcaagacgaccaacgactgtgaggaactggtggacaactctaagttgcacgctattagtgtgcagaagagtgaagtgaagactgacactgatatcaacgagatcctgaactccgtggaggttgggaaagacttgagaaagacttacgccccgatctttgaggtcaatctttgcctgcgaatcccagcagaaagtgattcttctgagaatagcaaagaaaatttccacgaatccgatcagtgccccgaggagtgcgtcatgtttgaagacgaaatgtctgagaataaggataactgtgtgaagaagcattctagtgaggaactgctcccgaaggcaaagaagtcaaaagaaattagttataacctggaagacattatctctgctaccataaccccactttgtcaggacccccagctcagcatttttattgacctggtcagcatcatggacctcccaaacaaaaccggaagcatcattcactacaaggagcaaactagatggccagattgtcacatcctgtttgaaaccgacccagcctaccagaacataatcgtgaacctgctaaccattattggcaatagtatgggtttggttaacgcctactctcataagttcatcaaatactgtactatgacagagaaagccaaaattatgtccatgaaaatcagcagcatgggcgagctgacaagcaaagagttcgaggccatcctgaatagatttagaaactactttcggcatattgttaatatggccattgagaagcgtattggtatctttaatgttgtggtggagtctagcttgcagcaattagaatgcgacccaaccgaaatcgaagaatttttagagcactttatctttctcaacgcaattagcagtaagatttctaagttagaaaaagagtttctcacaatgtcgcaattatactccgtggcaaaacaccatcaaatacacatttcagaggagcagatagccattttccaggttttactactgaagttttcgcagcttaaatcctccatgaagctgtctaaaattaataaggatacagccatcaccaaatttagagataacctggaggcttgtatatccggactacacgtcgacgtgggaaacctcaaggccaagattaggactccacttctgctgtgtgcaggaactcaagtctccaccgccatggagatgatccagaccctgtccggggaagccgcttcactcacaaacaaggccaaagcctatagccattatcaagattgtttctcagacagtcagtctcacatgcactctgttaatgtcgaagaaataacccagattgtactgagtgagattagtgacatcgagggggatctgacattaaggaaaaagctctgggaagctcaggaggaatggaagcgcgcgtcctgggagtggagaaactctagtctgcagtctattgacgtggagtccgtgcaaagaaacgtgtccaagctcatgcacattataagcgtacttgaaaaggagatctactccatttttataatccccagtattgacgatatttcagcccaactcgaagaaagccaggtgattctcgctacaataaaggggagcccccatataggtcctattaagagccagattatgttttataacgactgcgtcaagagctttgtatcctcgtacagccgagagaagctcgagaaagtgcacgctggcttgatgtgtcatctagaagaagtggcagatctcgtggtgctggatacaagcaatagccgcaccaaggccattctcggggcacttctgattctgtatgtgcactgcagggacattgtgatcaatttattgctaaagaacatctttaacgcggaagacttcgaatggacccgacaccttcagtataagtggaacgagaagcagaaactgtgttacgtgagccaaggtaacgcatcgttcacctatgggtacgaatatctcggctgtaccagtcgactggtgatcacccctcttacggacaggtgttggcttaccctaatggaggcactccacctgaatctcggcggctgcccagcaggaccggccgggaccggcaagactgagacagtgaaagacctggccaagtgtgccctgttcgcctttaagtgcaacacggctctgattaaacttcctaatagcctcattgtgttgacttgtttcggactcgagaaaacggtcctcgtgatgaatacagtgatgagctttcggttcgtgttggagggcaaggagatccgtattaatatgtcctgcgccgtctttattaccatgaatcctaggtatggcggaggggtggaactgcctgataatcttaaaagcctgtttagacctgtggccatgatggtgccacactaccagatgatagccgaaataatcctgttttccttcggtttcaagagtgccaattctttatcagggaagttaaccaacctatacgagttggcacgaaaacagctgtctcagcaagaccattacaactttgggttaagaagcctgaagattgttcttattatggccggtactaaaaaacgtgaatttaagtgtgacacctctgattccttgagtgaagcagacgagacattgattgtgatcgaagccatccgagaagcgtctcttcccaaatgtccacccgaagatgtgcctttgttcgagaacattatcggagacatctttccagaggtgaccgtgctgaaagtaaaccagttggccctcgagaaggtcatatatactgctactcagcaattggggttgcaaaactggtctagtcagaaagaaaagataatccaattttataaccagctccaggtgtgtgtgggcgtgatgctggtggggcccacaggaggtggcaagactaccgttcgccgcatactcgagaaagcacttacactcctgcccatagctgattttctctccgtggcagagcggaaatctgcctctaagatctccgagcgcaagggcaaggttgacatctgtgtgctgaatccgaaatgcgtcacactgagtgagctgtatggccagctagaccccaacactatggaatggacagacggcctcttgagcgcaacaatcagatcctacgtttacttcaacacacctaaaaatactaagaaggatatagatctgcgcctcaaatcgcgcatcagcgatctgagcaacgtcttcaagcttgacagctcagatacaacagagactgacgataatatcttcgaagagatcgaaaaggtcgtaaaaatccccgagaaccacaattttgactggcagtggattattctggacggccccgtggatacattctgggttgagaatctgaactctgtgctcgacgatacgagaaccttatgtctggccaattcagagaggattgccttgactaataagatcagggtgatcttcgaagtagataacctttctcaagcctcccccgccacggtgtcacgctgcgccatggtgtacatggacccagtagatctggggtgggagccatatgtgaagagctggctgctcaagacctctaaaattatatctcagtcaggggtcgactgcctcgagtttatgattaaaaactccgtgacagatggcctgcaattcattcggaacaggcagaagttccagccatatcctatggaggatatcacagtagtcatcaccctctgtcgcatcctggatgcttttttcgatttcatgggcaaaaacggtggtttcgagcagtcggacgatctgaatgatacctcgtccaaggaggctaacagccagagagaatctgttacttttaaagacattgaaaaacgggatgaaaatacatggtatcccgagaaaaacccagacaagctgacaaagatcatccagaagttgtttgtgttcgcgttcacttgggctttcgggggggcactgaaccgagaagacgagcaccgggaaaacattccgttttgcccttctttggaacccgactctctggcaaaggttacgtatgactttgacaaattggtccatgaattatttggcaactcctcccaagtgggcattaacctgcctaccggtgagtgttctatattcggctacttcgttgacattgagcagtgtgagtttataccttggtctgatttagtgcctaacgaccagacgctgattcagcgtgacaatccgacgaaaaaaccagaagtacgcacgaacaagaagctattgaaaaataatgaccacaaaggggtggtagtcagtacaattaacttcagtaccaatgtgaccgccgctaagacaaaagaaatgattctaaagaaactcatccggcgtaccaaagacacgctgggtgcacctaagaacaaccggatccttatctttatcgatgacatgaatatgcccgtctcagatatgtatggtgcacagccccccttggagctgatacgtcagttactcgacctgggcggcgtctatgatacagagaagaacacatggaagaatatccaggacttatcaatcgtggccgcctgcgtgccagtcgtgaatgacatctctccgcgactcctgaagcatttcagtatgctcgttctccctcacccctctcaggatatactgtgtaccatttttcagatcgggatcgatggttgcggaaaaaaaacttgcgctaccttggcttgctacctcactgacaacaagttatatagggtgccaataagccataaatgcgcttatatagagtttaaagaggtgttcaagaaggtctttatacacgctggtctaaaaggtaaacccacggttctgatggttcccaacctgaacatcgaacaggactcattcttggaggatctgaactacattatttcctctggtaggatcccagacctctttgagaacgtcgaactggatagcatagcaatgaaaatccggtacttaaccgagcaaagtggacatatggacaataggcaaagcctcctatcgttttttcagaagaggatctacaagaacttgcatatatttgtcatcatgtcgcctgagggacctagctttcgacaaaattgccgcgtttacccttctatgatttccagctgtactattgactggtacgagagatggccagaggaagctctcctgattgtggctaactctttcctcaaagagaaagtaaactttgaaaaccgagagaatctcaaagaaaaacttgcgcccacctgtgtgcagatccacaaaagcatgaaggacctgaaccgcaagtactttgaagagactggacgcttttattacactactccaaactcttatctccagttcatggaaacattcgcccatatcctgagagccagggaagaggagatgcaaactaaacgcgatagattccacatggggttgtctactattctggaggctaccacattggttacagaaatgcaggaggagctactgatactggggccgcaggtcgaacagaagacaaaggagaccgaaacattgatggagaagctgaggaaagattcgcaagtggtcgaaaaggtgcagatgcttgtcaagcaggatgaagagattgtggccgaggaggtgagaattgtagaggattacgcccagaaaacagctaatgagttaaaaagcgtccttcccgctttcgataaggccatcgtggccctgaatgctctggataaagccgatgtggcagaactgagagtttatacaagaccccccttcctggtgctaaccgtgatgaacgccgtgtgtattttgctgcaaaagaagcccaactgggccactgcgaagctgctgctaagcgagacaggcttcttgaaaaaactgatcaacctggacaaagacagcatccccgacaaagtgttcgtgaagctgaaaaaaatagtgacccttccagactttaatccacataaaattagccttgtcagcgtcgcatgttgtagtctatgtcagtgggtgattgctctgaacaactaccatgaggttcagaaggtcgtggggcctaagcagattcaggtggccgaggcacaaaacgttcttaagattgcacgccagagattggctgagaagcagcgcggactgcaattaataagcaggtggcacaatcagggcttaccacacggccagtactctgtggaaaatgctatcttaatcaaaaacgggcaacaatggcctctcctgatcgatcctcataggcaggcccataagtggattaggcaaatggaggggtccaggctacagaagctctcaattgaggattctaactatacgaaaaagatcgagaacgcgatgaaaacaggaggctctgtgctgctccagagctgtcaagcctctacctggcggaaaaaattgtacctttccaccgagatcgacaatccgcacttcctgcctagtgtgtacaacttcgttaccatgatcaactttacagttacctttcaggggctccaggatcagctgcttagcaccgtcgttacacacgaagtccctcacttggaggaccaacgctccaagcttcttgagagcattagtttagacgctatcactttggaggagctggaggagaagacactcaatctgctgcagaaagccctgggaagcatcttagatgatgataaaattgtcgatacactgcgaaagagtaagatgacatccaatgagattagtaaaaggatcgaggcaaccaaaaaggcagaaagcgagatccaggctatcagaaagaattatctccccattgcaacacgcggagccctcctgtactttctcgtggcagatctgacccagatcaattacatgtaccagtttagtctcgattggttccaccaggtgttcgtttccagcgttgtgagtaaatcaaaagaacaagaacatagcttcaagcgtgagaaggtttcaccaaaagaggtgcatgaattcatttccattagcaaggagcccaacttagagaatgagaagaatctgctggacaaacatatcaagtcagctatcgacatgctcacgaagtccattttcaaggttgtctcctctgcactgtttaacgaggataagctctgcttctcctttcggctatgtaccgttattatgcagaacaacgccaatggaaacttaatccaggatgacatcggcttcctgcctgaggaggaatggaacattttcctttactctggcattctaattaatattaaatctgccctttctcagtctcgtctaacctcaacattcgaaattggtgaatcccagcacttgcagtggctctcagacagcagatggaggcagtgccagtacgtctctacgcacctggagcctttttcactgctctgcaagtcacttctatcaaacgtttcccagtgggatactttcaagaacagtaaagcggtttactctcttatttcgacacctttcagcagtgagaacgctagtctggaggagaacaccaagccaccagaggaaaaacatacattttgtctcctgctccgcgctattaaccacacaggaactgatctgggcccagtgggcagggggcaatggttgacatccaccgcatgtgaccgccatacggacgtttgctctttttcgttcgcgcttaatgacggagtgcccgatgtagagcatgtccaggacatattctatggccactgcgtagataaataccacgtcaaggttcttcggccagaaagcttaaacaactccgttcgtaagttcattaccgagaaaatgggcaacaaatacttgcaaagaactggtgttaaccttaaggatgcgtacaaaggtagcaacgctcgcacacccctcattctgattcagacgcacggctctgctagcattaaggactacatccacatcatccagagcctgcctgacgacgacctgccagaagtattggggattcatcctgaggcgattcgcagctgctgggaaacccagggtgagaaatttatcgagaaccttatcgccatgcagcctaaaactacaaccgccaatctgatgatcagaccagagcaaagcaaagatgaattggttatggagattctctccgatctgctgaaacgcctgccgctgacagtggagaaggaggaaatcgcagtgggaacccctagtactctcaaaagtatgatgtcttcctccatttgggagtctctgtctaaaaatctgaaagaccacgacccccttatccactgtgtgcttttaacgtttctgaagcaggaaatcaagcgattcgacaagctgctgtttgttatccataagtccctgaaggatctgcagctggccattaagggcgagatcattctgactcaggagctcgaggaaattttcaattcctttctaaatatgcgtgttcccaccttgtggcaaaagcatgcgtaccgctcctgtaaacccctctcatcttggatcgatgatttgatccagcgtctcaacttttttaacacatgggccaaagtggcctacacagccatccagaggcggtatatgcgcttcgtcaccgtgtggaagcaatccatcccctctaccagccagaagtgcaaacatcctgaggattcagagaacaacttcttcgagggctttccaagtcggtattggcttcctgctttcttttttcctcaagcgttcctggctgccgtgctccaggactatggtcgctctaggggcatagcagtagatgccctgactttcacacatcacgtgatctctaacaccacggacaaggacgagaagtttagtgtgtttatgcccaagaaactgaacatcgtccggcgggcttttaaaggatctgcctcttctcacactggcgtctacatctttggactgtttattgaaggtgcaaggtggaatcgcgagcagaaaattttggaggacagcctcccactggaaatgtgttgtgatttccctgacatctactttctgcccaccaagatcagtacaaagacacccaacgccagtaaccagacagattccgagctgtatgcttttgagtgtccagtctatcagaccccagagcgatctagaatcctggccacaactggacttcccaccaacttcttaacctcggtctacctgtccacaaagaagccgccatcccattggataaccatgcgggtggccctgctctgcgaaaagaatgaaaaatag

SEQ ID NO: 186034 - DNA, 2619 bp, Artificial Sequence
  Description of Artificial Sequence: Synthetic coding sequence
atgagcagcaaggccgagaagaagcagcggctgagcggccggggcagctcccaggccagttggtccgggagagcgacccgcgccgccgtcgcaacacaagagcaggggaacgcccccgccgtcagtgaacccgaactgcaggccgaacttccaaaagaagaacctgaaccccgactggagggaccccaggctcagtcagaggaaagcgttgaaccagaagcggacgttaaaccacttttcctgagcagagccgctctcactggactggctgatgcagtgtggacccaagaacacgatgccattttggagcattttgcccaggacccaacggagagtattctgacaatatttatcgatccctgctttgggctgaagttagagttgggaatgcctgtacaaacacagaatcagctcgtttacttcatccgccaggctcccgtgcccatcacctgggagaattttgaagccaccgtgcaatttggcaccgtgaggggcccctacattcccgccttattgcggctgctcggcggagtgtttgccccacagatcttcgccaatacggggtggccagaatctatccggaaccactttgccagccacctccataagttcctggcatgcttgactgacactcgctacaagctcgaaggtcatactgttctgtatatccccgcggaggctatgaatatgaaacctgaaatggtgatcaaagacaaggaattggttcagagactagaaacaagcatgatacattggacgcggcagatcaaggaaatgcttagcgcccaggagacagttgagaccggagaaaacttaggccctttggaagaaattgagttctggcggaacagatgcatggatttaagcggaatcagcaaacagctggttaagaagggggtgaagcatgtagaatctatccttcatctggcaaagtccagttatcttgctcctttcatgaaacttgcccagcagattcaagatggttcccgacaggcccagagcaatttaacgttcctgtctatactaaaagagccctaccaggaacttgctttcatgaaacccaaggatatttctagcaagctgcccaagctgatatcactcattcggatcatatgggttaattctccgcattacaatacgcgcgaacggcttaccagcctctttcgcaaaatgagcaatgagattatccgcctctgttgtcacgccatctcgctggatcggattttcgagggttacgtgagtagttccaaggaggacctacaggggtgcatcctgtgctgccatgcatggaaagatcattatgtccaggccgtgcaaatgcacattcaatttagttcacgtggctgggtactggatcagacaagcatctttgcccaggttgacgcatttgtacagcggtgcaaagatctgatcgaggtgtgtgattgccagtatcacttcgctcgttgggaagatgggaagcagggcccactgccatgcttcttcggcgcgcaaggacctcagatcacacgtaatttgctggaaattgaagacattttccacaaaaatctgcatacactgcgcgctgtgcgaggcggcatactggacgtcaaaaacacttgctggcatgaggactataacaagttcagggctggtattaaggacctagaagttatgactcaaaatctgatcacaagtgctttcgagctcgtaagagacgtccctcacggagtgcttctgctggacacttttcatcgtttggcctcccgggaagcaatcaagaggacgtacgacaaaaaggccgtggacttgtacatgctcttcaactccgagctggcgctggtcaaccgcgagaggaacaaaaagtggcccgacctggaaccttatgttgctcagtacagtggtaaagcgagatgggtgcatatcctccgaagacggatcgatcgggtgatgacctgtctcgctggggcgcacttcttgccacggataggtaccggtaaagaaagtgtgcacacataccagcagatggtccaggccatcgatgagctggtgaggaagacatttcaggagtggacaagcagtcttgacaaggactgcattcggagattagatacgccattactgcgcatctcccaggagaaagcaggcatgcttgacgttaacttcgacaagtatcggagccacctggccccttttccatacaccccactgttacaactatcccaggagttccactcacatctgttgactcccctcttcattatcctctcactatcccacacgatctgcctcctatcttctttttacttttttttctcatccttcatttttgtttctccgcatctccccccgtgctatcagcactttaacttcacaacatacttgaagacccaacaaaacaaaaccatgattggccaagcacgctggctgacacctgtgattcccgccctttgggaggcagaggtgggcgcatcactagagccaagatctctccgcacggcgtgggctacgtggcagaatcccgtcagtgcaaaaaacaccaagatttcctgggcttggtggcataaacccgttgtgtcggccacctgggaaggagaggtgggtggatccccagaacccgggcgccagcggttgcagtag

SEQ ID NO: 186035 - DNA, 12591 bp, Artificial Sequence
  Description of Artificial Sequence: Synthetic coding sequence
atgagcagcaaggccgagaagaagcagcggctgagcggccggggcagctctcaggcctcttggtcggggagggcaaccagagccgcagtcgccacacaagaacagggcaacgcccccgctgtgtctgaacctgagcttcaggccgaactccctaaggaagaacccgagcctcgtttagaggggccacaagctcagagcgaagaatcggtcgagccggaggctgacgtcaaacccctcttcctttcccgggccgccttaaccggactggccgatgctgtgtggacacaggagcatgacgccattcttgagcacttcgctcaagacccgaccgagtctattttgacgattttcattgatccatgcttcgggctcaagctggaactaggaatgcccgtccagactcaaaaccagctggtgtattttataagacaggcccctgtgcccatcacctgggagaatttcgaggctactgtccaatttgggaccgtgcgcggcccatatattcctgctttattacggctgcttggcggcgtcttcgccccacaaattttcgccaataccggttggcctgaaagtatccggaaccacttcgcaagccatctccacaagtttctcgcttgtctgaccgataccagatacaagctggaaggccacaccgtgctttatatccccgccgaggcaatgaatatgaaacctgaaatggtgatcaaagataaggagcttgtgcaaaggctggagacttcgatgatccactggacaagacaaatcaaggagatgttgtccgcacaggagacagtcgagaccggagaaaacctgggacctctcgaagaaatcgaattttggcgcaataggtgtatggacctctctgggatctctaagcagttagttaagaagggcgtgaagcatgtcgagtccatattgcatttggctaaatcttcctatttggctccattcatgaagctggcccaacaaatccaggacggcagccgtcaggcccaatctaatctgacctttctgagcatactgaaggaaccatatcaagagctggctttcatgaagcccaaggatatctccagcaaactccctaaattaatttcacttatcagaattatttgggtcaactcgccgcattataatacacgcgagcggctgacctctcttttccggaaggtctgcgattgtcagtaccactttgccaggtgggaggacgggaagcaagggccgctgccctgtttttttggtgcccagggaccacagatcacacgcaacttgctcgagatcgaggacatctttcataaaaacttgcacaccttgagagccgtgcgcggtggcattctggatgtcaagaatacatgttggcacgaggattataataaatttagagccggcatcaaggacctggaggtgatgactcagaacctgatcacatctgccttcgagctcgtgcgcgacgttccccacggtgtcctattacttgatacttttcacagactggcatccagggaggctattaagcgtacgtatgacaaaaaagccgtggacctctacatgctgtttaactccgaactggcccttgtaaacagagagaggaacaagaagtggcctgatctggaaccatatgttgcccagtattccggcaaggcacgatgggtccacattctacgaaggcgaattgatcgggtcatgacttgcttggccggggcacactttttacctcggattggaaccggcaaagagtccgtccacacttatcaacaaatggttcaagcgatcgatgaattggtccggaaaacgtttcaagagtggaccagtagtttagacaaggattgtattcgacgcctcgacactcctttactgcggattagccaggaaaaggccgggatgctggacgtgaacttcgacaaatcattgcttatcttgttcgccgagattgattattgggagcgactgctgttcgagaccccacattacgttgtcaatgtggctgaaagggctgaagacctgcggatcctgagggaaaatcttttgctggtagctcgcgactacaatcggattatcgccatgttatctcccgacgagcaggctctgttcaaggagcggattcggcttctcgataaaaagattcacccgggtctcaaaaaactgcactgggcccttaaaggcgcttcggcgtttttcatcacagagtgccgaatacatgcaagcaaggttcagatgatagtcaacgaatttaaggcctctaccctgacgattgggtggcgggctcaggaaatgagcgagaaacttttggtaagaatcagcggcaagagggtgtaccgtgacctagaattcgaggaggatcaaagggaacatcgtgccgccgtgcaacagaagctgatgaatctgcaccaagacgtggttaccattatgaccaacagctacgaagtgtttaaaaatgatggcccagagattcagcagcagtggatgctgtacatgatcagacttgaccggatgatggaagatgccctccgcctaaacgtaaaatggtccttactggagctttccaaggcgataaatggggacggtaagacatcccctaatcccttgttccaagtcttagtaattctcaaaaacgatctccagggttccgtcgcccaagttgagttttcccctacattacagacgctcgccggcgtcgtgaatgacatagggaatcacctattctctacaatctctgttttttgccatcttcccgatatactcactaaacgcaagcttcatcgtgagccaatccagaccgtggttgaacaggacgaagatattaaaaagattcaaacccagatatcctctggaatgactaacaatgcctccctcctacagaattatctgaagacatgggacatgtacagagaaatctgggagatcaacaaggactcatttattcacagatatcagcggttgaacccacccgttagcagcttcgtggcagatatagcaaggtatacagaggtggcaaataacgtgcaaaaggaggagacagtcaccaatattcagtttgtccttctcgactgcagccatctcaagttttccttagtgcaacattgcaacgagtggcagaataagttcgctactctgctgcgcgagatggcggccggaagactcctggaattgcatacttacctgaaggaaaacgctgagaagatctccaggcctccacaaacactggaagagttaggcgtgtctcttcagctcgtggacgccctgaagcatgacttggccaacgtggagactcagataccccctatccacgagcagttcgcgatcctggaaaagtatgaagtaccagtggaggactcggtgctggagatgcttgacagcctcaacggggagtgggttgtctttcagcaaactctgcttgactctaagcagatgttgaaaaagcataaggagaagttcaagacggggttgatacactctgcagatgattttaagaagaaagcccataccctcttggaggactttgaattcaaaggccatttcacatcaaacgtgggctacatgagcgcgcttgatcaaatcactcaggtgagggccatgttaatggccatgcgagaggaagagaacagcctgcgggctaatctgggtattttcaaaatagagcagcctcctagcaaagacctgcagaatctagagaaagaactcgatgctctgcagcagatatgggagattgcaagagactgggaggagaattggaacgagtggaaaactggacgattcttgatactgcaaactgaaaccatggagactaccgcccacgggctgtttcgtcgtctgacaaaacttgctaaagaatataaagatcgcaattgggagataatcgagaccacaaggagcaagatcgagcagttcaagagaacaatgcctctcatctccgacctcaggaatccagctctgagagagcggcactgggatcaggtccgggacgaaattcagcgcgagttcgatcaggagtcagaatccttcacattggagcagattgtcgagctgggcatggaccagcacgtggaaaagatcggagaaattagcgcttcggctaccaaggagcttgcgatcgaggtcgcactgcaaaatatcgcgaaaacctgggacgttacacagctggacatcgtcccctacaaggacaagggtcaccaccgcttgcgagggactgaagaggtttttcaagcgctggaggacaaccaagttgctctgtctaccatgaaagcgtcccgatttgtaaaggcatttgaaaaagatgtggaccattgggaaagatgcctgtccctgatcctggaggtaatagagatgattttgaccgtgcagcgtcagtggatgtacctcgaaaatatctttctaggagaggacattaggaaacaactgccaaatgaatccacgctttttgatcaagtcaatagtaactggaaagcaatcatggaccgcatgaacaaagacaataatgctttacgctctacccatcatcctggccttctggacacactaatagagatgaacaccattctggaagatatacagaagagcttggatatgtatctcgagaccaagcgccacatattcccacggttctacttcctaagcaacgatgacttgctcgaaatactcgggcagagtcgcaaccctgaagccgttcaaccacatctgaaaaaatgttttgataacatcaagctcctgagaattcaaaaggtggggggccccagctctaaatgggaagccgttggtatgttctctggtgatggggaatacatcgacttcctgcactctgtgtttctggagggtccagttgagagttggcttggcgacgtggagcagacaatgcgggtcacccttagggacctgttgcgaaattgtcacttggccctgagaaaattcctgaacaagcgcgataaatgggtcaaggaatgggcaggtcaggtagtgatcacagcgtcacagatccagtggaccgcagacgtgactaagtgtctgctgacagccaaagaacgcgcagacaagaaaatcttgaaagttatgaagaaaaaccaggtctctatattaaacaagtattccgaggccatccgcggtaacctcacgaagatcatgcgcctgaaaattgtggccctcgttaccatcgaaatccacgcccgagatgtactggaaaagctgtataagagcggactaatggacgttaattccttcgactggttaagccaactgcggttttactgggagaaagacctggatgactgtgttatccggcaaactaatacccagttccagtacaactacgagtatctgggcaatagcggccggctcgttataacgcccctgaccgatcggtgctatatgaccctgactactgcattacatctgcaccgcggcggcagccctaagggcccagctggcaccggaaagacagagactgtcaaggaccttggcaaagcacttgggatttacgtgatcgtcgtcaactgctccgagggcctcgattacaagtccatgggtaggatgtactctgggctggcgcagacgggggcctgggggtgcttcgacgagtttaatcggattaacatcgaggttctgtctgtggtagcacaccagattctgtgcatcctctctgccttggctgcaggactcacccacttccacttcgacggcttcgagattaatctagtatggagctgcgggatattcattaccatgaatccgggctacgcaggacggaccgaattgcctgagaatttgaagtctatgttcagacccattgctatggtcgtccctgactcaaccctgatcgctgaaattatcctgtttggtgaaggctttgggaactgtaaaatccttgctaagaaggtttacaccctctactccctggccgtacagcagctgtcccgccaggatcattacgactttggtcttcgcgctttaacctcgctcttgaggtacgccgggaagaaacgtcgcttgcagccagacttgactgatgaggaagtcttgctcctgagcatgagggacatgaacatagctaagcttaccagtgtcgacgctccgttatttaacgctattgtgcaggacctcttccccaatatcgagctgcctgtgattgattatggcaaattgcgagagacagtggaacaagaaatccgagacatggggctacagtctacccctttcaccttgacgaaagtctttcagttgtatgagaccaagaacagccggcattccaccatgatagtgggctgtacaggctctggaaagaccgcatcctggaggattctgcaggcatccctcagtagcctgtgtcgggccggcgatcctaactttaacattgtgagagagttccctctaaacccgaaggcactgtcccttggggagctgtatggggagtatgacttgagcacaaacgagtggaccgacgggattctgtcctccgtcatgcgcaccgcatgcgcggacgaaaaacctgatgaaaagtggatattatttgacggccctgtagacacgctttggatcgaaaatatgaactcagtaatggatgacaacaaggttctgaccctaatcaacggagagcgtattgctatgcccgagcaggtaagcctgctcttcgaggtagaggatctggccatggcctcccctgcaaccgtgagcaggtgcggcatggtgtacaccgattatgccgacttggggtggaaaccctatgtccaatcatggctcgaaaaaaggccaaaggcggaggtggaaccgttgcaacgcatgtttgagaagctcatcaacaagatgctcgcattcaagaaagacaattgcaaggagctcgttccactgccagaatacagcggcatcacctcactgtgtaagttgtacagcgccctcgctactcccgagaacggggtgaacccggctgacggagaaaactatgtcactatggtcgagatgacctttgtcttttctatgatctggagtgtttgtgcctccgtggatgaggagggacggaagcggatcgactcttacttgcgggagatcgaaggctcatttcccaacaaggacacagtttacgagtacttcgtggatccgaagatccgcagctggacctctttcgaagacaaattacccaagtcttggcgctacccacctaatgccccattctataaaatcatggttccgaccgtggatacagtaagatacaactacttggtgtcttctctcgttgcgaatcaaaaccctattctgttggtgggacctgtcggcacaggaaaaacctctatcgctcagtcagtgctgcagagcctgccatcatcacaatggagcgtgctcgtggttaacatgtccgctcagaccacctcaaacaacgtgcaatctatcatagagagccgtgtcgagaagaggacaaaaggagtgtacgtgccgttcggggggaaaagcatgattaccttcatggatgatcttaacatgccagccaaagacatgtttggttcacagccccctctggagttaattcggctgtggattgactatggcttctggtacgatcgcacaaaacagacaattaaatacatccgggagatgtttctgatggcagcgatgggcccccccggcggcggacgcaccgtgatctcaccacggcttcgatccaggtttaatatcataaacatgaccttccctactaagtcccagataatccggattttcggcacgatgattaaccagaagcttcaggatttcgaggaggaggtcaaacccattggtaatgttgtgacagaggctaccctggatatgtataatacagtggtccagcgttttctaccaacgccaacaaaaatgcactatctgttcaatttgcgcgacatatctaaggtcttccaggggatgctgagagcaaacaaggacttccatgacacaaagagtagcatcacgaggctctggattcatgaatgctttcgtgtgttctccgatagactggtggatgcggcggacaccgaagcctttatgggcatcatatccgacaagcttggctccttttttgatttgacttttcaccacctgtgccccagcaagaggcctccaatttttggggatttcctcaaggaacctaaggtttatgaggatttaacagacctcaccgtgctaaagaccgtgatggagaccgccttgaacgagtataacctgtcaccaagtgtagtgcctatgcagctggtcctgttccgggaagcaattgagcacattacccgtatcgttcgcgttattggtcagccccggggcaacatgcttcttgtcgggattggtggatcaggccggcagtctcttgctaggctcgcttcctccatctgcgattataccacatttcagatagaagtcacaaaacactataggaaacaagaattccgggacgacatcaagcgactttatcgacaggctggggtcgagctgaagacgacctctttcatcttcgtggacacgcagatagctgacgagagctttttggaggacattaataacatcctgtccagtggagaagtgcctaacctctacaagccggacgaatttgaagaaattcaatctcatatcatagaccaggcgcgtgtggagcaggtgcccgagagcagcgattccctctttgcataccttatagagcgggtccagaacaacctgcatattgtgctgtgcctctcccctatgggagacccttttcgcaattggatccgtcagtatccggctttagtcaattgtacaactattaattggtttagcgagtggcctcaggaggctttactcgaagttgcagaaaaatgcctcataggagtggacttggggactcaggagaatatccacagaaaagtggcccagatctttgttactatgcattggagtgtcgcccagtattcacagaagatgctacttgagttacggaggcataattatgtcacacccactaagtacctagaactgttgtccggatacaaaaagctcctgggagagaagagacaggaattgctcgctcaagcgaacaagctcaggactggtctgttcaaaattgacgagactagggaaaaagttcaggtaatgtctctcgagctcgaggatgctaagaagaaagttgcagaattccagaagcagtgtgaagagtatctggtcatcattgtccagcagaagagggaagctgatgagcaacaaaaggctctcgaaagcctgaacaaaaaggacatcggcgagatcaaatcatatggacgtcccccagcccaggttgagatcgtcatgcaggccgtgatgatccttcgtggtaacgagcctacctgggcagaggccaagcgccaacttggtgagcagaacttcatcaagagtctcattaatttcgacaaggataacattagcgacaaggttcttaaaaagattggagcttactgcgcacaacccgacttccaacccgatatcatagggcgtgtctccctggcagctaagagcctgtgtatgtgggtccgggccatggagctgtacggtcgattataccgggttgtagagccaaaaaggatccgcatgaatgcagccctcgcccagctccgtgagaagcaggctgctcttgcggaagcacaggagaagctgcgggaggtggctgagaagctagaaatgctgaagaaacagtacgatgaaaagctggcacaaaaggaggaactgagaaaaaagtctgaagaaatggaactaaaactggagcgggcgggaatgctggtgtccggattggccggggaaaaggcccggtgggaagagactgtgcaaggcctcgaagaagaccttggctatctggttggcgattgcctgctggcagccgccttcctgtcatacatgggcccattcctgaccaattatagggatgaaatcgtaaaccagatctggattggaaagatctgggaactgcaggtcccttgctctcctagcttcgctattgacaatttcctgtgtaatcccactaaagtccgggattggaatattcagggactaccttctgacgcgttctctacagaaaacgggataattgttacacgggggaaccggtgggcccttatgattgatccacaggcccaggcccttaagtggataaagaacatggaaggaggccaggggctgaagataatcgatcttcagatgagcgattatctgagaattttggaacatgctattcatttcggctaccctgtgcttttgcagaacgtgcaggagtaccttgatcctactctgaaccccatgctgaataagtcggtcgcccggattggaggacggcttttgatgcggataggcgataaggaagtggagtataacaccaacttccggttctacattacgaccaaactgtccaacccccattattcccccgaaactagcgcaaaaacaactatcgtgaacttcgcagtgaaagagcagggactggaagcacagctcctagggatcgtggtgcgaaaagagagacccgaacttgaggagcaaaaggatagcctcgtgataaatatagcagccggtaagagaaagcttaaggaattagaggatgagatcctgcgactgcttaatgaggccacgggctcgctcctggatgatgttcagctagtgaatacattgcacacctccaagatcaccgccacagaggtgactgagcagctggaaacttctgaaaccaccgagatcaacactgaccttgcacgggaggcatacaggccttgcgcccaacgcgcaagcattcttttttttgttttaaatgacatggggtgcatcgatcctatgtaccagttttctctggacgcgtacatcagcctgttcattctcagcattgacaaaagccaccggtcaaacaagcttgaggatcggattgactacctaaacgattaccacacttatgccgtgtatcgctacacatgccgtacactgttcgagcgccacaagctcctgttctcatttcacatgtgtgcaaagattcttgagaccagcgggaagctcaacatggatgaatacaattttttccttcggggcggtgtggtgctcgatcgcgaggggcagatggataatccgtgtagcagctggctagccgacgcttattgggataacattacagagctggacaagctcaccaacttccacggtctcatgaacagcttcgagcagtacccacgggattggcatctttggtacacaaatgccgcaccagagaaagctatgctgccaggtgaatgggaaaatgcctgcaatgagatgcagagaatgctgatcgtacgttctttacggcaggaccgagtggccttctgtgtgacttctttcatcataacaaatttgggctcccgctttatcgaaccacctgtgctcaacatgaagtctgtgctggaggactctaccccgaggtccccattggtgtttatactgagcccaggggtagacccaacatctgctctgctgcagctcgctgagcatatgggaatggcccagcgctttcacgcactcagcctaggccaggggcaagcacccatagctgcaaggctgcttcgcgagggcgtcacccaaggccattgggtgttcttggcaaactgtcacctcagtctgagctggatgcccaacctcgataaactcgtggaacagctgcaggtggaggaccctcacccctcgtttcgcctctggctcagttccatccctcaccctgatttcccaatctcaatcctccaggtctccatcaagatgactactgagccccccaagggattgaaagcgaacatgaccaggttatatcagctgatgagcgagccacagttttcacggtgctcaaagcctgccaaatataagaaactcctgttctctctgtgtttttttcactccgttctgctggaacggaaaaaatttctgcagctaggatggaacatcatctacggattcaacgatagtgacttcgaggtttcagagaatctgctgagtctatatttagacgagtacgaggaaactccatgggatgctttgaagtacctgatagcgggaatcaactacgggggccatgtgactgatgactgggatagacgactgctgacaacctacattaacgattatttttgcgatcaaagcctctcaacgccattccacagactctcagccctggagacatacttcatccccaaggacggctctttagcttcttataaagaatatatctcactgctgcccggaatggacccccccgaagcctttggtcagcaccctaatgcggatgttgccagccagattaccgaagcacagactttatttgatacattgctgtcattgcagccacagattaccccaactagagcagggggtcaaacccgggaggagaaagtgctggagctggctgccgacgtgaaacagaagattcctgagatgatcgattacgaaggtacccagaaactgctggctctggacccctcacccctgaatgtagttctgctccaggagattcagcgctacaacaccttgatgcagacaattcttttctcccttaccgatctcgagatcccaagttgtgtctcccataaaagcgagcgcgtagtcttagagctttccgcagtgaagcatcccagacagtag
